United States Patent 9,328,346 (POLYCOMB-ASSOCIATED NON-CODING RNAS) - sequence listing, part 98

SEQ ID NO: 18409 - RNA, 29954 nt, Homo sapiens
cguccgggaugcugcugccgcuacugcggaguagcugcuucccuuccuccucucccggcggcggcggcggcagcggcggaggaggaggaggaggggacccgggcgcagagagccggccggcggcgcaguugcagcgcggagcccacgggccgccggggccgcuccagcgggcggaagccgagcccggggccgaccccccgcgcgcggcggaggccgagggggcgccggggcccggggcgcgcagccggggggcgggcggcggcgggcggcgggccgagcgggagccgcaugcguguauggauccgggcgccgcgcugcagaggcgggccgggggcggcggcggucugggcgcgggcuccccggcgcugucgggcggccagggccgccggaggaagcagccccccaggccggccgacuucaaguugcaggucaucauuaucggcucccgcggcgugggcaagaccagccugauggagcgcuucaccgacgacaccuucugcgaggccugcaaguccaccguggguaagggcgccacggcgacccugggccgggccuccuggcgcccgggcaggugcccuucgccccgugggcuucgagucucaucgagccugggagucuuucggggaugggccucucggugaaacuaggggcgggggucuccuuggagcgcccugcaucccaaucccaaagccuggcagagguuuucgugccgccuccgggcagaccugcccuuggcccccggcccugccucagagguccuggcagcccccggggccugugggggcggcucuccacggaaacuucggcccuuagcauacucgcccaagaaaaagcuggguucgaguggagcgcaggcaggcaggggagugaacgccuaaggccgcucucgcccggcccgccaaggccagcgcgcgccgucugcugcgggugugaucccugcgcaaccagggcaguuuucuuauuuugaacccauuuucaagaaaugaaguuuaaagucaccuauggagaauguuaaaacuaaaacuacaguaaguuucucgugcuagccguacguacggggcagaggagcuucagcuguauuuauccaugaccucaaacaacccggugacuggcgggcaugggguugauuccuccaguaccgcuguuuucggugagggacaggagugaaguaaguacaggaacgcuccagggucaaggaggaaaacagccguggaucugaaauggaaacugcaggggaaauuuuuuuaauuaagucaugcuuagaggacuugacauugagauuucucaguuggauguggguagcaguuguuucuauggaaaaccccuuaaaagauguccaaacuaggagaaccccguucuuuaaaauaaagggcagucacuuccgugauaggaagugagagauuuccccaggggcgguccaagaaacugaguagucaggagauuugauagaauuaaaagcauaauuucauguaauucuauuuauuaauaguguuauaaccagugguaguuccaaggcugucaguacgauuuugagaugacuugauuugaaauugucauguaacaaaacaguacuacauuuaaagugucuuauuggaaagugaaaccuccaauuuuuguacugucuuucuugguuuguuuucaagaacuuacuucccuuaaugcuuuuuuggaauagaucauuuuggaaauauuugugaugucuguaccauauguuuuuaaaauguugucguuggagacauuauauuaaaaugaguagcauaacuauaccuguuucaaauauccagucuuggaucaugcagaguacagggaguuguuaaaccaucaaaugaggguuaggcuguuauuuuaguaccugacauaaauaaaguaggguuaaauuccguuuagaauugucaauauuuuauggcuccguacuucaguauauaaaaaugagagauaauagaguugcacugugugaugaagagaaaucagguacccauagguggguaacugagggcuugaguggauggagggugagauggaugagcaaaggugugcuuuagaaugcagaagaggagagaggaagaaggauuuucuaagccuggcagcaguggagcagccccccaccucuggggaggguuccuuaggggacuugggaauggaugcugcgagaccuugaccgccaugcuaaggagaauggacccgauccuaugggcaccuggaaccaaaagacuccuuaguaaggcauuggcacgaaaacaguuuggcagaguugcauaggauguuugggaauaaggaagagcugcggaggaugcuugggaauaaggaagaaaccaggaggcaaggagaccaagcaguuuguuucugugucccuuaacaaacaugcacuuacccgagcacauacucccuacucugagugugguugaauuucugucuugcucauuuuuguuugcuucacauguagccuauaauacuuagaguacuggaguacuuuaguacucagugcgugcuucuaacugugggauguucagagaaugaucauggccccuggccugcugcagagcgggaagacacugugagaacgccagccagcuccacuucaguuucugcuucagaguugcuuuuccccuccacucaucagaucguuuguugagcaccuacuguguguuggguguuaugcuacccaguggggauucagugguaaacaggacaucgacucuguccagaaguggaucggagcuucugggagcugcgugaccgcuugucagggcagugacagauguguauggguauuugggagcacagugaaagcgccuccagucgaggcuagugaugaggccuggucagagaaggcuuccucgucauuggaauguuugaagauaaguuuguuccucuaguuccuuuagaaaaaugcaaauuaaauaugguacugggugugguguagaauugugguugccuuaccugaacgcuuaccauuugagcaguuagcucccgggguucuucccaggcugguuuuucuaguuucaucuucauguagugcagugaauuccauauagagcaagagucucuuccacaguaggaguuucucccuacccugucagggcugcucgcgacagccgucugggaaagaccgugagccucacagcauggcccagggaagagucccugagugugccuggaccaagaugggucacuagagugguaguauugucuaauuccuaggcuaggagaguguuuccauuaagagccuuuuuauuuuuauuuauuuauuuauuuuugagacagagucuugcucugucacccaggcuggagugcagugguacgaucauggcucacugcagccucgaccugccaggcucacacaaucuuccugccgcagccuccugaguagcugggacugcaggugcacaccaccaagcccuuuuuugauuuuuaguagagacaaagucuugcuauguuguccaggcuggucucaaacuccuagucucaagcacuuggccucccaaagugcucagauuacaggcguaagccacugcuccugaccaguaagugcccuuuuaaaguaaaugggauucacuugaacuuucuauaaaagauccguaguggaaguccuuagggauuugagaugaugaacuauuauguaaaauuauaaaugagcaaaauguuguuuuuuguauuguuaaucaaaucagaaacugguuuaaaagauuuacaaaauucacaaggguaugaaaaacagagguuguauuuacugauuggucuguuuaauggaaauugucuaauggaauugucucauauuuucaaaugggauuuuguuuucauggaauuuaauuagucugauuauaauuuacaaguucuuuuaaaaaguacaggagcagcuuuuuaaaguuugagaaacagaaaaaaguaauugacuaaagaaauuuacaacuaacaugccugguccacuauuuuccucauagcagugccuguaucacaagcauacuuauccaccaugaaucugugugugcuuuugcaaguugacauuauugcuuccugagugaagcuguagaaaccauuucuaucuagcaaugccgaauucuugaucuugguuccuucuguuugacucucauuaguuuuagcauaaacagguaaaugugcuuuuuuaaaaguauauuucaaaaaacaacuccauaaaauuacauaucugucaaucuuuguuuuauuucuauguuacuguuggaagcuagcuguuaauuuuguuuagguugaaaugguuuuaccuuuuaaaaaccuacccccgcccuugcuccaacagcauugcaugcuggaaaaaacacuagaguaagaauaagaaauguggguucuugcuccaggcucugccacuaacuaguuugugacuuuggauaaguaauguaguugucugugccuauaaauagaaguaguaguaguaguaguaguaguaguaguaguaguaguggucacugcuauauggugagcacuuacuacaccagcagaaggccucaucacagcccugaaaguuauccccguuuuacagaugaggacgagaagucucagagagguagaaauuuaccugcuguggcacagcugcucagcaaguggucagggccaagggcugcaagugaauucuuuuuaacuaucuuucugucuguuccuuagcuuacuuucagguuuagauugacuuugcuuuguugaaaauacuaauggcucacacacauaaaggucagacaugauggagcccuuuccucauuuuagaauuugguccuuguuacagcccugugaagauagugacauaauuauccuaugguauuagugaaacugauuuucuuuaagugugccccugucauuacuugucacuugccuuuugaauuaaaauaaugcuacaagaacugcuuuuuaaucuauauauuccaucauucaaauucaagugucuuaagccuuuuacauaccaaaauagguauauuugaauacaggagaagucaaagaaaggcaaucuggaccagaauucugauuuuucuggguaguaaaguuuccuucagaaugcugguggccagcauaggauugccaguucuuuauuuugccaaguaagaacauuaaaaaaaaaaaaagaaaaaaaaaagacuuaaaaaaauuaggaaagauaagauaccacaguuuaaaaguuuuuuauuuuauuuuuuauuuuuauuuuugagacgaagucucacccugucacccaggcuggagugcaguggugcgaucucugcucacugcaaaccuccgccucccagguucaagcaguucuccugccucagccucccaaguaacugggauuacaggcacucaccaccacgccuggcuaauuuuuguauuuuuaguagugacaggguuucaccauguuggccaggcuggucucgaaauccugaccuugugauccacccuccucagccucccaaagagcuaggauuacaggugugagccaucacccccagccaaaaguucuuuaaauuuaucuucauuuuucucauugugcggcagugcucuaaacuucacagccuggcccccuuaaaggauggcagcccuucggugaagcccuuuaacuccgcugcaggccgcaguccugugugcucucugccugacuccccucuagccuguguugacaugggggugcacucaggaugcccacugguggggccucggccugagacugcuuacgcuggggaaguaggguagugcgagugacuccguuucuuuggaccugcgguugagcuggcagcagaauggagggguccgagaaacgggugagugugaaucccuugcagaaaugcucucugggggucugcccuugaauguuaggcggcaugacaagucaaaugcaguccaccagggucuucaccuggaaauugacuacuuguacuuuauucuggaaacuuagggcagagauuuuuguuagaaaacccagaaugagcaucucauacuggacuuaaaugcuuaacuguguauuuuauuuugcuauacuguauuuguacacagucuucuaagccaugaccgaucugcccguguuucacuuaagagagaauuaaggaaaaucauccagaauucccacuccaaaagcccaagcucugcagcccugcagugugguuuugcuccaucuggagagaaccucacacagacuccccugccaaaaugauguaacaugaugacucagggaugugagcgugagaggaaccaacauuuaguucuuauacccacauaugcuguguguugugugauuagguuuauuuaaugaacuuaaugcaagcugagaggcuugacaaaacguccccuuuuguggacugaaguagcuaucuuucagagaaagcaugcagauuuaguugguguuagguuguuuauguugaauaaaaaucuauuuaaagaccuggcugaagugcauucagccuuucacugucugcacuuacaauaaaaaagaaagauuuuauuaugcaugacagagauccagauucuuagagauugccucuuucccucuggucuguggaaucugccagaagccaucuguuaauggaucuuggaacuggcuguagaaggcagaguagguuccuuugagaacugauagguccaaauuauucucuauccuugggugccagauacguuguuccaaauaagcauuaguuugaauuuguaaagaaaacagcuuuguacaguagucauucuacaaauaguuuuaagcagcauuuuguauuuauauaagacaccauccugcucgaccuuccccugggcacaaagcucacaccugguuuacccuuuucagagaggaggugagucacggagguagccauaauaaguguuagaaaagagugccuccugcuucagcugaggaagacauuuaucauccuccuuuuguccuuuaauucacgucuuugacauuuggaaaguauuuggaaagccaaaacuacagaccaaaaauugugcccuuaauugagugugauuguuaaaaaaaaaaaaaaaaaaaaacuugugaaacugggaagcacagcacaggcugaacagagcacuggauuccauagaaaauguuuucccuccaacucugacaaacuccacccuuugguuucuggugccuaguuaacaaaacaaccugcaauuccaacuccacgucagcacuugggcgaaggaauaggccccuauaaaugaggagcuuuguguuuuucgcuggcuuccucucaccucuucaagccaugugugugguaggaccucaacacacuugucgauuggcuaaagaaucacacaccugcagucaaauuuucacuuuuaauuuuuuacuuaaaaagaaaaaagagcagccugggcuacauggcgaaaccccaucuccacaaaaaaaaaaaaaaaugaaaaauuagccuggugugguggugcacaccuguggucccagcuacuugggaggcugaggcaggaggaucacuugagccagggagaucuaggcugcagugagcagugaugaugccacuguacuccagccugggugacagagugagaccuugucucaaaaaagaaaaaacacuccaccuucuccuuggccaccacugucuucccaagccauggcacuuguggaaagagauuuuggaggcaggcauacaguccugcauguaaguuucagcuccaggacaggcugccagcuguccuuaggcaagcagcuuaccucagugucuucacuuauaggaagaaaaacaaagugggauuuacacuuucuucacaucucacaguauaggcauaaaugaaguuaaaauaucuuacaugucuggcauagaaaagacaauuuuuaauucucuuuuccuaauuuauccuguagauccgaaaacucugaaacacuccauaaaaaaauccuuacccuuuaaugauacacacugauauauacagaugauauaaauuucaaaauguaaucacauguccuggguaaaacauaaucuguuugacagucccuguguuuucauggauccauucugaguaguagugaaguucaauuuuuuugcauaugaagaaaauguuaauaauccacuguuugaucaugguuuuuuuuuuuuuaaucucuucccuuuaaauauucuccuccucuuuugaccaggaacucaaauaacaugguagcauuucagauggggguuugucugaaggcaaggaguagagaaggccuccuggugcagggauggagucugucccagccaaccagccauccacccugucuuacuguuaauuuuauauacuugccuagcaaugcaaaguucuuuuucagccuuaaauauauguucuuagcucccuuccagccucugccuuuuguucaucagguggggcugcacagugcacagggaggagcacagccgggagccaggcaacccagguucaaaucugugcccucaugcucaccagcuugguuaccuuaggcagucuaccagcuucccugacuucuguuuuuucaucuauaaaauauagacaguaauauauaccucauaauauuguuaaugaauauacacugcaauaaguuaauguagauaaggcccuuagaauauuaucugaaauauagcaaacaccacaaaaguucuuaaucuuuucauuugugaagagaacauacaccuuucuguggaauucucauacguguguacacuuccaugagaggaacuguccacucacucugcugggcuccagccacgccucuccuuggaggcccaggaccuccaacugucccucuguccuccccucccugaugcaguccguggugucauuguuuguuccagucaagugcaaggcugucuccuugugcuucuguguacagggugggcuuuauuugcugggugggagcgugccaacccuggagugcaagcgaggacaggucuucuuguaccuggaugcaauuugacauccucaggccuggauaagcauuuuuuuaaugacgcauaguaacauuaggauuuuaauaguaccugcuucugaguugaucaaaauauuuuauaguuauaguacuuaguuucuauuuaaauccuuaccacacagguuagauaggaaaagccagauaauauuaaauaguaggaugucacaagacaggucuacuagcagugaguuugcauccccuuuuccucuuuuuuuuuuuucuuugagacagagccuugcucugucccccaggcuggaguacaguggcgcgauauuggcucacugcaagcuccgccucccggguucacgccguucuccugccucagccucccgagcagcugggaccacaggcacccaccaccaccacaccuggcuaauuuuuuguguuuuugguagagacgagguuucaccguguuagccagaauggucuugaucuccugaucucgugauccacccgccuuggccucccaaagugcugggauuacaggugugagccaccgugcucagccacauucucuuuuccuuauaugggacgagaauucauuuugaacucuuccccgguaggugguagaguuugggcagaagacuggccuuaugcccacaugacuugauuuuaaugcuagauuugccucucucuguaaccuuaacauguuccuuaauuuauuuucucacaacucacugaaaaugcuuacaauccaaucccuuaguagaauauuauauccaauuuaacauuauguaagauacauccuuggaagaacagccacuauauaaaacuuaaggucauuauuauaaauuggcagugacaacuacuguuuguauugagacuuacuuccaagucuauggaaauucuucaacuucuugaaaguauuaaguaaaaucuauggucugguccaaacuccagaucuuugguggaacgaggagaagugaccugggcauggaagaagagggcacaguccgcuuggccguaguccuagauguggaccacaguggugguuaggcuuuuuacuggaaaggaguguaaagaaagaaguuuccguguguuuuugccauuuucacuuuuguaacuucuuauggcccagcaaaaagaaacaguagugugcaaauguuucgcuuuaaggggaacauagaaaucuuacaagcacuaaguccagggauuccucccgcuguugcuagacaugugaaagacagccagcaagaaggcagagcgcagagucaggccuugucuuaacagcuuggcugugggagcuaugagccacuucagaacaucucacgcuuuucucucuuuucacccaucugacuuuuauuauaauaaccuuucauugugggcagugguguaaauuugagucuugguucugcugcuucucugucaugugguaugacuguaggcaaauuacccuguccucucucugcucaucauguugucuuccuuuauaaaauggggguaauaguuuccccgucacugggcugcugugaggcuuggauauguuggguauuagacauggaguauuugacagauguccacugucauuaguacuaaaggaaauuaaggucaagaauaagacaccggcacaguugcucaugccuauaaacccagcacuuggagaggcugagguaggaggaucgcuugaguuugagaccagccugggcaacauagugagaugcuaucucuacaaaaaccaaaaucaguuagugacaguggugugcuucuguagacucagguacucgggaggcugaggugggaggaucacccaggaguuggaggcugcagugagcuauauaggauccugccacugcacuccagccugggugacaaagccuucuuuuuuuuuucuucuucuuuuuuuuuuuuuuuuuuuuugcuucaaaaaaaaaaaaagacugacuuaaacagagcagucuaagaccuuugauaauacuguaucucuguagccugcgugcuuuuagaaagcauuguuaaaauacuuuuagaaagacuuccacaaaacugguaagccuaaagaaaagcaagcuccucucaccagacuaauucaccugguagaccaguucuguaucuaagggacugaauggagaaacuguuaccguaauccucugagauuaguguguguagggagaggcugugagcaaggaugucugccccauccugugaggaacuguaggagaaaugagagguuguguugcugcacacacucauauuuccccuguguccugggcaccccugcguucacugcuuccauuccacaccugcuacucagaugccuuuuuuuuuuuaacuaaucaguccugaauuucccuauuuuuucccaaaaauaauuugcauuucuucuuacauauacagcauuugauggagaagagggagcaguuuccagccaucaaauuuauugaguugcuguugugugccaggcaguguccuagacuuuagggggcugaagaugacuacauccucggagggcaggcacguagccugucggggaggccagcaaagaaggaacgaugugauaugggcuagaagagaguucagggccaagaacuggaacauagauaaagacaaggguaaaggugggugcagucagaagaggucagaugggaaaucuagggcuucagaggguucugggcagacaaggaguuucucuaagaagagagaacagcaaagacagaugcuuugccaagugcaugguguguuaauuuaggucaguaugacugagguuuucaaaggcagggacuguccccaucaacaguggugggggcucguugcuuccucccuuagucaagauaaccuguaggaaaccgguuuucaacaggguuguagacaguagugaagucgccacccucuuugucccuugguuguuuguaaacauuuccucuucuguaacaggaacucuguugacuuuuccuaaaucaucugccagauauuugagguuauucaugacuuuuuuccuuuuauugaggaucauuaucacuucuaugacaucccaguauuaaaaauagacaacauuaagggauauuuuugacuuuuaauauaagaaaguuuuuagaaauguuuagucauguacuuugauagagguauauguuucuaagccaaaaauuggauuaaguuuccagucauugcaggcuacuuaaugucuguuagaugugguauagguauaggauauuuuguuuaagagcgaggacuguuuuaaggaacugguuuuacucauggaaccguagaucuggccacuggguauuuuucuguuguguuguuaauugucauucaucuacucacuauaagauagucuucauuuuggcuaaacagauucuuuuuuucuuuuguuuuuuuccuuuccagcuuuuauuuuagggucaggggguacaugugcagguuuguuacaugggugaauugcgugucauggggguuugguguacagaugguuuugucacccaggcagugagcauaggaccugauagguaguuuuucaguccucuccuuccuccuacccaucacccucagguaggccccagugucuguucccuucuuuuugucugaguacucaaugcuaaaacagguucuuagcccuauuuacugucggguaaucuuugcuuuguuuuccuauuagaacuaauaauguguuuauaauuacauagugauaauguuaccacuuauuuccugauuuugaauauuaauguccuagccuuuuauuuuuauucauuaaauguugugauuacaaaauaguccuaguguaggacugcuggaguucgguaaguuguucaaguugguugggaaaggcagucugacauauucagacuccauuguuagcagagaaaacuguagucaaaacaaagauuaucugcucuagcuguuucagggacucuuagucaauuugaagcagagcucaaaagaaauaucaucugccaguuauuuucaauaaagucgcagccacugccacaagguuuacaaaaguuacagcuccuuuaauuacauuuuaaaaacuaacuuacuugaagaaauuggaaacaaaaguaaaauagaauauuggggaaccugccccguuagucacguagguucuuuucuauuuucccuaagcgucggccgguuugagaaauaaagggacagaguacaaaagagagaaauuuuaaagcugggcauccaggggagacgucacaugucgguagguuccgugaugccccacaagccacaaaaccagcaaguuuuuauuagggauuuucaaaaggggagggagugugugaacaggugugggucacagacaucaaauacuucacaagguaauagacuaucacaaggcaaguggaggcagggcaagaucacaggaccagggcgaaauuaaaauugcuaaugaaguuucaggcaccauugucauugauaacaucuuaucaggagacaggguuuugagagcaaccggucugacccaaauuuauuaggugggaauuuccucuuccuaauaagccugggagcacuacgggagacuggggucuauuccaccccuacagccuugaccauagaagacggccacgcccagggccccccgccaccccguagaccuacccccaggcgaguauucucuuucccagggauguuccuugcugagaaaaagaauucagcgauauuucucccauuugcuuuugaaagaggagaaauauggcucuguuccgcccggcucaccagcugucagaguuuaaggugaucucucuuguucccugaacauugcuguuauccuguucuuuuucaaggugcccagauuucauguuguuuaaacacacaugcucuacaauuugugcaguuaacacaauuaucacaugguccugaggcaacauacauccuccucggcuuacaagaugacaggauuaagagauuaaaguaaagacaggcauaggaaaucacaaggguauugauuggggaagugauaagugucgauggaaucuucacaauuuauguuuagagauugcaguaaagacaggcauaagaaauuauaaaaguauuaauuuggggaacuaauaaauguccaugaaaucuucacaauccacguucuucugccauggcuucagcuggucccuccguuuggggucccugacuucccgcaacaauagaauaguagucaucacagauuaugcauuugauuaguaaauuccaucacagaguagcauggcagcagugaaauccuaacucuacauuaauaugaagacaguguuuugucauuaaacugugcugcuuuaaaccagauagcaaauaucugcgcuauuuugugcgucuuguguagugucacuugaaauugcaguuuccuugcagcugaguguuaagccacugucuucaaguucuccaucaugcagaaccugcuuccugggucaaggcagugucugagcuuccuuugacuuuggaaagcaaaucauuuccagaacugaaagugaaauugaauuaaguagcuuuccuucagggacaucugaaauuauguguuaugugagagguuaagaauugacauggaguagugcucucuagcuuuguuuucuugugacauuuuauauucaugcaacuucucuccuagggcaggagggcugccucccuggccacacccugccccagggcuguaaacaugccuuuuguguggcauugguguccacaguguuacuaauuauaaaaaucggucacaugucuuccacuuccccucaagagccucaucugacugcagcaccucauuggugcccagagacgggcagucaggggcauggccagggccuugcccucugcagccaccauaccacucacaaacaugggcaccugcuggcccggggagcugggaucgucuacacccugggucccaaggaagcugucaggaagucguuccuguagggaaggugccucuaauucuaaauucagccagcaucccuuuuguuucccuuaguuaugaaaauuguguaauaaaauauuguugugaaauauuuacauuuuguauaacuggaaggcauauaagguagcauacacaaaugaaaacuugguuuuaaaaauauaucugaagcuuuacaggcuaaauugaaaaggaaauauacaugaugguuugcuuaguaauauuaaaaugaauaaaaauuaaaguuggguauguuaauuuguguaagaguaaauuuuaaaaucuucucacuguugaucauauaauguuauguuuauauuuaccuaaaauuuucaugaguacugaaauuuuuaguacaauaauuucuaaauucagacuaaggcuauuugacuaaaguugauuaaguuugauuaaguuuccaguguuccauauaagaauuuucccugagaaaacauccuuuuaaagccacuuauuuguugauguaguuauuaaauguaauuuuaaacugguuucuaugcugaacugugguaguuauaaguuguguuaugaacagcaaauacuagaccgaucacucaggauaagacauaacaugggcugaccuucccaguguggacugaagcgugagagaugggagguuauagacacuggugcagauacugcuuuuccuuggaauuaagugaugucagguuucgugggguuuucuuuuuuucugauaaugauaacaaaauacacaaauaggauuauuuuguaugacaaauugcaucuuuguuguuuuugcuucacauuuauuuguuuuauuuacagguguugacuucaaaaucaaaacuguagagcuaagaggaaagaaaauuagauuacagaucugguaagugggagagugugcacccaguaaugugcuguguguguuuaacaguccauguacuugucuaauaaaaugaacuguuugagcugauuugccucuccuacuuucuccucuuuugcucauuuuaaaauuaaauggacaguguuuccaucaagagagagaauuuagauaaggcuguuauguuauaugccacuugcacauggggagcaguuguggacagaagaauguuacuuuaaugguagcuaguuuggaaccuuuuugccucuauuuucaaauuauuuacgugauaucaaaacugucuccacuaaaaugauugcucaaauguuugucuucaugucuuuauuuuguaugauaguauucaaagaaagcccaauauguucauaaccagauuugcacaaucugaaggcagguccccugcagacaguuccagagcuucuugguggcacaaugugacuauuacugcgggugggcauacuccuuccggcuguacugcugauuccacgggaugugagcccccacuaaugccuacuagaaaugaauccaggccccuuucucaaaucacaauuggaaugagagacucaaccagcuguguuauaacugcacucagcacuaagagcuuucuguuagcuauuaaccuguuaacagcccgcaggugcuagcgaccugucuguggaagaagggauaagaucuggucugguggucuggcgguggcuuaaaaguagccccauugaggugcucugagaaugccguuuuguuuugaaugcuacagcugcgguguacucagcuuacuaacuccucuuggcaggucacccucagcucugauuguuuguccaccauguguguguuugcuuucaucugcguuaauugcugcuucaucuguggcaucaucggucaccuaaugcuugaauguuagugccaugucuucauucuucauccgugucccugucugggccgcagcugcagccaagccgcagugccugccuucuggaggugucugagguaauaucuucauuuggucacccuucacuguauaacacacuucuaagauuuuuugauuuggguuuuuguucguuuucuuuucuguugugcauuuggucugcauauuuucauuuuuggcuugauuaugaaacauuaggucuugucuaaauacuugaauaaacaacaaauagauauuucuuccugugcuagucccgcagacuuuuugugcauugcugcccagcuuuuaaacgcuggaaauggcaacaaaguguuuggcacacaagcugcuguuucuaauuauaagcucuauaagguaaagaccaucuucacaaggauuugggauaugccucucucuguuccuaguaccugugugagguacuuucugaugagaauauugccccacaaaagugauguaaacauuauuagaaugugugacgccugccuuggugacagccaugccugaugacuguggcacaugucuuaauuaaugcauuaauacuuccaucuucaucuuuggcggcaguauucuuuauaaaguauguccaaaugauuuauaaaguauguccaaauguccuggugccucccuggagcucugcccacuaagucuaugcuggugacauuguacacuccuggaaucugacuacaauguccuugacucugagauaagagggcccuaccugauggaaucccccucggggagaaagugagauacuguggcuccacgaagagcagcgggcacucagaaaccauuuuucucuuguauaugaaagcauucuccaaaugaccccucucccucuccugauucucccuugacucuuuacuacuuuuucauucucuaaaucugugcagcuguacagcaugggcaaagagcguaacuaagggaggaagaaugaaauggauuggacuuacggaaugguugauugcaaguuuucuacauggaauauuccagugacucuuuuccugcaggaagguuuugaacagugacucauauaucuacuacaggccagccauuuuguugaucacauaauacucaaaauaagauuuuuaucuucugaaauauuuuauuuaaaagaugaaaaccuuuuccuucauuauugcuaugcagcagguaaaaaggaaguguuagaaucaugauuguaauuuguauuacuguuuuaaaguaaugcguggcuucuuuaggagugaggcacagcccuugugcugcugcugguguaaccugcuuuguugugggcguguugucgucguuucacucucauccauugagggcauagaaggcgccuguguagcuggaaacggucccucaaggaggcgcaguggauugugcuaugcuaauaauagauagcucugcuccgauuuucuagacuggcaugaaagcauugccauucgguuuucauaggaggaucuuguuggaagaagugcauuauuuacuauagauuccuaaaagcuaaaaguaccaaaagcugcaggugucuguuacauuuuuacgucacguuuuaugucauugccacauauuucaguuuguugauuaccuguggucagaaaaaggaccauuuuucucuucucuguacuuuaaaguauuucuacaugaauguuagaacuuuauguaaguagcuaaaauaaaacauguugacuaggauguaguuugaugaauuuauauccaaaugguguccuagaaauuauuuacagugaacuuggaguuguguugaaauggacuugaagccgugaaauuugccucuuaccuuuaggcaaacacagaauugaaaugcuucauauaagggcccuuuguucugccugucggaccaguccacuguugggggacuuuguuuuaaccagcguucuuaggucagcaucauuccuuuuguucucugcuuggaagagggggaauauuucauacccuauauuggcgugugcccugaaaauuaguaauuaaauaauuuaaguggcuauauuaaauacagcaaauaagaggcuuugaauucuccaagcguuguuguaucaccaaacugggaaaacagaauugcaggaauuuuucaauugcacaaaaaccagauagaaaaaucagaauaagguggcaugcuaacuguaguaaacgaugauugagcugacguucauaacuugcaaaccucuagaaauccgcaccuuaucauuacagugaaaacucaaguuuauggggaaaaagagggaaauauuaggauucugccuuuucauagaaaggugaaagcaugaucagugcauugauguaaucuaauuuucugaaaaggagagauuugugugggauuuuuauggugcuggcacacgguagauauuuaagaaauacuugcugaauggaaucaacauuucauuuauuauucuuuggccguaccugauaguagauaauuuaguauguaagggaaauaaaucaagcaaaggcacuuuugagaggaauagaaaauaaaagcuuucucaacccaaauauuuugggaguguggaaucgucucucaaagaaacaugcuuuucuacccccagccuucagagccaggcccaaacaguggcauuuaaggaaugggcuuaaauggggagugcugaacuaguucauguuuccucauugggauuuuugucaacuaaaucaguuugcucauuugcguuaggacgauugccucagguuuugaauuuugagguuucuauccucuuucuuuacauuggacuuaaagucaguagaggcagcugacuucuuaauggugagcuucuuaauguuucuaagauuccugaguaugcuauucaugcaaaaacauuuuaagcuacaucaaaauugccuuuuacuaucccuguucuuugauuguuuuuauuaaaacuccuauuaucuguaauuucucugguuuugugccuccaguuucuggauucuuaagucauugaaugugaauggaagugcaugugaguugacuuauacugaaaaccagauuaaaauuaccuagaauaaaaguuuauuaaaguauguaauuccuaaaaugcuuauugaagaccuuaaaucugauuguuauuuaaauuugugguucagcgauauuguguuaaccacugauuucagaguagaaaaaaugcuuauuauuuuuaacuuuuuaaagaaauggggaauguuuuguaacaguacucaaauagcacagaauauuuuucaacauuaaaaacauuugauugaauccuaauuuagacaagccauaacuugggaggaugguaaaccauccucugaaagauuuaacucuuuauugguuuggaaguaguaaaguauaccccuaaaugccuaggauuagagaaauaauuuuauucauugacucuuuauggaaaccaaaugguaucuaacucuguuccuucucagccaccuugaaggugacuauuaguguggucuuuaaguugcuuuuagaaauccugaagaauucagucuucgucuaucauauucuucagauuuccuuuuuuguuuuugcaguucugaggccaaaagaugaaguuucuuugccuugccugauguggcaucaacuuucuaauuuuuaaacauguuaccagcgcaugucuacugaucguguacugcaggaccuggguagacagaaacauacccaccucugcccuccucaccuuccagucagggcagcaggggauccucauauccucugaggcaaagcaaauggcuucacuuuauguggaaaugaauuugccagugagcuuucgugcuuguuugacaauaaggcaucacugaugugaacuaauuugguggcaggucuccucugaaggaaaccagaaauuguaacagcauggccaagggguguuucuagggacccagucccacaggugccuaagggaaguguucuccuccccuuucaggaacucccugcuguguggugagaggcucugguggccuugcauggaagagccuguugccccccagcuuacuccacuguggcgcacuugguugggguucuuuggguaaagcuaaaucauagauggucuuuaaagaaaucgcuuugcaaguguuaguccuuccugauuggaagccuucuccauugagccuuauuggaauuagaaauuugcagugguucucaguuucuaggcuuaucauaauauaagauauaaaccaaaaaguaucugagacaggucucaaucaauuuagagaguuuauuuugccagggcuaaggacacaccuaugacacagcaucaggugguccugacaaccugugcccaaaguggucaagaguacacuuugcuuuuguacauuuuaaggagacauaauacaucaaucaauacauguaagauuuacacugguuugaucuggacaggugagacagcucaaaggggcuggggcuuccaggucauagguagauuuaaacauauucugauuagcaguugguugaaagaguuauuaucuauagaaagcaaugucuggguuacuauaagggguuguggagaccuagguuuuaucauguagaugagccucuaaguagcuggcuucagagagaagagacuaaacguuucuuaccagacuuaaaguguguguucauguucaugcuggaggguagagugaggaaugucugacccccacugcucaucauggccagcaccagccuuucagguuaaauuuuagagugcccuggccgaaggggagguccauucagaugguugugggaggacuucaaauuuuauauuugguuuaaaaaggagaaacagggcucagcuggcaucuguacugauugaugugcuuacauucuucauguggauguggccagugucagccuggagaaaaaagaacgcuuuuagauuucaaaggagcaguuggguaauaaugaacuuuaccauauuugcaaaccuaucugguaucucuccucccuuuuccuuugaccaccuauucugucuaggguuaagaaaauaacaaagccaauucugguuuguuuuuguuuuuguuuuuguuuuuugagauggagucuugcucucuguccccuaggcugcagugcaguggcgcgauugcaguuaacugcaaccucugccucgcaggcucaagcaauucuccugccucagccuucugaguagcugagauuacaggcaucugccaucaugccuagcuaaguuuuauauuuuuaguagagacggggguuucaccauguuggccaggcuggucuugaacucguggccucaggugacuugcccaccucagcuucacaaauugcugggauuacaggcaugagccacugcgcccggccuaacaaggcuaauucuacagcauuuuucauaagugugggacuauuggucaucuuuucaacaaaaccagauauuaacaaucaaugucaguuaaaggagaguuguagacuuaaauagugucaauuguccuacauuuucauguuguugauaacagccuaccauagagguguuacagcuuccaccauuuuacacaggaggaaacagagcucagcucagagagguugaguuuuccaagaagccaagucauggggccaagaauagugcccgggugccaugagacucugcccacuacugcccugcuggcugcagagcggcucagauacggcugucauccaagccagggagccuuugagccagugcugcugagaaaauugggaaaaagcccacugcccgguucccagcacaucuucacuguuccucgggcucccuccaugucuguuucccucugaguguaguagauuggggacucagaaccuucuagaacagaaguuaugguuuuguaaggggaagaaauauggucaagugcacaucuauaauuuagaguauuaaauuuccuuguacccuuaugauuuauucuagaaggucagcacauugauuacaaagcuaauguuggcuaacauuaauccuucagguaugagguaagaaauaaaaaauuacuuucaugcuucauuucugcacaaaauuucacucuggaaagauauuucauuugaaaaaaaaauuaaaaguuuuacucuguaaaggauuuucagaucuuuucugcuaugaaaauucuuguuuucuaauuuucaaaaucuugguuugaaaguaauuggaggcugggcugguagcuuacaccuguaauuccagcacuuugggaggccaaggcagguggaucacaugaggucaggaguuugagaccagccuggccgacauggugaaacccugucucuacuaaaaauauauuagccaggcaugguggcgcaugccuguaaucccagguugucgggaggcugaggcaggagaaucgcuugaacucgggaggcagagguugcagugaaccaagaucaugucacugauugcauuccagccugggugacagagcuagacucugucuccaaaaaaaaaaaaaaaaaaaaguaauugggacuuauugauguuuuuguuugaguguaacuuguucagaaaagcuacuguggcugacaguaguggcugugcacggaugucagugcagacuugaggagcuuccaguggccggacccagacagaggcauucucaagagcuggcucugcuugucuccacagacucagugcugcuggccugacugugccugcuaggguuguaacuguggaucuucuuuucuuccugaaguggucaucguaagcugccacaugugccccacgccugcccccagcacucuagguggugguuagugagcucugagaaaugaauucuuuguggcuuggagggcauucauuuucacaauccuaggaugcccaccauuuauugugugugugagcggggagugggucaugcauguguaucaaguguguguuucuuguguggcauuguugcucuuggguaugacaaaugguuuuguaaaucaccuacaaugugaauucuuagggauugauuguuuggaaacucuguauuuuaaaaacuuuucccccauuuuauuuuaggaaaacaucauauauuuugauguuauauuagcauuccuguugcugauuuucugucuugagggaaaaaguuauucaggagaguauguugaucuugguucauaauccaucuccauuaaucuaauuuaguuguuaaauauaaagguauuuucuaugucauaguuuuagucaaccuaaauuuuuccuacuuucuuuaaguguggucaucaggucaaagggaaauagggguuacucucguucuuuuuucgcagaaaaacugcagcauauaaucuauguuugcauuggaaugugauggugcucacuuugggcauuauuugggaacugacuuuggcugcuuuuucuuagggacacagcaggucaggagagauucaacagcauuaccucagcuuauuacagaagugccaaggggaucauauuaguauaugauaucacuaagaaggagacauuugaugauuugccgaaauggaugaagaugauugauaagguaaauguugcauuuuucuguccaaugugaacucucugcuugugagucuuaaucauuauuaaaagaaggaggggaaacacauguauugagcauguuuucauauagacuaaacaucauuuagcccauauauagccuucgggauagggauguaguccuguauuguggaugaggcaaagaagaauuaaauuuauccagaaucaggauuuuucgucugguauccuggacugucucaacuacagaggccaaacaugcucauuccacuacauccagcugcuuucauggaauagauauaagacauuucauuucugcggaaaggucaccuggacacucaucucaugcacguccacugagugacaaccuugaggagauggccuucuccacggugccugcggaugucccacgcgccuccgucacccacuggacaucuguccucgcaauuauagaugcccuuuagcuccucauuuugagcaagaggagcucgaguucuccuuuggcucgugauggaaucauacagauaggcugugucccugugguuaaugugaaccguggguucuccgcuaagaaacauguucccaaauacacauuuagaaggcagagcaguugggagugggaugugaugauauaccauugaccacauuuugaguuuucuuccccucgugcaguaguuucauguuuaguuccuuugcauaacaagcauaugcaauauaaauuggauuuuaucuacacauugcauuuaaaccugucugcuagauaacauuggagaauguuugccagcuuuaccaagcaugucauugaugauguaugccucuuuaaaauguguuaggauugguggccaggcauggugacucacaccuguaaucccagcacuuuggaaggccaaagcaagaggaucacuugaacccaggaggucgagaccagccugggcaacauagugggacuccaucucucucucucucuuuuuuuuuuuuuuuuuuuucauuaaaaaaaaaaguuguuaggaucaggguugcaagguuggaucagaccugaggcggggccccugccccagccugcucugcacugggcaucagucauaccaggcccuccauuggcacaucaguggauacugauguucccugauacggaagucacagagugcaauccuguggaaauuagaaguggacaguccucauagucuaaaacuuuuagaacuaauaggaugaauacaaaaccaaaagaaauggccuaaauccuaccccauuugguacuugaguuugugagucugugcccacccaggucuugaggucugaugcugucuuccuuuugucaucaacugcugcuuuucaccuuacuugagugagagcaucauuuccugagugcggggcccauugccccagcccugcggugggugcugucacuguuacccacaccucccugauaaggggccggcacuccucaccuggcugcguaacuggcccacggccacaccauucagguuccuuuuguugcagucuguuucaaguaacuuuuuagaacgacaaguuaguugcucaagagauuuuaaccucauuuuuaaagacagaaaucucauuguaccuauauguauuuuuaaacuuagaaauguagcuuaacuuuuuuccugguuauaaaauuaaugauaccuucauuauagaaauuuggaaaaugaagaaaagcacaaaaguaaagaagaaaucuguaccucuggcauccugaaaaaccaaauuggcuucacuguauuuagcuuuacgucuugcuuauuuugugaauauucugucauggaguccuuccugugucauucucuguucuucugaagcguguguuuuuuuaaaugccuguguuuuuaaaauaacuugauucuugagccauuuuguuugacuuguagguuuuucaguugauaaccauuuugaguguagagcuuugccuguauguugaaucauuuccuuaggaagaggucuugggaauuguugggucaacagccaagagcauugugguucuuaaugccugugcccuaguucuuucuaagacacagugagcccugccuugcacugcugcccaguccugccugggaacugguagaaccucaaagacaguggaagugaauggacaaauguaaauuagcgaaaaauacuguaucgguuuauauuucugcugucaguauauggcgaugcccaucuuugaaauguggcuucuuuuaaaauuccacaguaugcuucagaagaugcagagcuucucuuaguuggaaauaaguuggacugugaaacggacagagaaaucaccaggcagcagggggaaaaggugagagggcgugggaggcacgguugccacacacugugcuuagcgcuugagguacuguuucuuuuaauaaauuacuuauuuuaaaaauuacaaagaaauuaucaauacagugauaacucagucacauccuccuaauuuguuugcacuuuuuugacuucgugcuccuuuaaauucauucugaaauggagggagaaaaaaacacaucaguguauacaacauuauuaucuaaccugacauuuuauacagagaaacauauuuuaagccauaaaguugcuuuuauaauuuacuuuaacguacuuuaaacuuccuugguuuuugcuaaggauugaaucauggagaaacgaugcuauucacauuuaaaugucagauauguuacacuuuuagaaacuuaggcaacugauuugacuggaaggucccggcaucaccuucaggauuuuuauugucuuuuguuuugcuaguugcuuauaauguaagaauuugcuacacuugugaacuuuaucuuugagcgucagugggacuuucuaccccuuaaucccagcccuucccuugaagcugagcccagagaccucaugcucgcacgcuggucugugaggccccacacagaggaaauagguguguguuucuucucaguuugcacagcagaucacugggaugcgguucugugaagcaagugccaaggauaacuucaauguggacgagauauuuuugaaacuugucgaugacauucugaaaaagguaaaaaaaagaaucuacauuauaaaaguauaucaucugaaaccuguuguuuccuuuauugcuuuuuuauugagaauuuuguauuuagaaaccaaaauacaguaguugugcucaggcgcaagaaccagguaugguuguuaacucagccacaggcacccggccugcuguagccguuucccacccaggggcuucugguguccuugggguugguauauggcauacuugcuucgccuuaagauacagcaggguagacuuaacaggguguagcaauaugcuguguuuauuugacauuugcuuguuuucccacccccguuuuucugugagaauucaguuggagaccuagccaagucugcaggugucuuagcggaaaagagagccccguggugcugcgcuugcaucccuuccuguucugcucccuggugggagccacuuccuuacagagaccuuuccaugaugcugaguugcaagaaaauugcuagacagcuucauugagcagcagcaguuucuucaggcaucuuuaggcuuacauucaaaaauuguuaauaagaacugaaguuuauguuauuaagugaaauuugcucaguucauacauaauucagaagcuucuaauaaaguaauuguuuaggcugggugugguagcucacaccuauaaucccagcacuuuggaaagucaaggugggaggaucacuugaggccaggaguucaagaccagacugggcaacacagugaagccccaucucuacaaaaaaaauuuaaaaauuagcaagguguaguggcauguaccugguuguaguaaucccagcuacccaggcugaugcaggaggauugcuugagcccaggaauuugaggaauuugauacagugagcuaugaucguaucuacacuccagccugggugacagaaugagacacugucucuauuuaaaaaaaaaaaaaaaaguuuauauaauugccaagguagguuaugucugucuuuaguaaguaugcaacuccuuggaaugcagaccauuuuuaaaauuuauuaauguauuuuuauuuugccugguucugugaaaauauauguuuaugagguugaucuguucucuucuaccauaggguauuaagcaggcugggcauuguucauguugugauaugaagugucuugaacauggcuuuuuuuggcuuaauauuuuaaugucuaauugaucuuuaacgaucggaggacuuucaauaauaauacuuuuuuuuauauaauuguauaauuuggaaagcauuuacaguugacccuugaacaacaagggggcuagaggugcugacccccuaaacagucagaaaucugaguauaacuugacucccuaaaaacuuaacgacuaaaagccuaucacugacuggaagccuuacugauaacauaaacagucacuuaacacauagguuguauguuauacguauuuuauaccauguucuuaaaguaagcuagagaaaagaaaauguuauuaagaaaaucauaaggaagagaaaauauauuuacuauucauuaguggaaguggaucaucauaaaggucuucaucugugucaucuucacauugaguaggcugaggaggaggaggaggaggagggauuggucuugcugucucuuccggguggcagaggcggaggagaaggugaguggggaggcaggagaggcaggugaaacuuguauugaaaagcagcuguguauaaguggaccugugcaguugaaacucauguucaagggucagcuguauguguaccuuguaaaguuaaaacggauuuuuuuuuguuuguuuauacguuagaugccucuggauauuuuaaggaaugaguuguccaauaguauccugucguuacaaccagagccugagauaccgccagaacugccuccaccaagaccacauguccgaugcuguugauuuccuacuuuggagacaaaguggaaaugauuccuggaaaggggaaaaaacguucuauucugcacuacaaucauuuugacaauuuccuuucgcacuuuguaauccaagucagagcuauacacuaacuuguaaauaugcauauaugcaauccuggguaaguuuugguuauaaguuaccuauuucccuccaaauuauuauauuucauucauuaccccagugucuaguguacauacacugggaaaccuaguacuucuaauaugaagaaugggagaaaugaaagguauaauguuucuugaaauaaauaauauaauuguccuuauuaauuauauuaugaggacagaagauauucugauaagagagaacguggugcuuugcuuaccguuuuaaagaaaauuuguaaaacuaaagacuuuuugaaaaaaagcuaucuuaagugcuuuuucuuuauuuacaagacauuucccccagugguagcaucugaaguauuggaguguuucugccacgaagcaaagcuccauucauggccgucauggaagguuauuuauuaauguuacauaaugguagaauauuacuaguuagaggguuggauuugacuugguccuaaggccacagaaucucucucauggcuuccuaagggauguaccuuuaugcuuuuaagaacuacaaagauucaauaaagaaagaaauguuuuugaaacuauagaaaaagauuuuaaaacacgcugcuguccuaaacaaauccuguuuaaaggaauuuuaaagagaugcauuuuacuauaucaaagaacauacguguauuugccuaaacacucuguaccuuuguaaugauaaaacuucccccuucuuuacggugaagcuuauucugauuaagccuagacuguguucuuuuuuuuuuuuuuuuuuuuuuuuuuuuuuuuuuuuuuuuuuuuuggucugaugaugaauuugugaacucuaucuuugguauaucuuuuauuaaacugcacuguuuuguuuagucaagguaauuaaguaauuauguauuugaauaacuuggugugucuugaguguugugguaugaaaagcauuguggucuuucuacacuaaugaagugcaaauaaaauuuuguauuuaugaaugaagu

SEQ ID NO: 18410 - RNA, 5808 nt, Homo sapiens
acaaaccacccaagaaaucaaaaugacaugguuuuuaagggcaauagcuaccuacuuaacauguguaccgcacauagugcguccuucaugcauuaagcaugagcuaggcggaugcguguuuguuuacacagacuugcugccgauucauuaaggcagagcuggggaccugcuuccccccauuuugcccugaagcgcucugcauuaggcggcccuaauugcugguguuggagccgccaggagaccuuuccugucgcagcaccuggugcagaagacauagaugcugcacuucccuccagcgggguccccgguacaucugacaggaccugucauuaucuaagacuuccuugucaccaccaugccuccccuuuuagcccacguguucugggaagagacccuugucaguuuuccuggcaccugccaccggcugcacaccuggcauugaaauggcgcuggaacguguugugauuauuuucccucuuuaaugaacccaccugagggacauuuaguuucuuaauccagucgccuguuucccaggcauucccauuuacaccguuuguguggagauucaaaaacucuguugugguauugagcuguuccaucugccagaagucuuauaaccaaaucugcaggacucccaaaggagacuuuuuacaccgguaauuuaagcuaauuauuucuaaacauauuuagucaguuuuaugaagaccucauuagaaugugacuguuuauuaaaaauccaaaugaggucucacagucacuuaggaaaauuauuguugagucacucugaauaguucugauaacagaagauaaaauguuuuggagcugagagaaguggggaccagagcuguggaccucuaucacaguaggggaugggaagaaaccaccuacauggauucuuggauauuuuccacccaaggagccugcccuaaaauuccucucacaguacuugucacuaaaagagucaugaaaggaaaaguuuacuaugaacacuagacgucagaacuaacaacuuucuaauucacauacaaggaagguauauuaagauuccaggugccccucucacagccaagaaaaaaacaucuucuuuugugcaacagccaccagacccaggaucaaugaggaagcaagagagaggcaagguugcccuuuuauaaaaaguguggaaauacugguuaauuauaagaauaaaaauauuaguaaucguuuuuacuacaaaaucucuugaguuguuccaagacaucaaacucauaagaaagggaagagggaaauuguuuuuauagacauugcugacaguuuuccgucuugagcacucacuguuacuuucauagguccuuuuucauaaacugauauuuaagauugaucuuuugugaccuguguaauuacagucuuagccuuugaauaauuuaugcucauucagcaaacacuccucaucucaaucuacugucauccuuucgccuaucauaggaugaagcugacauaagccuuaccucccuccugcauguuaccccugggcauuuaacugcucauuggccaucucuaccucugugucccacaacuggcacaaaccaagcaccuuagaaacuaagcuuguccauucaucuucagacuccugguccccaguaccuauucuuaucauucaggcuugaaaacaaauuucauuuuguacucagcccaauccaaugucaagccauaaaaacaccaugugaacagcacaccugccuccuguuuucaaggugccuccagugcagcuugggaauucacagucuuucauaucagucccaguagcagcguccccacuggucacccugguguucacacuggucaccccagcauccacaguggucaccuugugcuguuguggucucagaggccaaaauggaugccccauuaucaacuaagacagaaaggugaaggaaacagaguuaccuacagguugaagguucagggccugucggggcaaauccucuaaguuccuauggccaaacucccuaccaauaggagcuacagcucugagucacaacccagaccacugcaacucugacuggccagaggaccagccuugaaaacacucuuuccugauaagcagcuguagaucuugagcccauuucggcagcucauagaggcugcauacagacugucuuugugucccauagcugaccuuuugauguaaagagccaaaugccauuuucuuuucaugguaaaaaccccaccccaaagugaacaugggauguaugguacauguauguuuaccuauugcacaugugcucagcuccccuuauaaauauguauagcuuuccccccaaaccugcugauauguaugacucuguugugugauacagaccuggugaggcauaaaagccaaccuguccuucuuucugaagagagagcaccuucaguccaugcuggagacucuucccagcuugcaaaccgauaacccccauaaagcucuccuuucuacuguccagccauccugguggucuuuuagacaacaccaucuucuauccauuccaugugucagugcugcauuaauuuuuauaaacauuggcuccugacacaccacucaucuguucagaauccuucagugauuccugucgaauccagaacaaagcccaaaccucaagaucccucuauucugugccuucacaguguggcucuagucuacggcaagcuuauuucccagcauucucuuacaaguguuugaagugccaggcagacaaaguauuugccauuugccacacacgcccagcacugcauuccuugugcuuuuggugcugucuggcccaugcacaguggagcucuccaggaaaaccccugccaguuuggaaugcucuaggucuacacagucgccugcagagccucuagucgcaggggucuacugaguauuuucagugugguuauugugacugagagauugacuucugagguuuauuucauuuguauuaauuuaaauugaaauguccacaugugacuaauggcuuuugucugggacauugcagggacagcaccuccuugccuuccuccuuaugccugcuuaaccagggcccuucauuuaauacuaauugaaaauuccacccuuucuaagaaggaaacccgaccugauuauucaacuggcuauuuuaucucccucaucagcauccucucuguaugucacuugccauauucuguccuuuaguauaaguuuuagcccuuccucauuuauaguaagucagucagagaaucagaaggccuuggcucuucccaugcccauugcaacaucucugagccccagauucgucaucuguuaagcauagggaaugaugcacuaauacccuucugugucacgggauuacuguaaggauuacagaauaaauugagcaucuguugugccuguuuccacuucugcaaacucaccuucucagccauuccugugcacaaccaccaggcuguggguccuuccagguaggcccaguagaagcaauuggucaagaaccuuucccuaaaucuggccacagggacggccucucuguugucagagaugguggaguuugcaccuugccuugaauuccuucaauucuguaggucaugaauuaucuguuucugcuggaaauagcagcaauuccuaaacuagaauugcuguaacuuuaacacaaaacuagaagucaaagaggagauuggcaguguggccugugaugauucccauccagacacugccaggcuucacgccacuacccccagcacaucagccaagaaaggaggcacuaacgaauacugagcuaucagcagcaggagaaaggccuucuacagacuccucaacaccagcuccuccaggaaagaugguucccuggcugcccuggugaaccuggagguuuucucugccugaaaaccucaguuccccucuguaaaaaguucaaccaaagagcucaauuugucauguucacaaauuagcccaaagauaggcuuuuuaaucccuucucagcacaauuuaacccaacauuuagugcuguacuuacuguaucuaugacacuaauaauccaaagauaguuauaauucacuuguccucaaagaauaucaccuguggucauugagaaccguauaucaacaaugaacugugauacauguucagaaugugauaguaccaacaaagggacucauucugccuguggcaaucuaggucuucucggagcacgugguaaagagcuggaccuuaguaggaggaaggauuuuauuuugucuuuauuuuagauuuagggggcacaugggcagguuuguuaaauggguauauuuaguggugcugagguuagggcuucuaaugaucccaucaaccaaacagugaacauaguccccaguagguaguuuuuaaacccuuucccuccuuccucucuccucccuuuuauauuccccaguguuuauucccaucuuugugccguguauacccaacguuuagcucccacuuacaagugagaacauaguauauuugguuuuguuucugaguuaauucacuuaggauaauggccuccagcuguacccauguuguaccaaaggacaugauuucauucuuuuucuuuucuuuuuuuuuuuuuugguuugguuuuuuuuguuuguuuguuuguuuguuuuguuuuuugagauggagucucacucugucacccaggcuggagugcaguggcacgaucuuggcucacugcaaccuccgccuccuggguucaagcaauucucugccucagccucccaaguagcugggauuacaggcacccaccacuacgccuggcuaacuuuuuguauuuuuaauagagaugggguuucaccaucuuggccaggcuggucuugaacuccugaccuugugauccaccugccuuggccucccaaagugcugggauuacaggugugagccaccccacccggcccgauuucguuuuuuauggcuauguagaaaauguguauauaccacauuuucuuuauccagccuaccauugauggacaccuggguugauuccaugucuuugcugaggaagcauuuuaaauggcaggagugagacaguaaccacuucagcagcauaaggaagggaaagcacaggaaggggaggaaauggcaagauggagaaagagcuaguggccugccugaugcagcugaugagggaagaacucugaggccgggaagcuaacugcaggcuuguugaugaggauuugaaauguguuucuaggaaggaaggagagguagcaagugggcaguguguguguuuguuuguucacuuuaauggaaggcauugagguagugaaucguguucuaauugguauugaaaagcaaucuuggugaccauuaagaaaaggcugagaaaggcuauggaagaguauggagacacguuuaggagguuagagcaaggcucuaggugaaagaugaugugggcuugaguuugggcagagguguugggagcuuaugaggaguauacaguuuggguguuaugguggguagguggugcugauaaggaaggaggagaacuugagaaugaaccaggguuucuaccacugugacuuggguugcuauaaaggauauuaaccaagaauggguaucucuuuccagcccacccccacacccccaaauaaaaguagguguaaggagaggcaauguguuucaucuuggacaugcugaguuuaagaagcugaaugagcaauaauguggugcuuuccaggaagcucaagagagagaugugagcugaagacacagaaacaaacuaugaaauauuagcgucccccuuuauucacaagcaucuacuguguguuaggcuuuggcugcacugaggauaucaagaugaaaagacauggcacaaacua

SEQ ID NO: 18411 - RNA, 2804 nt, Homo sapiens
agauuguuuuucagaguuagucauucaaaaauuuagucuaaauauucacccaaugaguuuuauuccucccuuccaaauagcaauaaaaauuuuaaaauagucuggguuuauggaaaacaaacuccguaaacaucaaccuauucuuuguuauaaguaagaaaaauauccaucuuaaacugcaacccuuaauacaagaagaucuuauuuauaaaauguauuuuuauaucguggcaaaaauacuauccuaauccaaauacaaguccauauacuuagucuguacuaauuuuaugugucagaggguuuuucuuaaguucucuagcucaaaaaaaaaucaaaacugcaucuuaaagaacucaaaauuacugaagaaaaaaauuaauauagaaaaaacuuuugucuagacaauuuaaauaacucaauagagcaccugaucuuuacuugaagccuaauagggggcugagaccucaaggacuucacuggccuuucugauacggcuagccucaauaaauggaaaugcaauaauuguggcuaaauauagccaagugugccaguuugggcguucauucauuguuauauaauauuaugauccugggaccauaaggagcauaugucuagcucuugauaguucuauguucuaccaggaggcauugcagcagcauaagcccucauguuuuaaggucuaacuuuucuuucugauauaccuaaauuuuaaagacuuuuuaguacauuaaguuuaugguugucccuaacuacugaguaguaaauuuagccuacuaauugcuuuucuguauuuugccuuaauaauaguaguuaacauuuacugaauauuuuuaugugccaggaguuguucuaaguccuuuaauuauauuaguuuauuuaguccucauuuaaauaauuaauucuaugugccaaauuccauuuauuaucuccauuuacuagaugugaagacccaguuauaauguuauauaacccccuaagucacacuuugagccacuaugcuauguugccuuauacuuuagauuuuuaagccuaaaauuauucuauuaauaaaaaggaaggucauaugaaguaauuguuuagcaguugauucuauuuuaaauaaaaggaacaaaccuuuguauaauacucucuauguuccaagcccauuauaagcacuuuacacaaauauuaguucauuuaaucuuuacuccaguccuguaagauagggacauuauuauuccuauaguguggaaaaggaaauugagacacagagagacuauguaacuuguccauggucacccagcugguacaugacagaaauucagggaaaaaauaccaucacaccaauuguugcaauuauuuuaauuuaacauucgaguccugccacugcuguuugucucagaauaaauuguuccaucuuucuaaaucuuagaaaccucauuuauaaauuaaagguggggggauucuaucaucuauaaggcccuuucaaauacucuuauuuauuguguacaaaaaccccugaaaagucacuuacaaaaaaacuuguucaugcccgucugaagauuuacgaacuccagcuuuuuaucugacugugcauucugacaauuuucugcauuucucuaagaauggucuggaaagggaucuggcaggaaauaaagaauauauaaaguauuuugauggucuccagaaaugcccauuucaacucagcaucugccgacaggucuaccuaaucuuccaaacucuguguaaauccuggauccaccauuuaccagcuguguaacccuggacaacaauuccaucuuucugaccucagugucuuucucugcaaaacagcgguaagaaugauccuacuucaauagaguugcugugaggauucacugagaucauguguaccaagcuccuacaauaguacugaacccacaguaaguacugagugaaaauuagcauuauugcagauuucugcuccuaugaaaguuacgauugugaauuacuacacuuauacacuuccucugaagucuaaagaaaucacaggcuccucccaagauuuggaaaauugagcucaucuuugucuaucuucagaaaaaaaaucuaguuaaauuguucaaugguuaaguuagauauuaucugauauggaacuaaguuugugagauauaaacaguauucuguccaccccuccuuaguuaagcuaagagguauuagcuuuauuauuugcuaaaugucacuuagcauuugauaaauguaacauuuacagugcauucuccgaggacuggaaacaguauuguagaacaccagaaccuguuuuccccuugaaguaacacgcuaucucaguauauaaauuacccaguacccaagguaauggagaagaaaaccuaaggaaguuugacauuuacuuuggaagugugauaaagcaauugagacuguugaaauuuaacacuaccuugaggucuuauuacacuugcaugucacuccuuagugcaaacucacuuuugcuuuauagaagagcccaauauauuaaucuacagccuuaaagugaguuaccgguuuaaugcagauccaaucugagaauaaauuaggcccuuuuaaaguguauuacagaauguugagcuaaugguaauugacgacguauauucacucuuugccaaguuguagguacaaaugugauaugauuacauccaggacaagagccugaauuuaaguaaggcuuuuagagcugaagaucauagagauuauaucaucuaccagaggcccagagggauuaagugauuugucuaagguuauacagauaauagguggauaucccagauuucagacuagacuuucuugag

SEQ ID NO: 18412 - RNA, 941 nt, Homo sapiens
agggccaaggagcugaagaaaugacagccagagaaauaaaagaagaaacaggcugauggaugaccaggagaugaguuucagaggaaagugguuagcuagcaguaucauauguuacagaaagggcacgcaggauguggacuaacaaaaguguguugaacuuaacagucaggccccaugaugacauuucagaguucagaagggcaacaggagcaccugccagguguguugaggucaggaguagguagcagaggcagcaggucguggcuucugcuuccuaaaguuuagcagugaggagugagaugggguuguggugcuggcauaagcaggcucagagagagcugguuuuucacuccucuucucucugcuuuuacaauccuauuuacagccugagaaaagugagugagaagaaauuggagacacacagacucugaagaaguugaaagaaauugauauaaaacacagagaaauagauauuaauaaacuauuaauaccuauucagguagucuaggagccugcaucauccuugccuacagagguuggcagagacucuucccagcuucuugcagcagagugcaagcugacucuuccauauaaccccuggcauuggcguaauaugugcauauuaguugcaggaugaauaaauggaugaugauuuagucacaagccacacuaugucugucuuggcugagucccuuagacaguagugauuuuuacaaacaccacugcacaugaacauccagagugaauaagaaguugggaaaggcaauugcgguugaagcauuugugauguguuucccacuuccccuaaucauccucaacaaacaagaaauagaggucaaacaugauuguaucucacaugccaugcauaugaccccucaccucgguucuuugccauauaaaugauuuuugcuauugauuauagcaguaguacccauugugug

SEQ ID NO: 18413 - RNA, 2172 nt, Homo sapiens
uagauuuauagcugagagaaaucaggguauucucuucaugcauugacacuuuuuccgcauaugcuuucuacuuuugcuugaggcccauugagauuguuugacuaaaugguaaccugaaguugauagcauuucaggacaauuuuacucugagauauuacaccaggcuuuuauugauauaacaagaguuuuauuugauuuuuauuuauaacugauuaucuuaauugauuuauauuacguuuuuuguuuuuuguuuuuaagacagugucuugcugugucacccaggcuggagugcaguggggugaucuugucucacuguagccuccgccucccagguucaagugauucuccugccuuggccucccaaguagcugggacuauagaugcccuucaccacaccgggcuaauuuuuguauuuuuaauagagacgggguuuugccauguuggccgggcuuaagaccacuuaaguuuucccacuuaagaccaaacuccaggucuuaagugauccacccaccuuggccucccaaaguguugggauuacaggcgugagccaucgcaccuggccaaauuuauaaucgguuccuaguagauguuuuauggggaaaguaguggccagaaauuuuuuuuuuuaaguaagguuauuucacacucuuuggcuguacauuuaaagagauuuuuuuuuuuuuuugagacauaguuuuuuuuguuuuuguuuguuuguuuguuuguuuuugagaugguguuucucucugucgcccaugcugaagugcaguggugugaccuccgccuccuggguuuaagugauccuccugccucagccuccuggguagcugggacuacaagcaggcaccaccacacuuggcuaauuuuuuuguauuuuuaauagaagugggauuucaacauguuggucaggcugaucucaaacuccugaccucaaaagauucaccaccucagccucccaaggaagcucuuuuuaaauguacaaccaaagacucugaggauucagcugguguuacuucagggcucccauugugugggaaccaaaaauuacuguagugcuaacuugacugucuacuguuagacaucauguugcuuuaucucuguuucaacaaaaguaguuuuugaaaacugcaucuuuuuuagcauuguauugguuaaccuuuucuguaagaccacuuuauggggaaauaucuguucaggaagcugacacagaauggaacauuaaaacuuaggcuuuggugagagaaaaauucuuuaaacaguggucuauaugcagugcuuaaguccuugcaguaaaaauaagaauucaauuacacuuauuguugaucauguucuaaaccuuugaaagcuguuuaucaaaaguaaucaagaacucauuaucacuauguucaugacaaucccaaaccuagcuaauaagaaauaggucuauauccauuugaaugacuuaaaaaggacccuuuuaugcagaauaagugaaaaguacgacuaccaccauauucuuguaccauuacacuucaguuccauucaaacuacugaguuucaagagacaaauuucacauugauugauuuaaauauaauaguccuuacaauauucaguuaugcucucaugaauuuuauuguaauugguuaaguuuggcuuauccuauuucuacuaccucuuuuggaaauaauuuacuggcucuaaagauaucagauacuggauuaaguuacaaaaacacaaacuaaauagccaacccaaacaaaacaaaacagagcaaaacuaaaugcuaagugaucgccacuuugaaugaaaguuuagggaacaacuuagagaauuuaaaggguggugcugauaaacaagggaacuucauaaguccaggcuauuagacuaguaagauauguuuuuuuuacauuuauaauacccuaaacauuagagaauuaacauuugauaagcccaaggauguuaauaauuuaaggaguacuuugaauauacugaacuuucccuggauauuaaugcuuuuucuguguuagugcagaaaaacuggagaacgccaggaaaggauuuuuucagcauaauuaaggaagaaaaacaugcccucugcagaauggcaaagcaguuugguuauuuaaacuggagaagagcaaaggcuggcauacucacugcuuucagcgucugcaggguuguuuuguaguccc

SEQ ID NO: 18414 - RNA, 7704 nt, Homo sapiens
caggccagggcccuccgggggcggccccguagucuccaacgaaagcgucggcaagggcccggauuaacccuuucuuugcucgcccacuuagagacccggucggguuccgugccugcgcaagccggcggcgcgccuuccccccagcccgcaccgcgcaugcacgggaaggggggggcgguggggguguucacggccggcuagacauucugugcucgugcaggaggagggcugcuaccaucagggacgugcacgauuucccccaccccgcccccuccccaaacuccaaaaaaaaauccaaaacacacugccacccaccgugcccccgcgccccgagccccuccggucccggccugcguuugcuagcgagcgcggggaacccacggcagugucugugccugugccaggcugcagguaagcgcgggccagggugcggaaggggcuggggccguccgcaaggcgggcgcgggggcggccggcggcuggcggggcggcccggaagacgcgcguucucgccgagcucuggggcaccagccagcuccaggaugugcggcggccgccagcggcgcggcgcggugcgagcggggacgggcgugggccaggguugggcguggggccggggcgccccgggggccgcgcgggccggcgagcgggcucggggagcggccaggcggcggcggccccgcgcgcgcgcucgcagagccucggcggccgaguucauggccgcccccgcucgcaccgccgcagugcaccgcgguggggguggggacggcccgaacccagcgcggagcgcggcccgccgggcgccgccccuccgagccgcgggccccgccgcgccgccuacagccgccggcggaggagggggccgggacccagcgcacgcacucccgggugcgcccgcggagcuuggguuagccggccgcgcgccgcccccgcccccggccgcgggagggcgggggagggcccggcgcgagcuggccggggagugcgcggggcgcgagcuccgggcucgcgggcggagcggggcgcggcgcggcgcggggcugcggagccggccgcacgcccgcucccgcucgucgcgccgccggggccgccgcgggccgcagucccucccugcgcgcuccgagccgcggucccaagccugcgcucgacgucugauuaugaaagggaaaguggcccuuucaccaccuggcucccaggcugggagcuuuugucugggaaggagugcaaacggccuccuccacuccccaccucccaggcccaaagaaauugagagggaggacucgauacgccuugagggcuucuugggucugcgcuuggcucccugcuuccucccgacuccgaaguugcaagcuugcaacaaggaagucgugcagccgccauugucgggcugcccggggcaggggaggcggcugcagcugcuuauguaaguuuuuggcuuugcgggaagcccggcucccugcacuguaacgcggcuuagcgcgcccgcaguuuggagagcaauuaggaaggggcagccuuauuaugaaggugguguuggggcuacgucuuuuccuacaccugccuacacagaugcuggcaacagcugucuuccaguuuugacucaccugaacugagcaauuggacaucucaauggcaaggggggcggggcggggaggaggcggcuuuggacacacauggucucucuuccaggucucauacaucuugagagagagaggggagaggggcgaguggccaaguacacacuagccaaaacaacaacaacacauugauauguugucauagcuagucuaaggccacuccucucucuggucccaugcacuuuuaucccacaagcccuaggacgaguuagugacaacaguaguaagugucacaguguaagguuuuugcugggcugccuagccucuggaugauuacaggccugggugcuucuagggaauagagaggcagaaacacguagaaugaucaagucagaaucaucuuuuggaaauguugccuaaccucaaacuucagaugagacaucccgcuucuacgcuggguagcucgguguguucacuuuucuuuagaaggagcuuauuauggguuucaagguguuggucuccagguuggagucuuguuccaugguuuuuguguaagacuguuacagcccaguccuuugcuccuaccacaccaaacaacuuaucuguguggucacuguucaguagaggaaacuuuuuguuuuucaggauaugggucugcaggauggaguucuuccgguaagaguuaaaacucacaaaaaagcugaaauucuuucacccuuauuguagggauagagguaaaaacaccuggauuuaucaaauacaaucuuaaaaacaaacguguaugcuauuaauacaucacacaggugcagaaagaaaaagcaaucauuguucccucuccucccauguuaccuguuggguuuauguacuucuauagcuuuauuuguaagguauauacuucuauagguuuguaugagccgagagaaaaauguagagggcuaacauacccagcgggaaaugggauagguguagggggcacggugcacuuguuuuuuucuauaucuguguagccaucaaucucuguacaaauauggacaugagcuuagugugugaggagaaaucccuuaaugguucuccaaccccuccuuccaguuccuagggcacagccccuuuaugcccgagugcuacagcccuuaucuguucuaguccauaucuguucagaacugcacuugauguaccagcuaccuaccugccacucuccccaaccugaaaaugcacaaaagagggaacaagaaaguuuauuuuuaaaaaaucaauucuugguuuaggauuugggauacaggaagauccuaccucauucuuguuuauccuuuccucuguaggucuggcgugcuccugaucagaguuacucugaucugaagauuuuggcguucaaggcauuaagauaauagccugaguuguucaugguaacuauaacuuuggauauuaaaucuugaugaaaaugacuuggcauuugcuuuaaaauauauauaccaauucugauugugcaugaacacuucuauuugucugggggaaaauauuagccgaauaaaaguaaaacaauguuuuuaaaaaggaaacauagagaaugcuuuaagaugaccaguuuuuuaacaugaugacagagaucuuucaugccaguuccaaauuuuugcuuauaaaauacucucagcacuuaucaaguacuuacaucugguguugauggcacuuuuaucuggaugcagguagauuggcaucuagagagaacaaagccacuucccaaaugucaucucauucucuuaaggucagauuaaaccuugaccuucauuuagaaguggcccaaaagugcuguggaaaaucuagaacacaacacucaaugggauauuuuggcaguaauguuccucucuaguucugcaauaguaauuuguuccuucugucaaggagguauaacauaauuauuuugcugaauccuccauagaguagauggaauaagaguaggugcaacagagaggacuagaggauuguucccuugaaccuguuucuuaaaacuugaguuugaguuauuugauuaucucuagucaggaagcacugguuuugcagccagauugucugcauuuaagucccagcucuucacuaaauagcuauagaauauugggcagauuucuaacuuugucucuaaaauaaggauagugauacguacucaugagguuaccugaauauuaaauuaauuaaaacauguaaagcacauagaacaaugccugggauauaacuaggcaaauacuuaguaaauugaagaugaacaggaguaacaauauggagauccuugaguugggaucagucuuuucuacccauauucaaagaccacucuuaacauugacuuucugaaauuguuagguuccauagauugaccaggaaaugaaaaugugacuguguucucuauauggaaaaguacuauuuauaauuacuaaacuuuuuuuuuuuuuguaggaguuuuucaucaguaugucugaaaccauuaaauauaaugacgaugaucauaaaacucuguuucugaaaacacuaaaugaacaacgccuggaaggagaauuuugugauauugcuauugugguugaggaugugaaauucagagcacacagauguguucuugcugccugcagcacuuacuuuaaaaagcuuuucaagaagcuugagguugauaguucuucggucauagaaauagauuuucuucguucugauauauuugaagagguccugaacuacauguacacagcaaagauuuccgugaaaaaagaagauguuaacuuaaugaugucaucgggucagauucuugguauccgauuuuuggauaaacuguguucucagaagcgugauguguccagucccgaugaaaacaauggucaguccaaaaguaaguauugccuuaaaauaaaucgccccauuggagaugcugcugacacccaggaugaugauguagaggaaaucggggaucaggaugacaguccuucugaugacacaguagaaggcacacccccgagucaggaggacggcaagucgcccaccacaacgcucaggguucaggaagcgauccugaaagagcuggggagugaggaaguucggaaggucaauugcuacggccaggaaguagaauccauggagaccccagaaucaaaagacuuggggucccagaccccucaagccuuaacauuuaaugaugggaugagugaagugaaagaugaacagacaccaggcuggacaacagccgccagugacaugaaguuugaguauuugcuuuauggucaccaucgggagcagauugccugccaggcgugugggaagacguuuucugaugaaggcagauugaggaagcaugagaaacuccacacggcggacaggccauuuguuugugaaaugugcacaaaagguuucaccacacaggcccaccugaaagaacaccuaaaaauccacacaggauauaagcccuauagcugugagguguguggaaaaucauuuauccgugccccagacuuaaagaagcaugagagaguucacaguaaugaaagaccguuugcgugccacaugugugacaaagccuucaaacacaagucucaccucaaggaucaugaaagaagacacagaggggaaaagccuuuuguguguggcuccugcaccaaggcauuugccaaggcaucugaucugaaaaggcacgagaacaauaugcacagugaaaggaagcagguuacccccagugccauccagagcgagacagaacaguugcaggcggcagcgauggcugcggaagcagaacagcagcuggagacgauagccuguagcuagaggcggugggacagggacacuuugccuggaaaguggagacugagaugacguggaucauaaugagugaaugccaguuacaauauuuuuguggaaacguauggaacauuguacucacuggacuuaaggcagugcuugguuagcuauuuuuaagacuuuucaaggaaaugguguuccucaguucugaccaaaccguuucacugucuugucuggugucuaguauuaauguugcccaguaagcaccucucucccuuuuuuuuuuuuauuauuuuaauuugagaacuccuguguccaguuuagaagugagagacuuccauuuuuaguuccuuuacacucaccacccuagcaagugcccugcacagaguaauaaguaaauugauuuccuaaucacaauucuaugugacuuauggucaaaagagcaguuuuaauaacuuuaaaaguacuucagauagacgcagaaaauuggugagugguugaccaagaacacugcacaaauauaaaaaaaguucuggaaaugcagaauggcguuagauuuauauuugguuuguuaauuuuauaucacuguuuuucacuguuuuuguggacaaauaaugguugcuuugcugaaguguucuuccucaaucuugauugcccuguaccuacccaaaagcuguagucacacauccuaaaggccaagcaaacccaccgggaugguggggggucuuggagccaagcucuuagguuccucuuauuuggggcaguaccaguccauaccagcugcgauuugugaguggaccugugguaagaagaauagaaaaggcucucagagauaagguuuuuuacauguguaacaaucccaagauuuccuagauuaaaaucuuaauugauuuugaaauuggauuuuuauuuagaaucaaaauuaggacaagaacagauaacuucuucagauacauuuguguaacuuuacagaaugucaucaagcuuuggggcucuguggggcacaugauuuauccauaaaggagaugcaguaugcuuacuuaaauuaauaaauuuaaaaucuuuuaaguguguaaauaguaguguuggucuuacguauuucaaguaaaaaguagacagcugcacuuuuuuugcacauuggauuaaaauaacuuccaucagcaacaaacaucagacuguuuuuaacaaauauuaaagauugucagaccaaauguuuauguuuucgaaauauauuucaucacugguuacaguuuuaaauagaaguugauugccuuuucauagccguaaaugagaauuauaaacucuauuccaguuuugguauacuaaauguucuuuuaaccaucuuuaggaauauauugaaaugccaacaauaguuugaauuguguucuguaaaaaaguauuagucaauuauuuuucaaaauguagaauuguagaaaaugucaauuuuucaaacucauuuuucauugcuaggauuucuuuuaaaaaaauuaaaguaauuucacuucauagcuuguugcauuaacaccuguaauucuauugugaaagaaauuugauuuuuuaauugguguguguuaugcccaagauguuaggaugaagaugcuaccuuuuuaaaaauuuuaguuauugguaaaauguuuaauuuuacuuaaaauuaauuucuuuucuugaaaguuguuuauucuguucuaaaaguaguccugucacuguguuuuuaugcuacuuauagaaggggaacugauugccguuccuaggcuguuuuaaccaaagcaaaggaaaaauaauuuuaacaucuugucaauagcuacuucaacaaaccauauuuugggacuucauuuuuuguauauaaaagaaaauauacuucuaucauuccucuuuucauuuuuucauagcaaccuuccacauaccuagauuucuaccaaaauguauuuuguaugcuagcuucauccuggcuuuacagaguugaaguuaaacaugugauauuaaccuccuuugaaaccacauagucauggugguaacccccaaaaagaaagguuaauuuucagcagucuaugugaugcaaauauuuaucauuuagccuauuuugcaugagaaauguauuuguguuauuucugccacugguacuggguuuacacguguguuagggcaccuguuuccuuuauauauuuuugguggcagcagaauccuaucauggcagcucuccugucugcuggguccuggucaguaacacugccucucuacaccuggcuggauuugguaguccucugcauaguggagccaucguguuagagucuucaaguuaccuccaacacccuagggaguuaauucugaaaugugguuacucugaaucuguaauguaagaggaagg

SEQ ID NO: 18415 - RNA, 1832 nt, Homo sapiens
ugauguuuccugagccacugcugaggcucugagagcugaucaaagguaccucugcaggcucaaauuaacacagaguuggugaaucaggccagcaccugccugcaaauagcagcauauuucaccaaaucagguuaaucuuuucaucaaggcaggagguggcaauccuuucauaaaaccuucacaaguuaaguuuauuccuguuguaccuuagcuuucugaaggaaaaguaaugaauggccuguucaauuuucuucccuuggagguacguauuuauuuuaaagcugaucuuuaccucaugguguauaccauugaagaccuccagcccuaaagaacuugccuuguuucaaaaaugguggagguuuugggguugaaagagaagaaugggaaggcauugucauaaaucuucacuuuccuuuuaaugcaggugggauuuauaacuucaaguauuuguauaagagcaguaccucaccucuguuuggggaaauauagcuaaaaagccauaauuuuugcagagagaaagcagaaaggcgcagcacagaguaaacuauagccacuggauagaucuaaagauucuaacagagcucaaauaaaaaacagaaacuaacuuaaaaaaaaaaaaaaagguacuagccuaaggcugcaggcucagaaaaccgauaccuacaaagggaaaugaaaugcaucgaauaauagauuaaguguuaauacuuacgcagagaagcuucaaaacagauuucuugccuuggaggaguucauuauuucaggcauuggcuagucauaagacuuaggaaaccaagaggaugugucagauccugcaagucucuccaagaagcagauguggucacaaggaaauggaaugggggaggggagggaggaauucgagagagcagaaaaauaaguugagauauuuggaaaauagagcuugcauaugauuaucugccaaagcaacccccaaauuuuuauugaacaguauaauaaaaauggagacaguuccaaguuguuucauuucggggauaggguguggaaagagugugagcaaacagaaucaccccaugacugggggccccauuacagcugguaaccacagacaagcugaacuuugaagagugucaguuuccucagcuacacaaugggaauaacacgucccauuaggguugugaggacuaaauauguauaugugguauucaacaaauacaauaauaauauaauagauaauaauuuaauauaagguguuugauaaguacaucuuuuccuucucaaauuaauccaacacuuucacuucaauacuggguuuacagaugauaccagaaaauaacacuauaauggaaagagcuauuguuauuuaucuauuuguuuuugagauggagucucauucuugcccaggcuggaaugcaguggcgugaucuccucucacugcaaccuccgccucccaaguccaggcgauccuccugcuucagccucccaaguagcugggauuacaggcaugcaccaccaugcucugcuaaucuuuguauuuuuaguagagaugggguuucaccauguuggccaggcuggucucgaacuccuagccucaagugaucugcccaccuuggccucucaaagcccugggauuacagaugugagccaucacgccuggcugggcuauuuuuuuguuuaaguuucuuacuuuuauuuuuucaauuaacaaaaguauauauuuaugguauacaacaugguguuuugauauguguauacauugugaaaugacugaaucaagcuguuaauuagagaauuuaaaauaaaugauguucuagauuguguagauuuauuguacaagcaggcuaggggaaaaa

SEQ ID NO: 18416 - RNA, 10741 nt, Homo sapiens
auuacaacaauuuuuaaagaaaauacuuuauuaugucaugaaaaaaaaggcaucaaccaacuagauucauacuuguuugaaaaaaaauggaaaauuuauuaauuagacaguaugugggcauccuguuccacaugggaaugagaagaugcuauagguucucuaaguauugcacagucugaaaaaauaacaaaaaaagggaaggggaggaaaaaaaaaaucacaugauauugggaaccaucucacauuaugaauaaucuaccaagaaacauuuaaaaaagaaaacccuuuguuucuacaguagcuuuaaguuuauaguucuuggaaugacuguauuccauugaagacaucucaguaacaggaagcuguuuuagcaaucccaugugcaaauauuaauaaaaaauauauaaaauaaugcaauucaucucuugccuucaccccggcaaucaugacauuucugagaacuguuuugcuugaaaauggguuaagcuguaaguuuugccugaagcuccaucucugcagcccguuugagugcaacauccacuagaagcugaaauccacugaaguccugguugagguccgguggaguagggggaggaguguugaaaagaccacucuguguauucguacuugguccagauuuacaaguguccucuggguacaugagagaggugucugugaaguuuuuggccgcuaucugcuguauaucuguguuuugucccacaccgaccgacuggcagagagagaaagggacaucuuucaaugcagucacagugguauggcagaucacugauggacgagccaaaacugaucccggggaugacggcuuaggagacaguggccucccuaggguuggguuuggcccagcuguacaggaaugaaauggggucuccucuagagcuggcaugaaguuuuugaugcccaucacggacuccacagagcucguuucagaaaucuuggccccacggcgggaaauugugaacugauuuggaucuuugccauccuuucucagcaugucagggaggagccugcggcgggcguugaugaaccaguuacagaccugaaaucauaucgguacgcuuuaacauuuuccucauucacucagccaacggguucugagaauguucuaugggguaccuaauugaucuugcucucugaauuaaagaaagcaugaaaagccuuaucugaauuuacaauguuauuucaagguaucugagcuccgccaagaaagcaagcuaccaccugucauaagccuucuaguuucuaauacaaauuuccuuuuuugucucuucauacuuaaaccuuuucaggacgaagaaaaagacauacaaucucaaaugcuuaaaaaugauuugagagagagguuuacuuuuuaacucuccccauuuuaaccuaucaccuacugccccaacauuuaaguuaaucaacuacaggaaaaccucuccuuaugaaaagggccacuccucccaguaacugauuuuucccaguucaaaugacugugucaacagacauaacaugaauuaccucacugaagucguccuuguuuaaauaucaaaccaguuuccuggacaauagaguaagguuuaaccuccuuuuaaugucuguugcauaaaggaagguucuuuuaggcauuaaaggaaaugcuaucugauagaugacugucaaguguuucuguguucucuaaauagcuaguuauuagcuuuuaacacuaucaaguuuacaauaaaaagauauuccuucugucuuugaguggcaaggagcuuaaugacuugacacacaggaaugccauaaaaugacuuugaaacuaaaaaugcauccauaaaccucacgcucucuuucuuuaccuguagcguagacagguguguuugcugggacagcaacgcuuuuucuugcucugaaggauaggcauuguaacggugcucauacagccaaucccgaagaaucugcacagacuccuuggguagguugccccuucuccuucucuugccugagccagcggaugaagaaagguccaagggaauguccaugcuguccucauccucagucucacugccagaugcugcaacaauaccuaggaaaggacaagggccaguugucaguugcuuuauaagcacagcaacuauugcaaagcucacuuaacgcugaccauucaauguaaccaugcuuucccaacaacugagagcgaggagaaggagcaguguuuucuguccugaauucaggguccaaguaaaaguaguuugacuagcaccacauaggaggcucucaaccaaaugccagaugccuuuucucagccgcuuuccucuaggauucauuaacuucucacauuccuuuugaaugauggucagaaaacucuuucgucuaaucauuggaggagacaaacugcacccaaaaugaauaaccugccacauuugaaacaggaagggugcuguggcaguuggaauaugccuaccaaccuucuuucuaagaucagugcuaacuaggaaaagcaaccuaaccaguccuaauguacauuuuaaaugcuacucuuccuccuuccucuacugaagguuugaaaugaaagggagcacucguacauuuuuuuucauggauauaaggaaggaaaauuacauacuacgcugaacccaguuaguauucuaaagguaaaacacauguuaaaauuuucugcuaacaccaugcauggucauuucuuauucauugcuauccacauuuauucaaaguuagacaccuacuuuaaaugggcaguacuagucaccuuuuauuaaauacgaccacugauguuuucaguuucaucacacaaaaauauuuuucuacuacugguacuuuaguaaggucaaaagaugccuaauacuaaaugaauuaaaaaugucuccuaaauuucagcuaccaguuugagcucaaccuagaauagaauacuacauaucaauaagcagaguucagucuuaaaugauuacaugacaaaggaaacugaauaugcaagccccagaggaagcucuuuuggcuguaaguacuuuaauccugccagaaauuuuaagaauucacaagccauagagaauauuuaaaucacagauggacgggguucaauaaagcuccagaacuggccuuuacagauauuuaaacaucauucugaacuuaaaaaaaauuaaauaacaaacgcuauuaauuccaccuuucaaaaacuacagcaggcuacuccgaaugacuaaagaaauacauucuuuugcuuguagacaaucuagaaucuuaaaaacagaaaugaauuacaaacaauggcaugcuugaaaaaaaucaguacuucuauauuaggggaaguaauuaaaauaacaaaaauguaaagguaagcauuuuuagcuuuguaugcuuucuuuccucuguaguauguaauuuugguugaaaauaugacuugaccuuaauugagccaguuccccuugacaggaaauaaacacggaauauuccucuuaagcuaaacaccguguuuuuuaaaggaauuuuucccacccuuuuaaugacucugacuuggugacacauuuuuaguuuuggacugcagggggcagaaggugcugcaggguauuccuacaaaaggcagaacucuccaaagacaaaguaaaguucuaacaaagagguggaugaucuugcaaauucacuuuagcucacagcuuaacaaacagcuacaaauaaacugcacaagaauccuaaguuuuaacugccauguauuugaaauuccccuccccugaugauuuaaguuuuuaaaaagguuuuuaaaagugcccauuuaaaacugaaacuacuuucacuauuggcaagaugagacuuucaaaaccuauauugaaauuugggugaagaacuauuaauaaaauagcuuaaagaaauuauagcugaguuccugucucacauuggcuuuaauaauuaaagaaaucgaacuuuuaaaaaaaguguuaaguuaauuaaaugacuaaagcaaauuugaauaaagcaauuuguuuaaacucuccaacgucugaaaagccagacauucuucucaaggcuauuaucuccuuccuuuuuuuaaucuagaaaaagugugaaaauuugcucauugaacagugaauucccaacuguaaguugguaaucacaaagaguuugaaacaaaaaaagccccugaaggcugcccuuugaucugcuugccuaguuugacaagaagccugaucuuucagaauagguuagugacacacaaaagcagguuucaguuaagcaacaccaaacugcagcgcgacuuuacucuguucucaguucauuuaaauaaaugaaugccagaccucuggaacucuuaacaaauauuuccaauaugugcacaaaagcugaaguaacaggaaguuaagacuucagugccuuggcuacgccagcugauauuucacugcaguaaaaccacguuugcugcugucaggacuguuuucauuaaaacucucccuccuaguuguggcucagcuuggaaaaacaaagacuuuuuuccuccuuacucauuuccuauuguaacagcgcuuuugaaaaguuucccgguuaagacuuguuuccaaacgucuugcuuugcuuacacuuuaaaaaauguggcgguggggagggugggggcaggaucacaagcuucuuucacgcuauccacauacaaggaaauguuguggagaaagccacaacauggccugaggaucccaccgcccuaagcagcgaccuuguuccugcacguucuuuuuuuuuuuuuuuuuuuuuugagacagaguuucgcucuugucacccaggcuggagugcaaugccgcaaccucggcucaccgcagccuccgccuccaggguucaagcgauucucuugccucagccucccgaauagcugggauuacaggcaaaagccaccacgcccggcuaauuuuguguuuuuaggagagacgggguuucuccauguuggucaggcuggucucgaacucccgaccucagaugaucugcucgccuaggccucccaaagugcugggauuacaggcgugaaccaccgcgcccagcccugcacuuucuuuucugaauagcucgguaacaucaugagacagggaggcagggagacaccgguugugaagagacucuagaaauaagauugaugggaaaagucgagaugcacaauuaggaaaaagcaaauuuaacucaacaaguuuccugaccagaaguucuccuuugagcugggagcaaugucucuugccuguaaucccagaacuuugggaggccaaggcgagaggauuucuugagcccaggaguucgagaccagccugggcaacauagccagacccggucuccaggaacaaaagaaaaaaaaaaucaguaucuccuugggagaagcaacaggcauugaacacucaagccaccaaauccaagguaugguuggcuaccccagccaaagagcaaucccaaagcaggaauucaacaguuaaaaacugggagcaaaaagacuuaguggauuuuccuuaucgauccuucucauuguuuuuaagucauuuuaggagaucuuuuggcgucacucucagcuuucugggaggacacacuauuaucacaaaccaagcuuaccccgggcucaggaauggagcugaaagugcacuuguuuuaagaaaacuugaaaagauuugcagacuuuuauaagacaagacaguaaggagggcccgacuuccucaggagucuuuccagagccgacggggaaggcuccccccucccagguaguuuuagaggaggacggcggaggagcacggggagagggaggggcccaaggaggaaaagcaaguagcuuuuguucuugagaguuccucggccucaagugaaacaggccggcccgcacacugcacgaguuagcacaagcaaaggaacuccaggacccaagaaacuagaaaugaggccgugaaucccaccuucucagaggccugcccaccccagacgacucgccagggaaaccuaaaaggggaaagaaacccggguaaccucggcagccucggcucccccaaagagcccugaaccagucgcaaaguuuccccuucagcccgucaccuuucauuguuuccaggagucggcgccgaggagcuggacccugugcgcccugggauggggaccgcggaaguucccaccgaugcggccggcggggcccagccuugguccccagcuccggggagagggcacgcggcugugggcagcgcgccgguggaggagggggggcgcaggaggaccccaggagcgcagagggggucgccagggaggaccacggcgcugggggaagguaggccaaagugccgcgggagagucggggggacgccagaaaagccguggaaaaggagcacuggggauucccggggugggaggcgggccauggaaaggaaucagagccgcccccgccggagcccgaacaaugcggggagcccaccccggcagacacccggcucugcgcuagaaccauccucgaaacacagagccccucacuuauucccgggaggcccaccacaacagacagcgcgugucucuagaccugucaguccucccaagggucggcacggcuuucacggggcgucucggacgccccccgcgcguuuucucccagggccaauucccugucccgaguccucccuccgucccgcggggagggguccuuagggcguucuaccaacaacgacugccaguugauccgaguuucaaguuuaauuucacucucgcugggaaagccuggaggcagagggaagcuccgcgcguuucagggccucccacagaaacgcagccgaaggaaccccgcuggccuugaggcuaccccccaggaacgccccgcagcgggccgggucugaaagaauguggaguuccaaacuccaggcggcucccgggcaugcgcaguagcgccgccccucccguccgcuucccgagugauuaacuucuguuuugaaccacuccacauaaaucacgacagaaacgccaccuccagcccacagcggaacacucgggggaccucccagccagggacucaauuuuuguuaacuucaaaagggacuucacacucugaccuuucgggguguuuugugugguuucuccaccccccgucccccuccgguguauuuuguuuuuaaaccaaacugacggcaaguuuuaguuguaaagcuuccagaacacuucguggaaacaaugacagccuugcucuuugcacuuacaaccaagccugcuugucacauuuggacgcauuuugacugcaugccgcuugaagcugcuggcccugggugcuaacucuuccuccugccccaaaauucaucgugggaaaacuuuuagagacuggggauuuguaaaagucuagcuuuccaaagcuguuuacacccgagggcgaugaggggguccagaaucgcauuccuucgaucguaaaaacaccacaucccuaaagaacagugcuagggcccggcugggaguaggggggcggcgggggcgggggcggggggagccuaggaguggaacuuucagacaaagccgcggcggucccgcggccccggccgccuggguccggaucgggaaaaacgaggggcuggguccucccuacucggaccccauauccccagcacgcgagaaagagcgagaagccacgcggcggcugggccgagcguggggugucggcggagacaaugaaacuugcaggcgcacaaacaaggcgcugagcguguuucuugacaacgugccagcagcguggagaggcucgccccacaacagccccucguguugugucuagcaggaaaacagccgcugccguuucagacgcagccucaacaaagagcacggccgccacuccagcaugagagccccugggcggaaaaguccaccaagugacuccgcgcggcgcggcccggccagcacguuuccccggacucgcgucuucuggugcgcgcagcccgcggccgccuuaccuuucuugccuuucauucuggaucuccccucccagcgcgaggcaaggcgggggucuggaggggccaggagcggggacacaggggauaagcgaacgucuccuucacagccgacucucccguaacuuguaggacgugcuccagccguuauugcuaaacaggacgcucugaucccaggcgcccgcuccuuggguggaauucaagugacacuugggcuuccucccgccgggaucuucuggcagccggccgggggcucucccucgcccaacucucuccccuccccucuccgcuccuuuguucccugcuccugcucggcgcaccucggcgcugucagagugagagaggcgaggagggaagguacaggagguccugccuccgcccccagccgcccgccccgucccccucccgccccgccgcuccuccgccccucccccgcaccuuccagccgggaagacuggaccgagcgcggcggccgcugucacucgucccucgggggcggcggugcggacgcgggggguggccggguccagaaacacgauccuuuccgccugccgcgcacggaccgcccgcaucccucgcccggcggugggggcaccagccgagcgccccagguuucucccuugggccuuucuucccggggcuggcgagggugcguuugguucggaaacugcaacagauggaaaaaaggacaccucccuccuucccuccuccacccccgggaagaaaagccuccccgucucguuuuugacagcugccccgaacucuacuggcccugcucuagccgcacgagacagccgccucugauucaaggggcggggcacgggaggaaaaguauucgagacaagaaccaacuucuuccagaaugcgcggcugccauugacacgcgggcgcggcgcggcgcacccuucuccucccggggcucuuccuccagcagcgacagugggaggucggcggggguggggcgggggggaaugaugagacacagccuaaacgaacgucuguucccccgggcuaaagcugcgaguuccggacuggauugcaaggcaguuucgaaaucugacacguugcggacagacacuugucacgcucacaugcucuuuaaacgucucugcccggggacggccgggcgcgcgccugccucaccaagacuccgccugacaccccgagucgccgaaccccggcagcggccacuuuuauagcuaaggggugaccacgccgugccugcucgucuguuucggucaacagugucuacucuucggauuggaacccugcuaggggaucccuccucccauuucaaacagaaacuagccauuaaguaaacacccguuccuguuggcuuauuuugguccacaguuaggagggauccaacaggaguuucuugaugaaauugcgcuuucaaagaccagaugcuguuuggcugacuugaagaaacgcaugcccccuccucugguucuaguuuucgcgugguuacguccuguuguuuugaagcaaacgaacugucacaugccacacaaugagacuucccccaucacuuuaaaaaaaggaaagaaaagcccuaaacguaaauaagccuagcagagacagcgcccgggucugccuccagucugggcucugugcuguuuuuguucgguaaccucgguggagaucccggcagaagaaacucuguggaaauaagauuaaacccgaggaguacuaagacggccaagggauaacuaacucgacuucggagcgucuguuucaggaacuagagcuagccugccacccucccucaaaaaaaaaaaaaaaaaaaaagacacccccgccccuagaaugcguggaggccagaguuuaaaaagccugggugguuuuuccaauuacaggacuaaaaugaaucaacagggaaaaaaagcgucucucuaagaaggcagcaaccuuacgauuuuuuucuucugugguuugcugacugcucgggacagaagagaacacacaccuaaaacggcucggggggagcgcgguccuggggacaagccacccgcccggacgcugcccugcaacugccgggagcacaguuccuucccggaccuggcugcagaugaaucagcugcugcgcccggugcgggacagauguggcgcagggagggggccagcgcccccgccgcccguuagagggggccgccucgcuauuucguuugaaggguugucuguggcugggauugguggcuccuauccgcuggggagccgggagcggagggaggagagacgcagggaggaggagccgggggcugggcgacgcugcgacuccgcggccugaguggcaggagccucgucuggaaccgggcgguuacuggggagacgcuuuguuugcuaacuucgaaagcggcuucggcugccucggccgcuuucgaagccacuccacaaaacacgccuucggucgguuuaacccuaccuccccccccgcccgcuuuagccagcucgagacaaaaauguuucccucuuccccgugguucuccuuggccacgcgguggcucucauuauguacacaaagguagcuuugcuuucguccaaguggacuuggcuaaugacugcgauucucaggcaaccgagaugggaaccgagaauuggaaaggguuuauagcuugaaaacaaacuuuccaggagaaggggggaggggcggagacaauugaaagccucuuucgaauuagggggaggaaaaaacggagaugugaacucaccuuggcuagaagucaggcuugaucgggccaaugcacaacuuuugcccgagcaagucauauccaaacgguuguuaaagcuggcgaggcacuccaaagagaaacacuggcacaauucug

SEQ ID NO: 18417 - RNA, 596 nt, Homo sapiens
uugucaaaugauccuuuauugaaauauuuuccuuugugcuuaacuggcugggcauuccacagcaccacuguugaugucaucgaugaugucaugaggauggcggccaucaacauuacagcccacagacugggcaguccccaggaucucuuuaaugguuccagagaguucucuggcuaaggaucggugccgcaucugucgaacaauguugacgaucucaucaaaagugauauucccacuguguuuaauguuuuucuguuucuuucugucucuuggugguuccuugagggcuuugaugaucagggcagaggcagaaggcaccaccucaaucugggccugucuguucugaauggucaguuucacuguaauccucaggcccuuccagucacccguugccuuggcaaugucaucaccaaccuuuuuuggagacagacccagggggccgaucuugggggccagggcagaaguggcaccgacuucaccuccggugcaccucagguauacgacuuugaucucguuggggucgaacuucggcggcaugguggaggcggcugguguuggaugaacccggauucgggacgaccgaagaaaguugcacc

SEQ ID NO: 18418 - RNA, 803 nt, Homo sapiens
gaugccgaaaggaaagaaggccaagggaaagaagguggcuccggccccagcugucgugaagaagcaggaggcuaagaaaguggugaauccccuguuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaguacaggccagagacaaagcaagagaagaagcagagacuguuggcccgggccgagaagaaagcugcuggcaaaggggacgucccgaagaagagaccaccuguccuucgagcaggaguuaacacugucaccaccuugguggagaacaagaaagcucagcugguggugauuucacacgacauggaucccaucgagcugguugucuucuugccugcccuaugucguaaaaugggggucccuuacugcauuaucaaggggaaggcaagacugggacgucuaguccacaggaagaccugcaccacugucgccuucacacaggugaacucagaagacaaaggcgcuuuggcuaagcugguggaagcuaucaggaccaauuacaaugacagauacgaugagauccgccgucacugggguggcaauguccuggguccuaagucuguggcucguaucgccaagcgcaaaaaggcaaaggcuaaagaacuugccacuaaacuggguuaaa

SEQ ID NO: 18419 - RNA, 98225 nt, Homo sapiens
uagagaaaauagccugagagaaacaggaaaagucuaagugggagaaauggaagaaaggaaagaaaauaaacgcuaacagccuguuccagguugcagacacuaacguaggcacuuuauagguuaucacggggaauccacaaaacaauucuguaagaaagacacuacuaucuuuauuuuacugacguagaaacugaggauuaaauucuuucucuagcuuuaauuuuucuucuccauauuuauaaaauccauugaauacggagggggauauuuuaguccucuucaauuuuuauuuuacuugugaagccaagugagaagcagugaaaugaggaaaauuccuaguggucuugugccagugaaacuaccuauguuucuguagggccuugauuacagauggggcaaaacuugaucgaguuucacagaaaagcagaaggaacuucagugaagaaguggucgccugcucccugaauccaagcacugcccagcuacaccaggcacuggugggaagaaacugggcugcagcuggauccuucaaggagcagcuuuguguaugcaaaugccuauuucaguacccuuagaacuguauaaaugaucacacacaagaugcaccucauaaauuaacugccauuuauauagaaguaacauaggcuucuguucauuacuuucaaucauagaauaguaauagaauaggcugcaaauuaaaaaccagugugcaccaauaguauauagcaccagcaauccaguuuuuuuuguuuuuuuuuuuuuugagacagaguuucgcucccaggcuggagugaaguggcgcaaucucugcucacugcaaccuccgccccccggguucaagugauucuaccgccucugccuccuaaguagcugggauugcagccaacaugcccggcuaauuuuuguauuuuuaguagaggcgggguuuugccacguuggccaggcuagucuccaacuccugaccucaggcgaucgacccgccuuggccucccaaagugcugggauuaccggcgugagccaccgcgccgggccccauuucuuuucuuucugagacggagucucucugucgccaggcuggagugcaauagcgccaucucggcucacugcaaucuccgccucccggguucaacugauucuccugccucagccuccugagaagcugggauuacaggcacgcgccaccacgcccggcugguuuuuuguauuuuuaguagagacggggguuucaccauguuggccaggcuggucuugaacuccugaccucaagugauccgccugccucggccuuccaaagugcuaggauuacaggcgugagccacccauuucuuaaaaaguauauuuuaaugcuggggacgguggcucaugccuguaauuccaguacuuugggaggccgaggugcggggaugcuugagcccaggaguuggagaccagccgggguaacagagcgauaaaaagaauaaacaaaaaacaacagaaccccggcauauuuuuaaaaaugaguuguguaauaggauuuuuuuuuuuucgguggagauguaaguaagcaaaggagaugugcuacuagugaucaaaaggggauuauaaaacauucauucccuagacuuuuuuugcacuuuaacauuccuuuuuggcaauugggcucucagucccacgugaccugccgcaggguugccauggggaccggaagaaacuuuuuuuuuuuaaaacaaaguaaggcuccugucgcccgaggcacuagaaaaucgaggccccgcccucacuuggccaggggcccgggcgcgcagcccagggacugggagcggugagaagccgcacgccuggcgcucggcggcgggggcgcggcgcgcggccgggagcgcgcgucacguggcuggggcggggccugcgcgcugcccgcccgccagcugccggcucggccgccgcagccgcggcgucccauucaugagggccgcccgacucagcugcggcccaggcggcuuccaaggcagcggcggcugcgggcgcuccgaccccgcgcgcgcccccgaccggccccgcccccucggcuucccuccccggcggguccuagccgucgcaguccagccgccgccugcccucagccgcccgcuggccgggagcggagccccuguggguaagugggcgcgggccgggcuccucgcaggcgucccuccggggcuggcggugagugucugcgccugggggcuucccuuggcgcgggcccggggcuguccugccggaggccgggacccuccggggcggcgcggguugagccgccccuccucgcgccgcgguccccgcuucccgguccucgcgucccaguccccgccucgccgcgaccgcgccacguagacgcggccccuaccgccgccgccgcaggacggaccggcggggugcgcggggagccgggggcgucggggcgucagugguggcugcugaggacucugaacccgcgcaguucccucgccgccgcccuggggaugguuacccgagaccaccccuaccccuggguuuggggcgcggaggggagugcggaaggcgcgcgggaggccgcgucuccaucccgcccccggcccugcgggagggggcgccgggcacgugaucugcggcgaggcgggggccgccgaguugcugguguuucuuccccgccgcgcuuugccccguaccuccgccuucaagcuguguggaccggauucaaaugugguuaguuuucucaaagccccccagcccccggugcagaucuuaauuugugaggaacacguucagauacaguuuguacugagagccucucuguccacuucuaacgccagcggaucaccauuuucuccacucgccugaacauuuuaagacucuuuucauugaaaauucaagaugacauuuuuuaggcauaauuaugcaaaccaguaccagaaagaucacccuuccuuuccgaaaaguacuggaacucugaauacuuggaaaugcuuugaaggacuacuuaguaaauggccaaacuaauuuuuaaugcacauuuggggcuuacccauuuuuuuuuuaauugaaaacgaggcucuagacuuggugucaagguagguccuguugaaugaaguucuuuacccaguagugaugauggguguuacuguuuauuaaaacuuggccuggcuagauuauaauguuuugacaauacaaagucgguuuugaaauacauuuugaaauauuuacgaauuauuuaguggcccauacugguuuauguuuuaacggucugguguugaucguucuuaguggcuucagauugagaagaaguggcaggugaugcugaagcgggggagaagcggcagagccggccacacagugcaggggauggagacaggugcugggcugguccuccugcagcauccucaguuguuggagggcagucauccucaggccguacccagccagagaagaaaaagaacagugugaagccacgugugauagccguccaacaucggcucuucccuccaauuacauuguaguugauugugguaugucagacugaaguaucucuuuuauuucgagacagagucucacucugucgcccaggcuggaguguaguugcgcgaucuccgaucacugcaaucucugccuccucuguuaaagcgauucuugugccccagccucccgaguagcugggauuacaggcaugagccaccacacucagcuaauuuuuguauuuuuauuagagaccggggguuucaccauguuggccaggcuggucucgaacugccgaccucaggugauccgccccccucggccucccaaagagcugggauuacaggcgugagcaaccgccccagccagacuuaagguaucuccaugcccaacuuuugauagagguagccauagaaagcuagaaaugaaacgacagguucuguuuuaacguuugauggcacagucgagagucaauaggcacgcauuaugcuuaagagaagcuggaaaugaaguguuugaaaacccuuuaauacuauaguaaagcacuguuaagaagcaaauaauagagucagcuggggcuuugucuucuuuauugcuaggagaauguagcaauagaaguucucaucgcccuguauugcacuuuugguuuuaaggacuggacccagaguuccugaaagccaaacuccauagcugcucaguaaguuccaagcacauagccggcuuugggaugcgauucggucgaggucuguugaaugaagguagacgcagcaggcaguuuguccuuaccagugaccuggaagacgguggcacuuccugagugagcucacuuaccuucccugaauggugaggcauggaugaauauuccugguggugccacguguuagaggugguaaagggucaaauguuuacuuuuauuaauauuacauuauggcuugguucucugugucagcgauuuuucuaugccuuggguacuuauuuccuaauauauaucagcacaguaacgccuagcuggaggcuuugucuuguuaguugauagauuagugguaacagguagauuugguuaucucccguaggugcuuagcaauuuacaucaagaggcuuuucuuuaagucugauuuaagucuuuccaucuuuaauuuaaauccauuucuuuuuacuccgaccccagugacugucguugaguguguauuugcccgacuugccgugccagauugguaggcagugguuuggaaucuucauuuuaaaauccuguuuuucucucuccaauacccuucacugcuugguaaguuuuuauacuucucaaugagacccagagucucgugaccuaccauuugccuccuucaugaugaaacaacucacaaguugguagauagccuccaguuggcagaauccuauguauaaugugucuuuaaaacuugaagaguuugaagguauuauagccuggagcaguaaguuuuauggcuauaccuugguaauaagacauuugaauaacuuggcuuagcggcuuugguaauuaacugugauuuuuggaauccaccuccccugcugucagcuugaaucuucauuuuaguaacacacuauuacuaacacuaaacgcuuauuacauguguguuucaagacaagcgugagggaguugcucacccugggguccaaaugaagcagucaguggcaacccauguguaguggggaauggccagaauccugccggggccacuuggugggcugccuugcucuugauuuucagcaggaagcugguggaagcugggguugggcaucugucucugcucaacuucucagucagaaaggaaggagaagaaaaaaaaaucuguugggagguaaacuguguuuuaauacaagauaaaacucuuaaugucacuuucaggauuaaaaugaugauaaaguaaacauuuuuacuaauuugauucacugacugcaauucagucuuuuucugcuaaagccuuugaauguuguauuucggugaucagguuugucaguuuauguuaaaauuguuaacaagaaaugaggaagaaggcugggugcggugguucacgccuguaaucccagcacuuugggaggccgaggcgggcggaucaccugaggucaggaauucgagaccagccuggccaacguggugaaacccugucucuacuaaaaauacaaaagaauuagccaggugugguuaugcaugccuguagacccagcuacucuggaggcugaggcaggagaaucauuugaaccugggaggcagaaguugcagugagccgagauugugucacugcacuccagccugggugacagagcgagacucugucucaaaaaacaaacaaacaaaaaaugguacuuauuuuuauaaucuuugaauuuagaauuuuacuaguguuuuuuuguuuguaacccaggcuggagugcagugucaugaucucggcugacugcaaccuccgccucccagguucaagcaauucuccugccucagccuccugaguagcugggacuacaggcacgugccaccacaccuggcuaauuuuuuguauuuuuaggagagacaggguuucacuguguuagccagaauaguguugaucuccugaccucgugauccuccugccuuggccucccaaagugcugggauuacagacgugagccaccgcgccuggccgaaacaauucuuuugaaagagagaagucucccuguguugcgcaggcuggucucagacuccuggggucaagugagccuccugcuuucgccuccuaaagugcugggauuacaggcgugagccaccgcacccggacagauguguugauuuuaaaguggguaugaggccugagcccuggaguuugagaccagccuggacaacauggcaagacccugucucuccaaaaaaaaaaaaaaaaaaacacagcugugguagugcgggcaccugugugaucccagcugcucaggaggcuaaggucagaggauggcuucagccaaggaguugaggcugcagugagccauguucacgccacugcuggaugacacaguagaacccugagucugaauaaauaaauacaugaguaagugggaaggagggaaggaaggaaggaucuagguuuaaaaauuauuuggcuuuggugguuaugacuaagcuguauuagaugaagggaggagcuaaagauggggaaagcauccuucggaaacuuuaaaguuggaacugguaauuuuacuccgcaaaaaauauaugguacaaaguaacuuuguuagugacagauugaauuucugcauuuaccuauuucugaaauaaaaugaaagggauaaaugaccuuagaauauugauuuaaacuucuauuuuauuugagacaaggucucacuuggucacccaggcuggagugcaguggugcaaucucggcucacugcagccuccgcuucuagggcucaagcgauccucccaccucggacucccgaguagcugggaccacagggaggugccaccgugcccagcuaauuuuuguacuuuucuguaggacaagguaucaucauguugcccaggcuggucucgaacuccuggacucaagugauccacccaccuuggccuccgaaaguguugggauuacaggugugagccacugugcccagccuaagcauccguuuuuaaauuuaaaauaagauggucucuuuuuauaaaaggaaucauaauuauaaacaaaaaguucauugguuaguaugggauugcaguuugccuagaagacguuuuauauaccccugacuaaacaguagaauuguaugcugaccaagaucguccucaucuauucagugcauuaugauaugacauuuaugguuccuggcaagauagguauguucagcugcacuggagacauggcuuuaaacuuauucggaaagggagguguccagaaugcaaacagcucuuaaaaaguauuuggaaauaauuuauucaauauaaggucaucugaucauuugauuauauguuuugaauugcccuccgguaugugccagcaaaaccaucagaucguuaauaugaauuagaagcucugauuuggagcugcuugaauuguuauggauauuuuuccucacaguugagucuauaaacuugugguguuuguaaaacaaugugcuuuucuuaugagccaacauaaguuaaggaauguuugggcuuaguugaagcauuauaggggauauaauauaucuuuuguuuguuuuaggaggcuguguuauuuuuuucuuuguaaacacugagagacgucuguccacauauuacauuucuuuaaacucuuuuaacaguauuuuuuaaaauuaauaauagguaccuggauaggugugguggcuuacgccuguaaucccagcacuuugggaggcccaggcgggcggaucacgaggucaggagaucgagaccauccuggcuaacacagugaaaccccgucucuacuaaaaauacaaaaaauuagccagacgugguggggggcaccuguagucccagcuacucuggaggcugaggcaggggaauggcaugaaccugggaggcggagcuugcagugagccaagauagcaccacugcacuacagcccugggcgacagagcaagacuccaucucaaaaaagauaaauaaaaauaaauaacuaacuaaauauaauagguaccuauuugacauagcuguaaugucaauuuacauaugaacuauucgagaauaagaguuauuuagagaaauacuacuugagagagagauaaagcuuuguuuuuguuauuuaaaauguuaaacaaaugcuguuuuuuuuuuuuuaaagagacaaggucucacuuugucacugaggcuggagugcaguggggcuaucucagcucacugcagccuugaccuccccagcccaagcaauccuccuaccucagccuccccaguagcugggacuacaggccugcgccaccaugcuuggcuacuuuuuuuuuuuuuugagacagagucucguucugucgcccaggcuggagugcagcggcgcgaucucugcucacugcaagcuccgccucccggguucaugccauucuccugccucagccuccugaguagcugggacuacaggcucccgccaccacgccuggcuaauuuuuuguauuuuuaguagagacgggguuucaccguguuagccaggguggucucgaucuccugaucuugugaccucccugccucggccucccaaaguguugggauuacaggcuugagccgcugcgcccggcccaugcuuggcuaauuuuuguauuuuuuuguagagaccaggcuucacuauguugcccaggcuggucucgaacuccugggcucaagugaucugccagcuguccugggauuacaggugugagccacugugcccggucaacaaaugcuuuguaagaaaggacugaucuucuguugcaggauuuucuaacuggcuuagcuguuaaaaauaacuuaccuagguagcauuauuugaaauauagaaauuuggcauuuuggggucuuuaauaucuagucuauccacugacauucuuagucuguuguaaaguggugcugaugccuucuacuuaggaacacuagguauuucgaggagguguuuaauauuuguaaaagauuaucauuauuacaguuaucuuauugaacaacuucuuuaggcauuuugcuaaguuuuuuacguaaaguaucucucuuaagucacaaccacuguacaaaguacagauaauaaugcuguuuucuaggugagaacccugaagcugaaagagauuugccagaggccacagccaugugguagcgaugaccugccuccccacauugccuuguuccuaugcugccccacugcccaaggacucugacaguuccugugcauugcuuuaucaucccuaagucaauuuuagcguuuuguuuuuacuucauuaugauuauuguuguucauuguuauuuauagcgaugaggucuugcuguguugcccagguuggucucaaacuucugggcccaagcagucuucccguuucuaccucccaaagugcugggauugcugaguugggccaccacaccuggccguuguuguuacguuuauuagguagaacuggauaagcuguguguguguguguguguguguguguguguaagauagugucuugcucuguuguccaggcuggaguacaguggcacgauuucagcucacugcagccuggaccugcugggaucaagcaauccucuugccugugccuccugaguagcugggaccacaggcaugugccaccauccccgguuaauuuugguuuuaauagacauaagggucuugcuauaucagcugaggaagaucugaaacuucugggcucaagcgauccucccaccucagccucccaaagugcugaggggguuacaggcaugagccacugugcccugccgagacacuuuucuuuucuuuuucuuuuucuuuuuuuuuuuugagacggagucuugcucugucacccaggcaggagugcagugaugcacgaucuuggcucgcugcagccucuaccuccuggguuuaaacgauucuccugccuuggcuucccuaguagcugggauuacaggcaccugccaccaaacgcugcuaauuuuuguauuuuuaguagagacaggguuucaccauguuggccaggcuggucucaaacuccugaccucaagugauccaccgaccuuggccucccaaagugcugggauuacaaguaugagccaccgcaccuggcugaagcuuuucuuuauagaugucagcaucuauaaauugguaacagagagauagcaccuacuuuauaggaguguggguuucucuggguuauuuauguuuucaaaggcaauugugucaaggagagaaauaccagccgggaagauggggaggugauguggcccuaccaugccuacuuggugcacuuuggaaugaguuggacaagguaaaccugauguucuuuggccuguguuucacagcaugagcauaucgcugggcugagacuggauggaaugucuaagcuguauuucucauacaacaugaucccuaaaacaaccuaaauauugcucucgggcucauccugauaggaaggugacuaaagguguuggggaggaggaaaugggcucagugggacuaugugagacgugguaugucaguauccaacauggugccuucuucaaggauuuucccucguaauuuugacgguuccugauuugaguaaguguacacugugacuccuggguuacauggcacuggacugugaguagaaggauccuuaaguuaaacaguuucagagcugaauagagcuuccagucuuuuauucuguucaguaucgggggaaccagcccccaauauuuuaauauagguucuuucuguuuucccuaaguguuggccggucugagaaauagacagaguacaaagagaggaauuucacagcugggccucugggggugacaucacauauugguaggaccguaaugaugaccccgagccccaaaccagcaaguuuuuauuagggauuuuaaaaggggaggggguguaugaacagggaguaggucacaaggaucccaugcuucaaagggcaauaagaucacaaggcaaaggcaaaauuagaauuacugaugagggucuauguccugcugugcacauauugucuugauaaacaucuuaacaggaaacaggguucaagagcagagaaccagucugacuagaauuuaccaggcuggaauuucccaauccuaguaagccugaggguacuguaggagaccagggcguauuucaguccuuaucucaacugcauaagacaaucccagagcggccguuaauagaccuccccccaggaaugcauuccuuccacacgguaucaauuauuaauauuccuugcugggaaaagaauucagcgauaucucuccuacuuacacguucauuuauaggcucucugcaagaagaaaaauauggcuguauucugcccgaccccgcaggcagucagaccuuaugguuaucuuccauuguucccugaaaauugcuguuauucuguucuuuucaggguacagugauuucauauuguucaaacacacguuuuacaaucaguuuguacaguagugguccugaggugacguacauucucagcuuaugaagauaacgugauuaagagauuaaaguaaaaacagacauaagaaauuauaagaugauuauuagggaagugacaaaaguccaugaaaucuucacaauuuauguucagagacugcaguaaagacaggcuuaagaaguuauaaagguauuaauuuugggaacugauaaauguccaugaaaucuucacaauuuauguucuucugccucggcuccugcuggucccucuguuuagggucccugacuuccugcaacaguucagaaauccaggucccaucacauuguugguagccaguggaaaccccuaauacaagugaguaucugaauucuuuuugagcagaucugucuuuugaacuagugcuuucuucacuguaucauuugacucacuugguaacuacaucugcagaugagcuccccgcuaauggaguuuuaguggugcuuuacuuaguguaauugaauaaaugaaugauacaucagcucugaugaagaaccuuucauuaaauagaaauauacucauagaccuuugggaauucccaaauucaugaauauacuuuugauguaucauuuacucaguugucucuuuuguaauagggagauaacaauaccuacuugacaggcugguucugaggauuaaaugaggucauauguuaaacuggagcccgcauccaccucuaggucuuacuaggccagagaagccaguguugagagagucauaggacaaagggcgaaaggugaaugaaugaacauuccucuugucccgaaguagcugauagugucauagaggaaucaaguaggucugcuucugcguaaagcaggguuuuaugaaucagggacagggagggacuuagaagggaguacugcuugagcgauugugggaaagucugaggaacugucuuggaguuagcucugggcuuauauuuuuaaugugagaauuuacuguuuaguuaaaagcuuguuuuuaucucaaagaaaaacauuguuuaauguguuugcuuagaauuucuuucuugacccagaaagaaauuucuuuauucucauagugccaaaguuagaaaucuuguauacaaauguuaugcacaacauguguuuauaaauguaauccuuaagauuuuuccaucauuucaucuauggcugcaugaauuuuguuaaugugugggccuguaggagggaccuuaucuuuguguuuagaaugggacgucuagaaagcacaguugucuauaccuaguguauugcaggugagcguuugacuaaaauuuaaaaaucugcugauuaguucauaaggccucuaauguuuuucuauaagcuugaauaauugauuuucauuagaauggacacuaauuuucuuagcuuauaaaacuacaugaaauguuauucucugccaguugaaaaacguagguacugguauaccuauguuguuaugguggguuuuuuuuuuuuuuuuuuuuuuggucuuuugaaggucauccuuuuaaaugcuggcugaaucuuucagugcuauccuugucaucaaauggaaauggaccuucccccuguaagugugguaucuucaugacagucaagaaauaggacuuuuguuuuaggacaucucccugucccaagugaauuaacuagauaacuuuguuguauuuaaauuuccugguuuguuuguuuugucuuacuaaugagacauaccuacaggucagauggaccauaggugcugauccugagaguuggaaaggaacuuuuccuaauuaaaagcaaaacaaaaaaagccuuacaaugcuuauauuugcuugguguuccuauuuuccuucccuuaaguaguuuucauuucuguaaaugugauucuuauucauuaggcuauaucacauaauaguucuauuuaucuuuuaaaaucuuaaguauuuauuuuuauauguaauuuaaacauuuaaguacauaguacugugagguuuauuaugaaaaaccccaguucucuuucucacagcugauuacugcucccuagcaaaagccccuuucauuucuuuucugugcuugugggauuugauuccaugcuuguaugcauacacuacuguagcuuguuuuuuucauuuuagaccuucucuauugauuuccuacgcugcaagaugaagguucaucucuuauauaacccuccucucacacgcacaauucuuuauacuaagcucucaauaccauuuucuaauuuucuuaauauucauuguuuauauuuucauggcuaaauauugcuuacagcugagcauaugcagugauuuuuauuucuuugccaguucaaauuuuucuuuucucuggagucaacaauuauuuuauugguuuacauuucuuaguaccagucacaaauucaggcccccaguuucugauaggacuacagaacucugcagucaacaccucacucauccugaaucccaguaauuuucuguguuggauucugaguccuggauuacacauugucuucucucuuggcaugccuccucauuuugauggagcacauccucuagcagcuuuuugagaaaggguuuacagggaggaaauucuuugagagcuuacgugucugaaaaugucuuuauuugagccuccuacccaacugauaggcuagcuauagaaugcuagaauggaaauaguuuuccuuuagaauuguuacuuuugagaaguuaccuuuuuuugagaagucucaagucuuuuuaauuucucucucucucccucccucuccccccucuuuuuccccauuuuccuauccuuuccccccuacccauuuuuuuuagcaccuuucuuuguuucuuuuuaaaguaucucauuaccaucucuugaugaagcaccuugguuugggauuugccaucucaguuuuuggacgagacacagucucuuaggagggaacacgggaaguacccaccuuaccuggcuucacagugaauccuuaccccuggccuuguuucguuacuuagaccuggcuagcaggcccuaugucaccagagucuccgcaggccagagggcauaaaaacacccagagacuguaguggguauuuaucaauccuggugaggccucuccccacagguagaaucaucuguagcuguguacacucaugauguuggggaaguagcuggcacuacgugccguacaucugauggagggcaugguguguauccugcuuuguguagucgugcccauauggugauuuuggaauccuuuguguagccuuuaacguugucuauuauuagcauguuucugucgugacugccauagguggagcccacaacagugcagguguuucuuuauccuuugagcugggcaccuggugggaacuuucaauuuggaaaaucauguuucugacgccaggaaauuucuuguaugauuuauuugauaauauccaacuccugccuuucccuaccuuuuuuuccucuccuguuucuguacuuuaaaaagucuacaagucagauauuggggccauuuuggauugaugcucugauauucaucuuuuuccuccuuuugcccauuccuuuauccuuguuggauuuacugggagaucugcuuucuacauuuucuccuucuccuccuccuccuccuccuccuucuuccccuccuuccccucuuuccccucuuccuccuucuccucuuccuccuccuccuccucuucuucuuuuuaaaagaaaaaaaaaaacaaaacagagauagggucucacuaauguugcccaaguuggucuugaacuuccagccuuaagugauccucccaccucagccuccugaagugcugggauuacaggugagacccaccgugccuggcuauuuuuuaauuuuuguagagacagggucuugcuguguuucccaggcugguauuuauucuccaacccuucuauagaaugucuuaauuuuacaauuguguguuaauuuccaagagcgcuuucucauucuuggauguuuauuuuuauuagcguccucuccuagcugcugguggguugcuggcagccuuuggcguuccuuggcuugcagaugcaucaccccaaucucugccuuuauauucacauggcguucuucugugugcaugucugucucucuguccagauuuccucuuuuuuuuuuuucuuuuugagacggaguuucucucugucacccaggcuggagugcaguggcgugaucuuggcucacugcaagcuccgccucccgggccaugccauucuccugccucagccuccugaguagcugggacuacaggcgccugcaaccgcgcccggcuaauuuuuuuuuuuuuuuguauuuuuaguagagacgggguuucaccauguuagccagaauggucucgaucuccugaccucgugauccgcccgcuuuggccucccagagugcugggauuacaggcgugggccacggcgccuggaccagauuuccucuuuuuauaaggacaucaguccuacuggauuagggccagccuuaaugaccucguuuuaacuugaauaccucuguaaagauccccuuuccaaauaaggucacauucugagcuaccagagguuaggaguucagcguuucuuuuuuggaggauauacuucaacccaaacaguggguuuugagaguggggauaacacaugugacauccucuggguuuaacaggaugucuaguuagagcaauauuuuuaaagaugcuuuuaguuacaccuaucuucacuaaugaucagaaagaaacucuuaggaaguaauuuuuagauuacaacuggagauuuuuguucagacuugugacugccaaaauuucugcauguuccugaauguuuaaugacaguaucugaguugucucauuuucacucuugguuuguuucuaaagucauuugaagguuggcaaaaugacuaaagaaagaacagcaguagugucuuaugagaaaguaaaccguaucuauauccuggcauaguuucgugaacauguuagccagguucucaucaugcucugucccuccauguuauacucuauuucuuuuuucagauaugagccuucuuggagcuuuguugcuuaaaaaaaaaucugucauguauuuuccuguucugggcucuacaacgcuuuucuuuccuuaaaaguggcucuuccugcucuuccucccucucuucagggagcagcacccucuuuuauuuccuuuauaauaguugucccagccuaacauauguuguuguuguuguuuucucccuccccacauuagaauauaaccacuacaagggcagguaccuugucagccaaguucacugcuugauccccagcucucagaauagaauagacacugcuguugagcagaucagugagugaaagaggccuuguuuucugacuuucaagugcuguuucgcugacuugcuguugcucuuggaaguccuucucucuuguugaaguagcuuaguaugcaagucagcuugugauaacacacuggugcagccuuacuuggcauuuguuuugcaaaacuacuuaaaaauagccuaaaucugagugauugguggcauugauugcagcagugcuguugguauggccacagccuuucccuuuacccaaguguccucccagagccaggaaagggagguaccucuccuuacguuucugaagauuccauuguggucccagugggcaccaugcagaauuuaauaaagcagggcaugaaacuugagcuguguuuugauugacauugggaaagacuccucugcagaacacaggcacagggugccuggagcugccuggcacuggaaacucugccucacggucaccauguucuguuuaacugagacaaggagacacuucaggcacuuccaaaggaaacaguagggaaguagugaauucaugcuuaccgaucuagcagacuucccucugggaagcugggggacugcauccuugagagcuaaaagcaagaaauuggagauguuugaaaaacuaagucuguggcaugggggguaaggaauccuccugcuacuucugugacaucagcuaaguaagcugaugaauuggugacuuuuuguuucuuuuugaguuauacugcuuuuaguaauuauggaagagccugcucuccccccacaggagucauuaaacaaugauugaugccauauguaagguuugugaauuguuuaugcagcagaagucaccuuuugaucagaauuggggcacugucuugguuucauuguggcacacugcagaguuauaggcauaguggccugguacucugaugaugucuugaaagugacugcuauagcuuugacuucauuaauguuccuuugaauuuguuauguuuagaaaaauacaagccucugccaggugcaguggcucaugcuuguaaucccagcacuuugggaggcugaggaggguggaucacaugaggucaggaguucaagaccagccuggccaacagaguaaaaccccaucucuacuaaaaaaaaacaaaaaacaaaaaugaguccaggcacaguggcucaagccuguaaucccaguacuuugggacaccaaggccggcggaucaccugaggucaggaguuugagaccagccuagccaacauggcaaaaccccguuucuacuaaaaauacaaaaauuagccaggcguggggguggguaccuguaauccuagcuacucgggaggcugaagcaggagaauugcuugaauccgggagguggagguugcaaugagccgagaucacgccaccgcacuccagccugggugagggagugagacucugucucaaaagaaaaagaaaaauacaagccuccaaaaaugaaauguacauauuuaugauguguugauucuggcaccucuuaugcagaaguuuaccauuagcaaauauagcaaacuuggugccauuggcaaggccuuuguagaaccaaaugaugcuuuauuuggagauggugggaugugggucuguuauucugggauauauaugauacucaauagauagauaaagauauuggucgagcgugguggcucacgccuguaaucccagcacuuuggaaggccgagguggguggaucaugacgucaggagaucgagaccauccuggcuaacacggugaaaccccgucucuacuaaaaauacaaaaaauuagccaggcgugauggugggcaccuguagucccagcuacucgggaggcugaggcaggagaauggcaugaaccugggagccggagcuugcagugagcugagauggcgccacugcacuccagccugggugacagagagagacucugucucaaaaaaaaaaaaaaaaaaaaaaaaaaaagauauuuuccugggagguaagcauguagucauaucuuuucugcaacgucaccaugccuguugaaauggagagguuggaugauguaauugauggacauuauaaaagaaccaauguaacacuuuuauuuuugggaugaagucuugcacugucaccaggcuggacugcaguggugcgaucucggcucacugcaaccucccacucccggguucaagcuauucuccugccucagccucccgaguagcugggauuacaggcaugcaccaccacgcucagcuaauuuuuuguauuguuaguagagaugggguuucacuguguugaccacgauggucucaaucuccugaccucaugauccgcccgccucggccucccaaaaugcugggauuauaggugugagccacagcgcccggccguaacauuuuauuaauaagucuuaaguuuguccauagagcuaauuaccucuaauucuucaguuuuguccuccguuauacacauguaauaaggaagcuugguacccugcuuaaaaaaugugacugugaaggaauaugaccagaaacuuacacaaugaaauguacuuugcacuuuagggacagcauauacauuucaucuaugcugucauucuggaaaacauuuugaaacaccccuuccuuuuuaaauugcuuucagagucucacaguguauccuuuuauccccagcgguggaaaaucuuuacccuucaagguagauuagguuuuuggaaauagccagaagccauucaaagcaacaucugaugaaccacgcaugucagaugaaucauauuuacuuuuggaguauaagaguucugugacuaugugguauugacacucauuuuuauccuguguggcaccuaaauuaaauuuaaagauaguucuuucaggaagaaaggggagcccucaugucauguuacacagugguguaucaguggaauuaauuuauuguagccuucagaggugauugauuuaaaagacaauauucauacuagaguguagaugugacuaaacaguuuuacaccaaaacuuggaagaagagaagacacuggggacaaauaggcugaagagugggguucaguuggaugagucuuaaggcauagggaaaugguuugggaaguuaaaacaugcaaagagcugaugauugaagcauuuagauuuagaaagucauuuguuuuccuuuccagugucccucauuauuaaauagcuccuugauggcuagaauccuauccuaacagucaucugcuaagcacuuacuguggcauaggucuuggaacuauucaguucauaguucuuuuuuaaugagaagaaaaaagaaaacuagcauuuauuaagcagcuggugguuuccaggcaccaccucaugggauccucacagcaguccuaccugacaggugcucugaacccugcuauaugaagggggccugugaagcuuagguugaccugaaacugaagaagguuccauccuggaggucuguaucaagugggagagcugugguauaaaacucccugucuaaauucagccaagucaugugcuugccggcccaccccuaacauguuuguggggacccagucagaacaggcuuaucaauacagggccauauaccaucuguuuaaaccagugguucucagcugcagacaauuuugcccacacaccgcccccacccgccgccggggacauucagaaauaaccggagacauuuuuuuggcugucaccacuggggagggugcuacuggcaucuggugguuggaggccagggcugcuacacuccucaccucccaagcaaagaauuaucugaccaaaaaugucaauaggcugagaaaaccuguaucuaaacuauuaaaagcuguaaauccaaagaaaagauaaauguucgaggggauggauaucccauuuacccugauuugagcauuacacauuguauacauguauaaaauauuauuauauguccuccccaacuaugauauaucauuaaaaaauuuuuuuaaagcuauaaauccagucaccacccccauggcccggccuccauggccaccaguggcccugcagaagccuuguccuuugccagcugcccuagggagccugaccauaggucugcugcacacaucuacacugaccagggcacaggucuggggcagcuuggcuugugauaaccaccuguuccuuuagcuaaauugucuucaaaaaacuuuccuagaggucugaaaugaagaagaaaaacacuuacugccuuuguauuuuggguuuaugauacacagagccuucuaaagugcaggacccaggacuaaaggcaguauugguaccugagauauuacaggcacugggcaaguucuugaaugauaggcguacauuuauguacagucuguacugcuucauuuuaagggcuguuacugugugguguaaggcuagauugagcauguuuuaacuacuuuggcugggaaguaauugacuuuuucaauaccuguaugcucucaucuuucaaauagcagugugguuuagaaccagagguuuuuuacuuggggucugcagacuaaccauagagggguuccaucggauccucagagcacaaaucuguguaugguugugucgguauacauguaugcugcugguuugcauguuuucuguaaagaggguauauugcaaagcuuaguuggguucucagaaaugagaauggcacaaacuacucaugggcuauauauauucucuaggguuacuucuagauguuuagaagcuaagauuaggaauuuguguugagaucagaaguggauuuguugugguccaguguaauuuuugacugaaggaagaagcucucuguuguguguagguauacauaaaaugaaaguuacacguuaacuuuuuguugaaguuauugcuguggaaucaccaagcucgugguaaaaacuaaguugugggaaauacuuugcuuucuacuuaguagaguugaaugcucagaaagccauaguuuucgaaaugucagauuguuuuaccuagaaggauacauagaaauuaucuagaaauucacuuuuugggugaggaaauugaggguuaaugauauucagugaguuguucaaauaaccuaggaaguuuguaacaguauaggaauagaagaugauauuuauagccaagaacaaauauauucucauuuuaaacuauggacuguauugacauugcuuuacauuucaauuagaguuuuauugcauaauuuuaauuccuauuuuucuucuccuaccuuuuuucuuucuucuuucuucuucuuucuucuuuguuccuuucuccuuucuucuuuuuuccuucuuccuuucuucuuucuuuuuucuuccuccgucagggucucgcucuguuucccaggcuggagcgcaguggugcaaucauggcuuacugcacacucaagcuccugagcucaagccauccucccaccucagccucugaguacuacagauguacaccaccacaccuggcuaauauuuaaauuuuuuuuuuuuuuuuuuuuugagacgggucucacuggcuggagugcaguggugcuaucucagcucacugcaagcuccgccuuccagguucacgccauucuccugccucagccucccgaguagcugggacuacaggcgcccgccaccaggccuggcuaauuuuuuuuuguauuuuuaguagagacaugguuucacuguguuagccaggacggucuccaucuccugaccucaugaucugcccgccucgaccucccaaagugcugggauuacaggcaugagccaccgcacccggccuaaagauuuuuuauagagaugagaucucacuacuguauugcccaggcuggucuugaacuccuggaacucaagaucugcccaccuuggccucccaaaguguugggauuacaggugugagccacugugccuggccccauugcauaauuuucuaauuguaguaagauucaaccauuuuugaauguaugauuucaugguauuaacuaccauuuacuauguuguacaaccaucacugcuauuuccaaaauuuuucaugacucuaaacucuguaaccauuaagcaauaacucuccauuuccuccaccugguaaccucuaaucuaccuuuuauuuaugaauuugccuauucuagauauuucacauaauuggaaucauaugacauuuguccuuuugugucaggcuuauuuccuuuagcauguuuucaggguucguccauguuguggcauguaucagaacuucacuuguuuucaugacugaaugauauuccauuguaugaauauaacacauuuuguuucuccaucuguugauggacaguuguguuguuuccacauuuuggcuguugugaauaaugcugccgugaacacugguauacaaaugucuguuuucaguucuuuuguguauguaccugggagugaaauugcuggauuauauggcaauucuauauuuauuuuuuauuguauuauacuuuuuuuuuuuuuugagauggagucucacucugucgcccaggcuagagugcaguggcgcuaucucagcucacugcaaccucugccuccuguguucggcaguucucuaccucagccucccaaguagcugggauuacaggugcacgccaccacgcccagcuaauuuuuguauuuuuaguagagaugggguuucgccaucuuggccaggcugaucuugaauuccugaccucaugauccacccaccucccccucccaaagugcugagauuauaggcgugagccacugugcccggccuuauuauuauuauuuuuugagacaggcccucauucuggugcucagguuggaguguagugacauggucucggcucacugcagccucgaccucuuaggcucaagcaguccucccaccucagccuucucaggagcugugauuauagguguacaacaccacaccuggcucauuuuguuuauguuuuguagaaacagggucucacuauguugccuacacuggucucuaacuccugggcucacaugauccucccaccuuaguccgccccagugugagccacugugccgagccugguaauuccauauuuagcuuuugagaaacgaccaaacuuguuuucuacagugguuacaccauuugacauucucaccaacagugcacaaguguuucaguuucuccaguuuucuuucuaacauauauuuuccuuuuuuaaaaaaaguugacaauuuuauuuucauauuucacaauauagauaaaaacugcacuuuuuuugucccacuucuccacuccaaaaugauucuuucuuuaauaggaagggggagcaccuuuucuguaucagacugauaagaaaacacccagagucacagcauugugaucuccuggugaagcagagcaagcaauauaaaacugauauagggaggccuccccucuauccuuucugucugcucgagucauucugggccaagugggcaccaucaugggacaagcaagaggucucaucauugggggcccaggcaucauuggcauguggccucccaugggcagccucauuccaggagcaggucccacuggcaucaucccaggaggagggccccguguggggugcuggcaucauaccaggaugaggaggacccagaagacuggagggagguaguaucauugucccugccggcggggaacagagauugaaguaggaaguaucuuuccuuguugaagugcaacccuuauuuugucagucaggcucugagccuguucuuccauccauuucuaauaguaaucuuugacauucugucucuguuuccuaccacugcaauaugucuuucucauaaauggagagucauggaugagguguguguugcaguagucacggccauuggccacucucuuccuuuuuaacagaaacuauagccaucguaguggguaugaauugguaucucauugugguuuugauuugccuuucccggaugguuaaugauguugagcaucuuuucaaguauuuauuugccauuuuguauaucuucuuugaagaaggguuuaucuagauccuuugcccauauuuuaauugaaucauuugucuuuuaguuguuguaggaauuuuuaaauauauucuagaguuaaacuccccaauuugcaaauauuuucuuacauucuguaugauucuuuuucuugaucauguccuuugauacaaaaaaaaguacuuuuagugaaauccaauuuaucuaguuuuuguuacucaugcuuuugguguuauaucugagaaucauuugccaaauccaagaucaugaagauuuacccuauguuuucuucuaagaguuuuaugguuuuaggucauuaauccauuuugaguuaauuuuuuaauaugguguaaaguaggguuccaacuucauucuuuugcauauagaaacuuaguugugucagcaccauccguugagacuauuccuuccgccaugcaguggauuugguacucuugucaaauaucaauuggccauaaauguuuggguuuauuucuggacucucaagucuauuccauuggucuguaugucuguuuuaugccaguacuacaauguuuugauuacuguaauuuuuuuuuuuuuuuuugagacagagucucacucugucacccaggcuggagugcaguggugcaaucucagcucacugcagcuuccaccuccuggguucaagugauucuccugccucagccucccgaguggcugggaccacaggagccugccacacaccugccuaauuucuguauuuuuuguagaggcgggguuucacuguguuggccaagcuggucucgaacuccugaccucaaguguucugcccgcauuggccucccaaagugaugggauuacaggcgucagcuacugcacccagccugauuacuguaacuuugaaaguuuugaaaucaagaaauggaagucuuccaacuuagcucuuuuucaguauuauuuuggcuagucagggccccuuguaacuccauaugaauuugaggcuuuuggaauuuugauagggauugccuugaauuugaagaucgcuuuagguaauauuggcaucuuaacaauauugagucuuccuauucacgaacacggaugucuuucuauuuacugagguuaucuuuaauuuuuuuuuucagugauuuuugcaauuuuauuuguacaagcuuucaccuccuugguuaaauuuauuccuaggcauuuuuuuucuuuuagaugcauugcauaauguuugagauuuuagaaauacuuagcauaguaaaucugaauuucagcuuaaauaaugagucuaagaagguacuguggaagacaucuugagcucuagcugguuuguccuuggauauuuaacauaaccucucucuaaaccuccauuucuucaucuguaaaauauagggauaaagcaaaucugucuuucaugagaauuguguagaucagagauaauauaugcaaaggauuaauuccaggguauggcuuagaguaaauacuaaauaaauagugcuuggcugccaggauuguguuuucuucuaugauuucaauauaaauaccuauguuguacuugaaguauacuuuuucaaauugaauacaauuaauuuguugcaaaggcugaagauuuuuacacaaacuaaaugcccuguuccugagagagcuuuuuuauauuaaaguauguugagucuggaagaaaaauaaaaugaaaugucacacuuguucuguuucaauggugcuuuauccuuagaagagggagcauuucuucucauguugcaacuuucagaugccucuuugcuuuuugaauccuaucugugucuugacauuacaagguuaaaucuuagacauuaccagcauuuaacuugaaagaguagcaaagcugacuaacuuuuccccuuuucuuuuacuacuuagugcauugaggcuuuacccucacuggagauugcaauuaccgucaccaucuggaauuggauucaucuguauguguagaauauaacuuacauauaaagcugaguaucaguguuucagguuuucucuuuuucuuacacaucucagucaagcuuuagauugaaguaggcagauucacugaguguaauaauuuaagaauucaguuacuuucauuuuaauuuaaauuucaccaauuaaauaaaauucuucauaacacuuaaguauagcauuagaauuucuaaacauugugaaacuaaauucuuuauucucauagcaaaguauauuagucauuuuugccguuucuccugaagagcauaaaugagccugcauucaagaauauggaauguuguacauucugauggggaaauagaguggcagaauauagucagguugaggagcauggaaguuugaaaaagaaccagaaauuuggagagagagcugaccacagaaacaaaggaggguugccagauucuguuggggacccauuuaaggcuacagauaaguaauuuauacuguuacccaucuggccugcuggcagcacucaugaugauucuuuuuuuuuuuuuuuuuuuuuuuuuugagacagucucucacucugucgcccaggcuggagaacagugguaugaucuuggcucacugcaaccuccgccucagccuccugaguagcugggauuacaggcgugagccaccacacucagcuaauucuuguauuuuuaguagagaugagguuucacuguguuggccaggcuggucuugaacuccugaccucaagugauccacccuccuggauucuaaguacacuuaaaauuacagcagccguucguuucuauagauggaagaagguggcaggaagaagaguaauuacuaagaguaauuuacuaaguaaagcugauuacaaauaucuuuuaaauaaaaaauuuuuaaguaauugaaagagaucacagcaacagaauaauuuaaacaaccaucaccaguuuuucagguggucgagaaaaucuugaauuagaacuguugugaggaaccagcuauggaagagaaaauuggagucaaagauggaccugaaauguccacguggaaaaaaauaagucaaggaaugugaggaugagggguuccuacaugaugccgauacauuuugugauaauuuucacuuauauuuucuuuggauugucuuaaugauauaaucaacucuugcucaccuuauuuguuguuuguugcuguuuuugggggacaagcuuuaagcuaucucacuuuuugaucuggaguauaggaacccagcacuggcuucuuccagcaccuucacuuggccucaguguugugaugcacugagccaccccuguuauugugagucuauaacaaguaauuuguuucugaaaagauuaaagcacuacacuuugaaaauuauuuaguguuuuaaaauuugaugauaguaagacuugcauuucaacaggauuuuuugaguuugaaugaaaugggggugauauaaccccagaacagaaaaucguauaccuaagggugucaucacugugcaaacugcuauucagaggugaaaugggagaagaaaaagacauuuaaacagaaacaauuaggcaauuaacaggcccccucuucacccccgaccuccaccccugucaagcaacugaggccucaggaguccugccugagcagaacagaggguuuuccauuucuuuuggcuuuauuuuguugaaaauguuguccaaaaguugugacacaagucaggccauaauuacucugauccuaaauuaggcuguucagcuuuacucucuuaauguucagaugcacuugacugcuacagccaggcaacucucaguauugucucucuugucuccaaauaguggguaaaagcuugaccucaaacauuuguguuggaaggguuagaccgcagagguuguuugguccuaagcuccuuaaacugcgauguguacacugagcauccucuaauucuuacaguaaauguguugcauuaaccuuugaacuuggaagaagaaagcuuuggccaguuagucuuucuuuuuuuuuuuuuuuuacauuaaaaaaauagacuuaucacaauagacuacaaaaugugugaauuuuaaagauaaaugacaagucuucaaagaaguuuaucuuugggagagucacuuuaagcugggcgucugaccucaggagacccucccuuguuuuuucucuucuguuccuggaaagaucuguuugcauuugguuauucacucacaguucagugaaauugccagccacuagcuaucuuguuuagaauuuugagauuauaugaggauauuaugaaacacuggaacuugaguaaacuauauaaccauuacccaaugagcaguuaaacuacaaauguuugaaaaacccaagagugguagcaagaggaauuuuaucuugguuuugaauaaaacgucagucccuuugggguuguuuucauaaacagugaauuauaagugauuccauuuaggagaagaaacacuucauaugcuuugguguagauggugagagccauuuggcucuaaaugaaaacauuuguuucaggugagccaugguccuuuacauguucccuuugucaugaggagucuugaaaaugcagaaaugcacuuagguucuucacuauagaggaauuccgguggguauuaugaaauucuuuguaauugagguuauaaaauauuuucaugauuuuuuaauaaucaaaacuuaguuuugucacaucuucauugguaauccaggagcaagguguuguguuuccauaguauggccacugggggggaguacaauuauuuucauguuuuaugguaaaauaacaugcuugugguguaaagguauuucuguugaaccagcuuaguacagcuucagauaagcaaauucuagcuagaaaguuuuaaauaaaucguuauacccucuuaaaaagcccuguauaccuagucuuacauacuuaugggauuaguaguagaaaaaacaaaaacaaagaagguauauauuuuacuuagcaucauuaaagcuguggaaucugaacaggauucuguuuuuccuaacuagcauuuuagcuuuguuucccuaaguuagacuauuuuuuuuugaaagaguuaagucuugggaaaaagacuuccaaauucuaugcacuuuuuaaaaaaaagaucauugaagauguuauacaaaaguaaaaaguagcuuuuuucaguagucauuuauuuuuauuuuagccuguagagaaaaaguuugacaauacaguagcguuuuccuuugaaaaucauagggaugauuaagaauuguugguugugauuuuuaacauuuauccaucaagacugaaaagugccaccuugcagaugguggggguggaagcagaacuuuggcuaccagcuuugaaggucagggugauccacagguggccauaggaggaaacuuuaggugugugccuguuggcaacacagauguuuagaaaaugagcucacuucugauggguccauaguacauguuccuugcagucaggacauucugggagucaucagcuaaaacaaggaaacaauacaaacacuaucaggaaacccccaaaugacuggcuugggugccccaccuguuguguaagcugcauuguaggcaagaguugcugaacagaauucuacccgcugaccucugcccugcuggaucuccaccacgccucacuugcuaagccuuugcuccuaccucuugucagccuccuccugcugauccccagcauguucuuucuuggucucugcuuggcauaacacaaaaaagcacugaaccagaaacuggggggcuucuucucccuggcaccuuugcugaccaguugagugacauugggcuaauugccugaccucuuucugggccucaguuuccucacauuuaaaguggauaugguuuuugucuuucuucuuuccacccuccuuacaguuuuccccuucuccugcuauccaguugaauauuuucucaucucuucuacauuuuauuuccucugccccucuaacuuuucuuuuuuucaccuucuuagguuucucuuuaaucucucuuucuccuacuagccuccccuucuugcugaccucuggcuucuuccauuuuucuccaccggcagcaccccaauauccgguuuuuaucacuaccaucugaugccaaggauccugaacugcaguagaucauggaugaagagauuuaaauuuuuauucauugcauaaaauuuaggccagaaaaaccuaaacaauucucuucuggaaguaggaguuuguguacaugauguguguugaauuagaucgcaagugacugggcacuuugguguacugcagguccacgauacuaugcugggcuagaaggcaagcaggaaaacaugcugcaugcaagauaaguuuugccauuucuaauuuuggugaaauugguuuuuaauucugccacuuaauguuuuuauuauaugaaccuuggugauauguuacuguauuaagcaucaccagacaccuauuacuuggucaaacauuugaaaauuuugucuuuugugaaguuuagaugcagagaaaaggguuuaaugugaagguuaaauggauguggaucagcuaguauauuguugaugaauuaacuaaauacuuuaaaggaaugaugaacaauccaguuguccucaguucuuccuuaccuauaacuugccugaauggccuuuuccccaccuuguucucaagauugucucggggccuuagagcagcauuguccaauagaaauauaaugugagccacauguguaauuucaaauuuucuaguaaucacauuuuaaaaagugggaaaaaaaaaacuagguaaaaguaaauguaauuucuuauuuaacucaguauauccaaaauauccuuuaaacauguaguauauauuagaaauuaugaguuuuuuuauucucuuuucauucuuagucauggaaauccaguguguauuuuacacuuggagcacauugcaguugguacuggccugauugccauugcucaguagccacacguggcuaauggcuguuugugaugaacagcacaauccuagacaaugguaugaaaaaaacaguguaucuuaauucagaaaucuaauauguuuguccaugugaguuguguguuugcgguuuuuagaaaaauucaguuaaaauuacuauguuuugacuuacugagagcugccaaggaaauaccaggaauguuuuaauuuuacaguguugcauuaucauauucuugaaauuaauaaauucugcuuguuauauacaguacugagcaggauaucucccagaauugugaaaauaccuugggucacaccagucugacaaaggaaaaguguucaguaguugggcucuuggaggcauguaaucuggcugacuuugggaagcucccugcugcucggaaaaugucuguaaauuacuucccuuacaugauuagcuuauguaagaucacucuccauauguguaguagcuguuuuuauuucuaaaaaaugaggaugugauugguuuagagaaucauuaacucaaucccuguccugugugauggaagcugcaguggccaucaugugauugggcaggucuuggugccuaucaguguaaacacauggcacaaccugucccaugccccugcuuaucuccuuuggggagaagggguugagguauuuugagcaaaucucauugguaaacuuguguaugcauugcuuuuuuuuuuuuuaagaaccauuuccuuucaguuuuagccauauaacugugucugcaagcaguuuguacucaguuugucaagagagcagcuuucuguuuggauuauauaccuucaucucugaaaaaagacaugcuaguuaaauuucaagauguuuuacuuagaagaugacaaggaagaugaggugguuuguaaaggcucauuaaguaaaacucaagauguuuaccaugacaaguccccuccugguaucuuggugaguuacaucucccaaugucccugcucccuucgcugcuugcucaaucuggacacuacugagagacaaggggauggcauccaccaaaagaaaaagacuaaugcccuuucuuaggaaaauguaauguuguagugaauuuuauuaacuucuaaguguuauguugaacagaaaucuuuggcuaccugcccuccugcauuuacuaugccaucuuucugcuaucucuauucguuguuauuuaacaaaagacuuuuuuuuccuaggaaaaaaaugaaguugcuguuuuaaacugagaauuuuuaaaaauuauguuucaaaaauaauauauuugguuucacauucucuuugcauuuaaguguaguaguaaaaaucauauaaaaguguuacaguuuuuguuggccuagucauaauuuuuggaaugguaaacuaauauuuugaagcugacguuguauuuggauauaugagaguggcugcaguugcuuucuucugugaucauaaacaagaauuuuuguaagcuugaaguauguggggaaaauauaaauuguaugaacuucuuuaauccagaguuuucucucuuguuacaaaauauaacuuagaacaaguuauguaagcuuaguguaagucccagaaaucugcauuaaagaaacaaaaucaagugacuugaggacaguguaacucuaccuguggaagcuuuccuuuaaaaauaauaggaaggaaacacuauuuucaagguuauuuuuuaaaauuaaggauggauauuuuuaugaaaacaagcauaaaaucagugagacaaaaauuaguuucuaaaaucuguggcucauaacuugauuuuaguuuuaagguuauacaaauguuuauuaucuuuaaaaauguuaucacacucugcuuuuugcuuuuggaucuguuagugaaaguguacuuacucagaguucucaggaacuaauggaaagacgugguuugaauaugaauggaagagucaggugcuaccacgggggaggcaguuugcuuuugaaaucaacauuguaauauuauagaauguauacacauauuggcucacucacauuuguuguaaaggucagaagggagaauagagaaccuugcugacuuuuuacgaaauacuuuaaacauucauauauuaaguagcacuaacacacauaaacucucccucacaggaaguucuuaagacuugugucugcugguguuuuccagaaagaggucaagagguguuugcuuaggcugcauuuuauuaacggucccauuuuauguugccguuagaacauugaagucuaaugagucaccucccugucccaugagaagcaugaguuuucuuaaugcuaacguuugggauaaggaucugauaucugcuuaguagccuguaaugauuauauaggaguuugacuuuauaaccugggugugugugguuagagggagaacccugguuuucaggguccaggccuucugugaccugaacacuccuuacaaaucacauccuuucugggcaccccuuuuguaaggugacaguuucaguuuugaaagagucuuuccucaugguuuugugauuugggaauauaaauguaucauaucaugauuuggaaaaccaugagaagauuucugugcuuuguuagaaauugggaaauuucaaagaccauguuuucauauuuuuugaaacaagugaagacaauaccuuuauuugcuaaggaaaaagcuaaauuauuuuauauucaaauaaccugaagucccagaauaaucuacuggccauauuuucaccccauuuagggcagaauauacuacaggaguucuuagccaaacuuguaauccucagaaaugcuuauagaauuggagcuuuucugcaguuuagagcuggggggggacucuagaggucaccugaccauucuuguuagagagaacccccggcacagagcccagaccucuucuccagcggaagcgagacuugaucuugagucuucacauccucaccagcuucaggggacuccaggaagcccugagggcagugucccucaauucucaucucugugagcuauuuaucaaaggacaugggcaccucugguugaugccaaaaagcucaaccagauuuaauaacacaaacaguggucagagguggcaagucacccuguagguggggcacaugauacgaggcagcgugcaucaugcuaaguuaggaaaccuuaguccacccaggauuugggguggggcugagguuggugguggggaaccauaacacguugucauuacugauugcugcccagauuccuagaacaacuggaggugaacaagucuaaaacuaacuguguuccuccagucuagcauggccaguguucaaaaaaguaauuauuuaauugaguggaauuuuauuuccucauagaaauaauguugcuaugccugucucauaauuagccagagaacucaaccagaguucugaguccuagaacaagggggaagaagggcuaaugcaagaauuuccucuuucuuucuggauaagggccaaguuucgcuaaaauuuuugagacaaacauuuucugaguuccauuuucaagccauguuuuagcucccacucuccauagcuaguaacuuugggcuugaaaaugauaccuuuccucccuccuaacuccccuaaguuuuaggaguguuugugcucuugccacugagcugugaaugggugaugguuccuuaagcgcagcagaaguagcugcauuggaggaagaggauucuaguaaaccuacaggugugcuuugguaggcucacuagccaagugacagugugcacugaaaugaaaacucugaggccugcuaagaggauauauugagggaccauacaagauuacugguuaggcaguuugggggaguaaauucucugaaagucuuuguuuucaaagcaugcucgccacagaugaacucaggaauuugggggggaguaguuuugggacuguggacaugaauauguuucggcuauuugaaaauuauuuauuauucauuuuuauauuugugcccccaucuguuuucaguaaggaaggauuuagaaguaguuuacaauuaaaacauacaugcacacagacugccuccacacacacuguauauugcauagcuaagccuauuaauguagaggaaacaaaauugucuucauuuagcaaauauuuauuguacuacaacugaguccaguagaugcauguaaaucaauuuuuuuuuguuugccuccacuaauaugucggaauuuuuugcugcucuggguuuaugaauaacacagcugggcagauauccagcaaauggcuguaugaaugcuaccauguugaguuugccuggauacuugguccugauuacauacucagcauacucagugcguuagagugccuggugagcccuguuuuguagaugugauccagguguagucuucgugcauugggaaaacacaccuuaguuacaucacugugccuuuaggugucccaaaaagugaggcugcuggccuggccuagaggagauggacacaacucugaaaggaucuaaauaaaaaucucaguugggcaugguggcucacaccuguaauccugcacuuugggaggcccaggcagguagaucacuugaggccaggaagugaggcaggaaaggaacaggaacuacuacaccacccuucuucagcucuguucacugucaagaaaacaagaggguuugggagucauuccaccuaccugugguccugaggcacagcuugagaugugcuacauucugggaucauuuggaggcuuucaaaaguacuugcaguagaaucugcagaugggguggccugaucaugaggauuccccaagcaccucagugacugcaacgugcaccgggggugagaagugagccccaaggacgaugaugcccacaucugacucaucacugagugaaucccuguggagcuuucaaaagaaaauacagauuucccagacagacugaagcagaauugaaggcaguaguggaggccaagaauaacuguuuuguuuuguuuugaaaaugaaacuacagacuuuauucagauucuucuuacuaauguccuuuuucuguuccagagcccaaccuuaccuugaauuguccugucuccuuagucucuuccaaucgugacaguucuuuagucuuugcuucucaugaccuugauguuuugaugagcacuggucagauauuuuguugaauuugucucuacuucgguuugucugauguugucucauaauuagauugagguuguguguuuuuggucaaaauaccucaaaaguccuuuucagugagucauaccaggagucccugaggucagugugucuuaaguuuucccgaucacuugauuaugguggugucuuccagguuucucuacuauagaguuaaaauuuuuuccuuuuguaaugaauguguaucuuggggaaaauacuuugagaauauccagacaucuuguuuaucuuguuucuccuucaacuuuuuuuuuuauuuuuuauuuuuuaaaagacagagucuugcucugucgcccaggcuggagugcaguggcgcagucuuggcucacuucagccuccgccuccugacuucaagcaguucuccugccucagccuccugaguagcugggacuacaggugccaccacucccggcuucuuuuuguguuuuuaguagagaugguuucaucauguugaucaggcuggucuugaacucuugaccucaggugauccaccuuccuuggccucccaaagugcugggauuacagguguaaaccaccgagcccggccucuccucaaacuuugucuucuguuuuuaacauccauugauggaucuugccuuccauaaauaauacugugauauauuccaauagugaguuucuaguuucuucauuuuuucuucauuaauuauaauucaucuguaagagcugucauuucucacuuauauauuaauuuauucuaucagugaggacucaagaauauuuuauucagcuaauuguaaucuaguaauccuguuuuguugcucagauuguccuguguuuagcucuugggaguauacuccuguuuuuucucugacauacguuugcucuuuugauuuugagcauuucccagucucugacuccacgagaugcuccagcauuaucuuguauuuuccugcccacagccauggaaugaaucaaccacuuuuccaaggaacccugguuccuuuuauuggagaaugauauucagaaagcaagaucugagccauagauaugcacauuguuuugagaguauccuugauucuagguccucuuaacagagaguuaggauauuugaguguguuuucuagcucagguauaaacacaucagugcuugugcaucuaguuaccuguguauguacuuuaaaaccauggguucauaccgagaccuccaauuccaguccagcaccacaggguucauuuuagcuuccucucuaggaaguuuuauuuuuagaagcuuucccagguguuuaugauuuuuuuuuuuuuuuugacaaggucucacugccacccagucuggagugcaguguaggaggcaaccucugccucccaggcucaagcaguccuuucgccucagccuucuaaggagcuaggaccucagguacgugccaccacaccuggcuaauuuuuguauuuuuuuguggagacuguguuucuccauguugcccaggcuggucuugaacuccugggcucaagugaucugcccaccuuggccucccaaagugcugggaauacagacaugagccaccacacccagccccagcuguuugugauuaauuagucuuggggaacgaugacuuuuggauguauaucuguggauccaaaggcucuuacggcuuaguuaaguacucuuuguuaaugaacagucuguuccauggugaaguaucauuuuccauaacuggguuaaucaucauuucuucuuauacuaaaaagaauuuuuaugucacuccuagcuagcucucauuaguaaaguaaguccccuguuuugcgugggaagugguacaguuucauggccaguaugcuuauaaacauuugucagagaaauugagcacaccucaggaaauguuuaguggguugaaugcccagggaagcuguuaaacauuuuaaaaaacauguaaacaauccacgcagacaaaugacaggcuuacgauuccacuaaaaccaaauuuauuuuaguccuugaguuaucuucuuuuugauaaggcagccuacauucuuuuuuccacguguagcuugcuuucuaaagcaggugcucuaucagacuucuugauaagaaacccuucaaccccaguuacugagaguacugacugugaacuuugggccugcaugugcuuguuaauuuaguagcugccaccuuagcuacaggaguugcaaugguaguccaucuggcugguucuuacccucauuuacuaggauacaauaugguacagguugagagaccuucaccccagggcauuaacacaauuaggacacguaauuacuugacauuuuaaacuucccuaauuguguuaauguuaacugugauauuaacuaaaguucuuuaaugggugagagaggaugagaugggaaauaagggggaugagcaaaguuuaacauguccuucccuagacauagaaccuauaguaauauauuacuuuguuuccagucuggggcuguaauuuggauaguggaagaaucguacaaauuccugacuucuaggucaguguguaaauagaaaaaacuuccgauagaguuggaguguuucaaaguuggaguguuugaauuuuggauaaaauucaaaaaaauuguaucccaccaaugucagugauagucaacccugaaaauacugcacauggcuucuauagcaaccugcugaaauugugugccuuuuguauguggaauuaagccaaauaaucagauuuccuggcuuauuuuagaguugcuuaugguuaucaauagucgccaccaaaauagguuuacuacacaauucuuuuagaagguuuaggauaaggacauaccccuuaaaacacacuuuuauguucauaacguaaucguaucuguaagacuacucauaauaaaaggcuuggcuaggcguggaaucccagcacuuugggaggcagagguggguggaucaccugaggugaggaguucgagaccagcuugaccaacauggagaaaccccgucgcuacuaaaaauacaaaauuagcugggcaugguggcacgcgccuguagucccggcuacucgagaggcugaggcaggagaaucacuugaacccgggaggcagaaguugcagugagcugagauugcaccauugcacuccagccugggcagcaagaguaaaacuccaucucaaaaaaaaggcuuaagauuuuucauguaugguagcauauggaagaaucaucauagccuucuaaaagccuuuaugaaauuccuacccacacauagccugaaaauuccauaaauuuuuaggagcuguuuuagguuucagugaaacaagaauggguauuuaagauggacauaccagggcuuuugucuggucaugucucuggguaacugcuagacuauagauaaguugcuucucugggccucaguuuucuuauuaguacaaugaauauaacauuuaccucaccuaguugugaggauuaaaucagaugagguacguaaaauggcauuugggguuuaaacaauuuuuguuuguuuguuugagucaggaucuugcucuguugccuaggcuggagugcaguggcacaaacauggcucacacuacagccuucacuacccuggcucaggcauucccucccaccucagccuccggaguagcugggacuacaggcaugcgccaccacacccaacuacuuuuuaaaaaaauucucuguagagauggagucuccuuacauugcccaggcugcucuccaccuucugggcucaacuaauucuucugccuuggccucccagagugcugggauuacaagugugagccaacgcacgcagccuaaaauggcaauuggaagggguaaguuagugcccucuccacuuuuucccccaucaucucccuguaacuaacauuaggaagaauaaugaguaaaacaucugaauuacagcuuauguaauuuguugaggauauacaauguuuaaaaaguuaagaccaugagaaaaugaauuugaauuuucaccaguauagaggugaauuuacauuuuaagcaaaucccacaugugaaaauccaaacuuaaaaaacaguuacguuauuuuacaaaggaaggauuucucuaauaacaggcucccccaaggacacugaagauuccuuaaaaacaauaccaguagaagcccaggcgcgguggcucacgccuguuaaucccagcacuuugggagucugaggcgggcggaucgcgaggucaggagaucgagaccauccuggcuaacacggugaaaccccaucucuacuaaaaaauacaaaaaaauuagcugggcgugguggcaggcgcccguaaucccagcuacugaggaggcugaggaaggagaauggugugaaccugggaggcagauugcaccacugcacuccagccugggccacagagcaagacugcaucucaaaaaaacaaaacaaaacaacaacaacaacuaaacaauaccaguaaaaucaacuuuguaaaaagauaucuuagcaaucccguuuuaaaauauccaaauaaaaugaaauuauguucacacaaaugccuguacacaaauguuuauaguacagaaugagcaucccuaauccaaaaaucugaaauccaaaaugcucuaaaauccaaaacucucugaugccacaaguggaaaauuccacacuugcccuggugauaggucccagccaagaugcaguuaaagcuuuguuucgugugcaaaauuaauugaaaauauuuucuauaauuaccuucagccuauguguuuaagguguauaugaaacauaaaugaauuuuauguuuggacuugggucauuauguauaugcaaauauuccaaaaucugaaaauauccaaaauucaaaacauuucugguccugagcauuuuggauaagggggauacucaaccuguaguuuuauuuguaauugccgaaaccuggaaacaacccagauaucuucuagcuagugaauggauaaacauuugauacauccaugcagugggguacuacuuaacagggaacagacuacugauacaugcagcaguauugauuaaugucacguggacugugcuaagcuaaagaagccagaauccaaagguacauacuguaugguucuauuuauaugauauuccagagauggcaagacuagggacagaaagcagaucagugauuggcauggguggggaagagggauugacuccagauggguuugggcauuuuggagagcagucugauugaucuguaucuugauuauagugguggcuacagcaauguguggucacagcuaacaacuguacacuacaaaaggguuaauuuuccugccuguaaaguguaugcuuuuuuuuuuguuuuaagaaaaaucuauuuugaauaguucaagguacagcuauuuguaaucuuaaaacuucauagcuaaauuggcaugaacauuuagcuggaauuuuuucugugcugauagguauaaccauuacacaaagguuaacuuaaguaauaguuuaauaucuuucauuauuaauuauaaacagaauguugaacugauuacaguucuuaaugauuuuacuuauugcauuucucucuauuugccagucagguuaaauguucccuguaacagcaucugucaccucauguacagaggucaaaacugggcauauuuuagccuugaugggaacagacaagaauuaaauuaucagaaaguuucaugacaagguuuuauuuucauuuugggaaaugaagggagaagcauuaaagagaaaugugggaacaggaaccauuuaguuuuacagagcuaugauaguuugaaacaaguuuggccaugugaauguugucggggcugaggaagggaguuggggcccccuuuugagggugcugcuuaccguuuuaggaucuccuuaagccacacauguuauuuugaaauuuaacgauaaaauugaacacuaguuuuucuugcucuguaccagguucuauuucugaagaaaauuaauguucugguacauuauugagcacaggaaaauuaaacuauuguuuccagccauuuuccuuaaaggcugugcucuguagcauaauuauauugggcauuuucguaaaagucagcugacuaguagaagauggauaacuuugugguuguguuucacuuuguuuucuguaauaaugcaguuacggcacccuugccccugccucggcugacuucacacugacuuccucugaugaccagcagucucugccgcgaguugcugcugcgcugcucaguauucuccagaaugaucuacuuggcugucauuuguucucacggggauauuuuuagauuuacccauccugaggcggugucauuuuugucacugacauagacuagauuuaugcaaguuuuucucugugaggucuucagcagcuucuggaggaaaguauuggucugaacacaugggcauugcuuuugggacuuuggguuaacuuccaccauggauuucuuuucuuuguuuuuguuuuuuuguuuuguuuuguuuuugauauggaguuucacucugucgcccaggcuguaaugcaguggcgcgaucuuggcucacugcaaccuccaccuccuggguucaagcgauucucgugucucggccuccugaguagcugggauuacaggugcccaccaccaugccuggcuaauuuuuguguuuuuaguagagaguuucaccauguuggccaggcuggucucaaaccccugaccucaggugauccaccccccgccucggccucccaaagugcugggauuacagucgugagccaccgcacccagccuguuuuuuuuuuuuuuuuccagugcaugguuauauguaucuucacuuaccucuugaauuuuacucuaagucagugagauaaaacgcaacacuguguauauuucucccucuccuugcugauucuguucacuaggucuugcauucauucauucauuuauucauugguccauucauugauccaaaaccacuuauuaagaaccuacuauugcuaggcacugugccaagcuuucaggaagcagugaagcuugcgggacuuuucucuuccuuaccggaacucaagaguuugaagguagccuaaauguucaugccgcguggugggugcugugguagggagagggcagggggccuugggcacucacagcaacagaucccaucuugugaccucugcuuucuucucagccgcugagcccacacauccuccccuaucaucuuuuugaucuuugccuuugugcucuggggauucacaaucuguuguggauguacguuccuuuuugaucccacuuccuccuuacccagggaaccugaaacauccuugcuccucuuacgaaauaccagauuaagaugaaaacugguauuggcuuuugaagaauuguccagaaaauuauugggcugaugacugggguggguagaagaugggggcugguaauuuuugaagaugaaauaggugauguuuaugguccuuccuuaaguuauaccugcugaaaagcugaaguagacacugucguugaguaaaggucugggccgccacucggagagagggugcauugcuauacugggaaagcgucuucccuuuucugagcccuacucaguccaacaaagcaguucaucuguuuauagaaagugaguguguugaaaucaucauagugaagugaacucagugagcagaagucugagcuuucagauucccucaaaggaaauaacauggugacagauccaaaaauccuaauuuaaaacuuaucagcccugagaacuaagcuuaaggccagcuucauauuuucucauuuuuaaaaaauuaaaaauuuuuuucucaacagauuaaguuguuaaguagcauaaaguguuaucuggguuauguuugaagcauguucuugcuaguuuugccaggcugauauuugcaggaggguguuuuagggcuccagguggcuuuauccagucaggaucuagccugucugauuuaaguccucuguuggcaacauuggaaauggacucugaacaaccacgcaaagaaacuuaugacuggcucaucguucagagagaugccaagagggcaagagccagggccaccuggggugucaguguuccaagcuggugggccuucugcaucccaucucagguagcccagcccucccagucuuggguggccuuggcucuccauauacguuucaugaauaucuguuugggccagauguuucccaccccugucagccagcagauaccaagaccugggucccguauuauagacauggcuacugggggcccacccuuguguuucggugccucucugagcacugaaaucauugaaauccagggagcccuguuuuuaccuucagaucuagccauugcauuaugugucuguuuaaauucccaaacagaaauauugaaucagaaaauccccucuucuuacguaucccaaagguugauauugaguaauauuugguuguaauuguggaagggguccuuaggcaagcagucuucccaggccagaauuucugaguuuuuucacagaagcacugccaguucuagaauuuaaguaucauaaaacagucaggucagcugucauuaaaaugucuaaaauucuauuacuaucuauugcuuccacuucugauccacacuuaucagaccuugacaucuuuauacgacaggaugugaacuugagcccauaacaacuuagucuucauaacaaacuuaaucaggcuuaagaggagaaaguucuugcaacagagccuagaguuaguucccaaacuugggugucugucagaaucguggguaacagauuuuuaagaccucauuuccagcuuuuuauguaguaggucuggguugggguucaugagcguguauuuguuuuuaucccccuuucccguauuuuucaugaaugaaccuacauucuuaagcaccaaaacuugcuucuauugcaggcaguccaaggaccacucuuugagaaauacugaccuagagugugcuccuugccaguuuuccucauuuaguggggaaaaagaaguuagauauaaaaaccucccugacugcgacuucaaacaguggaggugaugggguugcucugauuuagaaagacagaguuugugaucuacggggaauugacuagaaccucagauccuccaaagcacaccucauccuggcuaaaucucauucucucaggagggaguccucugaggcccaacaccagcucagaacgauucaaaaacuccccuguacuuuuucucuguaaaagacaaaggacaggacaauucccaaggcucagagccuuuguguagucaguuuucuguugaacugauuuuggaaguagcacaaaguagcaagagcucuuacuuuuacauggaacuaugcuucccuaaccuggcucaucuucauaauuaguucuuaagcuuuaaaacagucagaaauuugcauuuuuuaaaaccacccagaaugauuuucauguacacaaacuuuugaagcagugugguaguaaguaguguucuuuaaguucaaccuugauaggaaguuccccaccaggucuacucuuuuuauuuccauaucucuaaguugguucaugcaacagucaucaagacuaacugauucucagcucccugugugugucucuucuaccauagagcugugcagucucuugccugaauuuguuguggugacuucuggaguagucucucugccuuuagcuaccucuucucuaguucauccucccccugugaccuaauccugucgcuucccugaacagaagaagcacugauugcacccauugcccacaugauaaacuugcacagggucaaaggccuuguggcaucucacucuugucccucaaacuuagcacacuuucccauaagcuguucucucugccugggacugcccacugggaaccuuccuuccuuaaucuguucagcccuuuacacauacuugcacuucuagaacaaauauuuucugcugcuugaagccuuaccuaacucucccaaguagauuuuuucucuuuuuguucucuagucuuccuaacagucucccaaauagcauuaucauaagggauuauauaagacaguauuuguuauaucucuuucaagaaccaagguccucugagagaggaugagggcagaauuuuguuuaucuucauaaggacuuacuguagugacuggcaugaaauaggugcuuaauuuugacugugugaaaacugaacuguaccagaaacaggccaguauaaugggcaucuuuuuuugugauuguuucugaguuaaaccuguaggaggauuacaucgagaggccuuucccggguaaggcuucuuccagauuuccuuuuucauugugaugaaaaagcugucuggauacucgguguauucaggaaguuugcugggaggcacuggguuuucguuuacagagucuguacagggacuaaaucguccuagaaaugaaggagaacacuuugaccagucgcccuacacugcuggggcagcaggagacccgcuguguucuugaggagacauuuggggcucuuucuccacugaaggucuaggagcggugaguguuagaggcucagcugucagcacuucucaugggccaucuuagcuucaggaagaccgcaugggcuuuaaugaaccaucuguuuugugcuccugggggguaggccagguuguucuugugcggcugcuauuuucuauuucuuguuuuauaaagugagaauuuaaagauagcuaauauaaaauaauacaaaacuaaagaaacaaauuggcauucuacuaugacggggaaaagaaauaaccaggaaguacaaaguaaggcauuugcuugaauuuaaaugucugagaacagcuucccucggaaaggcuggauuccccgucagggcuuggcgucgggagucuguggcccugcuuucaacuuacccuagacugcgcuguguuguauacucuuccuuucuucugucuagcuaaguuguaaccuccuuucguucuuuguaaucccuuagcaucuggugggcacacuguaaauguuuuguaaaauguugacucaguuaagcaccuacacgaugugggcaagccccugggggacugucacccccugcccucccugaccggggagaagcuugcggcagcugcugcguggguaccuuugcguuucaucacuuacuuuuggggggaaguuuuuaccauccagaaucccccccagauucauauuggccaccucuagguuacucugggauucuuugagaaaaccauagggauuuaguauaaccugaguucagcccucagauuuuuuuugcccucagggacaccacaugaccuugagacccaaugauuuaagccaugggucagagguaguggagaaaguugggacccugaguauagguagaacuggguucuagugaauaguagacaccucuuaucucaaucucaaauuuaaaaugaaauuaauaaugccugcuagcauaacccacauucucuuuuugaaaaucaaaugagguauguuugaggaaguucuugaaaaauauuacaugcuaaucaaaugcaaaccguaaucauggguguccugaaggaguuugguccaggagcacaggggcaagcuggaauguuuaccuacauccuagguaacaguguccuguugucuauuuccugaagcaucuggugucucucuucccuccuagcauacuccucauguccaugagcagaaaguuagcugcaauggcauguucuuugguaaaagcuguuuuaaccucuguccguaagccucaugacauguggcgcucccaggagucugcuuuguaacacuggaccaugguccagcgggaggguuaauaguaguggugugaggagacuuggaggguaaguauggcuucuuuggauucccuguaaucauuucaucuuuaaguagucaagucgcauuaaguaaaaaugauacucagauugcugaaagcagcccacuugcaguaagaaaucuggaggcuucaugaaggcuuuuaucauguuuacuuagagcauuucuguuacuuagagaugcaauuaagggcuuagguucuaggcucauacuugaguuugaauauuaacucugccacuuaauagugugcugaccuuggauauuucugaacccgaguuuccacauauaaaugggaauaccaaauccauggguaucugugaagacuacaugagauaacauacagguuaacauagcacuugacacaugagagacguguaacaaguuuaguuguguguucguugguaguaguacuaacaauacuaguaccgauuagauauuuggagauaaacuuaagaaacagauuuugaaacacuuaaaauagugguuuagaauguauccauuuugaggccagucgugguggcucacacuuguaaucucaacauuucgggaagccaaggcagguggauugcuugagcccaggaguucaagaccaaccugggcaacauggcaaaaccccgucucuacaaaaaaauacaagaauuagcugggcaugguagcacauuccuguagucccagcuucuccggaggccaaggugggagcaucgcuugagcccaggaggcugagguuacagugagcagagaucgcaccauugcaguccagccugggcaacacagugaaacccugucucaaaaugaaaauaaaaguaaauagaauguguccauuuugugcugauaauuuaugaauuuuuuuuauuguuuuuaaacuaccuuuuaucucugauuacucuuuuccuuaacaaaaguuauuuuugauugaacacaucaaauaauugaaauaauuuuaagcaguuuuuguaggagggggauugguauuugaaccuauuuacugaugcuuuuuuuuuuuuuuuuuugagauugggagucucacucugucacccaggcuggagugcaguggcacgaucucagcucacugcaaccucugccucccggguucaagcgauucuccugccucagccucccgaguagcuggggcuacaggcaugugucacgauacaggccaauuuuuuuguauuuuuaguagagaugggguuucaccauauuggccaggcuggucuugaacuccugaccucaagugaucuaccugccucggccucccaaagugcugggauuacaggcgugagccaccgcgccuggcccauuuuauuuauaaauccauacuccauauagugauuauucauuuuaguuucuuugaugcucagcaaaagaugcuaagcugaucuucaaacuuuuggugaauaacgaaaucuugaaagcuaccauucauuccaguguguguccuuuuauaccuuaaaauauuugauaagaaaaauaugauagugggcacugucaaauuuuaugcaugaaggacuaauuuggcguauugaauuuuauaugcgaagggccauuuggucucuaauaaguauuguaguugcuuauuuucuacugcuuuuuuuuuucuucacuuuuuuauuugaguaaucaauaaguacuucuuuuccuucggagcucccaauacuuaaucuagcccaugggaagguaccuaggccuaaacagcacacuguauauuacauacacuguguagcagucaggccacaucugagccauugugucuagcugucuuuaaauaucguuuuuaaagauggacauaaauaauugucauaagagucagaguagacccaaucaguucacauauuuuaaggaacaagaaugcuuagccuagaauagaagagacucugauaaauucuuugguguguugugguuucauuuggaagagcgugguaauauucagugugauuucuaguggacauaauaguucucugacauuuuuauggacuucuugguaaaguagugagucucugucaacuguaacgaucccaaaacugaaaugcagcauagcaugcgauguuuaagaagagacuugucuuagucagcuugggguacugcagcagaauaccauagaugguauuuggcuuaaacaacagacauuuauuucuuaccauucucacagaucaaagugccagccgauugggcucucuuccugguuugcagacuucuugcuguauucucacgaggaaaggaaagagagcguggucugggucucuuucuccucuuagaaggacacuaauccaucacauggaggcuccacccaugugaccucaucuaaaccuaauuacuucccaaaggcccugucuccaaauaccaucacauugggcgucagggcuucaauauaugaauuuggugguggugggggacagagggaggucauagauauuacuuaacuuuucuaacccucauuucuuuuuuuuuuuuuuuuuuuuuuugagacggagucuugcucugucacccaggcuugagugcaguggugugaucucggcucacugcacccuccgcuucccagguucaagugauucuccugccucagccucccaaguagcugggacuacaggcgcacgccaucacgcccggcuaauuuuuuguauuuuuaguaaagacgggccuucaccguguuggccaggcuggucuugaacuccugacuucaagugaucugcuugccucagccucucagagugcugggauuacaggcgugagccacuacacccagccuuaauugucuuuaaaaauagaaauaauaccaccucuaaaguaguucugagauaauaauguauaaguuuaagaauuugggauguuacgagcuuucaaaaaaagaguuguuuccagugugauuauuguuagaguauuucagagauguguuagaagcauuuuugguauuuguuaaaagaaugggcuggauguauucuucuuguuccaagaaucagcaagugcacuuuaauauuuuuauuuaugcccguaagccucaagauagggaugcugcucugugaccauuuuucauuuccacauuuugcuuuuugugugggcaucuccaaaugagccugccuuucugguuaaauauucugucuuugcuuuugcucuuuuuucucugugacuucuuguuuguuucuuucugcauggcucuccuuuggucucugucacucuccauuauuuauuuuguccucccacauuuucccucaucauucaugauaaaauaggaggaauaguuuauaguguguuauuuugcuauauuuuuuaaacauuuggguuacaucauuguguaucuuuucugcugcugguucagaguguggcuuucccagguguugaccaggacaggucugacuugguucuuauuguguagcuaugcugggcuagcauguaggaauaagguauauggcacuagauucugcuucaagagcaggcuguuuaacauaucccucaugccuaugacgaacaacugcauuuccuccagacguaacuaacggugaggaagccucuuuccccagcucuguuggggugacccuucuagcagacagcugcucaucauacccaggguguagcauguuaagcuacaggccucccuuuacuuuuguuuuaccagccuucacaauauaaaugucauuguuucauuaucugucaagagaaaaccaguuauuugacaaccuguauuuuucuacauuuagcaacuggcauuuacacauuagguuuucccauauaacagcacaucccuuaaccaugguaguuaaaauaaucuugaauagguacgguuacacuuaauuaugaauuuuaugcuguaguugauggaagcuuguuacacauuuauguuuauaagacuuguuuguggcugaaugucaaugcuuaaaaguuagcauuuuuuuguuuauuuuaagaaaaggucuaacauguuuuuuuuuucuuguaauaaaauucauuuuaacauugccaccaccauucaagcaguaauaccaagauugacugcuuggaugcuguuuaauucaugugugugccauguagguaaaaagcauguugugaauaugcauuaccuacagaauaugaaaaggaugcaugagaucuagcuguguuauuuuuuagaaccacaugugaaucuacagugaccucaaaauaggaauuuaauuauuaaaaacauaaugggauguuauaugaauauuuugaugaaacacuauuuccuccccacacuuuuuuuuuauguuucuuauuuuuuuagucucauuuauuacuaguucauuuguucauucauucaauaaaugauuauugagcacuugauacaugcuuaauuugguuuagcuauugaggucaaaucaauuauuccaaaaccaucaccagauuauaauuguuugauaucacauaaaggaugucaucuuauuuuguuauuuaggaguaaguuuugcagcacaagcguuuuccagcuuuucuaugggugcauuuaagggccuugguaacauuaguuuuaaaauauuuuaaaaauuucuuccaggguaaaauuaucauggcgaugcuucaugguguagaacugaugggccuugauuacacauucauccgcguguaggaacaggaaacaauuuagaaucagggcucugccguggccacucaucugugaagagcagagugaauuucugugcaggcagauauccuggaggccccugaguuuucccaagaagacagcauucuuucucccaguucaguuuuggacucacuuggcaacacagaacaugaucucugaaacuuuucagagcauggaccuuuaagcucaaggcagccuccaagcuggguguagagaaaccacgagcugcuuauggcagacagccuggagagcagucagucaguccugugguugggugaaaguuggccucugaauuagcuggagcauuggaggggcucuugguuacucucugucauuccaguccccagaauggcuuucacugaauugugcuuuggcauaauauuaggggugucagcaucuaaugaauaaaauguggggguguauucaguagcuggaaguaaaaucugacauuaggacugaagggggggauuugguuuuuauuaguggaaaaguuggggauggggccaaggcaauaaagccaccccuggcuuuagcuguacuuccucuccuuugagccuuucuggagaacuccuugcagaccuuuugauugugauuugaauagugaauugagguugaggaacaagaguaaaacccuuuucugugcuuugaacuuuguagaacuugauugcauguuccaguuaguuauauugagucauugaagggauuuuuccguagaaguaauguuauaaaugggcuaggcucaggcagacuugccagaguuuauuuaaucuagcauguguccgaaccauacuauucugguaauaauaguuccuuacaaaauguagcucucacuaauuuauuacauugguucuguuggaagaugaaucucugguuucucccggggaugauguuuguuuuuucuguuuggcugcuauggccaaaguggaugcaguagccgcagguuccaaagggucuugggcaggaggucaggguucuuuggugauucugugcugauccugaacuuuggggaaaaagucccuaauggcagucaguacuauccagguugcugagaaaggaaagggaaugccucaggcccuggcuggagcagccucucagauacaaaggagaauagucucgggagguccguguguggaaaugcguagaaacaaugguagcaugagacuguuagguugaaaauuaauaaggcuaaugauaugaaaucuggcauacaagugaguagugucauuuuuguuacgacuguuauuucuuugucaauagaucacaaauuuaguguuaacaucucaucuaauuuuuguuucuuguagucucaaaccaugaauuaugugggacagcuggcugggcaggugauugucacugugaaggaacucuacaagggcauuaaccaggccacccucucugggugcauugaugucaucgugguacagcagcaggauggcagcuaucaguguucaccuuuucacguucgguuuggaaagcugggaguccugagauccaaagagaaaguggugaguguccucaaggagaggaaaagucauccugagauucaaagagaaagugagugaguguccucaaggaguagaaaagucauccucuaugaauaaaucgcuauugugaguuuucuaggccuuuuuuuuuuuuuaaccugaaugauguugagacaauguuacgagaagucaaccuuuauguauugcuuuugaaguuacuuugaaaaccacaaagcucgacugcagaagucucuucaagggaaagggaaacugaaaauuauuauaauaaucuuacauguugcaacucagaaaagcaaaacagaaacuagaugggggaacuuagacauauuuagaaaaagaaaaauuuccuuuaccuuauauaguauuuuuaaauacuuaggcuaauaccuucauacuaauuguaaauggaauagguggguauaaucaagaacacacacacacacacacacacacacacacacacacacacacacauuuuugagucggagucucgcuuugcuguccaggcuggaguacagcggugugaucuuggcucacugcaaccuccgccucccagguucaagcgauucuccugccucagccucccaagugccugggauuacaggcacgugcaaccaugccccccuaauuuuuuguauuuuuaguagagacgggguuucaccuuguuggcuaggcuggucucgaacuccugaccucaagugauccaccggcuucggccucggccucccaaaguucugggauuacagguguagagccaccgcaccuggccauauuuuuuuuuuuaaaggaaauuaauuaaugccacauuuuguuuguuuugacaaagcuguaaaaacuuuuguaaucuaaauucuguuguugauaccaggacuuguccccauauuugacugaaaugcuaaccaacagaccauaggcugguugacuuuuguuuguuuuagggaagauucauucaggaagaagauauuuguguagguuuuucuuauccucuucagguuauggagcagcuggaaguuuugcuaguauaucugaugucaaucaaauuagaaaacagagcuaguaauaacacuuggcagguacacagauuucucuuucuauucuugccucgcaguaucuacuuaaauaacauagaaaggcuuugucaacauuuuaaagcacaacaaaagagccucaccauuuucuggcacagaccuaaaaguaugugguagaggaccacugguguaagucgaaaacauuuauuuucagcuuuuugcuauuuuauauagcugagcuuuaaauagaaauuucccucuauuuaauuaaacuuaaauguuauuuugagagugaaagaaaauggauuucacaaaacuagauauucuuuuucuuuuuuuccuccaggaaaaacaucucauuucuagguauuacaaaaucaguuuccacuggagaaccacauuucaggguagcagggcuuguguggucuggccucuguucagagucacccuuuagaaagcaaaagcaguugcaguuuacuuagggacuuagaaacuuuccauugcaaaacaguguuauuuagccauaguuuagguucucugaaauuuuuucuuucuuugugguaacaccaauaguacuuucagacuggaccuguucugggggaauuggcaacaaacugaaauuucccauuaguuguguauggaucuauuguaaaacugcugauaagguaucaucaucauuauuuuuuuuuuuugcugagauuguuuuuuaucacauuggaucagugucuggccuuucaaaauggaaccugaaggcagauguauuuauaagcauguaugcaucuguaaauggugaccaaguagauaaaacaccuuuuccugcuugcugugugccucuaauuuaggaaauaauacaauuccugugcaaaagcuacacaaucguuguguuacuaucuugucaaaacguugcauuuuuaauaggaauguacucaugagacacaggaaaagagaauuuuuuuccuccuacucccuuaguaucucagaaacccaaagaauauguuugggaggaaauuuggccauuugauuuaccaaaacagcuuuccugugagaaaacugaaaaacugugagaguaaaacugaaaucaugccuacuuugagauacacuggcaauuugcauuaacuauuugucuuauuuuaagucaguuuggguuagggaaagcuggccauugaugugaaaguaagaccccaaauuuucaaauacggguguaccuaugaagugaauuugaaaucaugaccaccuuaaaaccacuguuuagagagauguaguauaauaauuuucccacugccauugauacguaauuguuugguagaacagcaguacucccaguaaauuuaguaacuuaggaguuuacuuuuagaagguaaauguguacuugauauuuuaaaauuuauugauaucagaaaaagcugauuacuugauuauuuauaaaaguuuuuuuuucuuuuuucuguuuuuuuuuuuuguuguuuuuuuuuuuuuuuugagauggagucucgcuuugucgcccaagcuggagugcaguggggcgaucucugcucacugcaacuuccgccucccugauucaagcguuucuccugccucagccucccgaguagcugggauuauaggcgcgugcuaccacgccuggcugcuuuuuguguuuuuaguagagaugggguuucuccauguuggcuaggauuaccugaucucagguaauccacccgccuuggccucccaaagugcugggauuacaggugugagccaccacgccuggucagauuauuuaucaaaguuaaauaacccaguguauuaaaacuauuuucauugcugauaacagaaauuuacccucuacuagcuuaggcaaaaaagcuugcugucagaauucccuuuuucuuuccccaccucugcucucugcuuccacuucuguuuucucucuaauguaaaauggccaccaauaccuccaggcucacaaucuguuaacucaucaaucccaguggagagagagcuuccuacagaaguaucaguauuuagucucccugucaaaggaacggacauaucucugggaccaguuucuguagcugggaaagagauauauuuauuggcuuggacaacagcccaccucuacucccuaaagccacaccagaaauacagguugaguaucccuuaucugaaaugcuugggaccagagcauuuuggauuucauuuuuuucauuuuuuggaauauuuacacuauacuuacugguugagcaucccaaaucugaaaaucugacgucugaagugcuccagugagcauuaucuuugagugucauguaaaugcucaagaaguuucagauuuuugagcauuuuuagauuucagauuuuuggauuugagacacucagcuuguauaugauuugaaacaggaugaauagacucccaaaagacauuugagauauucuuacccaaagagugguaagcuaguucaaaagucuaguacaucgacuguuucucagagauaccaguuucauuucagcaucuuaguccuauauuauguucagcacaauuaagccacaguguaagaaguaagacuauauggaaaugagggguuauuuuuaaaacuguuuuacuagaauuucauacaucaaauuaguguccuuuuuaaaauaaucacguuggugggaagaauuuguuccaacuugguguucucucaaaauauuuuuaaaaccuuuguguuguuguugccugaagaguucacagcauauucuuuuaaguauugccaauauuagcauaauuugauguuagguuuaauuuuuggaaagaccaaacuccauuuaaagucacacaaagaugauaaguagucacauugagaaaugucauacuugaucucuaaaaguaagggcugugaaguguuaauuuuucugagauaguguaugaauaguuuagagucugaauuugcauguuaaagaagcauucuucuauuuucccagcuacacuguuuaaauggauagccuccaaaaaugaaauuaguugcucagauugucccaguuugacuguuaguguauguccuucaaguugaguuccuuugaaaugcucccaucaguuuuugaacccuuccuuccugguaccagaagguguuccagaagaagcuacuuucccugccucagcucuggcauuaauuauuuuacgccaguuccuuuuauugaagaauaguauuuacgaacaaagaucugcuuauuaggcgugcucguaacuccugagguaucauugcuucuaggcagcccaagcuggcagagccaggaaauggguggaugugugcacguguacacacacacacacacacacacacacacacacaccccugcaucuauauaugaaaaucaugagggcacacggguuccuccaauucccauccaccaucgcaggcuucuuucccccuccuuauuuauaauuuuuuucucuuucaacaggaaacaugguucugauuaucgucaguauaucugcuuaguuacucaauccuaggaaacacaaaauaguuucagaauugcuaacucaaaucucugugaauguauuaacuacugcacaauguuuguuuggaguaacauaucaaauaugucuuuagacuuauaauacaagucaaaauacuguuuccaagguaagguuaguuccauucuuccucacuucagugugguuauguuauucauacauaggagguuuuuuuguuuguuuuuguuuuguuuuguuuguuuuucuuuuugagagaguuucgcuuuuguugcccaggcuggagugcaauggcgugaucucggcucacugcagccuccgccuccuggguucaagcgauucuccugccucagccucccgaguagcugggauuacaggcgggcgccaccaugcccagccgauuuuguauuuuugguagaggcgggguuucaccauguuggucagguuggucucgaacucuugaccucaggugaccugcccaccuuggucucccaaaguacugggauuacaagcaugagccacugcacccggcccauacauaggaguuuuauaacaagcauuuugacaaaauauguugauaagguuuggauguccccuccaagucucauguugaaaugugaacuccaguguuagaggugagccuggugggagguguuuggaucaugggggcagaucccucauggauggcuuagcaccauccacuuggggaugaaugaguuuuugcugaguugacaagauccaauuguuuuaaaaguguguggcaccuuuguguggcacccccagucucuugcaccugcucucacuaugugacgugucugcccccacuucgccuuucaccgugaguaaagguuuccugaguccuccccagaaaccaagcagaugccaacgccgugcuuguacagccugcagaaccaugagccaguuaaaccucuuuucuuuauaaauugcccagccuuguguauuucuuuauagcaaacacaaaaauggcccaacgcauaugucuaccugaauuuuuuuuugacaugauauuacuuaucccaucguuucaccugguucuugggaaaauggaaccgccaucaucagugaccaaucacagcacugauugucaccuguuacuuacguagugaucugugggcagaagagcugucggugaaguuguacuugaugcaguugcucacagcucacauacugagguuccugaaacuuguguguaucugaaccgugugaggugaggccugccugugccauaacuuggaaagugugcaaauguuugacaauaauauuucccccauuuuaaauuugaaaaauaauuuuaaaauuuuuauauguuguaaaaauagauggugaaacacuuucuuucaauuccugguuguccaucucucccucugccagcuccauuuggcuucuuagggguuggguaggggcaaguagcaguguuucucagaggcuguaguucuaggaaccucaaaacuaugcuaaguuugacuugagaacucagaguucugguuuaguuuaacuugaaggaaagacuccuugaacauuaagucauacuuuguuucucccauagauugauauagaaaucaacggcagugcaguggaucuucacaugaaguugggugauaacggagaagcuuucuuuguugaggagacugaagaagaauauguaaguuugcauggguuacacccuccuuacacagugugcucaggccucugguacguggcccagacggaccguuuagcaguuuuuuaugguugauuguacagaggacuguuguuggcaagacaagcuuuaguuucauguugaagaacuaagcugucaaaaaggaacugaagggaugaggaauuuuucuccauacaaaguuucagggugcagggagcaugcugaaugcacauacuugcacuuuuucuaagggaaggcacaucacuuucuagcuuuaaugagcuuucuuacuuaguguugcuucugguucacauauugacuugaauacauucaguucugccugaguagggcauuucucuucuggcuauguguuuauccacaugugcccuuuggacugggacucauguuuaccauuuugguugggauauuacaucccucaccuugaguagucaggugaauuaauuuauuaugaucucaagagaguuaaauuaauuggccuauauccuuuuauaagugauuacauguuugacuucuucuagcaaacgagcaugauuuguuaaaauccccccuccccagcacacacauucuguauguacugauuugaacgcuaguuaacgacggauucuugauggauucaauguggaucuuuuuauuuauuuauuuauuaauaauagauuuuacauucucacuaaagaacucagaucacguaaugugcaucuuuuuaaaaauucuuucaaaggcaucaguacaucauucuucauaaagaauaaagucucaaauagcaaaacugauaagcaucaaguuauuaaggauacaggacuacuuuuuuggcuuugaagaugaacuuacaguuugauacaauaaauuuacaaagaaaauuauuaccaaaaaauacgauagcaaaaugagauuguuuaucauuuuuugauugagaaaccaacaacuuagguaccaguagguaaagcagcauugaaacacuaugauuuaugaaggggaagcuugaucagacuggugcuuuuucuaguuucuucauuacuuaucuuuguaauaccuuguuugcauuuacuuggccuaagcaacauuuuuccuuaucagagacagaggcaaagagcagaaugaaacauaauaaaugacaucugucaaaaaaaaaaaccacuuuuuguauguuucuuaaaauuauuuauaauucauaacacugaacuucuagaucagcaggcaccguaagcgagaggacuggguuauugauguuaaccucguuuucauggcuuauucugacaguuccgcuaaaaauuaugcucagcaaggacaacuuggaaaaugucaacuuuccagccuuuuucucccuauuccacauaugacuacauugaccagaguuuaucuuguguaguaugcuucuccuuaaaauaaaaaauuguuaauuuauccaacaaauguuggaauuacuacucuaugccacaugcuaugaauacaacaugccucuguuccucuagggguucgucauuuagaguaggauaaagaugaccaaaaacccaguuuguugccauuuauuugauuuuuuucucucagauuuuucucauuuaauuauaugucaucaacauucuuuucaagucuaguucuaaaccuaacucugugcuuuuaauagcugcacaguauuccauaguauggacauaccauaguuuguuuaaccauuuucuugcugguaggcguucagguuaucuucauccuacaaacauugcuauaauagaacuaagaaauaccaccagaaacaaaaagagcuuucaguaaguaaaauaaagaucauugaauuaaaaauccucaaagucagagaccacgaccucucaucuggguuucuuuuggacauucagaauaucuuauuacaauuucucuguaaguguguguuucuggugaacacagauuucuccuagcuaaaucaaacuuuagcuucaggguaauauguuuaucaaagcuaaguucaaaagcuuaauaaaaaaauaauuacagaaaccuauacauuuucagaacuauuguuuaaaagcuugaguauuuuaaauuauaugagguuaauuuuuuuguuguuuguuuugagauggagucucgcucuguugcccaggcuggagugcaguggcaugaucucggcucacuacaaccucccccucagguccaagcaauucuucugccucagccuccugaguagcugggauuacaggcaugcaucaccaggcccagcuaauuuuguauuuuuaguagagacaggguuucaccauguuagccaggcuggucucaaacuccugaccucaggugauccgccugccucugccucccaaagugcugggauugcaggcgugagccaccacguucugccugaaguuaauuuuuaucucuauuauguaccuuccauuuccucugaugauacaaaaaggaaugaaacaaauggcuaagacaugaauuuacugaacaccagacuugaucguuuauuuaguauuaggaguuugacugcuucuaaauauugggccuuauuuucuucuuuugaauuccuacaggaaggaauauuucuuauuuuuaaacauaaaugcuuuaugguuuaaaaauuuacuaaugucauuuguuacacgguauugucucuaauugccuuucuccaauuaauuuggcaaaacauaagcauuggccgcucuguaucacugcauccucgcgucacucaccuguccugcugcccuuugucugauguaguguccuuaaucucugccuucugcuuuuuccuguucugaauguucugugugaguucuugagagaguccuuuguaacaccuccugagauuuuuguugcugcuuugaucuuugcuuugugaagaauuuaauaggcuuagcuuuaauuauggcuuugggguguuccaugcugacuuggcaugucaguuccuucagauggacucaguuacauguacccaagugggcugguacuuagcugccucacaggggaaagaccucgucagaguauaguaggcagugccuuaguucagugggacuuucuugccuuuagggaauauguauuuuuuuuuuuuuuaccauggugaaaauuuauauauucaaaauauuacugcuuuaauucacugucgaguuugucauggauaacuuuucuuucuccauucuccucaaggaaaagcuuccugcuuaccuugccaccucaccaauuccuacugaagaucaguucuuuaaagauauugacaccccuuuggugaaaucggguggagaugaaacaccaucucagaguucagacaucucacacgucuuggaaacagagacaauuuuuacuccaaguucugugaaaaagaaaaaacgaaggagaaagaaauacaaacaggacaguaagaaggaagagcaggccgcaucugcugcugcagaagacacaugugauguaggcgugagcuccgaugaugacaagggggcccaggcagcacgguaggacucucagccugggaagggucuugugcggguaccuagaguucaugugaagccaggagcugccaguuuuuuuauggauacacagugugagguuugggcuuguuuucccccuuuacaguuuauuguggaaucaagcagcaaaggcaguuucuuuguuccuuucaacuauucuauaaauaugcuacugaaaugucauuuguagcagacugguuguguuucuuuucauaaagaaguuuccaggagccaaauaaguucuaagucaaaagaucugaauuagugauuugccccucggugagcagauccaguuggacaccaugucaucucugggauuucccuacccaguggccuuaggcuugguauguuuuuccugaggaguugaguuuuguuuuauuggaauugaaaaggaaugauuuuuauuuuuuuacaugagcagucuugaucgcugcuuauuuaccugcucuguagaagagcucauuauaugccauuuuucaugucagcaccgcuugggguugaaagguagcaguugggaguagaacacguuuucuuauucaagauuccguuuucuuccaccuguugcacucaguggccaccuuggcacuaggaccgugguggggauucucuuuauuggugacgacuggacaagaagcugcugcccaugaguggcccugcauuuccagacucuuuauuuguggcgggagcugcugguccacuuguguguuuucaccccaucugucgaaaagaggucacacccuacuuccuggaaaacagugauguucaaguguuuuucauccuagaauagagggaaauaauuucuuucacuagcuauggaaaccaaauauauaucaagaguaaacccuagcucaaucugguauguguuuuauuugccaaucuuuuguuuuaaauggucaaaccaggaaaaaaauaugcuuuguuuuguuuuguuuuuuaauugagacagguucucccuguguugcccaggcuggagugcaguggugcaaucauagcucacuguaacauugaacucccgaacucaagcaguccucccaccucagccucccaaguagcuaggacuguaugugcuuaccccuacacccagcuaguuuuuaaaaauuuucuguagaguugaggucuugcuauguugcccaggcuggucucaaauuccuggccucaagcaacucucccgccucagccucccaaagugcuaagauuacaggcaugaaccacugagcccagcaaaaaguguuaauuaauguaguauuaguauauuauaauuauacugcauuaaugaauaacauaguauaauccuuuuuuguaaaacaauucauuuuccaaaauuuugaaaucuagauuuuaaaucuuagaauuaaacaucuauauuugauaguaauuuuuuacaauucgauauuauaaguaacauagccauuuuuaauacaugaaauuuuuuucuacuccucuuguuuuauugcucacuagcugucaugucugugguguucugucuuacuccucccacgcugaauauguaacacuuugauuucaguucugauagaaugcagaauuucuccaauagaacuaaacaacaaaagauggaaagcaauaguggaaaaguauguuaagcucuacaaaccagaguacacuauauuuacaaaauuuuaaaauccugaaugaaucaauaaauuuagguaauuuuuuuugucagugucaaaauacuagcugagaagaguuucaucauaaauguucugaacucuacuuuuaaauaucauugauucccaaagaaauuuaagcugauaaaaaguaccagaauuucuuaaaaagagacucuuccuguccuuuuccuuccuucauucagucuuuuaaagguuauuuguccuucucuucacuaggagaauaaaguaugagauuuuuuacuuuucuacugcuugacuucaggaauauuaaaaacauuauuaaaaggccgggcacgguagcccaugccuguaaucccagcacuuugggaggccaaggcgggaggaucaccugaggucaggaguuggagaccagccuggccaacauggugaaacuccaucucuacuaaaaauacagaaauuagcugggugugguggcaggcuaauuacucaggaggcugaggcaggagaaucacuugaaccugggaggcggagguuacagugagccaagaucacaccacugcccuccagcccaggugacagagcaagacucugucuuuaaaaaaaaaaaaaaaauuauaaacaauuuccuuuaaaaguuuugucuuaugcauacuaaaauguguaggugggcaagaaacguauucuuuugagaaaaacuugaaaugcuuacacaucuuaaguuuuauuaggaucagccuuguaaugcucccagaagugcuucguuccugaaaauauuuuuaccaacuaaaauucuuccaagaucuaccaaaaagagcacugaaguaaugcuuuugucuuagaauuuuguugaccuguguccuuugucagacauaauagagcaacauuuagaauuccugaacaaccuacagcuugggaaauuaaaacaauuucuaaaacauaugccaaguucccuacuaaauuguacaagaaucauuauucuaaaggaauuugcaaacgaauguuguaagccaauugcagaaauauuaguacauaccuuguuuuuccugauggugugaaaggcuguauccacuguguacugauguguuugacagguaugaauggcugccagccuaucucuaagccagcagcuugcuggcuugguaagcaggcaugucacaacacacguaagcuagggccuugcagucguuuucaggagguugguguuuugcuuuuucuuuagguuaccauggaauaauugaugcugccaccuggaggagcucuuccaugaaauuuccuuaaaauagaaucugcuuaaauaauauagccaacagaaauuaggacuuuaaaaaaagaaaacaaaauguaaacaucugugaaaauucagguuguuuucugaaauaagcacugagcuaaaagguagacagacugggcccauuauagauuguagaacaguagccucuucaucgcucagggcguugguuucuuaaucuauaaagugagagggucgaaggggccuuuaaaaggccccuuucagcucagcaccuagacucugacauuauuugagggaagcuauuuacggucauuaacagcauaugaaacaacguguucaaaaucuaagagaaaaagaaaaggaaaucaauugcuuuugcaguugugaggacuaggaauuacguggcguugcggaauuugcagcuuuccuauagcauauucuccucagcuccuaccacuuagaaaagaaauuauuuuuccagagaagauaaaugcauaaaauagguuucuguuuuguuuugacaaauggcauuucguuuaaauucuuuacuuuucaagaauuuuguugauaauagaauuaagguuaauugaggcuccuugaaggaggcagauggaagagggaaucauucuuuaaagcagauugcuauagcacagcuggaagaaacucauuucuggaaaucggagagcuuuaaacuauacacggcuuuaaaaaacuguaccuaguaagucucccucccuuccuaaagaugggcguugggcuuaaauauaacauagaagccuuguuuguccuucuagaggauggauggaugucuuugugugagagagagauuaaaaacauugcaccuaggcauauguagccuuuuggagggaagagacucugcauauuggaugguguucuagcauaaucuugagugcaaauauaugaaacaugccaccgauggaaauauuucaaauacccagcaauagcaaaaauggaggcucaauaucacaccaucagaaaggagucucaacuuuuaauccacuaaagcagacuuacuuaaaagugauaucugggagcuaaauccagggagccuaagacuuuucacagauagcaccuacugcucugaugaucugcauacuucaucuccugaucgguaauuggcuucuagagaacccuccauguucuucuggggugaguguagacacucagggugacauggaucuuacagaugcucccugccuuuucucuccuucguuucugacacagaacacagagagaaguauugcagggcuccauaugucuuacgggaaaugcucuguauccaaaugccagcugagaucauuagccacgcugaaauucguugacucguacugugcuaagguugcugcuagacguuguuaacagaguuaguggucuuugguuauggugguuagcagccccacuuaucuguuccauacuaccagugaauaguuuaaaauucauguugcaccuauaauuuaucccacauaaauaauucaggcuauuuauuuuggcauucaauugauuuuuuucucacuuuaaaaaacugagguauggagacuggugcuagcaacacgggauuggcuaacgcauccucuugcuguucccgguguuugggccuugccugugacagugggaaaaaaaauggccuugcugugcuacaaccggagcugcggucagcgcuucgauccugagaccaauuccgacgaugcuugcacauaucacccaggcguuccagucuuucacgaugcauuaaaggguuggucuugcuguaagagaagaacaacugauuuuucugauuucuuaagcauuguaggcuguacaaaagguagacauaauagugagaagccaccugagccagucaaaccugaggucaagacuacugaggagaaggaacuaucugaauuaaaaccaaaauuucaggaacacauucaagccccuaagacaguagacgcgauaaaaagaccaagcccagaugaaccaaugacaaauuuggaauuaaaaauaucugccucccuaaaacaagcacuugauaaacuuaaacugucaucagggaaugaagaaaauaagaaaagaagacaaugaugaaauuaagauugggaccucauguaagaauggaggguguucaaagacauaucggggucuagagagucuagaagaagucuguguauaucauucuggaguaccuauuuuccaugaggggacgaaauacuggagcuguuguagaagaaaaacuucugauuuuaauacauucuuagaccaagagggcuguacaaaagagaaacauguggacuaaaaaagaugcugggaaaaaaguuguuccauguagacaugacuggcaucagacuggaggugaaguuaccauuucaguauaggcuaaaaauucacuuccagaacuuagucgaguagaagcaaauagcacauuguuagaugcgcauauuguauuugaaggagagaaggaauuugaucaaaaugugaaauuauggggugugauugauguaaagcgaaguuauuaacuaugacugcaacaaagauugaaaucacuaugagaaaagcugaaccgaugcagugggcaagccuugaacugccugcagcuaaaaagcaggaaaaacaaaaagacgacacagcagauugagugggagaugggaggaaggcuauuacguauuucagaauuuuuaauacugugugaagugguggcuugcugcugucaucuuuuguuuuguuguuguguuacugaauguggcauuucaggguuaacauuagguucuuaaaagccaaagucaguuuaucuuuuugugccucucaucuuucuuucguguuauguaagauugauuauucguuucucccuacugguaggaaccauaguuguguccuguacuugaagaggcugaaaaauagcccauaaccauaauugcaguauuucuuuguauuucucuguuaagcaaagaaauauuaaggaacuuuuuuuaugucuuuguauuauuccauaauuaguaaagcuaauugugaauguccaauuuuaaugaaauguccaauuuuaaucaguuuuuuucauggauuuguguucuuacgguacuugaaaauauuuaaggaagagaugaagcucugcaguuuuuucuaugugggaugauugcuuuuuuaaggaggauuaauucugagguaguauaguaaguaaaggggaauauaugaauuguuaacaaauuaggauuuguuuacaacuacuugaauuuuuaaauuaugucaaaacuuacauuacuugccaagcaguaugauguaagaguauaggaaacauaaauaagaauacagagguaucaauuugauuaaaauucaccauuuuauaagacuaagcaauaaucuuaaaaaccucuuuccugaauauuuaaauguguuuguaugguguuaugacuaauuguuacugauuuacagacuaagcccucuuaaaaccuuuaguuaaauauaaaaagaaauuauauauaucuugccucccugauggaaaacuauguaaaauuguagacuuaaaagguuuguggaggccgggcgcgguggcucaugccuguaaucccagcacuuugggaggccgaggcgggcagaucacgaggucaggagaucgagaccauccuggcuaacacggugaaaccccgucucuacuagaaauacaaaaauuagcugggcguaguggugggugccuguagucccagcuacucaggaggcugaggcaggagaauggcgugaaccuaagaggcggagcuggcagugagcugagauugcgccacugcacuccagccugggcgacagagccagacuccgacucaaaaaaaaaaaaaaaaaaaaaaaaaaaaaaaaaaaaguuuguggaaauacauuaggauaucagaaaacuaaauauauggaguugcuuuaugacuauuacauguuaaauaaaauagcuuguuuuggaguuuuuuuuuuuaaagucaugaagagcuucacaauucuagugauacaguguugauuauauauugugcuuuauuuauuuuaaauauagguaacacagaauuagaucguuuggauagguuuugaugcagugcagagcuuaagaagaaaaauuaggaaauauucugaaggccagaacucuggaagaacuuagaaaguuugggaauaaauuaaacuuacauagauuuaaaauuaaaagggguuuauuucccaaaccccuugagucuuuucuuuuccuuggcauuugcggaauucuuacaaagaaaaauuuacagaaguacuauuuucguuaauaaagcauauauaucauucuacuaccauuagcaaauaacuuaguuguaguuaauauaauuguuaaaagguuuagcucuguuacaaauaaaaacaaaaagaucuggcaaccagacucaugauguuacacuaccaugacaagaaacucugggcagugaaaguuggacccacauggaguacauaaacaucugauacugggagauguauuuaaaauuuuucaaguuauauuccaugauuuaggaaccauuuagagacaugaagucuuuauggguugggggaaagguugauacuuaguuugauuaaagguaaugauuaauaugccuuuuuguuaauacuucuuucugaggcugucuuccccuaaacaguaucuuaaucuguuaaauguaauugaaauauuauuugaagcagugaguuauuguaaccucagauuaguuacauugaucaaaacauugauuuauacacacacacacacacacacacacacacacgcagcuuuuauauuuagucugguuacauuagugaccaugguauuuccuuucuuacuucuuaaggagccuuugaauuucuuguccagauaaaaaucugaauaauauuuaucuuagacucauacauaaagggacacaguuaccguuagguagcauauguuuuacuaucgguuugucaaaaaaguuaauaaaaaaugcuuauugauuuguuucucuaaaaaacaaaacagaaaaaaaacugagguauaauuuacauacagcaauauucacagaccguaagugugcaguucagugcauuuuggcagucauauacauccauguaaccuccguuagcuuuugaauuggaaaaauguuaggcuuagaaaaugaugcggaauuugaaagaugugauguuguagcacaucugugagggcuggagugcccuguucacacuggcugugaaccucagccuccgagcccccagcccugacugaaagucaccguuuacaucuuuugcucaguucugauguauuagcaaaacagaaucagugcuugugcuguuuucuucacauucuacuguguacgcuccacuauagccucacgucacgugcuuaguuuguuacucugucaugguuugccuugcaggucccuguucuaaggcauaccugccauuuugaaaguuccuaaaagguuucuggaauuucuauuuuaauaaaggaaucuuaggacugaaagggaucucagcauaaaucuuuucugucacuguagugggccuagacuaaugggcuguauuuuugucaggauaugaccaaaaaaggccaccucuugucuuccuggggcugugaauucaggugguaccugaucgcuuuuucaauauuuuacuaaauccuguuugcuuugcugaauucuucuuggcuuaccuuuuauacugcagugaaauaugucccaaaaguaaaauauuuguaauauaaaaauuccgguuagaaauuugugugacuuuuacauuguucuuuucagaccacuuucacguauggauagugaugggucaagcugauguguccuuucagagugggcaaauaaagaccauucacaaaccugauuuucccuuucucaggggaaaauuugccuuuugauauuccuuuauugagaaauagaguacuuuuuccuagaugucuuucucagguauauguuuucuccccuucaaugagugguaugccagaguaaggcccuagagaaagaagaccagaguuaggaaaaccuuaaauuaaaagauuaagcuauguggaaaaacuauuacaugucagaguuagugguaaauaagaguauguuaaguuaagauauaaaggaagaagaguaauauuaaaaaagaaccugguuuucuaucccuguguuuaguccagcaaacuaagugauguggauauucucauuuacauuuauuaucuguccuauuagaacauugaauuuucuauaagaagccuuuaaacuuguauaauauggcgcuuuaugcuuugcagaguuuuguuuguuuuugggauggagucucucucugucaccuaggcuggagugcaguggugcgaucuccgcucacugcaaccucugccuccuggguucaagcaguucucugccuuagccucccaaguagcugggauuacaggugcccgccaccacacccggcuaauuuuuguauuuuuaguagagacaggguuucaccaucuuggccaggcuggucuugaaccccugaccucgugauccacccgccucggccuuccgaagugcugggaugacaggcaugagccacuguaccuggccagagucuuucuuugugcuuuucuuuuuacuuuucagagauuucaacaugcuacaccauguaacucucacauugacucugaaguagacaggacaaaugauaaauuuccaaguaaagaugaaaacgggggcccacagugcuucugagggauguuuucaagguuauauggcaagguaguuauaguaacugaaaaucugagaaaccaacaaguaaauugauuaaaaucuuaucagcaguaguguaacccccuacccaagguccuuuuaugaaucuuaaaagcauuugucauuuuugguaucaucuucacaucuccacaucuuguagauuccaaguaaaggaaaccuucucagauaauccuugggccaaacaaagaagaaaauuagucccaagguuuuaagagguuaggguauuguuaaaauuuugagccauagaucuuguuugucuucagcuaauauacauuuucaaauguauucaguagaaaggggagagcaguggaaagaauaagggcuuacuuguuuugaauccaacuacuuccuaucuuuuugacuuugagcaaguuacuaaauuucucuggauccuugauuacuuaaaaucuacaaugaaauauuaccucauuuuguaaggauugaaugaaauagacauaaagccuuaguuuucuuuuagccuuugaaucacccuuaagggauggaaaaaagagaaaucacauuucucuuuuguccucccccuauuuauuccauaugugaauagugauugugguguuuuauaguggguggcauugguguauccccccuucuccuucauauauuuuagagagaguuaguaaucauuugccccucuucauuuugauuguuuguaguaucaguagguuugggggauauuuuaaagcugacaagaaugucaucguuccugccuuucuuugguuucuccuucacagaggaucuucaaaugcuuccuugaaagaagaagaauguaaagagccuuugcucuuccauucuggggaucauuaccccuuaucugauggagauugguccccuuuagagacguaaguaucuuugaaauuucuugguuucuugaaagaggaaggagauguauuaauuagcuuuucuguuaaucuguaguaaugauauuucccauuucucucacacagccaaggaacugaauguuuacuuguaacauaaauaugaaucuuuucucucaauaauuauuuuguuucuaaauuugaucugacuuacucuaacaguguuggccaguuguagaucuguauaaucagcauggaauuuagccaucuacaguuauuuuuuuucuuuuucuuuuuaguagagacaaggucucgcucuguuuucccagccuggagugcaguggcacacucauagcucacugcagccuuaaaccccugggcucgagugauccucccaccucagccuccugagugacugggacuacaggcacgcaccacugugcucagcuaaguuuuaaauuuuuuuguagagacagagucucgcuauuuugcccaggcuauucuugaacuccuggccucaggugauccucucgccuuggccucccaaagcacugggauuacagacaugagacauugugcccacucaucugcaauucuuaaaaauucucaucuuuuagugucaacuguuggcuguaaaugaauaauauagugaaaaaaaguauagucauaacuguuuauucugcaaucagauucucagguguuauguuaauuugccugcuuuuccuuuccuacaaaauuaucuucuuucucauugauuucuugugaaaagcaaaugagauuaugaaucuacaguguuuguuuacaaaggaccugguaaguccucuuaaauacuaguuggugucauuuuuauuauuauuauuaaagaacucaaguggaagaaauaauugaugcucccuuccauagaguuuuuauauaugcaggauaaagucaagauauucagauuuguuucuuuuaaucugucaggcucagcaagacugaagguuucccgacuuucaagucaucgugugucuuuguucucuuugcagcaccuauccccagacagcguguccuaagagugauucagagcuggaggugaaaccugcggagagccugcucagaucagagucucacauggaguggacguggggcggauucccagaguccaccaagguacuaggguuuacuugccuguggaaaguguguuaaugauuaaacaagugacgaauuccucugcccauaaguaaaggaggcaauuucugacugagcucucaugaauguaaaugauagugcccucaugucauaaaaguaaauucaaaguuaacauuuuuuguaacauuuggacuauauauuugcaaccgaaggauuucaguaguauuuuguguauauuucuauuuacugaauaauaaugauuguuaauuauuauaaggacauuuuaaaaggcaucuuaaacugaaauuuucacacugaauuuuuauuuuuuauuuuuuggagacagaguucuugcucugucacccaugcuggagagcaguggugcagccacaacucacugcagccuuaaccuccugugcucagguaauucucccacaccagacuuucaaguagcugagacugcaggugugugcuaccacacccaguuaauuuuuuaguuuuuauuuuuuguagagacaaggucucgcuauaucagcuuggccugaucgcaaacuccugggcucaagagauccuccugccuuggccucccagagugcugggauuacaggcgugagcugccauccccagccaacacugaaauuuuaaacaagaaauuguuaaaccuuuuuuuccagcucauaaugaaagaagaaagaacugagaagauaaauuucuugagagagaaaauguuuagaucuucuguugaauuuagguuuuuaaaauauacauuuugcauauauuugugaucgaauuuagacuugccacuuuuacacuguuuuaacagagccuugaugugguccaaggagggugaaauuuucauuuaguuuucucccccaaaaugaguauuuucuacuucuuaguaacugaaaauugucaguuuccucagucuucuccaguauaacuucacaguagaacauuuaacguacaccuuuuuuuuugagauaaagucuugcucugucaccuaggcuggaaugcaguggugccaucucggcucacugcaaccuccaucuccuggguucaagaaauuaucuugccucagccucccgaguagcugagauuacaggcgccugccaccaugcccggcuaauuuuuguauuuuuaguagagacaggguuucauccuguuggccaggcuaaucucgaacuccugaccucaagugaucugcccaccuuggccucccaaagugcugggauuauaggcgugagccacugugcccggccagaacauuuauaaguaucaugauauugaacaaaaggcaauuauuaguuuuucucacuuuauuauggaauuuuuacauguacaaacuaagauacuuaaugaauguguuaaguuaaaaauagaaugaacacauugccagcuuaggaaauagauuauaacaaauacucugaaaguaguuuaauuuuuaaacaauuuaacuuuuuuaggucagcaaaagagaacgaucugaccaucauccuaggacagcuacaauuacaccaucagaaaauacucauuuucggguaauucccagugaggacaaccucaucagugaaguugagaaggaugcuuccauggaagacacugucuguaccauagugaagcccaaacccagagcccuggguacacagaugagcgacccaacaucuguggcagagcuucucgaaccuccucuugagaguacucagauuucaucuauguuagaugcugaccaccuucccaacgcagccuuagcggaggcgcccucagaauccaaaccggcagcuaaaguagacucgccgucaaagaagaaagguaaucguuuguuuaauuuggcuccagguacucucaaauuagaugguaaauuauuucaguguuccacauaacgugauggcugccucuguauuuguauucaccagucgaaacccgucgcacuuuuuuuuuuuuuuuuuuuuuuuuuuuagcuggaguuucgcucuuguuacccaggcuggagugcaauugugugaucucggcuaacugcaacuuccgccucccggguucaagcaauucuccugccucagccuucugaguagcugggguuacaggcacacaccaccauccccggcugauuuuuuguauuuuuaauagagauggcauuucaccauguuggccaggcuggucucaaacuccugaccucaggugaucugcccaccucggccucccaaagugcugggauuacaggugugagccaccgugcccaggcccgucacucacuuucuuacaauugcuuuccauggcgucccccuggaaaguccaguuggagcagggccugacuugcacacugcugucucuugacuguugcuacucaguggguucuugagaagcauuuacugagaaaacaaauaaugaguuguaaucaauugaugaguaaaauuaaccacuuuauugauaagguaugucaguaaagugaaguagaaucuuaaaaaauuagaauagagaaaaaauguuuucacuugaaacaucuuagcugaggcuaaauuagguagguuuuuuagcaguaauaucagauaaaaaucaaugcauacuaauuaugauuaugaguaugugcuuucuuuugcugauuauuucccucuaaaauagguagaaggcuaggugcaguggcucacaccuguaaucccaguacuuaggaagcugagguggacagaucacuugagcucaggauuucgagaucagccugggcaacauagugaaacccugucucuaucaaacauaaaaaacugagccuggcaugguggcguucaucuguggucccagcuacuugggaggcugaggugggaagaucgcuugagcccuggggcagagguugcaaugagccaagaugaagccacuccauuccagccugggugauagagugagacccugucucaaaaauaauaagaaaaaauaaaaauuaccuuaagaaguuauucuaaucaccugagcccagggaggucacgacugcagugagcugugauugcaccacugcacucuaacccaugugacagagugagacccugucucaaaauaaguagagaaaacauccaacucuugguucaacaguucuuccucacuuuuggaacacaaguuuaauaaaucagaacauccuuacuauuugaaaauaaaaagccaaccaucgauacuugguacagugggucagaacauacauauucugaacucuggccuuggauccuauuuuuaggaaagugugaaaccuucucuaaaauuacccaacaucauauauagccaauuaccuauuucaauuaaaaaaaaauucuagcaccaaagauuagguaauuauaaaccaacuuaauauauauuagguauggaccuucaaguucacucagaaauaauuuaucuaaaaugaaagaaugugacugucgaagguguugguggucagauaaaaccaucuagcgaaugguggcuuaacuuggcaccugcucuuccaccaaaggccuguagccacuuguuaugcucuaagaaauguuaaggggggaaauccaguucuuuuaggaugaaugcuuuguuuuuggaacuaaugacuccuguucuuagcacacagugcaggaucugacuagagacaggaacccugagugguuuuuacuauucuuuuggccucauucuuuuuccccucuacuuuuuauuauacauuuuugcccucccucucuccucaaccccucucucccuacaucucuccauucauccacauacaguguuuuauuaauaaaacauuugaaaacaaauugcaggcaugacauuucacucuuagauaugccaggauauaccuucuaagaaugugaacauucucugcauagccccaguacuauugucaucuugaagaauucauguuuacauuucccuaauuguaccaagaauauuuuuuuagcuggccuguuucccaagccaaaauugcaucagguuucacauguugcauuugauuuuuauguuucuuguaaucuuuuuuauuuuagaacucucucuccuacacccauccacacccucaugcccucucuacacccgugauaguaaccuuuuaaagagcucagccagugucuucuaggcucucucacguucuggauuugucugauuguuuuuuugaaggugacauuccuauauuuucuuaacugggaguuagcucuagaacuuacuguccacuagaaauggaauaugaaucacauguguaauuuugaaucaucucauugccacuuuuaaggaaguaaaauaaggugaaauuaaguuuagugauauauuucaucuaagccaauaaauccaaaauauaauuuuaauauguaaucaauauaaaauuauuaaggaaguaucuuaguguguuuuacgcauuuuuaacauuuuguguaccucacuuuagcaacaguuuaaaugcucaguagccacauguggcugguggucacuagagugggcaguacaggucuagaggcuuagaguuauuguuugaauugaagauuaguuuauugcauguauuggguacucauauuguaucucaugaugaccacuaauaguaaugcugaacgugauuauuguuuaagauguuaucugccacaucuauccauugugaaguauuuuuuguccuuuuguaguuagaagguaaugcaggguggauacuugggcaccaugugaauauccugugcccagacaaccuugccuucaugguuuuagaguaaugcccucguucccaaugcaggugguugccuuaaguuuggucaugcuuguucuuagaccuauaaauacaaaaaagacuucaccauuaaaauauaaauuauuuaggggcuaguauuacucaauuaacagcaaaugagagaaugaguaaaaucaaaguauauguauggagcacugaacuucucuucuauuggcauggauggcugggaaccaaccuaaguaaaaaggcugguugacaccuuuaaaauuaaaacccuauucaaauccugcuugucacucuuacuguuugcaaacgugcguguguuuugcagagcuguaaaugaagaauaacuaaauucuuaccucugauuuuuuuuuuaaacagguguucacaaaagaagccaacaccagggaccugaugauauuuaccuugaugacuuaaagggucuagaaccugaaguugcagcucuuuauuucccuaaaagguagagugguccuuauuuauugaaggacagcucugaaauagucuaguuauuucuagaguaaaacauuucaucucaggaaaaaggaacaagaugaugguguccuuuagcuaaaucugaugauggcuucagguuuuggaaaauuuagaaauagcgcgugucuuauuucaauauagugacuugaaauuaauaauuacuuacgaagacauuuucaauacaaugaggagagauauacuaguuaaaccuacauaaggguauaugacuucugauuagcauuuccuguagugguuaauacaaacucaacaugcuugggaaaauuuuuuagcauuuauuuuauuauguguuuuaaaagaaacacaucuuuauuugaaaauguuuuccaaagaauguguucacuucuugggagucugagauccugagccuuuucugaaccgggucugggucugguggggcacugcccccgcgccccguguccccacauccccugcagcuccacagcugccacccagccucccucacugucccgcaccauuuucccuuugaauuacuucaaauaugggccucaaauaugauacacuuggacugccuucccaaguucauuucuacucuuaggggaauucuguuaaacugcuacucugugguuagaaaaaaacaacuuuucuccacggaaaguaugacuugaauauacugagccauaggcacacauaauuaaacacuuguaaaugaauuacugaaaaguauauuuuguuuuuuauuuggaauagaaagaugggauugauauaaagcuauuuaaauuuuuuacagguauuuugggaaaguucuuaaaacuccuuucuagcucuguccuaaauuuaucucaacauaucuacuucauuugaaguaauaguuggauuuuuuuaaggugaaaaaacugaaacggcuuuauuuuaacaguaggaaaguucaaauauaagcugucauagaauuaccacuuuuccccccacauuucccaggccuuaaucauuuauuuauauugguauuccuucgguauaugucuuaguuucucuuuuaaaaagugaggagaguaacuaaggugaugauaccuuacuccacucuacuguaauuuaacuguucacagucacuguccaugcacuaaguaagcuucuuaccucauuaacuauuucuugaaacauuucauaaauauuuaaagauagugagugagacucuuguaauccauguaagcauuagucaugucaugauccuuagcaucuucauuaccaaauuuacaguauuuguaauuaucacuaaacuuuaauauaaaucacacacuuuuguauuugguggcauccugagucagacggcauccccauguguguagauguuguuguuacugguugggguaacacuagcugcuguagagguggaacuccugaucucguuggccuaccacgauggaauuuuguuucuugccccugugaagaaugcucuguguugguguuuagggggaggccuugcccacagggauucaggaacacaggcuccuuucaccuugaggcucucccauccccauagggucucagaguccagaguuuacuggcagcagagaaaggaaugagcaucgcauaggagagggccccuggggaggggcaccauguaugccuuccguccauauucacggcucagucaugugcucacguggccccaccugacugcaagggggccucgccgugugccccggagaaagaggagacagguguggugaacacagaaggguuggccuugccccucacucccaguauaacaacaguucugcugacuuuguguuuccagugagaacauucugucaguccaguuaaucucaauuuuguggguaugagugugcauggcuauuaagaggaaaaaauauccaaaaaccugaauuuuuuuguugauucaaaugggaaacagguuuugaaacuguuaccuaguuaaaacauaaucuguagucugcugccaccuacugcucaaagaugagauuuguuugaaagagccaguaaaccucugggucacuguuuuuuuaauucacauaaaaauacuggcuuuuugaauaaaauaagugaauuugaaaauucucaauaucucaaaugugacauuaaauaccuauucaaaggguauagaguaguaagcauuggggacugugagacuuaaggugcugugccauucaugauuauucuuucucaaauuuacacuucauugcauaagguuucccuugaucaccuucugaaaccuggcuucugugccuuaucuugaaaaaugaaaauauucaguaaccucaucuuuagcuccuggaauaacaguuacauccaguuuauuucugaauacauuucuuuuucuaggugggucuugccucuagagaauuugcucguuuaauuucuccuuccuucuuugugagguaauaggcgaacuuagaaaagauuugguuuuaaagaauauagccuuggacuacaguaauuuucuacaggauguauaaagugccacagcuuuuucuaggacguuaggaucaaagguuuccaaacagcagauuuucuuaauuacccugucauuuucaucauggaaauguaaauaaauacuuauaacuauuuuacuccuuuaauuaaaaaucagaaaggccacaguugaaauguuugcauuauugugaaugaccguggugauuuugugacguauuuacuauauucacaguuaauuucucacugguacuauauuagguuaucuuucaugucauuuaugauaugauucuaaacccuaucuaagaaaaguuaugccugauuguagguccauccguucuuuuuagcggauguguuauuugguuugagcccccagagaaccaugcaguaaacuaggaauucaaggaguuguaauaaagcacaucuuuuccccauccccuguccacagugaaucggagcccgguuccaggcaguggcccgagucugacacacucucuggcucccaguccccacaguccgugggaagcgcagcugcagauagcggcaccgagugccucucagauucugccauggacuugccugacguuacccucucccuuugcgggggccucagugaaaauggagaaauuucaaaagguacguuggguguuugugccccaucuucauuucagagagcaaucuggucaucacuugguuaaaacuuaccguguagccauuucaggauauuuacauucuuuagggaucuugugcagguaacagguauguucuguaaugucagacccuuauacccucacuuaaggucuuaauugacaccucuuuauggaguggcuuugagguagugugcccuuaaaggcucuaauuucaaauuaagagguugggaguuaucaggccgcccuguuuucugagcugccagggugcgaucaucacacugcaccaguuuucucaucuguaaaguuacagaaacauuuguggaacuggggcccagcugcccuucuggaaagcacugggccuuagacaugaauauagggcccugaaguuguagaaaauugauuguccacugaguacguggucuuucuggcaaaaauuaggaggauuacuuucuguauaaggcuggaggguuggccuacgagaguaaagcuugcucaggaaucaggagggaguuuagcagacaugucaggaugccuauaggcugggcugagugccaugugcauccguccucaauucaucagcauuuuuuuuuaaccuuccuuuuaaaacugaacucuuaguauuucucaguuuggccuguggccccuguaugauuuucuucuaagggaaaauuuucuuuccgugacuagugucaucuuuugucuucccucucccuuagaggaacugaaggugugauguggcagacugcauggccagaggcucaggaccauguguuccugaagucuuuccuuuccagggucacaggaagcucauuaugccucuucccugucucuucauuguuuguuugcuuuauauuuugcaagaaauuuaaaguguguuauggccaaugguucauucuagggacuaaguuaaauaggucacauucuuucuguaauccucuuaaauguucaguuuaaaaaauuauaugcgagggaaugcgaaauacaaaauguagguaaaauauaaaaguuacaccuuuguuuuaaauauuggugacuuagucuaguagaguuuauuggaagaggcagaaaugacaaguaaauguaaguaauacacacauuaccuggagaaacaauccaagugagcaguuucucuguuagccuagaucuaggagaauacagguuuaggaacaggguacaaaaauucaugggaagcccucauucacucugcaagaacuugggauuuauuucacagaccuugagccaaauucuagguuuuuuuguuuugccuuguuuuguuuuuuuaauucuccaagcaauuguaacauguaauuuuuguuguuguuuuuauuauuuaagacagagccuugcucugucacccaggcuggagugcaguggcaccaucucagcucacugcaaccuccaucuccuggguucaagugauugucacgccugccucagccucccaaguagcuggaauuacagguuggcaccaccauacccgccuuauuuuuguauuuuuaguagagauggguuuucaccguauuggccaggcuagucccuaacuccugaccucaagugaucggcccacaucggccucccagaguguuggaauuauaggugugagccacugugccuggcccaaacaauuuuaagauauguuuugauauaauguagcuugcuaaagcuguaagaccccuaugaauauuccccaguuaugccguugccugucaguaaaguuucuuccucugagaauagaacuucgacaguuuucgugugugugugucugucugucuuucugugucugucuuccgucccucucuagccacaucuguauguauuuuuuuugaaagucucugucaugucccuuuuuacuaguuuguuuguuuucacugggagacaguggaaaaggagaauagaaaagaaguguucuuucuuguccuggggaaaaaaagcgucugacauuuugcuuuugaugaauauucaaaaauuaguuuuuuuagacagaugauuuuagccuucaauuucugcaaugcagagaguauuauaaucucauauagggauuuauguaaucucuaaccaaauugauuauuauuuuacauugcagaaaaauucauggagcauaucauuacuuaucacgaauuugcagaaaacccuggacuuauagacaauccuaaccuuguaauaaggauauauaaucgguaaauacuccugcuuuuauaauuguuaaauacucuugcaguuuuuuuacaagugccauuuuuaacuguuacuuauaaaaguguuccuucuuauaaaacuugucaucucauauaaauuagccagugggcaaugacuuugaagugaaaguaaagcuucaauuuuauuuuuaaaagaagcauugaaauguuacucuguuugauagauuuuacggcuucucuguucagagaaguugugcuugaagcgaagguuauucaugugacaaaaaauucagcugaucaucuuuauugaaaagaauaagcaauuuuauaugucacuucccuccucccucccucccugauucccuccccucucucuugcucacuuucacuguguaaugguuuugcacaauuuuuguuucucacaguuacuauaacugggcuuuggcagcucccaugauccuuagcuugcaaguauuccagaagagcuugccuaaggugaggcgauccaccaucugcugccuuuccgaaagcauccgcagugucuaguacuuacacaaauccauaugugcauauuucugaacuggguacuauucaaaguuuuacuugagcuuaauauuuaauauaaaagaucaaagucauauguacccacuaaaaauaucucaugcccaaacucugggaaauuagcagggcugccacuucuuuauuucauuuuuauuagacauaaauacuaguuucugauggucuguaaaaguugagagauuuuacuaaucauaaguuaaauauggaaugaaugaaaaaaacuuuuucucccauuaauaugggaagaagcagcaagaagaaggugauguagccaagagaagcuugacaucagugugguuagggcagaugguggcuaacauaccuguuauauacaaacucacaauugguuuuuaaucugucccccaagaagacaucaucagccuaguugguccucuuaacucaugagaaccacauuuuccaaagauagauaaaugagauuugcccaccugucagccccuaagguccuacauagcagaccgccuggucucaugccacagagcugugcugccaugaaagcaggacggggucugucucucagagguguuaaaaacgcuagaggaaucugggaggugugaagagagcaucggucacguucucacauuccauaguaaggccccguccuucaggcuagcauagaagguaggugcuguguggccaguagauugcccagacuaacccagguugguuguuuucaggccacaguugaguccugggugaaagacaagaugccaaagaaaucuggucgcuggugguuuuggcgaaagagagaaagcaugaccaaacagguaacagaccuagaggucauuguuuccgugggcugaaagaaaugaaucuuucauuuauucaaaaaaccuuuuugucaggcacaggaauuuggacuguauagggcuauuuuaccauauagcaguuuccauuuuugagcacuuaggacgugcagguguugucccaagugguccuuuacuguagcucagcacuagagauguucgaguugccauuucacagguaaggaaacuugggugcuucacgaagucacauaacuggugagagacggagcuggggcaagaccuugagucugacuccagagccugugcucuuucugcuucacuguauuaccuaucagauaggagcagaagguuaucgucugccugcauaguuccagaugcaaauaaccagaaucuguuccaccaggucuccauagaaauucauccagagaaccauacuaaacaagcagcagagcaagucuuuuuuuccccaacaccuucugaaaaagaggguucagggaguucucaccuguuuuucaaaugucagaagggaagucuugccugaaccaaguucauguccacgucagcaagggggcugccuuucagucccuucugcacguggugaguuacucccaggaggagaaggaagcuggggaccuaacaaguuugggucgcuuguauuauguuuugugacuugaaauggugcucuuaaaauguuuuccuucugggucuguagggacagugauuugcauagaagcacaugacuucugucuuagguuucuaauucuuuggcucagaauagagaaagucugguuuuugagcauuuuuaaguuguggguucagaaggcaguuguguucuuuccuagagagggcugcugaugaacuuggcuuaucuguagggaaaaaauugcauguugccauuaucaucuugcuguuacagcugccagaauccaaggagggaaaaucugaggcaccgccagccagugaccugccauccagcuccaaggagccggccggugccaggugggugcccuguccucugcccggcucauagcacucaggcccucuagcagggccauuacuucuaaguugauuuuggcagcuuguuuaguucuugggaguaucuucugcagauacuacaugcugugauauauuugugccacucagcagaugacaacugcuuuucuaaaaaacaucaccagcuuagaaaaauaaauacccugccuccuuguggagccguggcgccagcguaugggaaggggccgugaggaacgcuucagccauguuggcccaggugccucugcucccccugcaucccauccggagccaaagggagacauacaaaauaaucuccagguuggcuuggguggguuuccuuuccuggaagaaacagcauucuuuggacaguuagggugagcagcccugagaggaguugcucgcgauacgccguguuccugcuucugccuguccaccucccccggccagugcaugcuugcuucucccagcccuuggcugucucauuuagugucuaaggcugaggguuuauuuucuugccccuuaccgccccccauccuauaucuuuuaaggggugucuaaaauuuuucuuacuaguuuuuguuuuuuucuagagucucacugugucacucaggcuggggugcaauggcauaaucauagcuccucggcucauacaauccugccucggccuccuaaguagcugggacuacaggugugggacaccaugccuggcuaauuuuuaaauuuguauuuuguagagacagggucuugcuguguugcccaggcuggucucaaacuccugggcucaagcaguccuccugccucagccucccaaguaguuaggaccacagacaagugucacuaccccuggcuaauuuuuaaauguuccguagaaacugggucucccuauguugcccaggcuggucucaaacuccugggcucaagguguccuccuaacucggccucccaaaguguugggauuacaggugugaggcaccgcacccagccggaguuuguuaaaucauuguaagcgauuauguuuucuuugauuugugccuugugaaacauacauacccucuucaacaagagucaguagaccuucuagcauucacugggcauagcagaaaauagcaggucauagucagaaaguaagugcuugccaguuaugaaaguggccuuaucaguuaacaauaugaauauuucaggcguacagagcuguggauaugggagaauggcagaagggauaacucuacccauuccuagaaaagauuuaggauaucuuuauuuucuugauccuaaaugaaaagcucucaucaauaaaaugcccugcugccucuuccguaacugggcuaauguugaacaggccggccgagaaugacuccucgagugacgagggaucacaggagcucgaagaauccaucacaguggaccccauccccacagagccccugagccacggcagcacaacuucauauaagaagucucuccgccucuccucagaccagaucgugagucuugcaugaucuguguuguccaguaggacuuauuuuaguaaugguuuaauuugaugcacauccucuucuguccacacguccccagcugcauacacgccacacggcauggucgugucaaugccuauccacaguggaaccacgaccgccgcccccaagagcuaucaggcccaccuggggaaccuguggcuuggguccugccacccaccccagaccuccuuccuccaucucuugagagucagucguacacagcuaacccagcgcugagccagguacugucucuuaggagccacagcaauagagaaaugacauuuuagacacaauuucuccucuuauuuuacacccugccuuugacccauuuucgguaugaaaaggucuugcugggaccagagcaggcuguggcuaaagcaguaauucucagguguggaguaagaguaguagaccuuuugcuuuguggguguucagagaagucccuggaaccccaaaauacuguucaggcaguggcucccucagcauugucagcugcgcugggcacagggugggcugugucuaagaccccggaaaccauccugccucuuguugggauuccgagacaccaguuguucuguaaauuuuuaaaucguuucaaacuauguuuucagcugauuuucuuuauucuuaugcuuuuuuaaaaggcaaaacugaagcuccacgauggcccaaaugauguuguguuuaguauuacaacccaguaucaaggcaccugucgcugugcagggaccauuuaccuguggaacuggaaugacaagaucaucauuucugauauugaugggacaauaaccaaguaagcucaauccuucagguggguggcaaggaacagccccgugcucagggaggggcaggcagugugugguggggaguuccucaccuggggcucgaagcccucagccaaggcauuuuauaagccauaugcucugaggcguccccaguacaguccacauggggucauuuuuuugcauggaggagauggugagggugcauaacaaaugucaaaaaucacuuuuggaaagauuaguuauuugguuucaauucugauaugaaaacaagccccuugacauuggggcggaggaaaagagaaaguguggcagucaguuaccuccgaacacacacaucuggcgcucgugagacuccgcuuucagaagcaccucagugggugcguuugcaugggauggccuugcaguugcuugaagcugugauuaaauccccuuucaagagugucccgccaccaauuaguuauuggcagcugauagucaaccaaauaggaaaacgcuguauguguuugauuccugauagcuuuuccuguuucuaccgucuucuuaggucggaugcuuugggacagauucucccacagcugggcaaagacuggacccaccaggguauagcaaagcucuaccauuccaucaaugaguagguacccuccccacguuaacucgcucuggugagcuggaagcuugcuuuaagaacuauagaacaaugguguaagucuucaguccacaugagucauguguuuaugcugaagcauucccgcucuuccucacuccuuuccuguugauggugugggagccgugugcaccuggcauuggcaucgaaccugugucaucucaguuaauccucacagugcuguguuucaggcacuaccuacaucuauaacuagaaugacaguuauuuuuuuagcuagaauuuaauaagauagcugauuuucauuuuugguuuauuuucuggguauuuuaaauuuuuuuuuuuuuuuuuuuuuuuuuuuuugagauggaguuuugcucuugucgcccaggcugaagugcaauggcgcgaccuuggcucacugcagucuccgccucccggguucaagugauucuucugccucagucucccgaguagcugggauuaccggcacaugccaccaugcccagcuaauuuuguauuuuuaguacagaugggguuucaucauguuggucaggcuggucuugaacuccgaaccucaggugaucuccccgccucggccucccaaagugcugggauuacaggcaugagcuauugcgcccagccuuaaaauuguauuucuuugaguagauagugcacgcaugcaugagggaaauaguucuugcaugggcugcucucucuuggggcacccuuugaggggaagauagccgugccauggcguuuguggguuccuaauacauauauuacauugaucugaagaaucucagugucuucagcauuaguugagaauaccauaauaugaaaauuacgaauaugucaguuaccuggguauaauuuugcuucuugucugauggagugguuugcaucuugcacauugccuuuauaaauaauauccccuauauuuuuucuucacaguggguaauuuaaagauaguccaagguuuuuucuguccucuaaucuggcuuucauggacuagaugcugaacauuuuauaucaguacuuacaaacuuaacauaauccuuaguugccuguaccuccauuuuuuucccacguuuuccauggaaggugaaaccucuauaauccuaagcaguuuccugcuaaauuugagaauuugguuuucacaguaaaugagaggaaguuuauuuggaucuuuuaaaagaaaaguauggguugagcaugguggcucacaccuguaaucccagcacuuugggaggcugaggugggcagguugccugagguuaggagcuuaagaccaaucuagccaacauggugaaacccugucucuacuaaaaaauauaaaaauuaagccgggcauggugucccaugccuguaauccuagcuacuugggaggcugaggcaggagaauugcuugaauccaggagguggagguugcagugagccgagauggcgccacagcacuccagccuggguaacagagugagacucaaaaaaaaaagaaagaaaagugugggguuuuuuuuuuguuuuuuguuuucuuuucccuuagccagaacaugugggcuaacaggguguguuuucuuucaggaauggcuacaaguuucuguacugcucggcucgugccaucggcauggccgacaugacccguggcuaccugcacugggucaaugacaagggcacaaucuugccccggggcccccugaugcugucccccagcagcuuguucuccgccuuccacagguaccucuccggcaggcagcccucugcccaccgccccagcaugugggcggggcugggcccaagguggggggaugugugggaacagaagucagauguuggagccgccacgccucucccaguucuuuggucccuggugguguccuaccacauacugcucacuugccauguggcgggccuggugaagaaaggcagguucuaggaaccgucaaguuuucuccuucccuaaacuucaucacucaaauuuucuuaguuaucagacuggcaaagaaggagaaggaaagauuccaguuacaaaggguugaagaaauugggugguugugagcacuaaaauuuuaggaccacucacuggggaaaacgaccauuuugagauuggugauuguauuuguauuuuuuucuuagagaagugauagaaaagaaaccagagaaguucaaaauugagugucuaaaugauaucaagaaucuguuugccccgucuaagcagcccuucuaugcugccuuuggaaaccguccaaaugugaguaucuccugggcucuggguucugaugugggugaaauucagagggauguacuucgugggguguagccacgucccaauucucaaagcaguuuuguaagcaaaaugaggcaucuguucugcuuguucgguuuucacuugaucuauuccaaauaucuauagcaacuggggagguccugcaggugcagaucugccccagaauuuauacgaaggacgcuuuuccaucguuucuguggcugccauuccauuuccucaggcagcuccggcuccucuucuaagcaguucugagcugcguccuuggaucaccccagagccagggucagugcuggcccuucgcuagcacuucccaaccugccucccuucugcagggccaucgggccucaggugugcagaagauguggccucucuggccucuucugcgccagggacccuggcuuccccuugguggcugcccaaguuuucugacucuccaagcaccacucuguaguuuagguuugucuaaagcucaguuuugguggcaacugcacugugccgccuccgcauguuuucugucgagucugucugugcagugcuucuggcucacaaggagccugagaaguaucuccugaauucuccucccuggaaucacccgcuugcuauuuucuucugcaggaugucuaugccuacacacaaguuggaguuccagacuguagaauauucaccgugaaccccaagggugaauuaauacaagaaagaaccaaaggaaacaagucaucguaaguacauucucagcucucagcccggcgcccugcagccagggguacaguuggggacagacagacccuguccuuuucccccugauccuugagaucaggcccugaucaaaggaucagcuacaucuccucuguggguaucucucuuucacaauaucuguuugaggggucucugguuauccuagacuuguaagagggaguuugagcccugugaugggacugaggccugccucugaaccugcccaccugagcaaucugagugacagcuucacagccccccaucuugugccuuugaccgaucuugaaguaauagccugugccucuuccccaaccuuucucuuagguaucacaggcugagugagcucguggagcauguguucccccuucucaguaaggagcagaauuccgcuuuucccugcccggaguucagcuccuucugcuacuggcgagacccgaucccugaaguggaccuggaugaccugucuugaggcggcaccucagugggugggcagggcuuggucccccuccccacagcaagggaaggcagcuggcucuucugcugaccucagauaccagccuuccccagcggggacgggugcuucuggagcuggucccgccauccuccuuugccuucccaggccagcugcucaggcucggcaggucugcagcucagcuccuggaaggagaagggaggaacugggccuggggcuggaggccugggaucccuccuuugugggucgcacacauguuuccugcugugagcuggggccuccuuccauugcaucauuuuaaaggaagaaaaaagcagcuaaaaaagaguggaccaaaacacugcacacagugaaguguuccaguuuccacugggcaguugagguggcuucuguaaccagggcugucuucagaugucagggucccugaacugcugcgggcccagucagugaugcuggcugaagcugccugugcacguuucuucucuggucgccucauuuccugcuacacugaaggggucagcugcuccagugggccaaguugggcaggacccccgccccugcagggcccaugcaccagagccacugagcccagucccauaaaccuggcccucuuuggggaaagauccccacagagcauccuccucucaucugugacaacuccacgagcccuuaauuucuuaguccucaccagaagaacaggucucacaaguauauauuugaugucuguaauaaaagugggaaggugggucuuaaaacagaccaaaccccgccccgcccccaacaacucugcuuuuagggaggccuccgaaaugcagauaggcgguugagugggguccugggaagagcgcugaaucccucugcuugcugccuggugugggccuuuggaaagcaucuugccuugggacaggauuucuaaaauucugugauucagauuugucagggaagcacagugaagcuugcuuaaaggcacuggccagcagugugugacuuuggcuuuugggaucacacccuguaaucgggcccguggaagcagcgucaaagaggggucuuggagcuccuauggagcagacugccccccgagcaguguccccagccuagcccugugagaccccauggggacacgggugccuauguauuuucacuaaaauauacaugguagcuccauuuacugaugcgguuguaaugagcucacaucgugucugaagagauggcaccagggaaaggugugccauaagcugcuccagagcuuuugguaugcugaguguugacagagcugcacucuuaacaucaagagaacugucaggagcccagaaccaaccccaggucuuggucuccauuggcgagaacacaggacguggugguuccugagcagagagggaucugcagauacaggcuuggcgcucgggguggucucguggccaacucuucaugccccugccguuguaguggaaccucuacauguuuuaguuugcuucaccuaaaauaaugcugaucuagagauagagaaauaggggugguuauuuuuccagauuggagaguugaaagucccugacugauuucagccauuuuccuagugcuugucggaugcagagacaauguugaaauccccuaaacacaguucucaguggcaaaaccuaggaaggcucauguucccagagaagggaccacaugagccuucucccaugcaaagcuucccccagcuuaaauaguugauaaggacuaauuguuuaaugaguuuauuuaucuacaguagguuagggauccuggguucuguuuauaugaaguucuucccaguuugugaauucuaguacagcagccaugcagccaccuuauuucauagaugccaucuguguguccucuugacuaccuucuauuuagaggaagaaugagagcuuuguguguuuaacugagcuuauaguaggacuucuuugcauauguaugguacugaaaaaucuuaauauacaucuuuaauccuuuuuagguuguccuuuaaagaguuuuugacuaguuucuuuuucuugacagcucuucucuuuggacacaugggccuucuuagaggguucagucuaggacccggcucuccuggcccuguguugaggguagcuggucccucugucccugugucugcuagcacuagacuuuguugcugcagauugauccaguggguacauaggcuaauuaaugugagucuuuuuccuuguuuaaaggagucccucuugcugaaaguagaugauuacuauugcuguaguguuaggaaaguauuaaguuugugcugaaaauccauugccauuugguacaaaugacauuuguucuuucugugaaagagaugcccucgaguguguuuguacacaaacccuuaggauggugaguugaagcaucacccucgcgcuaucuucagugacgggugacggcucagggagauggcaggcagauugggcucuaagucauuauucucucaguuacuccauuggugaaauggcccuuucccucuuugcaguucagucuaagucucguauuugcuuugcugucugugugcugaagcucgucccgugugaguugcugucugccccuugucaggcugugaggugcucguguagaccuggagcaugcaggcugccuccguuuuuggguacuguguuguguuuugcucugucuaaaaacaucugcauaguuuucaacuggaaaaagaaaaaacuuaaaaaugggauguccuaaaaugaaagcugcucaaagucacagaacaaccgagggacaaaggagauuggaugacugggaagcgcuggcccggaacagccccugcaacuguggggccugcacacagcccuuccacaguuggcacugcaggugcaggccaacccuuuaaagaauaaacaaggaagucagcucuuucacuuuuuacaaguuggcaaaaacagacuuccggggaauuucgauguuuucccguguuguagagcuuccaggguuuaauaaaacugguuaaaaauugagucuuucccugaaguaagugcucuuuccagaugaaaacuacucuuuugguuuuguuugaaaguaagaaagggaggggaaacuuugcucuuuuaauaauuauguucagccuaugaugaaguauuugauuauuagacagcaaugucacuaauaaguuuuaaguuguccaaaguuaauuguaaacaucaucaguacaguacucuuaguuacaguaaagcaauuguugcaagaugaauggcuaauauuuuggugcaguguuugauguucaaaacaaaauguuacaacaauaaacgaacauaacauaaacugaau

SEQ ID NO: 18420 - RNA, 917 nt, Homo sapiens
uacaucuuguuuuuuccugcacaggaccuuaauauuauuagagacccaucccagacuucuucuggcuguauccuucauuccuacaugcaugaccagaaugguaagcagagaguagaagcugaugagucuuggacagcgguugaccaugccucagaggcaggcuacaggaaagcaggucaucuauagucaacagcagagaugacaacuuuaucaccuggaagaagcgauucuucagccauguagcuuagcaagggcuuuagauaaaaucauggacaaaagaaccauaauggcuuauuuuaaaaauuaauaauaauaacuuugggaggccgaggcagguggaucaccugaggucaggaguucaagaccagccuggccaacuuggugaaacccugucucuacuaaaaauacaaaaaauuagccagguguggugcugcaugccuguaaccccagcuacuugggaggcugaaauaggagaauugcuugaacccgggaggcagagguugcagugagccaagaucgcaccacugcacuccagccuggguaacagagcaagacucugucucaaaacaaaacaaaaaacuagaaauauuugugaauaucuuaaucuacuugaauuugauuucagggaagucaugcuguucuaaaacacuuuuucaaacaacuggcagaaaccagcccgugguuuguaccaaaucugccuaaggccagauagcauuccuuauggcccuauguuaucuacuuuuagcuuacuuuuuaaaaaauaaaaugaggacaguaauagcaccuugugucuuauaagguuguugugagaguuagauaugaagcacuuacaacaacacuuagcaccuaguaaaaggcuaauaaauccuaguuccuaguaugaugcauuucauuaugguugccccauuaaacauuuu

SEQ ID NO: 18421 - RNA, 3685 nt, Homo sapiens
cucaugccuccucuuuaaagccugccuucacuggaguuccuggaagggagagucuguucagcacucaucucuguauccacagucaccaaaauuguaacugccccauaauaaauucccaauacuugcagggauuuugcuucuuggcuuguuuuguuuugcuggaaugaaugaauaaguaaaugggaacgauuuugacuucacccuaagccuagcuaaaaguuuggguagugacaguuuugguuauuuuguguaaccugauaguggauccccuuucuaugccaaaaaaaaaaaaaaucccccaauacuagaguaccuguuuuccuagggaauugaccucagcaacugaaggagaggcgauucaaagcagggagugugaugaauaggucaacucuguccucgcagccgucccugagagggcgcuguucccaaaucgaagccccagaggcggagacugagacaccggcacucucccacuggacugggucagcaucccucuccccgcgcggccgcaggucuagagcugagcgccugcccacaaacauggcggcgcccugcgcggcuucccgucgccgcaaccguggggccggcccugccuugccaguacuaggggacuuccucugcgcgccggcuuccugcccagcuggcauuuaaaccaccgccuggggcugcaggaugcugcugcggaugcagagcuguccgcgggcugggcagcgucgccgucuccccugagccgccucgguccggcaggagcggagccgaagcaucccuugcugcacgcagggcagagcaggcgagggcugggggccgaucggggaccccggcuugggaccccggcaucuggcaguuuccuugcagguucaacuuuaauugccaagauuucaccccuccuccucaagcccagauuauuuauccucccuccggccugggcugcuggaugcagcagcggcugggcuuggucccaggagcagggagagugcgcucccggcccuccuagccgcgugcccgggccauggugcggcugagccccgcgcuugggugaggcggcggcgcggcucggagcccggcggaccgguccuacgggacaucuuccccugaggaggagucuuccccuggggcugcgugccgggggcgagcggcggccgcgauguucagcuggcuggguacggacgaccgccggaggaaggaccccgagguuuuccagacggugagugaggggcucaagaaacucuacaagagcaagcugcugcccuuggaagagcauuaccgcuuccacgaguuccacucgcccgcccuggaggaugccgacuucgacaacaagcccaugguucugcuggugggccaguacuccacugggaagaccaccuucaucaggugagccggcccaggguccuggcagcccaccccggagcccagcgccuagucccuccggucacuccuggugcuccaucccagacaggggaccaaugggaagccuucaguugagggcucugaagagaucuguguuugugcaggcgucaaaaucuuaccccacaauuuuugcuggucccccuucccauccuacccaauaccuguccacucuacuuggcccuuggcugugguggucaaccugaaguauucaaguguaaagccauucccagucuccccaucuuauggaugaugaaaccgaggcccaggaggcacaauggaagagcuccuggucucuggagcgccuuauguugguggggaugucuuacgucuucacuuuuuagcaacacaucauucacgggcaaaaccucuucccuuguuuuucaaggggcuuggcacucacaugggggccucacaguugcagcugaguucugaugggugcgggccugggaacggagguggccuggggaugcuacuuguccuccuuuuaucauuuccuucucuaaagcagagcuccuguguauauaucuuggagacucaacagaagcugaguccagaagcagaaugcuuuuuuuuuccccuuucucuuauuugaucuuaauggcuuaauaauaauauuaaagacgcuuagagauggaagggauauuggcauugucucauccaguugcugaguuugcaggugagauaaccgaggcgcagagaaguuaaaugaauugugcagagccaucuaaagagugggcagcagaccugggauguuaaguccuagaugcaugugaggagaugcuuggcuaaacgccuguaacucugagaaugagucauccauucccuucaauuacagaauccuugggcuggagggaggcucaagaagucaauuuguucacccugcauucagagaaguccaccagaggcccuucuuaucuuuagagaacaggcuucacuccaguccucaaucuucccaacuucaaggccagccauuuucuuggccccuuuuauagccauuccaaauuguugagaaugcuguggcccucugucuuaagacucaggcucccacagcuugagaauggaguuugguggccccccaaagucaagugugcucaucuccugcagaggguuuggaaagcagggguacccuuauuccuauuccuuggcuguuugagcauccacagcaugugaaaugcugugcuuuguuuggugaggagugcagaaaaguuaacagucuaguuacuaauuuucuagguacuaauuuucucuaacauccaccuuguaacgccagccuucuggaaguagcaccaugcuaauaggucaugucuaaacacaacaccacauugaguuuguccuuguggagugcacagccuagggcucagcagcuuuaagaggccaagugauuucugaaggaguuugggaggugaugggccuguuggcucuuguauguuuuauauugauagaacugcaagaggccuuagagauuaaacuaauccauugcuucuuaacuuucuaucuuuagaaaaauguacguacaucccaaauuugcauauaauguuggggguccaagggccuucuuuggacuuuagggugggaaccccugaucuaagccaugcuucuuguuuuauuaagcacccauugcugccaaaggcacuucagagcugccuggguugccugcagaguuuccuuugugagcccuggccuccacuuggcccauucaugccucaggggaaguucaggccauuugcagauggcccuugcccucucagccuucccuggcucucuacacauaugguauuuauaaccuuucauacauuaucuguagcuucuccuuccugguguacaaucauugacaagacaacauccaugccuuagcaucucuggggccuugcccagggucucggcuauaggagguucccaguagacauuuugcagaaugggagggaagauggggagaggugaggauccccaagcagcagacagguuugagcgccuuuugucugagacacucucccggcuuugccuaagucaucacuggcuguuaacugggucuaagaaaguggcagagucaaauugccacagaugauuccucaucugagggagacaguaagaccgggagaggcagaucgcucuucuuucuuauccuccaugugcaguaguucccucuccccacucaugucagcaacugaauuuagcucaugcgucaaaagcugucuccccuugagggagugucagccagcgcuguaggaggggucauaccacagggaacccuccagaaccaaaucauguacuuuucuuc

SEQ ID NO: 18422 - RNA, 978 nt, Homo sapiens
cucagagcaggaaggggaugaugggcaugcgcaggggcggguagucccagaacuccuuuagggagcuguggugcuugcccuuggccuagaucgucaucuggguaaagcccaccagggagaacagggccacugggagacacugugucaugauggcaaaacugauccaggaccccaucugguagguguaguuggggcaggacaccagcaggaaaagccacgugaaaggguucuuggugagguaugggaucuucuggguguuggacucagcgggccgccggucccacagggccauguggauggagaagucgccaagcacaggcagaucacaaagauggcgagugccaguuucaccugcugagcucuguaaguaggggguguguagagagggugguugauguaauaggccauccacccagugaagccccaggaguaggugcaguucuugaagauguugcgcaaggcaugguaccaugggagaaguggugcaugaacaacgucuccagcaggugcuugacguagugcaaugagugacagaugcaggugaggugcaccaccaugugccgacuggaugugaagucauauuuguugccauagaugaagggcacucagaaguagaagagcagguagaugaaaagaggccccccguacucuguuaggaagaccgucacccagcugaucugggcccccacauccuggaaguagaguguggccauggcgcccacgggcaucuucugcagaacaucuucaucauucagggacuugcccuugggguccaggcggagggacuggugggcaggguaccacugcagaggggucuuggugaagagguucuugaucucugcaguggugguguggggcuccaccuuguccaggaaacacagcuucuccccugucuuugcgugcagaaucuccaccucuuagugcuucauggcugucucccacggcggcuacugcuccauggcugcugcugccuaacug

SEQ ID NO: 18423 - RNA, 978 nt, Homo sapiens
caguuaggcagcagcagccauggagcaguagccgccgugggagacagccaugaagcacuaagagguggagauucugcacgcaaagacaggggagaagcuguguuuccuggacaagguggagccccacaccaccacugcagagaucaagaaccucuucaccaagaccccucugcagugguacccugcccaccagucccuccgccuggaccccaagggcaagucccugaaugaugaagauguucugcagaagaugcccgugggcgccauggccacacucuacuuccaggaugugggggcccagaucagcugggugacggucuuccuaacagaguacggggggccucuuuucaucuaccugcucuucuacuucugagugcccuucaucuauggcaacaaauaugacuucacauccagucggcacaugguggugcaccucaccugcaucugucacucauugcacuacgucaagcaccugcuggagacguuguucaugcaccacuucucccaugguaccaugccuugcgcaacaucuucaagaacugcaccuacuccuggggcuucacuggguggauggccuauuacaucaaccacccucucuacacacccccuacuuacagagcucagcaggugaaacuggcacucgccaucuuugugaucugccugugcuuggcgacuucuccauccacauggcccugugggaccggcggcccgcugaguccaacacccagaagaucccauaccucaccaagaacccuuucacguggcuuuuccugcugguguccugccccaacuacaccuaccagaugggguccuggaucaguuuugccaucaugacacagugucucccaguggcccuguucucccuggugggcuuuacccagaugacgaucuaggccaagggcaagcaccacagcucccuaaaggaguucugggacuacccgccccugcgcaugcccaucauccccuuccugcucugag

SEQ ID NO: 18424 - RNA, 2968 nt, Homo sapiens
aggggcuuuguuaugcaccuaaagccauauuggaagcuccagaagaaagagcaccccccggaagucagcagggaaacgcagagaacuccuaugaaccaccaaaaggcuguaaaugaugaaacaugcaaagcuagccacauaacaucaagugucuuuccuucagccucucucgguaaagcaucaucucgaaagccauuugggauccuuucuccaaauguucugugcaguaugagugggaagaguccuguagagagcagcuugaauguuaaaaccaaaaagaaugcaccaucugcaacgauccaccagggcgaagaagaaggaccacuugauaucugggcuguugugaaaccuggaaauaccaaggaaaaaauugcauucuuugcaucccaccaguguaguaacaggauaggaucuaugaaaauaaaaaguuccugggauauugaugggagagcuacuaagagaaggaaaaaaucaggggaucuuaaaaaagccaagguacagguggaaaggaugagggagguuaacagcaggugcuaccaaccugagccuuuugcauguggcauugagcacuguucugugcacuaugugagugacaguggggauggagucuaugcugggaggccucugucaguuauacagaugguugccuucuuggagcaaagagccagugcucugcuagcuagcuguucaaaaaacugcacaaacucaccugcaauugugagguuuucuggccaauccagaggugugccugcagugucugaguccuauucugccccaggagcuugugaagaacccacagaaaggggaaaucuugagguuggugaaccacagagcgaaccaguccguguccuugacaugguagccaaguuggagucugagugccugaagcggcagggccagcgugagccugggagccucucaaggaauaacagcuuccgucgaaaugugggcagaguauugcuugcaaauagcacucaggcugaugaaggcaaaacaaagaaaggcgucuuggaggcaccugacacucaggugaauccuguggggucuguaucuguggauuguggcccuucaagagcugaucguuguucuccuaaggaggaccaggccugggacggugcuucucaggacugccccccauugccagcaggagugaguuuccacauagacagugcagaguuagagccggguucgcaaacugccgugaaaaacagcaacagauaugauguggaaaugacagaugaacucguuggguuaccuuuuuccucucauaccuauucccaagccucugaauugcccacagaugcuguugauuguaugagcagagagcuugugucccuuacuagccgaaauccugaucaaagaaaagaaucuuugugcauuaguaucacuguguccaagguagacaaagaccagccuuccauuuuaaacuccugugaagacccaguuccagggauguuguuuuuuuugccaccuggucagcacuugucagacuauucccaguugaaugaaagcacaacaaaagagucuucagaggccagccagcuugaagaugcugcugggggugacagugcaucugaggaaaaaagugggucugcugagccauuuguacugccagccucuucuguggaaaguacauuaccagugcuugaggcauccaguuggaagaagcaggugucgcaugacuuccuggagaccagguuuaaaauccagcagcuuuuggagccucagcaguacauggcuuuucugccccaccacauuaugguaaaaaucuucagguuacuucccaccaagaguuuaguggcccuuaaauguaccugcugcuauuucaaguuuaucauugaguacuacaauaucaggccagcagauucucgcuggguucgagauccacgcuauagagaggauccuugcaaacagugcaagaaaaaguaugugaaaggggaugugucccugugccgauggcaccccaagcccuauugccaggcauugcccuaugggccaggguauuggaugugcugccaccggucucagaaaggauucccuggcuguaagcuggggcuucaugacaaucacuggguuccugccugccacagcuuuaaucgggcaauccauaagaaagcaaaagggacugaagcugaagaggaauacuaaaguccaugugagaggcaacaaaaggaccgguuucuaaagcugcaaaacaccuagauacaccguucaaaugagcguagcccccugagucaucacucuagaagaaucuguacaucaucaggacugcauugcucaggcauuuucuaaacucuaaauuuacgagcuguacaaaaaaauuggucuuguuguuuauaguggcaucucauguuugaacccgggugguaucccacaguuggauucaguuggcugugaauaacugccuguuuuccuaaaucaaacccauccucaaaggaugaagacucaccaccauccaggacauucagaagaguucacugcagaugcugcagguaguccucaaaaauggguuccagaaauguuuugagcacuggcaacauauuugaaauaagugaauauuguccugugaaaagaauagcaggacuuuuagaugaaaaguauucuuaaaaagaaaagucaggcaccccaccuuagaccucguaugcuugauccugugagauugauguuuguggcuggagguggauuucaugcccugugguguuuacaguguauauaaugguuguguuuucauggggcuaugaaagugcacguuaaaccugagcgccuuuaccuuuagaugagugcuuuggccccucugugaauagcacgauuaaaauccaguuguauauaauggacagcuaacggaacaauauaaucaccacaaugcagcuaggauaguguugcggcuauaauuuuguguuuuuuuuuuuuaauugucuagucuuaaauuuguacaucuuguauaaaauaugaauguuucccaaauaaa

SEQ ID NO: 18425 - RNA, 2968 nt, Homo sapiens
uuuauuugggaaacauucauauuuuauacaagauguacaaauuuaagacuagacaauuaaaaaaaaaaaacacaaaauuauagccgcaacacuauccuagcugcauuguggugauuauauuguuccguuagcuguccauuauauacaacuggauuuuaaucgugcuauucacagaggggccaaagcacucaucuaaagguaaaggcgcucagguuuaacgugcacuuucauagccccaugaaaacacaaccauuauauacacuguaaacaccacagggcaugaaauccaccuccagccacaaacaucaaucucacaggaucaagcauacgaggucuaagguggggugccugacuuuucuuuuuaagaauacuuuucaucuaaaaguccugcuauucuuuucacaggacaauauucacuuauuucaaauauguugccagugcucaaaacauuucuggaacccauuuuugaggacuaccugcagcaucugcagugaacucuucugaauguccuggaugguggugagucuucauccuuugaggauggguuugauuuaggaaaacaggcaguuauucacagccaacugaauccaacugugggauaccacccggguucaaacaugagaugccacuauaaacaacaagaccaauuuuuuuguacagcucguaaauuuagaguuuagaaaaugccugagcaaugcaguccugaugauguacagauucuucuagagugaugacucagggggcuacgcucauuugaacgguguaucuagguguuuugcagcuuuagaaaccgguccuuuuguugccucucacauggacuuuaguauuccucuucagcuucagucccuuuugcuuucuuauggauugcccgauuaaagcuguggcaggcaggaacccagugauugucaugaagccccagcuuacagccagggaauccuuucugagaccgguggcagcacauccaauacccuggcccauagggcaaugccuggcaauagggcuuggggugccaucggcacagggacacauccccuuucacauacuuuuucuugcacuguuugcaaggauccucucuauagcguggaucucgaacccagcgagaaucugcuggccugauauuguaguacucaaugauaaacuugaaauagcagcagguacauuuaagggccacuaaacucuuggugggaaguaaccugaagauuuuuaccauaaugugguggggcagaaaagccauguacugcugaggcuccaaaagcugcuggauuuuaaaccuggucuccaggaagucaugcgacaccugcuucuuccaacuggaugccucaagcacugguaauguacuuuccacagaagaggcuggcaguacaaauggcucagcagacccacuuuuuuccucagaugcacugucacccccagcagcaucuucaagcuggcuggccucugaagacucuuuuguugugcuuucauucaacugggaauagucugacaagugcugaccagguggcaaaaaaaacaacaucccuggaacugggucuucacaggaguuuaaaauggaaggcuggucuuugucuaccuuggacacagugauacuaaugcacaaagauucuuuucuuugaucaggauuucggcuaguaagggacacaagcucucugcucauacaaucaacagcaucugugggcaauucagaggcuugggaauagguaugagaggaaaaagguaacccaacgaguucaucugucauuuccacaucauaucuguugcuguuuuucacggcaguuugcgaacccggcucuaacucugcacugucuauguggaaacucacuccugcuggcaauggggggcaguccugagaagcaccgucccaggccugguccuccuuaggagaacaacgaucagcucuugaagggccacaauccacagauacagaccccacaggauucaccugagugucaggugccuccaagacgccuuucuuuguuuugccuucaucagccugagugcuauuugcaagcaauacucugcccacauuucgacggaagcuguuauuccuugagaggcucccaggcucacgcuggcccugccgcuucaggcacucagacuccaacuuggcuaccaugucaaggacacggacugguucgcucugugguucaccaaccucaagauuuccccuuucuguggguucuucacaagcuccuggggcagaauaggacucagacacugcaggcacaccucuggauuggccagaaaaccucacaauugcaggugaguuugugcaguuuuuugaacagcuagcuagcagagcacuggcucuuugcuccaagaaggcaaccaucuguauaacugacagaggccucccagcauagacuccauccccacugucacucacauagugcacagaacagugcucaaugccacaugcaaaaggcucagguugguagcaccugcuguuaaccucccucauccuuuccaccuguaccuuggcuuuuuuaagauccccugauuuuuuccuucucuuaguagcucucccaucaauaucccaggaacuuuuuauuuucauagauccuauccuguuacuacacuggugggaugcaaagaaugcaauuuuuuccuugguauuuccagguuucacaacagcccagauaucaagugguccuucuucuucgcccugguggaucguugcagauggugcauucuuuuugguuuuaacauucaagcugcucucuacaggacucuucccacucauacugcacagaacauuuggagaaaggaucccaaauggcuuucgagaugaugcuuuaccgagagaggcugaaggaaagacacuugauguuauguggcuagcuuugcauguuucaucauuuacagccuuuuggugguucauaggaguucucugcguuucccugcugacuuccggggggugcucuuucuucuggagcuuccaauauggcuuuaggugcauaacaaagccccu

SEQ ID NO: 18426 - RNA, 849 nt, Homo sapiens
gggcucuuuuucguggugccuuggaggcauucaccugcuucaagaugaagcuggacaucucuuucccagccacuggcugccagaaacucauugaaguggaugauaaacgcaaacucugcacuuuuuaugagaagcauauggccacagaaguugcugcugaugcucugguugaagaauggaaggguuaugugguccuaaucaguggugggaaugacaaacaaugguuccccaugaagaggggugucuugauucauggccguguccgccugcuaaugaguaaggggcauuccuguuacagaccaaggagaacuggagaaagaaagagaaaaucaguucgugguugcauuguggaugccaaucggagugcucuaacuugguuauuguaaaaaaaggagauaaaaauauuccaggauugacugauacuacgaugccucaucaccuggggcccaaaagagcuagcagaauccacaaacuuuucaaucucucuaaagaagaugauguccaccaguauguuguaagaaagccuuuaaacaaagaagguaagaaaccuaggaccaaagcacccaaaauucagcgucuuauuacuccauguguccugcagcacaaauggugccauauugcucuggagaagcagcauacuaagaaaaauuaggaagaggcugcagaauaugcuuaacuuuuggccaagagaaugaaggaggcuaaacagaagcgucaggaacaaauugcuaagaaaugcaggcuuuccugucugcaagcuucuacuucuaagucugaauccagucagaaauaagauuuuuugaauaacaaaucgauaagaucagacuaaaaaaaaaaggauaauaggaa

SEQ ID NO: 18427 - RNA, 799 nt, Homo sapiens
ccuccuccccgagcccggcgcaccgagccggccgugccaccgagcugcggcucuggccccggcgccgcgggugcgcugcggaugggcuuggggcgcacccagcgagcagcgagagucgcggugucccgggcgcucgcuggcaccguggccgcagcggccggccugggagccaggagggcgaggcggcugcaccuucggggccagauuggaguucgaagaguggcggguaccccagaagcucggggccggggcgauggcugcagccucgggaggguaucgccggaucgaacuccgggaaagggaagcaaaggcauggaaccuccgcacacuggaugagaauccaucuuccauucgagcugggaauagacuuugugaaagauauuauguaauggagucucgggaacccugagaccucuccagcgaagcugaagugaauuaauuaagugcuuuaaacggucuugguaaauauuccgcgggagcuggggaggaccguugggauggcuguagcuugaguugaauuuuaacuguccucauucuggguuuugucgcucugcuuucugugccaaggugcuguguuacgggagagagugacuggaaaguaacaaagcugaaucuuucucccuggaguaaggccgaagacuggauuacuacacgccuagacgugacacuacacccauagaucucaugcaucauuaaugccauaugacauugccauuuucuuucucaguucacggacaaaagugguggguuuucauugucuucacugauugucaaugcauuaauaaagaagauguguggu

SEQ ID NO: 18428 - RNA, 2699 nt, Homo sapiens
aggacagcaaucauauuggauuagggucuauccuaaugaccuuauuuuaauguaauuaccucuuuaaagaccauauacuguaacauucugagguacuugggguuaggacuucaacacaugaauuuuggggaggacacaauugagucuauaagaaaccccaucauauuugaaguguagaauagauauucaguaauuauuugucaaaugcaauuccuguuuguacaaauagucuuguguguuacuaugaagaauuuugggaaccauggaucuguuugacauaugugagaauaaugaacucuagaaacucuacaguugauuuucaugaaaaaugucugaauaaauauaaccagccugugaacagccugaggcugguuggaagguguguaucuaaucauugccauaugacuggucccuuccuugaauaggcacugauggggucuguaucugcucaacucguguugucaccuaguuuuaucuuuauggcaugcccaguccaaagcuuaguuaccuaaagaccuuuggguuguauggcuucaacauacagauggucagacagaccaaauucuuucagauggucugauuuggccauguuccuguagguaugggcuaaacaguguuaacguccugacucccaaauacaguccugauaccugauacagauacuaaaaucuguauugguuugcuagggcugccagaacaaaguaccacagaguggguggcuuaaacaacaggaauuuauauucuauaguucuggaggccagaagucugagaugaagguguuggcagguuugguuuuuuucagaggccucucuccuugacaugcagauggcugccuuuucccuaugucuucacguggucuuccuacuguguccugaucacccuauuuuauaagaauaccagucauguuggguuagggccuauccugaugcccucauuuaaccuuaauuuaccucuuuaaagacccccucuccacauucugaggcccuguggguugggacuuuaacaguguccuaucugucacaaggggcagaagugcugagaaaagacugaaaugggguuucagggaauauuguucccuuuugucuucccaguuuuuuuaguccauucuugcacugcuauaaaaugccugaaacuggguaauuuauacgaaaagagguuuaauuggcuaaugguuccacaggcuauacaggaagccugguagcaucugcuucugggggggccucagggagcuuuuacucauggugggaggcagagcuggagcagguaucuucacauggcuggagcaggaggaagggggcuggggggagugccacacacuuuuaaacaaccaggucucauaagaacucugucaugagaacagcaccagggggaugguacuaaacuguuagaaauugcccucaugauccagugaccucccaccaagccccaccuccagcaucacauuucuguaugagauuuggguggggacacagauacaaaccauaucaccaauuucaacaaaauucacagaucaggacuuauguaauuaaguguauauuuaguuuaauucuuucagaucaacuccuuuccuguucagagauaucccagaacccugcugaacggcuugcaguuuuuugucagcagguggauucuguacuuucccucgacuuuuguguuuguucuuuuccguguacaagccuucacagucuugacugaaguauuauucaugcaaugauuuauuugcacaaguaaaaacuuuuguuagacuuucuugccagcaagcugagaagugacucaccugcccacuuaccucuacucagaucugaucuccagaaguuguagaauucugagaagaucacccacagucaauuuaauugcuuggaauaugauuuuugcucuuuggcauugauuacauagguguuuauuuagucauuccuagugacuacucuguuuugcuuccuugaaauguuuuugucuuaauaucugcuguauuuugcuuuuggucacaggagugaaaaggcucucagugucugaguuaaaugaaauccuggaagaaauugagacugccauuaaggaguacucugaggagcuggugcagcaguuggcuuuacgagaugaacuggaguuugaaaaggaagugaaaaacagcuuuauuucuguucuuauugaagugcaaaacaaacagaaagagcacaaagaaacagcaaaaaagaaaaagaaacuaaaaaauggcagcucucagaaugggaagaaugagagaagucauaugcccggcacaguaagugauguuuugcaggaggcgucgaacacuggaaacagguucugugguagucccagccuuuggggcugguggcaggugcgacagguuguacaugggcaggaguguuaacacuucuaaucagagcccagugggauuuuauuccagaauaccgcugugcucagcuucuucagaaagucguuuucuugacuaggguguacugguuaucugaauaauacugaaauguuuagcaaggauguaaguggaaggaagagggggcaaaaaaggagaaugucuugaagaaaagaagcuuuagcaagugaacauuuuuaccacaucaaaaugugaagagugguuauguauauuuggcuaguaguuuuuuucuuauuuuugcugaacucuuacgaguugugugauaagaaauuagaagggguuuauuuagagguaucagaacucugcucaa

SEQ ID NO: 18429 - RNA, 2348 nt, Homo sapiens
uuuuuuuuuguauagaaauguaccauuuuauuacaaaggucucaaaaaugaaaacgguaucucaaaaaggaaacuagaccaccaaccuccaccugcagaauuaggggaagacaaagggcaggcagugugaguuucuuggcucaccugaggccacugggaagguaugaggacagagccaaucuaaaaauggcugauguuacauuagcagccugaaaagaacgggagacccuugaagaccuggccaccccuucuagaauguucaauaaggguaccuuuccaaagcuacuaagcaggcauuuggcauuuucaggauuuugucuuaugguugcaugaaaguaucccuuucacccaaaccugguacucuuuaugguucaaaguuaagaacuggggaaggauggaaggauggguggcaaggcagcuccuagaagaguucacccagcauagcugcccugggcucagggccuugguuucugucuagucccuggggauauuuauauuuaauaaacuuuccuauaaauacacagagaaauagaaagcauaaaaucugagguguugguggagaaaggcaggggacuuggcaagaagccagagcuggagaggucugcucaggccaaccugaccuccuccuugaccccuuuggcuucuggcuucuccuccuugguuuucuccucuucugugacuuugcucuucucaucuaggucuuucucuuuuccauccuguuuugacucucuuggcuuuuuugaaguuggaagaguucuuguggccacccucucucaccucaucagagucagagaacucuuccucacaggcaauucguuugucagaggaacagaucgagauccauuugucagggucuucuucgcucucaucgccacucuccucagggacagauccucuggaaucaccugcauuuggacccagguuuguggggcagcauucucagguucucaaacagucgcuguuuaucuucuccaaguaccauucguguucugguuagucauacuggaaggacugauguggagccugaaaucugguccaaacuauuccaaguagucgcuguauggaagcucauuagggaucucuguauccagggccacaccugucucauauguccagcacuaggcaacauuacaaauuggaaccacuuccucccagcaucagcauaggcagguuaaagcucuugacaaauuccauacacuuggcaugccccccucaacccuuuuuuuuuuuuuuugagauggagucucacucaguucuccaggcuggagugcccuggugcaaucagcucacugcaaccuccgccucuagggugcaagcgauucucaugacucagccucccgaauagcugggauuacagaagugcaccaccaugucugacuaauuuuuguauuuuuaguagaugcgggguuucaccauguuggccaggcuggugucaaacuucugaccucaagugauucuccugccugggccucccaaaaugcugagaacaggcaugagccaccacgacaggccagcaugugcuuugaugaucagauugaagcaaccuaaccaguccccagauaaggagucugagccacacuguaagagcacugaacuugaaauggccucauaggacuugucgucaaucccaucucggagcagguaguuaacagcauaauacuugccuuugccagccccaauauccuguagaucccuaguuccugaaaaguucucucccuacuuaggagaagacauagucaugacccagucugugguauagaaggccucuuccaucccaucgccguggugaauaucaaugucaauauacagcacccucuggugauagguuagcaguuccaggauggccaagacaaugucauugauguaauagaagccagaugccucaggcuucuuggcaugguucaggcccccagcccaauucacagcgaugucuaucugcugcuuauuaaguuucacagcacuugccagagagccaccaguagacaacuguaagaauucaaacaggccauugaauacuggacaguccuugcugacguugaaucugcaucugcuugcugugcucgaacauguaucugaagagauggagcgcaagaauuuaauguagucaucccugugguacuuggucaucuccucaguacuggguuugugagggugacagauuucuauuguucaguggagaccauagcugggcagcaaauugugaguaguagauuuggugaggcuucauuggauggucuugucuauaauauuaauuuccaacauccccgucguaguaguaacagacuuuccuccuggugcccugugucugcgucaucuugcuugccuuccaucccucccaucaguugguc

SEQ ID NO: 18430 - RNA, 6983 nt, Homo sapiens
cgcagucccccuugaacgcaccucagguaagacucuggcgaguggcuucccaugggcggucggauuucggggucccuagugcgacgagaguggggcggucuucugcguggggccucgucacaguucugggggcauguggaggauagucaggugucacugccuuaauucacuggaggcgaguguuuccgggucgcuaggcggccguggucuggcggccgggccgugcuccgugcgugcccgcgcgugucgccugcaggcccgggccuagcguuccgcgggcuaggggagagcugagggcagccgagggcaccagggaaccgggggaagcgggagcugggugggaccgcggcaggagccgggagccgggggagcggaggcggccagcucucggccucuguugaaaagucguccucugcacagcuaggcugggagagacguugcugcuugaaaccgcguagccugcagacgcuaagcugggaggccgccccgauucccuggagcgcaucccgggauaaggggcuuccgacccagcauugcacauuuggcuugagcuuguguccccgagucagcgucucagccccgugugauguuaacugcaugacacacagcccugcgccgaaucugucagaggcggcuucguguuaaacuucaccuaaacuucccggaaugaugccuuucccugugccgagaaggcaggcgcuggucugccgugucucccuugccgcagcuaguaaaccucacuucuuuguggguggacagguguaucccugguggucuguagcaaaggaacuugaaguuuuaucagccuccugaagccgagagccucagugcaaaacguauauguauuuuuaaaaagguaaauacuuuguuguacgguguuauuuggaggcagcuaugcucaccacuauacaccaaggcagccguacaguauuauucgcacuuuauuuucuuuucuuuuaacccuggccuacagauggacuuuauuucuuagcaccacccucucuuaaaacaaaauuuuacuucgauuccuugaauaauggaacuggcugcaggcggucuuuguucauuccuugaacauuaaaaauaaccccaagaggccgggcguggcggcacacgccuguaauaccagcacuuugggaggccgaggcgggaggaucacuugaggucggaaguuagccuggccaacauggugaaaccucaucucuacuaaacauacaaaaaauuagccagacgugguggcacacgccuauaaucccagcuacucgggaggcugaggcaggagaaucacuugaacccgggagacggagguugcagugagccaggaucgcaccacugcacuccugccugggagacagcaagacccagucucaaaaaaauaaaaauaggccaggcgcgguggcccacgccuguaauccuagcacuuugggaggccgaggccuguggauugccugagcucaggaguuggggaccacccugggcaacagggugaaauccgucucuacuaaaauacaaaaaauuugcugggccugguggcgggagucccagcucccagcuacuggggaggcugaggcaagagaauugcuugaauccggcaggcggagguuacagugagccaagaucgcgccacugcacuccagccugggcgacagagcgagaccgugucuccaaaaauaaaauaaaaaaaaaauaaccccaagagaggcaucuguacugagcaugacuuacuuucugucagucauguacagcauuguagugaauggagcaaaacaacugucccuucccaccacucaacugccucuuaguuauauaugaauuacuuuguaaauuucuuugcuucauuucuuuuaaauaagaauaauaaaguuuuaaucuuuugguccccagggugaucacauuauuaaaaugagggaauuuggggggugguggggagggccaccugguaagauaucagcagaauaauccuacaaaaggaagguuauuugauuacacccacccucaggcauugaaaaggggucggaagugaauggaguaaacaccugacagcagcgagcugggauugagaacaaaagagcacacacaggacaauagaaaaaucugaaaaacaagugguucuccucuucuggacuuugagguuauaaggaggcugacuaaaaacuuggguuuacauuaaugucuucaguaagucuuauauucuauuuucuuagcuuaucuuuaauuugaaaaagaauaaugacacaaacgcuuuuuccugauuagcuuuuaaaggaagacaaucaagaucuaaccggucuguaguuuugccacuuaacugguucaucacccaaucaguuuccauccccugcccccauuuguauaaaaauuacugcgugucugcgaaagggcagauuacuggcucaugccuguaaucccagcacuuugggaggcugaggugggcggauugcuugagcucacggguucgagaccaaucugggcaacauggugagacccugugucuacuaaaaauacaaaaaauacaaaaaaauagccaggcaugccaguggucccagcugcucgggaggcugaggugggaggauuguuugagcccagugagcugagauugugccacugcacuccaaaugccugaacuauggcacaguuuaguauauguuguauuaauaguuuaguauauguuguauuauuaguauguaucaguauauaggauaucuauacuaucuauaauauauaguauauguaauaguguauguuguauuaauaaaugaagaacuccagcccuuuagaaaguguagaaccacuugagaaagaucuuacuuuuguacggcacuuuacaaagagcuguuuauauauuguauccauuuagauuauuucuuaacucccagugcagcuaaaaaauuaucuuccccauucuguuuuccuacacaauuaaauaauuuuaguuccguaaauuguucuuuuuacaacgcuuucuugcauuuucucucuuuccugugcuuuauccaauuuugucuuugguucaucaugccccucaggcauggaguuugaaaacuagguagauaggaugucuaaaccaaaaaaguauaccauaguauuggucuuacucccauacagagaagccauucaaacugugggaaugaauuugaguuauuagagaaaugauaauaguaguuuaaguauguucauucagguuuacacauaucuguuguuaaauuuaggauggcccguacuuuggaaccacuagcaaagaagaucuuuaaaggaguuuugguagccgaacuuguaggcguuuuuggagcauauuuuuuguuuagcaagaugcacacaagccaagguaaucauaauucagaaguuaaugcuuucuaaagggguauaguuuugcuaauccauuuuauguguuaaauggcaauggcauguuuggagaaauugguucuucagauucaagauauuagacauuuuuaggggcagaacaggaaucaaaguauucauuauuguggacuagaucacucucacuucucccuuaaaaauguuguuugugggcuaaggaaaaaauuucauaccuccauggauuuuacuauuguggaggauauagcaaguguccuuggucuggcuuaguuugggagcacagauggaggaaacuuagccugcccauuauacuucauuguuugguagacuaagaaaguaacugguauugcuguuuucugaguaaccaguuuucucaggcuauaguauucuuccugggcaucaacagugggcacuaagacuuucacaugcuauggccgaaagugcuuuaacauuuuucuuggggaaauuuuauauuagagcucucaacuuuuuaaauuaggaagugauuuuucccuaaaacagggaauagaccuggcaugauagccaucuuugaaacuugccacagucuuccucagcauacuugguuggaacgcuguaccaagaugcuacuggauacucaaaaaaucccuuuucuuuuaaacucuaaggaaggguauuaaaaaaacaucccaacaguauuuaaaaacaaauuaaagcuugggaucaguuuuaaaaagugucauggcugggugugauggcuugcacuuguaauuccagcacuucgggaggccaagguggaaggacugcuugagcucagucugggcuaaacauaacaagacacuguaucuuaagaaaaaaaaaaaaagugcugggcaugauggugugcuccuguagucccagcuacucgggagguugagguaggaggcuccccugagccccaucccagcuacuugaccuuggcugacguaggaggcucgcuugagcccagcccaggggggucuaggcagugguggauugugacugugccacuguacugcagccugggcaacagggagagagauccugacucaaaaaaacaaaaggagaucguuccuggauuaccagaaagaccuucaaacaaauuucuaaucuauaugguucccaucauauggacccuaaagcuagcauuaaauuguggcuguguuaauauaaugaauuucuguucauaucuaauuucaagacauccuuuuuuccaucagauuucaggcaaacaaugagcaagaaauaucccuucaucuuggaagguauguuuuuccuuaaguaaaaauaaguauaaaacaacuucuucagguaaccuauaaauuauguaguaauuucuuuacaaggaauuucuaacaauacuauucacauguauuuuaguucuucugagacuaaauucucaucuauucuagugagaggagaauuagguaaugggcuggauucugaauucuucuagugguuaagaauguaaacucuggaaucauucauauaugaggugauagaaucaaaccacaguuuaaaccuuugguuuuaaaagaucaguuucaucucagguuugcuaacuucuuggagcugucucuuucucugucaaguagauaaagacugaacaagaugacaucauguaguuagacgaaauagugcucauuacaaugaucagagaugccaggacuuauaugugaagucuguaauccuacuguccucuuuuucauuuuguuauguagcaauauggaaaaaagaaguuguuuuuuucaauacauuuaauuuuaacaaugcuuccacaugacuuuauaaaugagagcuauuuuuauuuauaguuuauuacaaauccacugagaagucuggaauguauggaaucagagagcuagaucaaaaaacaugguugaacagcaaaaauuagauguaaguagaauuuuaaucuauaauuuacauuaauaacucauuuccuuuguuuuuuaguuuuuugagugguuuuaauccucuucuuuuuaaaauguuucuuuuucuugaugauacuuuuugcaucucuguuguguagccagucaucacguucagccucccaucuaagcuguuugagaccuuugagagaagaagaaaagaugaguguacuaccacacuguagacucuugguggucccacagaacaugcugcugagucacaggaacuucuagccugccuuggccugugguuucccacccacuauacaaacccacugcuuguuuguugcuuuucuucucauauuuauugucaaagauaaauguuucaaaaagaaaugacuaaggaaggaaaagaaacaaaugcucuaaagauuuucucuccccaagcacuuuuacuggugaaauaaaaaccaguaacaaucaauauguaaaaacggcccacuucccuaaaaaaaaguaauuuuuguagucugcaagguuuuuuuuuuuuuugcuuuagucuaaauacuuguuaaucuuacauguucuccugagagaagaaaaagccauuccuuucagguuguaaaguaccaugaaaaggucuuucaaaaauauuccuaucagccaggcaugguggcucacaccaguaaucucagcacuuugggaggccgaggcaggcgggucacuugaggucaggaguucgagaccagccuggccaacauggugaaacccuguuucuacuaaaaauacaaaaauuagcugggcgugguggugcaugccuguaaucccagcuacuugggaggcuaagguaggagaauuacuugaacaugggagauggagguugcagugagccaagaucaugccacugcauuccaaccugggcaagggagugagacgcugucucaaaaaaaaaaaaaaaaaaaaaaaaaaaaaaaaaaaaaaaaaaaaaaaagaauaaauaaaauaacgaaaauuuccuaucuucugaaguuccaagccaaagcuauuuuuaaaacaucaauaaaaaaauuuaaguuacuuacuugcauuaucuuuguuagccauggcauucaugccaauguuaucaaacuuggaucccauauuuucauccaauagauggccaaacuuuuaaacaaaaacgauaaauuuauuagaaaacuaaaaauaauguagaauagcuagcuuguuaaaacaguacauuagccuuaccucuucagcagauacaaauaggcuggaaucauuuaaguuucuuuucuuuuuucuuggcccuaaaaaaaauuguaagucuacauuauucaauuauaaaucuaaugauuuuagaaaaaugcaaugcaacaugauuuuauuuuaaaaauuauacuuggguaaaaacaauugcaauaaucuucuggcaccauuggguagcuggcauuuaaauauaauuuaagaguuaguauauaauauuuucaaaaagcuaacaacauccuaauagaacuguucagaugacaagagugucuucuugcuuuucagauuuggccacugaucgaaguuuuacccauaagggaaauaacauaguaucaagcaauaguaaaauuaucaguuugacauggauggguuuugaaauacuuaagacacaacauaaaauuuaguucaggggucuuuagauuguaaagaaauugacugaaaguauguuuauuaugcuauaaaugaaguuguuuauaacagcgaaaaagguucuccuuuaaaaaaaaaacuuau

SEQ ID NO: 18431 - RNA, 6983 nt, Homo sapiens
auaaguuuuuuuuuuaaaggagaaccuuuuucgcuguuauaaacaacuucauuuauagcauaauaaacauacuuucagucaauuucuuuacaaucuaaagaccccugaacuaaauuuuauguugugucuuaaguauuucaaaacccauccaugucaaacugauaauuuuacuauugcuugauacuauguuauuucccuuauggguaaaacuucgaucaguggccaaaucugaaaagcaagaagacacucuugucaucugaacaguucuauuaggauguuguuagcuuuuugaaaauauuauauacuaacucuuaaauuauauuuaaaugccagcuacccaauggugccagaagauuauugcaauuguuuuuacccaaguauaauuuuuaaaauaaaaucauguugcauugcauuuuucuaaaaucauuagauuuauaauugaauaauguagacuuacaauuuuuuuuagggccaagaaaaaagaaaagaaacuuaaaugauuccagccuauuuguaucugcugaagagguaaggcuaauguacuguuuuaacaagcuagcuauucuacauuauuuuuaguuuucuaauaaauuuaucguuuuuguuuaaaaguuuggccaucuauuggaugaaaauaugggauccaaguuugauaacauuggcaugaaugccauggcuaacaaagauaaugcaaguaaguaacuuaaauuuuuuuauugauguuuuaaaaauagcuuuggcuuggaacuucagaagauaggaaauuuucguuauuuuauuuauucuuuuuuuuuuuuuuuuuuuuuuuuuuuuuuuuuuuuuuuuuuuuuuuugagacagcgucucacucccuugcccagguuggaaugcaguggcaugaucuuggcucacugcaaccuccaucucccauguucaaguaauucuccuaccuuagccucccaaguagcugggauuacaggcaugcaccaccacgcccagcuaauuuuuguauuuuuaguagaaacaggguuucaccauguuggccaggcuggucucgaacuccugaccucaagugacccgccugccucggccucccaaagugcugagauuacuggugugagccaccaugccuggcugauaggaauauuuuugaaagaccuuuucaugguacuuuacaaccugaaaggaauggcuuuuucuucucucaggagaacauguaagauuaacaaguauuuagacuaaagcaaaaaaaaaaaaaaccuugcagacuacaaaaauuacuuuuuuuuagggaagugggccguuuuuacauauugauuguuacugguuuuuauuucaccaguaaaagugcuuggggagagaaaaucuuuagagcauuuguuucuuuuccuuccuuagucauuucuuuuugaaacauuuaucuuugacaauaaauaugagaagaaaagcaacaaacaagcaguggguuuguauagugggugggaaaccacaggccaaggcaggcuagaaguuccugugacucagcagcauguucugugggaccaccaagagucuacagugugguaguacacucaucuuuucuucuucucucaaaggucucaaacagcuuagaugggaggcugaacgugaugacuggcuacacaacagagaugcaaaaaguaucaucaagaaaaagaaacauuuuaaaaagaagaggauuaaaaccacucaaaaaacuaaaaaacaaaggaaaugaguuauuaauguaaauuauagauuaaaauucuacuuacaucuaauuuuugcuguucaaccauguuuuuugaucuagcucucugauuccauacauuccagacuucucaguggauuuguaauaaacuauaaauaaaaauagcucucauuuauaaagucauguggaagcauuguuaaaauuaaauguauugaaaaaaacaacuucuuuuuuccauauugcuacauaacaaaaugaaaaagaggacaguaggauuacagacuucacauauaaguccuggcaucucugaucauuguaaugagcacuauuucgucuaacuacaugaugucaucuuguucagucuuuaucuacuugacagagaaagagacagcuccaagaaguuagcaaaccugagaugaaacugaucuuuuaaaaccaaagguuuaaacugugguuugauucuaucaccucauauaugaaugauuccagaguuuacauucuuaaccacuagaagaauucagaauccagcccauuaccuaauucuccucucacuagaauagaugagaauuuagucucagaagaacuaaaauacaugugaauaguauuguuagaaauuccuuguaaagaaauuacuacauaauuuauagguuaccugaagaaguuguuuuauacuuauuuuuacuuaaggaaaaacauaccuuccaagaugaagggauauuucuugcucauuguuugccugaaaucugauggaaaaaaggaugucuugaaauuagauaugaacagaaauucauuauauuaacacagccacaauuuaaugcuagcuuuaggguccauaugaugggaaccauauagauuagaaauuuguuugaaggucuuucugguaauccaggaacgaucuccuuuuguuuuuuugagucaggaucucucucccuguugcccaggcugcaguacaguggcacagucacaauccaccacugccuagaccccccugggcugggcucaagcgagccuccuacgucagccaaggucaaguagcugggauggggcucaggggagccuccuaccucaaccucccgaguagcugggacuacaggagcacaccaucaugcccagcacuuuuuuuuuuuuucuuaagauacagugucuuguuauguuuagcccagacugagcucaagcaguccuuccaccuuggccucccgaagugcuggaauuacaagugcaagccaucacacccagccaugacacuuuuuaaaacugaucccaagcuuuaauuuguuuuuaaauacuguugggauguuuuuuuaauacccuuccuuagaguuuaaaagaaaagggauuuuuugaguauccaguagcaucuugguacagcguuccaaccaaguaugcugaggaagacuguggcaaguuucaaagauggcuaucaugccaggucuauucccuguuuuagggaaaaaucacuuccuaauuuaaaaaguugagagcucuaauauaaaauuuccccaagaaaaauguuaaagcacuuucggccauagcaugugaaagucuuagugcccacuguugaugcccaggaagaauacuauagccugagaaaacugguuacucagaaaacagcaauaccaguuacuuucuuagucuaccaaacaaugaaguauaaugggcaggcuaaguuuccuccaucugugcucccaaacuaagccagaccaaggacacuugcuauauccuccacaauaguaaaauccauggagguaugaaauuuuuuccuuagcccacaaacaacauuuuuaagggagaagugagagugaucuaguccacaauaaugaauacuuugauuccuguucugccccuaaaaaugucuaauaucuugaaucugaagaaccaauuucuccaaacaugccauugccauuuaacacauaaaauggauuagcaaaacuauaccccuuuagaaagcauuaacuucugaauuaugauuaccuuggcuugugugcaucuugcuaaacaaaaaauaugcuccaaaaacgccuacaaguucggcuaccaaaacuccuuuaaagaucuucuuugcuagugguuccaaaguacgggccauccuaaauuuaacaacagauauguguaaaccugaaugaacauacuuaaacuacuauuaucauuucucuaauaacucaaauucauucccacaguuugaauggcuucucuguaugggaguaagaccaauacuaugguauacuuuuuugguuuagacauccuaucuaccuaguuuucaaacuccaugccugaggggcaugaugaaccaaagacaaaauuggauaaagcacaggaaagagagaaaaugcaagaaagcguuguaaaaagaacaauuuacggaacuaaaauuauuuaauuguguaggaaaacagaauggggaagauaauuuuuuagcugcacugggaguuaagaaauaaucuaaauggauacaauauauaaacagcucuuuguaaagugccguacaaaaguaagaucuuucucaagugguucuacacuuucuaaagggcuggaguucuucauuuauuaauacaacauacacuauuacauauacuauauauuauagauaguauagauauccuauauacugauacauacuaauaauacaacauauacuaaacuauuaauacaacauauacuaaacugugccauaguucaggcauuuggagugcaguggcacaaucucagcucacugggcucaaacaauccucccaccucagccucccgagcagcugggaccacuggcaugccuggcuauuuuuuuguauuuuuuguauuuuuaguagacacagggucucaccauguugcccagauuggucucgaacccgugagcucaagcaauccgcccaccucagccucccaaagugcugggauuacaggcaugagccaguaaucugcccuuucgcagacacgcaguaauuuuuauacaaaugggggcaggggauggaaacugauugggugaugaaccaguuaaguggcaaaacuacagaccgguuagaucuugauugucuuccuuuaaaagcuaaucaggaaaaagcguuugugucauuauucuuuuucaaauuaaagauaagcuaagaaaauagaauauaagacuuacugaagacauuaauguaaacccaaguuuuuagucagccuccuuauaaccucaaaguccagaagaggagaaccacuuguuuuucagauuuuucuauuguccugugugugcucuuuuguucucaaucccagcucgcugcugucagguguuuacuccauucacuuccgaccccuuuucaaugccugaggguggguguaaucaaauaaccuuccuuuuguaggauuauucugcugauaucuuaccagguggcccuccccaccaccccccaaauucccucauuuuaauaaugugaucacccuggggaccaaaagauuaaaacuuuauuauucuuauuuaaaagaaaugaagcaaagaaauuuacaaaguaauucauauauaacuaagaggcaguugaguggugggaagggacaguuguuuugcuccauucacuacaaugcuguacaugacugacagaaaguaagucaugcucaguacagaugccucucuugggguuauuuuuuuuuuauuuuauuuuuggagacacggucucgcucugucgcccaggcuggagugcaguggcgcgaucuuggcucacuguaaccuccgccugccggauucaagcaauucucuugccucagccuccccaguagcugggagcugggacucccgccaccaggcccagcaaauuuuuuguauuuuaguagagacggauuucacccuguugcccagggugguccccaacuccugagcucaggcaauccacaggccucggccucccaaagugcuaggauuacaggcgugggccaccgcgccuggccuauuuuuauuuuuuugagacugggucuugcugucucccaggcaggagugcaguggugcgauccuggcucacugcaaccuccgucucccggguucaagugauucuccugccucagccucccgaguagcugggauuauaggcgugugccaccacgucuggcuaauuuuuuguauguuuaguagagaugagguuucaccauguuggccaggcuaacuuccgaccucaagugauccucccgccucggccucccaaagugcugguauuacaggcgugugccgccacgcccggccucuugggguuauuuuuaauguucaaggaaugaacaaagaccgccugcagccaguuccauuauucaaggaaucgaaguaaaauuuuguuuuaagagaggguggugcuaagaaauaaaguccaucuguaggccaggguuaaaagaaaagaaaauaaagugcgaauaauacuguacggcugccuugguguauaguggugagcauagcugccuccaaauaacaccguacaacaaaguauuuaccuuuuuaaaaauacauauacguuuugcacugaggcucucggcuucaggaggcugauaaaacuucaaguuccuuugcuacagaccaccagggauacaccuguccacccacaaagaagugagguuuacuagcugcggcaagggagacacggcagaccagcgccugccuucucggcacagggaaaggcaucauuccgggaaguuuaggugaaguuuaacacgaagccgccucugacagauucggcgcagggcugugugucaugcaguuaacaucacacggggcugagacgcugacucggggacacaagcucaagccaaaugugcaaugcugggucggaagccccuuaucccgggaugcgcuccagggaaucggggcggccucccagcuuagcgucugcaggcuacgcgguuucaagcagcaacgucucucccagccuagcugugcagaggacgacuuuucaacagaggccgagagcuggccgccuccgcucccccggcucccggcuccugccgcggucccacccagcucccgcuucccccgguucccuggugcccucggcugcccucagcucuccccuagcccgcggaacgcuaggcccgggccugcaggcgacacgcgcgggcacgcacggagcacggcccggccgccagaccacggccgccuagcgacccggaaacacucgccuccagugaauuaaggcagugacaccugacuauccuccacaugcccccagaacugugacgaggccccacgcagaagaccgccccacucucgucgcacuagggaccccgaaauccgaccgcccaugggaagccacucgccagagucuuaccugaggugcguucaagggggacugcg

SEQ ID NO: 18432 - RNA, 30661 nt, Homo sapiens
aagcuagcauuaaauuguggcuguguuaauauaaugaauuucuguucauaucuaauuucaagacauccuuuuuuccaucagauuucaggcaaacaaugagcaagaaauaucccuucaucuuggaagguauguuuuuccuuaaguaaaaauaaguauaaaacaacuucuucagguaaccuauaaauuauguaguaauuucuuuacaaggaauuucuaacaauacuauucacauguauuuuaguucuucugagacuaaauucucaucuauucuagugagaggagaauuagguaaugggcuggauucugaauucuucuagugguuaagaauguaaacucuggaaucauucauauaugaggugauagaaucaaaccacaguuuaaaccuuugguuuuaaaagaucaguuucaucucagguuugcuaacuucuuggagcugucucuuucucugucaaguagauaaagacugaacaagaugacaucauguaguuagacgaaauagugcucauuacaaugaucagagaugccaggacuuauaugugaagucuguaauccuacuguccucuuuuucauuuuguuauguagcaauauggaaaaaagaaguuguuuuuuucaauacauuuaauuuuaacaaugcuuccacaugacuuuauaaaugagagcuauuuuuauuuauaguuuauuacaaauccacugagaagucuggaauguauggaaucagagagcuagaucaaaaaacaugguugaacagcaaaaauuagauguaaguagaauuuuaaucuauaauuuacauuaauaacucauuuccuuuguuuuuuaguuuuuugagugguuuuaauccucuucuuuuuaaaauguuucuuuuucuugaugauacuuuuugcaucucuguuguguagccagucaucacguucagccucccaucuaagcuguuugagaccuuugagagaagaagaaaagaugaguguacuaccacacuguagacucuugguggucccacagaacaugcugcugagucacaggaacuucuagccugccuuggccugugguuucccacccacuauacaaacccacugcuuguuuguugcuuuucuucucauauuuauugucaaagauaaauguuucaaaaagaaaugacuaaggaaggaaaagaaacaaaugcucuaaagauuuucucuccccaagcacuuuuacuggugaaauaaaaaccaguaacaaucaauauguaaaaacggcccacuucccuaaaaaaaaguaauuuuuguagucugcaagguuuuuuuuuuuuuugcuuuagucuaaauacuuguuaaucuuacauguucuccugagagaagaaaaagccauuccuuucagguuguaaaguaccaugaaaaggucuuucaaaaauauuccuaucagccaggcaugguggcucacaccaguaaucucagcacuuugggaggccgaggcaggcgggucacuugaggucaggaguucgagaccagccuggccaacauggugaaacccuguuucuacuaaaaauacaaaaauuagcugggcgugguggugcaugccuguaaucccagcuacuugggaggcuaagguaggagaauuacuugaacaugggagauggagguugcagugagccaagaucaugccacugcauuccaaccugggcaagggagugagacgcugucucaaaaaaaaaaaaaaaaaaaaaaaaaaaaaaaaaaaaaaaaaaaaaaaagaauaaauaaaauaacgaaaauuuccuaucuucugaaguuccaagccaaagcuauuuuuaaaacaucaauaaaaaaauuuaaguuacuuacuugcauuaucuuuguuagccauggcauucaugccaauguuaucaaacuuggaucccauauuuucauccaauagauggccaaacuuuuaaacaaaaacgauaaauuuauuagaaaacuaaaaauaauguagaauagcuagcuuguuaaaacaguacauuagccuuaccucuucagcagauacaaauaggcuggaaucauuuaaguuucuuuucuuuuuucuuggcccuaaaaaaaauuguaagucuacauuauucaauuauaaaucuaaugauuuuagaaaaaugcaaugcaacaugauuuuauuuuaaaaauuauacuuggguaaaaacaauugcaauaaucuucuggcaccauuggguagcuggcauuuaaauauaauuuaagaguuaguauauaauauuuucaaaaagcuaacaacauccuaauagaacuguucagaugacaagagugucuucuugcuuuucagauuuggccacugaucgaaguuuuacccauaagggaaauaacauaguaucaagcaauaguaaaauuaucaguuugacauggauggguuuugaaauacuuaagacacaacauaaaauuuaguucaggggucuuuagauuguaaagaaauugacugaaaguauguuuauuaugcuauaaaugaaguuguuuauaacagcgaaaaagguucuccuuuaaaaaaaaaacuuaucuguaguacugaauauauaaacuuuuccugaaacaauuauucaaacucugcaucuuugauaucaaugucucuagcaguaguagagccauauuuuaaaaagagcuuuacuaaauacagaucauaacauucagcuguuuuaaguguauuaacgcauuuugguaaauuuacagacuuguucaaccacaaccacagucugauuuuagaacauuuccaucaacuucaaagaucccuggugccauuuguaguccuccaacccaucuccgaucuaucuuguuucuaugacuugccuuuucuggcuauuucauauaaaugggaucauaugacaugugguuuccuauaucugacuuuuuucauuuagcauaacguuuuugaggcucauccauguuguaguacuccaugccauguugugggcuacauaauauuccauuguauggauauaccacauuuugcuuaucaguuaauggacauuuagguuuugucuacuuuuuggcauuaauagugcugcugugaacaaucauguacaagucuuuguaucagagccacuuuugauaaaauaguuucuaaaacauuucaucuugauuuuuauuaaggugauauguauguuacuuaacagcuguauaauacacauuugcaugcauuaggaaguuuuuuuuggguuuuauucauccuguagugauguaucugugaccucaacgaguaggcacuucuguacuguacugguuucuuaaaguuucuuuuaucccgcccccacccccaaccucagccucaaguauguaacaccaugccuggcuaauuuuugauuuuuuuuuuuuuuuuuuugagacagagucucgcuuugucgccaggcuggaguacaggggcgugaucucggcucacugcaaccucugccuucuggguucaagcgauucuccugccucagccucccaaguagcugggccuacaagugcaugccaccacgccaagcuaauuuuuguauuuuuaguagagaugggguuucaucauguuggccaggauggucuugaucucuugaccuugugaucuaccugccuuggccucccaaagugcugggauuacaggcgugagccacugcgcccagccauuuuugauuuuuuguagagauggggucucauuguguugcccaggcugauuaaaguuucuauaagguauguuuauucuuaaggauaucuacucuaacaccuguaaauguagggugaucaauuaguaaauuaauaaaucugaaucaauuaauaaaucuguuuaaaauuccuugccucuuuuuguuucagucaauucuguuggguauucuuuaaucugcauccaaaacuauuaucaauugagaucugaaauccuuucaggcuaaugucuucugaaacaguacuuuacuauuugaaacaagcucagagcaucuuuuuuaacauuaaaaaauuuuuuucuucuccucaaauuccuuuuaccagcaucuuuuaauaaaaggcucaguagaacuugaaguaaagcaacacuuuucugugggaugcuuuugagaaaaacugccuauaucucaucuuaugcuaauacuaaaacaugaucuuagauacucaagggaagacaaaaucuggaagauaacguguuauaauuuaaauauguaucaguuaaaucauaguuauuacaggacuaagaaauugacagcaguauuugaaagagcugauaaaauuuuguaggcgugaggcucugaaagacuacuaccaauauguaaaugaaacuuuuugucaggccucugagcccaagcuaagccaucauauccccugugaccugcacgcacacauccagauggucgguuccugccuuaacugaugacauuccaccacaaaagaagugaaaauggccuguuccugccuuaacugaugacauuaucuugugaaauuccuucuccuggcucauccuggcucaaaagcuccccuacugagcaccuugugacccccacuccugccaggcagagaacaacccccuuugacugcaauuuuccuuuuuucuacccaaauccuauaaaauggccccaccccuaucucccuucacugacucucuuuucggacucagcccgccugcacccaggugaaauaagcagccuuguugcucaugcaaagccuguuugguggucucuucauacagacgcgcaugaaacuuuuuaaaacauuauuauuauuuaacuuugcagaucuauuuuuagucaucaguauuuagcaguaagcagaagccagagaggcacuggaggcaaaguauguacagugcuuucuacauuuuuaucaaaaaucuuaagacugucaccugauacagcacuuuuuucuuuuauuagcaccuuguguuacacugugaagcagaaucuuguaagauaauacuuuuaaaaauguuaaaaaacaauuagcagaaagaagaguucguaucauaauaaaggagcauggauuauugcaagggucaaauggcaaauaaugguugagaaaagaaaaagauaacaggugucugaaaaaugcaaggcuuuuauaauugaaugguuuaaaaaugaaugagcagagauuagcaugugaaucucuggacuagguaaggaagaucugcauucaaaugugagugggcaccauccaaucugcuggggcccuggagagaacaaaacaaagaggcaaacauguugaucugcugugcugaggaggaaaauggcggauaaggggacaggacuaacgugcagcucccacauggauggacagaacagcguguggcaacguguuuagucuccuuaaaagguauccaacaaaacuaagcuuccuaaaugaaggagagauaucuaugcugagaauucaccacuaccaagccagcacuauaagaaaugcugaaaggaguucuaaaucuuuguuuuuuguuucuuuuuuugagauggaaucuugcucugucgcccaggcgggaaggcaguggugugaucuuggcucacugcgaccucugccuaauggguucaagugauuuuuguaccucagccuccucaguagcugggauuauaggggcuuaccaacaugcccagcuaauuuuuguauuuuuuguagagauaggguuuugccauguuggccaggcuggucuugaacuccugacuucaggugaugcccgccugggccucccgaagugcugggauuacaggugugagccacuacacucagccuaggaauucuaaaucuugaaacaaaaccuugaaguacaccaaaauagagccuucuuaaaaccuaaaucuuacagggccuauacaauaacacaaugaaaaaacaacaaaaucaaaguauucaagcaacaacuagcaugaugaauagaauaguaccucacaucucaaauacuacguuggauguaaauggccuaaaugcuccucuuaaaagauacauuuggaccaccaaccaagaaucugcuguguucaggagacucacguaacacauaaggacucacauaaacuuaagguaaaggggugggaaaagauauuccaugcaaauggaaaccaaaagcaagcaggacuagcuauucuuauaucagacaaaacagacuuuaaagcaacaacaguuaaaaaagacaaagagggacauuacauacuaguaaaaugauuaguccaacaagaaaugucauaauccaaaauauauaugcaccuaccaccagagcuuccaaauuuauaaaaccauuacuacuagaccuaagaaauuagacagauggcaacacaauaauagugggugacuucaauacuccacugacagcccuagacgggucaucaagacagaaagucaacaaagaaacaauggacuuaaacuauaccuuagaacaaauggacuuaacagauaccuacggaacauucuacccaaaaacugcagaauauacauuauuuucaccagcacacggagcauucucaaggauagaccauaugguaggccacaaaacaagucucaauaaacuuaagaaaacugaaauuguaucaaguacccucucacaccacaguggaauacaauuggaaauuaacuccaaaaggaacccucaaaacuauauacaaauacauggaaauuuaauaaucugcucuugaaugaucuuugugucaacaaugaaaucaagauggaaauuaaaauuuuuugaacugaacaauagugacacaacccaucaaaaccucugggauacagcaaaagcggcacuacauuuaguaaguucacagcauuaaaugucuacaucaaaaagucugaaagagcauaaacagacaaucuaagcucacaccucaaggaacuagagaaacaagaacaaaucaaacucaaacccagcagaagaaaagaaauaacaaauaucagagcagaacuaaauaaaacugaagcaaacacuacaaaagauaaaugaaacaaaaagcugguucuguggaaaaauaaagaaaaucgguagaccauuagcaagauuaaccaaaaaaagaagagagaagaucugaauaagcucaauuagagacgaaaugggagauacuacaaccgauaccacagaaauacaaaagaucauucaaggcuacuaugaacaccuuuaugcacaaaaacuagaaaaccuagagaaaaauggauaaauuccuggaaauauacaacccuucuagauuaaaccagaaagaaauggaaacucugaacagaccaauaacaaguagcacgacugaaacaguaauaaaaaaacugccaacaaaacaaaguccaggaccagauggauucacagcugaauucuaucagacauucaaagaacugguaccaauccuacugaaacuauuccaaaagauagggaaagagggaauccucccuaaaucauucaaugaagccaauaucgcccuaauuccaaaaucaggaaaugacauaacaaaagaaaacuagagaccaauauuccucaugcacacagaugcaaaaacccucaacaaaauacuagcuaaccaacuccaacagcauaucaaaaagauaauacaccaugaucaaguggguuucuugccagggauauagggcugguuuaacauacgcaagucaauaaauaugauauaccacauaaacaauuaaaaacaaaaaucauaugaucaucucaauagacgcagaaaaagcauuugacaaaaucaagcauccuuuaugauuuaaacccucagcaaaacuggcauacaagggacguaccuuaaaaguaaugaaagccaucuaugauaaacccauagccaacauuauacugaacagggaaaaguugaaagcauucccccugagaacuggaacaagacaaggaugcccacuuucaccacuucuauucaacauaguacuggaaauccuagccagugcaacuggacaagagaaagaaagggcauucaaaucaguaaagaggaagucaaacugucacuauucaccgaugauaugauagcauaccuagaaaacccuaaagacucauccaaaaagauccuagaucugauaaauaaauccagcaaaguuucaggauacaaaaucaaugugcgcaaaccaguagcauugcuauacaccaacagcaaccaagcugagaaucaaaucaauuacucuaccccccuuacaacaccugccaaaaaaaaaaaaaauaauaauacuuaggaauacaccuaaucaaggaggugaaagaucucuaaaaggaaaacuacaaaacacugcugaaagaaaccacagacacacacaaauggaaacgcaucccauguucauggauggguagaaucgauauugugaaaaugaccauacugccaaaagcaaucuauaaauuuaauguaauucccaucaaaaugccaucaucauucuucacagaacuaggaaaaaaaauccugaaauucauauggaacaaaauaagagccugcauagccaagcaagacuaaacaaaaagaacaaaucuagaggcaucucauuaccugacuucaaacuauacuacuaggcuauuguuaccaaaauagcaugguacuuguacaaaaacaggcacguagaccaauggaacagaauagagaacccagaaauaaagccaaauacuuacaaccaucugaucuuugacaaaguaaacaaaaacaaaguggggaaaggacacccuauugaaccauuggugcugggauaacuggcaagccacauguaggagaauuaaacuggauccucauuucucaccuuaugcagaaaacucaagauggaucgaagacuuaaagauaagaccugaaacuguaaaaauucuagaauauaacauuggaaaaacucuucuagacauuggcuuaaguagaguucaugaccaagaaccuaaaugcaaaugcaacaaaaacaaauagaugggacuuaauuaagcuaaaaagcgucugcauagcaaaauaaauaaucagcagaguaaauagacaacccauagagugggagaaaaucuucguaaacuaugcaucugagaaaggacuaauguccagaaucuauaaggaacucaaaaaagucagcaagaaaaaaacaaucccaucaaaaaguguguuaaggauaugaacagacaauucucaaaagauauacaaauggucaagaaacauaugaagaaaugcucaacaucccugauuaucagggaaaugcaaaucaaagccacagugcaauaccaccuuacuccugcaagaauggccguaauuuaaaaauaaaaaaaauuucagauguuggcauggaugugguaauaagggaacacuucuacauugcuggugggaauguaaacuaguacaaccacuaugguaaacaguauggagaguccuuaaagaacugaaaguagaacuaucauuugaucuagcaaucccaccacuggguacuacccagaggaaaauaagucauuauauaaaaaagacaaacacacagauuuauaguagcacaaucugcaauugcaaaaauauggaaccaaccuaaaugcccaucaacuaaugaguggauaaagaaaaugugguauacauauaccauggaaugcuacucauccauaaaaaggagagaaauaauggcauucgcagcaaccugaauacagcuggagaccauuauucuaagcgaaguaauucaggaauggaaaaccaaacauucuauguucucaguuauaaaugggagcuaagcaaugaggaugcaaaggcuuaagaaugauauaauggacucuggggacuuggggggaagagugggaggcagugggggauaagaguacacauugggugcaguguacugcuugagugaugggugcaccaaaaucucagaaaucacuacuaaagaacuuaccuauguaaccaaacacccuaccuguuccccaaaaacaacugaaauaaugauaacaaauuuuuaaaaagugaaugaaaagaugauccagagauaucugaaugcgagaaacaauucaaaauguggaaaauaauuuccacuuaacaucuuucuuaaaaagaaccccccccaccccugaauuuuauuaaucaaauuuaggagaguucauuucccaaaaugauaaugacaccuuucacauggacacugcuuuuaaaagauauuaaauguauuuucuuaccuugaaaugagccagcaaagucaaaaucaucuguaccuuuucucuugcuuuucuuaguacugacuuuggaguggacuucaaguucuguuacacgaaaaaauuugcuaauaagcaauuuaaaaacaauaagacuggaaaauauuacuccaagauaugcuaaaaucuuuauucugaugguaaggcacuauacugcuauuccauguggguuuuguaauuccacuagcauaggcuugaggacagacugagaaaaagacucuaagaauuggcacaguucuaauauuuugugcaaguacaaaauuuucuaaauagcuucauuaauaagaccaaauaauauaaaaccccuuaaaacaagaaacuucugcugugguucagaauaaguaagaagaauguugggcaggcaugugcaugcuggagguaugugaaaggacagaaaggucagacaacagucuagagacaauucuggguguuccuugcuaauuuacaagauaaaauauucaccuucaucuaugcugggcuaugaugaauacugauuaacuuuuauaaacugcuaauuacuaucaaaaaauggcagcauuucagcucaacauguauuguacagagaagcuagcugcugguuaaaguaaaaguccaaagcucaaaaagcugcuuaaaagaaaacacacauaacacacaauaaaaacccuucagcuccaaacgagaagggaaaagguccuuuuaaguuucuggcugacaugaguauuaauuugaauacagggcuauauuaaaaaccuuuagcagaaaaacaaacuuaaggcuaaggaagugaggaagacacaguuuaugucuuauuuuaaaaaaugcuuaccuggaacgcucucacuuucaucaucuaacacauccaugaauguuccuccaucuucaucaacuucagcaaauucuucaucauccauacuuccuaaagaaacuucaucgucauccagguuaccaaguucaucaucacuaccuucugaaucuucaucuaauguguuauccuuagcuccuuuuguucucuuuuucacguuucuggaaaaaaacacaacuuguaauacaagaggaggcaguauuuucuaaaguaguguuuugcugacuacuagggcaguaggcuauuaaaugacucagaaggagaaagcuuugcagacugcucagaguaaauaauaacgugcuuuauaaaugucaaagaugaaaguacuguauccacuucccaaacuuacuugacuacauuuccccuuuaucauauaguucuguggucuacuguucugagggacaacaauuugggaaaugcuagaaaaauaggaaggagaagauagaaguauguuacccagcaaaauccauaucauccuuuccagagcugaaacaguuaucaucuucaaaugugucugccagacaauacagaaaugugagauacaacaaagaaugacaagcuugacauauaucuuguaucugaaucaauuauucuaagucaugauucugcuguuuaugacaagugaacaccaaaacaauguaaauguuacuguugcuagugugccuuaauaauguauacaaaccugugaaauacugaucuuaguuaaaucccaaaacuaaagaaggauccaguuaauuucggcucuuucuacaguucuuuuauggaaagaggauaaauaucaaauaaaaugauauuuagcaauugucguccuuuuuacucuauuagaacuacuuaagugcucauuuuuaauaggugugauacaauauguaacaucucaugcuuguaauuccagcacuuugggaggccgagguggagugaucaucagccugggcaacacggcaagacccuaucucuauuaaaaaaaaaaaaaaaacaaaaacaacaacaacaaaaaaaaaaacaaaaaaaaaacgagccggacaucauggcauguaccuguagucccagcuacccguggggcugaggcaggaaaaucgccugagcccagaaggucuaggcugcagggcugcagugaguugggauugugccacugcacuccagccugggagacagagagagccugucucaaaacaaacaaacaaaccccccaaaaaacaacaacaaaaaaauauguaacgugaaaucaguguaagucuuuccaauuuaccauguuuuuuguuuaagucuauuaaguuucaaucaaaauuucuguagcucuguggauuaaagauaaaaaagaucaaacaguagacuauugcuaucaauuaguacugauauacuauaauagauuaugaauaguaaaaaggauuucuuuuucacaugagauuuggcuguaacaauugaauagacuuaagcaaauauaaauguuuucuuauauagacuauccaaagcacaaaucauguauuuuucuggugcaaaugugggugaauuaccauauaucauaaaaauauuuguuucuuuuguuuuuuuuuugagacaggauuucacucugucacccaggcuagagugcagugccguaaucuuggcucacggcaaccucugacuccuggauucaagcgauucucgugccucugcuucucgaguagcugggacuacaggugcgugccaccaugcccagcucauuuuuugggguuuuuaguagagacaggguuucaccauauuggccaggcuggucucgaacuccugaccucaaacaaucuuccugccucggccugccaaagugcugggauuacaggugugagccacagcgccuggccccaaauauuucuuaaucuuccacugugauuugcaugauauucuuagcuaagugauuuuuuaaaacuaaggccacuucucccacuaauguuccauggucuauuaacacauaguaguagauuauuuuacaaagagucaacaaaacaaauuaccaaucagcucuucaaauucuucaucauccacgucuucuauacuuucuucaucugcaucccguuuuuguuucucuuuaacagcaacuuuuuuauaauaccuauaauauucauguuauauauuugacaauuuuauuaaaggucuaaucuuacuauauaucaucaaagcaccuaugaccaguggcaaaccacaacuguaaaaucuuaaguauacucaauuggaaauaaaugacugaaauuuguaucuaauauacaaaaaauaguuuaacucaauaaaaaguagcuggaaucuuuuaaguguaauacauuucaaagauaauauuuuaucagcccuauucuuauauuagaauacagcaaaacuuagccauuuacagauguaaucaaacccucaaaauuauucauucuaaaugauuuuaaaaaacaagccaaaucaaaccuaauuaaccagucaaccagaugagauaagagguacuuuacuacccuaaggcauuagguuaugauacuaguugguuuaggacuuauuucuauaacagugcacugaauccauucuaagggccauggucuggauaaauuacccaugaguuaucacuauauuaaacuuaaaguauuauauuaaaaucuauauuaaagguagauuuuaagccuauaaagaaaauuauuauaaaaggaaauuaaaggcuaaauuccaaaaagaagcauaaaacaaaauuuauaugcuaaauuaacaaaacucccaaauuuacuuuaguuuuacuaagauauauuaagauuagcaaaaugacggauuuguaaauuuucuuaacaaacacagacauauccuuugaucuuuucaaaauaugcugauuagauuucauaaaaugaagcauuuaaaacuaaggccacuucucccacuaauguuccauggucuauuuacacacaguaguagauuauugaaguagauuauuucauaaaaugaagcauuuuaugaaaucuaaaaauuuaaauuuuagcaguuuccccaaaugaaacuauauuauguauaguaccuguggaaaaacacuucauccacugguauuuggcuuucuucuuuugcaaggaacuccuuacuguucacuacaaaaauaaauuuaaacauuuuaacuucauauagcaauccccuuuauguuacucaagcucuuaagacaaaauacagcauaaucuguaauucuaaaaaucucagaauugugugggaagguagacagaagggacucuggagugcaagggacaaucucugaaaaagucugugugaagacccccccaacauuugaaacuucacuggcuacagcauaaaguaggcaguacauagcugucagugccguuacagugaaacaacaggguucucuuacuguucuucauuugcauccaggacccaacuuucaagagaaauaaaaaauucaaagaguuauuuuaauaaauaaucacuuuaaacuugucauuuucagcucaaaaaaugacaagcuugccauuaaugcgugccauucugggaauaaacaggaaguuaacagaguuuuccuuuauacugaggaaaacuaagaaauaaggaacuacaagaaaucaguuuuaccucuucagaauaaaaauugcugacucauccugaguaaaaggagauuuggcuuuuaauucuaacuuacuaacuguggguaaguccuuuuacaucucuggaccucugugaaguaagucacuggaaauuaaaugaucuauaaggucuaauuuaauccuggucucugaacaaaagggagaugagaucugguaugcaaagaaaugucugcuuugaauacaacaacagacucagauccagaagauggcuagcaaauauagaaguagguuauuaaguuuaaaaugaugcucugugacaaaaccagcuguggguuuuugugcugcuaagcugauauuagagagcuuuaagauggucugaauuguaagcaauaauaauuauauacauagggguuguggaugaagcuacggaugauaaaauggugacaacugucaaagcugggugaugguaauggggaggggguucaucauacuauuuuguuuauuuuggauauguuucaaauuugcuguaauaaaguuaaaaaaaaaaaaaaaaaggcccagucagauacaguagauuuaagaauaccuauucuugggaaaaaagauggauaaugucuuugaugcucagguuuuauucugauaaauuagaacaaagaauaauacaauuuaugcaucuuugucuuauauugucuuuucaguuucaacugucuaagguuuauacuuaccaggaagaugacgaauauccuuaauaaaauguuuucuuuucggcugcaucacaacacuaucuguguuuucugaaauguaaaauuaugacaguauaaugcaaaaccuaguuauaagcucauauuguuuauuauguauuaaaaaugaaagccaaauaauucacuaaauagaagcauaccuuugccuuuauggggcuuuggauuucgguauacaaaucgauccaaaaaucucauuagagugaaauccugcaguggguccccugaauacugaauauaguuucccugaaaaguggagcggggauuuaaaaacuuaauucaaauuaugucuaugaauccaaguaagaaaaaggaagaaaaagauaauuucuauuacacuguauugaagauacaaauaugcaauaaaugacucuucaaauaucucucucaugcacauuauacuuaaaaaauuaaacacacagauacauauacauacauauucuaggauguaauguugauuugauggauagacuaauauuaauaaugcaggccaucuaaccauuaaucaggaaccaaacccugaaguggcaaacacagcaaaugggaaagugaggcaguauuucuccaggagaggagcuagaagguaauaaauaaauaacugcguggcuuucaaugucuuauugcuuccacucaucucagagugggaaaaguuaucugcuacucuguaugaaacaagucacugcuucuuuauacgagcaguaaaauguacaagauucucucuguuagagaaaacacuguaugaccaauuauugauuaucuaaaaugauacuuuuuuucuuauuucucaucuuuggauuuauuuuagacucaccugaaggauggucuuugcaaaaagggccacggagggaugaaaaugcacagauaacuaaaaagaaaaaugugaauaauaucaauauuucuaaggucgacucuuaguacauuuauagcuuauuuaagaaaaucgggcugggugugguggcucacaccuguaauuccagcacuuugggaggcucaggcaggcagauugcuugagcccagaaguugagacuggccugggcaauauggcgaaaccccaugucuacaaaaaguacaaaaauagucagggugugauggugcgcgcgugccuguacucccagcuacucaggaggcuaaagugggaggacugccugggcccaggaggucgaggcugcagugagcugacauggcaccacugcacuccagccugggugacagagugagacccuauuucaacaacaacaaaaaugaaaaugcaaaaauuugaaauuuaagccaauacauuaaaaaagugauucucaaaacauauuggucucaggaccauuuccuacacuuaaaaaccaaaaauuccaucaguuucuauucaacagguuuauaucuacagacaccuauguuauaaaaauaaacagaaaaauuguaaauacuuauagguccauuaaaaauaacaauaaagcggccaggcgcgguggcucaugccuguaaucccagcaccuugggaggcugaggugggcggaucacgaggucaggagaucgagaccauccuggcuaacauggugaaaccccaucucuacuaaaaauacaaaaaauuagccgggcgugguggcgggugccuguagucccagcuacucgggaggcugaggcaggagaauggugugaaccugggaggcggaacuuggagugagccgagaucgcgccacugcacucuggccuaggcaacagagcaagacucugucucaaaaaaaaaaaacaaaaaacaaaaacaaaaaccauaaagcuacuacauacuaguaaguagcauauuuaugaaaaauaauuaugcagccaggcgagguggcucaugccuguaaucccagcauuuugggaggccgaggcgggcggaucacgaggucaggagaucgagaccauccuggcuaacacggugaaaccccgucucuacuaaaaauacaaaaaauuagccaggcguggcggugugcgccuguagucucagcuacucgggaggcugaggcaggaggauggugugaacccgggaggcggagcuugcagugagcugagaucgcaccaccgcacuccagccugggcgacagagcaagacucugccucaaaaaaaaaaagaaaaaagaaaaaaagaaaaauaauuaugcuucaggacgaaauauauagcgaguaguauuacuuuacaguuuugcaaaucucuuuaaugucuggcuuaacagaagagaguggauuauuucaucugcuucuguauuccacguugaaacauacaaucuggccucauguguagaaaauagucuuucacauagcugugaauuuucuucuuuaguacuauaccaaaaccaaagauuaguuguaauauggaaucugaaacccauauucaauuggcuuuugguacuugcuacuuaaaauuauuuggucuacuuugaaucaaucauuuauucacucaagaauuuguaacauucagguggcacaguggcucaugccuguaaucccagcacuuugggaggcugagguagguggaucaccugaagucaggaguucgagaccagccuggacaacauggcaaaacacugucugugcuaaaaauaaaaaaauuagcugggcaugguggcaugcuccuguaaucccagcuacucaggagguagagguugcagugagccgagaucgcgccacugcauuccaguaugggugacagaaccuucucguuucaaaaaaaagaauuuguaacauugugcauuggucauuggaaaaauaccauaugcaguccuuccaaacacuggcacauuucguuauacuuuaccacaacaaucacauuguuagaaccacugauuucaucagaaaaguuuuacaaauugagaaacugucaagcucaagguggugguuacaagauuuuuaaaacuuuaaucuuugcucgaaagcuuuauuuuugaauuuuauugcugacaacaaauacugccagcuuuuuuguuucauucauuuucaagaaaauaucucccaaauaccuaagccugaauaaccaguuugucagucuuucaugaaagagcagcuagaugagcuugcaacaacugguaagcacuuguccuugagacacgugacaaccuucaugcuuuagguaggcagcacagguauguuacgcauacuugcuauguaugcacacgaaauacuaaaaagacauguuacuuuaaggucaagacacuaaaaucaguaauucucccugugucaucauucuuaagucauacuggcuuuuuuuuuuuuaacugcacauauguggcagugaugaauauaauggcuucugaugcagcuuggugcugucuuuauucaggauaagcugcagcaguuuuaccuaucauuucuuuuauaguaucagugccaccgucaacacagugaugaaaacaaauaauguacugguauuacuauggaaagagcugugaccuggccgacucacuaaaaagguaucaggaacucuuaguggucuggccgcacuuugagaauagcugcauaagauacuuacuggcuuuacacaaaaagucacagaaagguuauuaaaaauaugaauuccucuuacaaauucagaaaaguaacuuuacuugcaaaaaauuuuaucauaaaacuuuucagagguaucuaauaaauaaagcaaaauuuauccauuuucucaacucuauaugcaauaaucuaccuacaaaaagcaacagucauaacccaugcaugacauccuuauuuuacgugcacacuuaagauuuucuacaaaaugaacacuucacauaguaucuucccccaaauguggacuuuuaauguuuauuaaugcuuauaauuaucauaaaaaaacaaaaacuucaaggcauuacauccucaagggcaaaaauauacagcauaggccgggcgcaguggcucaugccuguaaucccagcacuuugggaggcugaggcaggcggaucacaaggucaggagaucaagaccauccuggccaacauggugaaaccccgucucuacuaaaaauacaaaaauuagcugggcgugguggugggcgccuguaaucccagcuacuugggaggcugagccaggagaauggcuugaacccggaaggcggacguuacagugagccacaaucaugccacugcacuccagccuggugacagaggaagacucugucucaaaaaaaaaaaaaauauauauauauauauauagcauaaaugaauaaaagacaauuugaaauuauuuuaccuuuuugaguucccaaagacuuguauuuucagcuccacagaacagaggguuucuacugaauggaucguauuuauuuaacuguuucccaccuaggaauaacaaaaaaaauacgauuucucaaaugcuuucuuccuagcccaagaggucauuaaaagcaccaccauuaauauucucaacagauaucuccaacauucuuacuuagccaagcaaccuagauuaaaaacucugagcucccucaagaauuugucuugguacuuaagcuagcaucugcucuugaauaaagcagagaacauguuuaucccaaacaccaaaagcuuucuucaaggccaggugcaguggcucacaccuguaaucacagcacuuagggaggcugaggcgaguggaucauuugaguucaggaguucgagaccagccugggcaaaauggugaaaccccaucucuuacaaaaaauacaacaaaaaaacuagccaggugugguggugugugccuguagucccagcuauucgggagacugaggugggaggaucacuugagcccaggagaugggaguugcagugaaccaagaucgugccauugugauccagccuuccugacagagcaagacccugacucaaaaauaaguaaguaaaagcucccuucaaaacuucuccuuuggcugggcacaauggcucaugccuauaaucccagcacuuugggaggccaagguggaaaggcugcuugagaccaagagcucgagaccagccggugcacagagugggauuucgucucuacaaaaaacacaacuagccauaccugguggcacgagccuguagucccggcuaccugggaggcugaggugggaggaucgcuugaguucaggaguuugaggcugcagugagccauaauggcccacuguacuccagccuggccugggugacauagugagacccugucucaaaaaaaacaaaaaccaaaccaaaaaaccccaaacuucucccuuuccuaaauggcaacaaaaggugcccauuuuggggccaaagagguggaaacguuaagauggaaauaaucugaagaugaacuaggucuaaagucuuuuggagcuuuagagugcuucaaauauuugucaugaaaguaugcccagaaauaauucucacuuggaacaggucugacauuaucuucauguuuuuagaaacucaggauuaaaaaaauuuaaaacaaagauuuuucagaacaaacuaggaacugacuaccuuccaacacacaagcucuucauccuucuaaaggauuauucucaguuuagucuucaggggaacugauggauucuucucaaacuuuucuggcagcuaucagacuucucuuuuguacuucacaaacugaaauuuguagaugaauuaauuugacugugagucccaaagcaagcugaagaaaugggucuggcaccacauuucucgaaccucaaggcugguguuuucuucacagccucaaaugaaggggcugcauuucuaagauuuuuuuuugacucuaacauucuauuaauagacuuuuaauuuaguuugguguguguauagaaaaccacuuaacguuucuaucuugaacagaaaguuuucuaucccuaaaacauuacuuuaagaaacugugggccagguacaguggcucacgccuguaaucccagcacuuugggaggcugaggcaggcagaucaccugaggucaggaguuugagaccagccuggcgaacauggugaaacuccaccucuacuaaaaauacaaaaauuagccaggugugguggcacaugccuguaaucccagcuacuugggagguugaggcaggagaaucacuugaaccugggaggcggagguugcagugagccgagaucacgccucugcauuccagccugggcaacagagugagacucugucuaaauaaauaaauaaguaaauaaaaugguagaaugcuauuuucuaugaaaaucaaagagaaacaaacucccuagagaauaaagaugaaaaaaacucaccuuucaaauuaucaaagugcacccaggaagcaaccucugguuuuuugguuucuacaucaguuucaggaacuguuuccucugucucaaguuuuuucacuaucucuguuucuuugucugcaucagugaauuuuuccaugucuucaucaucauuugcaucaauaaaauuuucuucaucaucagacuccuaacaaaaguauaguuucauaaaucuacauaaaucaacuggaaguugcaauaaagucugugcuccauuaugugaugcagaguuuuacuuauugcaacucuggugaaacgugaaaguucuaauaaaguaaaaugauggcuaucaaugguauuuaaacaagagaggagauuacauccuuauuucuaaacauaacacaguuaaguuuugagcuaagaaccccugagccuuaaggacucuaauacuugaaaacaauuagcccucaaguaaauuucugacuuguaaauaacccuaugagguagguacuauuauuuccauuucauuguuaaggaagaagacuuaagaggucuacuaaguuuuauagucuuccaaaucucauauaaugguagcuucuaguauaguacaguuuauugcaaguagaagaguugagcaacaugcccaccuaguaaacuguacagcugguacuaaaaucuagguuuguccuauuccagaacucacacucauaugcuccagagaacuagguuacugucauuugaagcaaagaaaaacaaaacaaaaaccaauauauuucagcacccacucaauuuaaaaagcaguuguaaaauauaccggaugaucaucuaguuggcuucuuaaaccugguuuugcuuuaaggaucucagacacaagauauaaagcuccacauauaaaugguggcaucuguugacaaguaacuugaaguaaccucuucacaaaagccuucacccggcgcaacacaaugucagcuuucagagauuuguagacaagguuaagaaacauagcuugcuuggaacacgucaucaacccuggauccaacaucuuccugcaaaacaaaaccaaggucaaauauuuauguauaaaaccaucuccacaaccaauggucacauauuagaaauagcuacuaaccucaucuuaguuagggauaacuuugcugcuuauuuuagaacaagagacccugcccuaagagguaagauggaagucaaugaccagaaaaggaugaugauggcaccaggaaaaaccaacagcaacagacacaggaauaggcauuuuugagugugugguuuucuugucuuuuccaaguguuuuucuguuuucuauaucaacagggcacagcccuaacaguauuuacagaaccccaccagaaaagcuaaucuaaaaccagauagugaaaacugacccaugaaagcagaacauuagaagauuuggguuuuuguccuuguauaacuaccuacuagcagggggaccagaggccgccucuucaugauuuuagugaagaccaucgaugaacagcagaaaauuaaauucuaaggacuucagagaaucucuaguccaauguacuagcuguguaacauuccucucauacacgcuauuuucacugcccagagugcuucucuccaacucucugcauguccacaguauccaaaauugguucuucuauuagucucucagucccauguuuguguucuucauaguuucacaaacuugauuuuccugccuuucccucuucucuaaagguccaaugaaauagggauuaugccuguuauucacuguuguaaccccagugccuggcaguuaauaccuuuacaugacaguuuuccaaauacuugaaccuauuuagcuauuaugugcuugucucucccuaaugucugucuucuguaggcugcucuacuuugaucucaugauacuuuaaaaauucucuauccuaggugcugaauccuacacauguccccaaccggucuagaccugcagauauuaggacacccagaauuaacacaauccuccagauuagcucuauuaacaccuggaaucauuacuuccuuuguuuuaagcauuuccauuaauuuuuuccuacuaacacuagaaaugaaaaauacuuaagcuugugaagcacuuuccuauugcucugaauacucugggaaauaucacccuuuugguaauauucugggauauucuggauuauucaauuuucucucuuuacauuuaaauuuucccucuuuacauuuaaauuuuccaacauuuccauccauuuugcaauuuauuauuaggcauaaauuacaucucacaucaacagaaacaucugagaagaauuuagagacaugucucuaucauuucaugaaauauuuuccuaauguuuugauaaauauuuuuguaaaccaaaucaugucauuucuuuuaucccucaauuaacuagggguuuucuuaaugugaaggauuccuaauaaaaccaagagcaaacaaacacuuuaagaaggccuaaaggccuguuaagaaacuccaucugugagcgcuuuuggcaaauaguaauuucaaaaacuuaaaaauccacccuuccucagagauguuagacuaugauguuaaauagagacagaaaaauguuuucuaauagauuucaaacacuuucuaaaaaucaaaaauuccuaugaccaucaaaaguucaaaauaaugaaaccaccccccuucaaaacaaacaaacaaacaaacaaacaaacaaacuaacaaaaacaaaacucaagaucccgaaaccucuacauuuucagccuuggaacucuuuucaaauuaacaguguuaaguuaucuauuacuucaaagaguuguggaaaggcuucugagucuuuuuaguggaccagagcaaucagugcuaugaaaugucaugaaaucuacagcaaguggaccuggacuugccaccuaacuuggucucuuaauaucugugugaccuugcccaaauuauuguaucucacaguguggggaaaaggaagagagaucagauuguuacugugucuguguagaaagaaguagacauaggagacuccauuuuguuauguacuaagaaaaauucuucugccuugagauucuguuaaucuauaaccuuacccccaaccccgugcucucugaaacaugugcuguguccacucagaguugaauggauuaagggcggugcaagaugugcuuuguuaaacagaugcuugaaggcagcaugcuccuuaagagucaucaccacucccuaaucucaaguacccagggacacaaaaacugcggaaggccgcagggaccucugccuaggaaagccagguauuguccaagguuucuccccaugugauagucugaaauauggccucgugggaagggaaagaccugaccgucccccagcccgacacccguaaagggucugugcugaggaggauuaguaaaagaggaaggaaugccucuugcaguugagacaagaggaaggcaucugucuccugccugucccugggcaauggaaugucucgguauaaaacccgauuguaugcuccaucuacugagauagggaaaaaccgccuuagggcuggaggugggaccugugggcagcaauacugcuuuguaaagcauugagauguuuauguguaugcauaucuaaaagcacagcacuuaauccuuuacauugucuaugaugcaaagaccuuuguucacguguuugucugcugacccucuccccacaauugucuugugacccugacacaucccccucuucgagaaacaccgacagaugaucaauaaauacuaagggaacucagaggcuggcgggauccuccauaugcugaacgcugguuccccgguuccccuuauuucuuucucuauacuuugucucugugucuuuuucuuuuccaaaucucucgucccaccuuacgagaaacacccacagguguguaggggcaacccaccccuacaucacagacuggagagcuguuaagaggauuaaacuaaagaaacauggaugacuaucaguaauaaggauagccgccaacauuucacauagcacuaaguguuaggcacuguuaagcacuuaauauacauagaaagauuacauggguuaacacacauaaccucccaaccuucauuaaagccccaguucugucauuuacaagcuguagaaccuugugcaaguuucaaaaucuucauaauaaucauaugagauagcugcuuuucucuccauccuacagacaaauccacuuaagcaugauaacaugggaugaauuaugucuaccaauagguuuuuaguggggaucaaguaauuugcccaaaauuacacagaaaacuaauggcagggacucaaacccaggcggcguggcuuaagucuaagauacgaaccacuacuccacauuuucucacaagauauaucuauguaaaaauauaaaaaugaaucagaaggaaauauauuaauuucuugaacacaguugcuauguucgacugucucuuaaacagcuccaaacuguuuacacauugcugaaaauaugaugccucaaugggugaguugcaaaauucaguaaagaaaaucuucaucuccauuaaaaaacaacaacaaaaaaaacccugcacccugcaucccccaaaacucucuacuuaacauacuuuguuuaccaccgcuccccucucugccaccuccuccaauaugaaugugagcgccuccaggggugggauuucuguucgcugugccuccugugcaccuagagcauggcaccauacugcaggcacucagaaaauacuuguugaaugaguuacugugugaaugcauucaacugugugaaagacagcagggaaaagauagaggacugaggagaaugggaagacggaaacugcaauuauaucugcaauuuuauuucuuuaauaucccaaaagauuuaaaacaaauauagcaaaauguuaauucugaaauacuaggugguagauaugaaugaaucuuuuggguauuuuucuguauuuuacaaccucucaaaaugaaaaauguauucaaagcaucuaauauaauuugugcccaucagggaaacaaagauuaagugacuuacuugaagguggcgaguagcaagcugcugagggggccuaaaaccaaauuuucuaacucuuuuucuugccccacagagggcacugcuugugcuguacuacaucaaguuauuauuucaugucucauauuggaaggguauguucuuaccuguauaaugcuguguaauaucgauccgauauugucugcugagaauucauuacuuggaaaagcaacauuaaagccuggacacugguauuaaaauucacaauaugcaacacuuuaaacagugugucaaucugcucccuuacuuugucaucaccagucugggaauaaggguaugcccuauucacaccuguuaaaagggcgcuaagcauuuuugauucaacaucuuuuuuuuugacacaaguccgaaaaaagcaaaaguaaacaguuauuaauuuguuagccaauucacuuucuucaugggacagagccauuugauuuaaaaagcaaauugcauaauauugagcuuuggagcugauauuugagcggaagaguagccuuucuacuucaccagacacaacuccuuucauauugggauguuuacaaaguaaugucucuaacagaugggaugcuuuuguggcaauucuguucugaggaucucccaguuuauuuaccacuugcacaagaagagccuuuucuuccucaggcuuguuacaaagcagcucaugagccacgguaagggcucgaguuuuagugguuacuaauguaucaugacuuaaaguuucuaagaccugcacaaauucagccacuaaguguuucagcugguguucaaaauaccauaauaucagucuucuaucucuugaguccuuguugccacuggacaacuguuccaguuugucaaaaggacgcuggcugaaaauccucagcuuccgauugucuggcaaaaggucugugauaagcaacucuuugaaaguauccaaggccauaaggcacugcuguuugcugcccuucuuuuuaacaagguucacaagaguuucuacaaacugaagugugugaacggcaucauccugaauaagaagaaucauggcugccauccugucaccuaguguccccgaugacacaauugccuucauccagguagaagaggcucccuuuugacuauucgucuuacuuuugaauaaguugauuucaugcugauacagcuucugagcaaggguuuuguacuuagauacaacauccugaggcugggguuucaaagaauauucauugcuguacuccagaucauaccauuugccuccaggccuaaguaacaaagucugucucucaaaaaauucaaagauguucuguuuaucuuucuuuacuuucggugugguacugccauucucaucagaaugugguucuggccuauucuuauuuuucaccuuauuaacugauguccuuugacuuucugcuguauuuuuauuauuuauuuuagguauuuuuacuucuuuuuugcuggaauuuucuuuuucagcugguucaucuucuucaacuaaggaagcuuuuguauacuucgccaaauuaagauuuugaauaaaugcuuccaauucaccuugcugaaggucaucgauugcuccuuuuuugccuccaucuaucacuuccucauucucauccaaaguagccagcauaagguaaucuugcugcauuaaaaacauaaguuaaaaauacauuacaaaugugaaaaauaaaaccauaaaauaauaggaaacacaacauaauuuuaaaaauaauuucggaacuggaaaaauccuuucaaauuugacauaaaacucaggguccacaaaggaaaggauaaguaaauuucucuuucucucucuuucuuuuacacacacacacacgcacacacacuuuuuauuucgauauaggaaaaaaauauaaauuauaaacuggaaaaaaaauacaagcaauuccuaucaaaguaauuggguuuaaucccuuaauauaaguuucuacacaucaguaagugacaacccaaaagaaaaaugugcaaaggacaugaacaguucauagaaaaaaaggguucuuuaagaauaugaaaagauguucaaccucacugagguuuagacaaauccacauuaaaaccacaaugauacauccaucuuuuaauuuaucagaugagcaaagauacacugcaagaugagcaagauacaaugacaggugaugcuggggaagggguggcggaaacggcacuuucauacaugguugaugugaguguaaacugacacaaccuccauggaggacaauuugucaacuccaaucacaacuauuuaauacaaggcacacaucuguuggcccagcagcuucauuucuaaaaauuaacuaacugauugagacauggucucgcucuguuguccaggcuugaguacaguggcaugaccauggcugaacugcagccucaaccucccaggcugaagugauccuccaaccucagccuguagcuggcacuacacgcccagcuauuuaaaaaaaaaauuuuuuuuugagaugaggucuccuuauguugcccaggcuggucucaaacuccuggacucaagguauccucccaccucugacucccaaagugcugggauuaugggugugagccacugugccuggcucauuucuacaaauuuauacuacauauacacuuacaaaagugggggaaaaacacgauuaagguuauuaacuguaguauuauuuaaaauagugaaagacuggcaauaauuuaaauauucacaauaaauggcugguuagauaaauuaagacagacaaaaugauuuaugcagccauagcaaugacacagaacguuaugcacugauauagaaggauuucuaagacagaaaagaaagcaaaauguagagauagguguauauauaugguaccauuuauguaaaaaagauacacccguauuucauacacauaaaugaguauguauaugcuugaaaagguauauaguaucccugaaagauauaaaaugcaguuguaaaaauaauugcuuccuaucagggcaaugguuauggcugagauaaaaguggaaacaauuugacuucacuauguaucuuuuaaaguuugcaccacguguuucauguguauauauuaccuauucaaaacuuaaauauacacaagcacagagcaaacugugaaucugccuaucucuaacuaacuccuccaccuugaaaguccagucuccaaacaaaauaauauuaaaaacaaaguuaauuucuguuccuuaucugcuuaaaaucuuccagugguuuugcaucaaacucagagcaaaagccugcccucugaccccucggcccuccuuucuuacuauucuccccuuaacucacucugccucugcuacacuggcauuuuggcugcucauggaauagguuaggcacucuucugccugucuuugcauuugcuguuccaacugacuggaauggcagcucacuccuuccuguccuuuaggauucugcucaaacauuuccgugauguguuugucgaucaucucauuuaauacuaacgcgcucccacuccuuaucguccuuccuuguuuuauuuucuuuuauagcacuaccccgcgucugcuguacuauguguuuaaaaguuuguuuacuguuucucucccuuaauuaggaugcuccaaaaaagagggcuucuggggcauacagugacacgugcauguacucuaugagaacagaaaugaaaauuccaauaccacugguguucaaaacacucauaccacaaggucaggaccaagaaaagccacucuccgaccugauggugugaugguuauaccacgucaauaaaaucagaagaucgccuacauccuaagaauagccagagaauacaacguucaauucgaaacuuuucuuuuguaaacagcaguggaaaccggcgugggaagcgcaccgaacacaugcuucagaggcugggaucucgguccuggacgcccgcgcucuacgcagcgcggaagcggcggggcagucagccuagccaccuucggaacucuccacgccugaucccguuccccggagcccgcggccguuaccuuggugccuccgagccguaacacuuccuccagggagaacccauucucggcuucacuaguauuauccucauccuccucguccggaucuucuacugccuccucggggcgccaaggccgcuuggcauggaacuccaaaggcuccuugacugcggccauggcgggcaaagcauacgcgcgugaaacucagccuauuuccgcucugccaguggcguaauu

SEQ ID NO: 18433 - RNA, 30661 nt, Homo sapiens
aauuacgccacuggcagagcggaaauaggcugaguuucacgcgcguaugcuuugcccgccauggccgcagucaaggagccuuuggaguuccaugccaagcggccuuggcgccccgaggaggcaguagaagauccggacgaggaggaugaggauaauacuagugaagccgagaauggguucucccuggaggaaguguuacggcucggaggcaccaagguaacggccgcgggcuccggggaacgggaucaggcguggagaguuccgaagguggcuaggcugacugccccgccgcuuccgcgcugcguagagcgcgggcguccaggaccgagaucccagccucugaagcauguguucggugcgcuucccacgccgguuuccacugcuguuuacaaaagaaaaguuucgaauugaacguuguauucucuggcuauucuuaggauguaggcgaucuucugauuuuauugacgugguauaaccaucacaccaucaggucggagaguggcuuuucuugguccugaccuugugguaugaguguuuugaacaccagugguauuggaauuuucauuucuguucucauagaguacaugcacgugucacuguaugccccagaagcccucuuuuuuggagcauccuaauuaagggagagaaacaguaaacaaacuuuuaaacacauaguacagcagacgcgggguagugcuauaaaagaaaauaaaacaaggaaggacgauaaggagugggagcgcguuaguauuaaaugagaugaucgacaaacacaucacggaaauguuugagcagaauccuaaaggacaggaaggagugagcugccauuccagucaguuggaacagcaaaugcaaagacaggcagaagagugccuaaccuauuccaugagcagccaaaaugccaguguagcagaggcagagugaguuaaggggagaauaguaagaaaggagggccgaggggucagagggcaggcuuuugcucugaguuugaugcaaaaccacuggaagauuuuaagcagauaaggaacagaaauuaacuuuguuuuuaauauuauuuuguuuggagacuggacuuucaagguggaggaguuaguuagagauaggcagauucacaguuugcucugugcuuguguauauuuaaguuuugaauagguaauauauacacaugaaacacguggugcaaacuuuaaaagauacauagugaagucaaauuguuuccacuuuuaucucagccauaaccauugcccugauaggaagcaauuauuuuuacaacugcauuuuauaucuuucagggauacuauauaccuuuucaagcauauacauacucauuuauguguaugaaauacggguguaucuuuuuuacauaaaugguaccauauauauacaccuaucucuacauuuugcuuucuuuucugucuuagaaauccuucuauaucagugcauaacguucugugucauugcuauggcugcauaaaucauuuugucugucuuaauuuaucuaaccagccauuuauugugaauauuuaaauuauugccagucuuucacuauuuuaaauaauacuacaguuaauaaccuuaaucguguuuuucccccacuuuuguaaguguauauguaguauaaauuuguagaaaugagccaggcacaguggcucacacccauaaucccagcacuuugggagucagaggugggaggauaccuugaguccaggaguuugagaccagccugggcaacauaaggagaccucaucucaaaaaaaaauuuuuuuuuuaaauagcugggcguguagugccagcuacaggcugagguuggaggaucacuucagccugggagguugaggcugcaguucagccauggucaugccacuguacucaagccuggacaacagagcgagaccaugucucaaucaguuaguuaauuuuuagaaaugaagcugcugggccaacagaugugugccuuguauuaaauaguugugauuggaguugacaaauuguccuccauggagguugugucaguuuacacucacaucaaccauguaugaaagugccguuuccgccaccccuuccccagcaucaccugucauuguaucuugcucaucuugcaguguaucuuugcucaucugauaaauuaaaagauggauguaucauugugguuuuaauguggauuugucuaaaccucagugagguugaacaucuuuucauauucuuaaagaacccuuuuuuucuaugaacuguucauguccuuugcacauuuuucuuuuggguugucacuuacugauguguagaaacuuauauuaagggauuaaacccaauuacuuugauaggaauugcuuguauuuuuuuuccaguuuauaauuuauauuuuuuuccuauaucgaaauaaaaagugugugugcguguguguguguguaaaagaaagagagagaaagagaaauuuacuuauccuuuccuuuguggacccugaguuuuaugucaaauuugaaaggauuuuuccaguuccgaaauuauuuuuaaaauuauguuguguuuccuauuauuuuaugguuuuauuuuucacauuuguaauguauuuuuaacuuauguuuuuaaugcagcaagauuaccuuaugcuggcuacuuuggaugagaaugaggaagugauagauggaggcaaaaaaggagcaaucgaugaccuucagcaaggugaauuggaagcauuuauucaaaaucuuaauuuggcgaaguauacaaaagcuuccuuaguugaagaagaugaaccagcugaaaaagaaaauuccagcaaaaaagaaguaaaaauaccuaaaauaaauaauaaaaauacagcagaaagucaaaggacaucaguuaauaaggugaaaaauaagaauaggccagaaccacauucugaugagaauggcaguaccacaccgaaaguaaagaaagauaaacagaacaucuuugaauuuuuugagagacagacuuuguuacuuaggccuggaggcaaaugguaugaucuggaguacagcaaugaauauucuuugaaaccccagccucaggauguuguaucuaaguacaaaacccuugcucagaagcuguaucagcaugaaaucaacuuauucaaaaguaagacgaauagucaaaagggagccucuucuaccuggaugaaggcaauugugucaucggggacacuaggugacaggauggcagccaugauucuucuuauucaggaugaugccguucacacacuucaguuuguagaaacucuugugaaccuuguuaaaaagaagggcagcaaacagcagugccuuauggccuuggauacuuucaaagaguugcuuaucacagaccuuuugccagacaaucggaagcugaggauuuucagccagcguccuuuugacaaacuggaacaguuguccaguggcaacaaggacucaagagauagaagacugauauuaugguauuuugaacaccagcugaaacacuuaguggcugaauuugugcaggucuuagaaacuuuaagucaugauacauuaguaaccacuaaaacucgagcccuuaccguggcucaugagcugcuuuguaacaagccugaggaagaaaaggcucuucuugugcaagugguaaauaaacugggagauccucagaacagaauugccacaaaagcaucccaucuguuagagacauuacuuuguaaacaucccaauaugaaaggaguugugucuggugaaguagaaaggcuacucuuccgcucaaauaucagcuccaaagcucaauauuaugcaauuugcuuuuuaaaucaaauggcucugucccaugaagaaagugaauuggcuaacaaauuaauaacuguuuacuuuugcuuuuuucggacuugugucaaaaaaaaagauguugaaucaaaaaugcuuagcgcccuuuuaacaggugugaauagggcauacccuuauucccagacuggugaugacaaaguaagggagcagauugacacacuguuuaaaguguugcauauugugaauuuuaauaccaguguccaggcuuuaauguugcuuuuccaaguaaugaauucucagcagacaauaucggaucgauauuacacagcauuauacagguaagaacauacccuuccaauaugagacaugaaauaauaacuugauguaguacagcacaagcagugcccucuguggggcaagaaaaagaguuagaaaauuugguuuuaggcccccucagcagcuugcuacucgccaccuucaaguaagucacuuaaucuuuguuucccugaugggcacaaauuauauuagaugcuuugaauacauuuuucauuuugagagguuguaaaauacagaaaaauacccaaaagauucauucauaucuaccaccuaguauuucagaauuaacauuuugcuauauuuguuuuaaaucuuuugggauauuaaagaaauaaaauugcagauauaauugcaguuuccgucuucccauucuccucaguccucuaucuuuucccugcugucuuucacacaguugaaugcauucacacaguaacucauucaacaaguauuuucugagugccugcaguauggugccaugcucuaggugcacaggaggcacagcgaacagaaaucccaccccuggaggcgcucacauucauauuggaggagguggcagagaggggagcggugguaaacaaaguauguuaaguagagaguuuugggggaugcagggugcaggguuuuuuuuguuguuguuuuuuaauggagaugaagauuuucuuuacugaauuuugcaacucacccauugaggcaucauauuuucagcaauguguaaacaguuuggagcuguuuaagagacagucgaacauagcaacuguguucaagaaauuaauauauuuccuucugauucauuuuuauauuuuuacauagauauaucuugugagaaaauguggaguagugguucguaucuuagacuuaagccacgccgccuggguuugagucccugccauuaguuuucuguguaauuuugggcaaauuacuugauccccacuaaaaaccuauugguagacauaauucaucccauguuaucaugcuuaaguggauuugucuguaggauggagagaaaagcagcuaucucauaugauuauuaugaagauuuugaaacuugcacaagguucuacagcuuguaaaugacagaacuggggcuuuaaugaagguugggagguuauguguguuaacccauguaaucuuucuauguauauuaagugcuuaacagugccuaacacuuagugcuaugugaaauguuggcggcuauccuuauuacugauagucauccauguuucuuuaguuuaauccucuuaacagcucuccagucugugauguagggguggguugccccuacacaccuguggguguuucucguaaggugggacgagagauuuggaaaagaaaaagacacagagacaaaguauagagaaagaaauaaggggaaccggggaaccagcguucagcauauggaggaucccgccagccucugaguucccuuaguauuuauugaucaucugucgguguuucucgaagagggggaugugucagggucacaagacaauuguggggagagggucagcagacaaacacgugaacaaaggucuuugcaucauagacaauguaaaggauuaagugcugugcuuuuagauaugcauacacauaaacaucucaaugcuuuacaaagcaguauugcugcccacaggucccaccuccagcccuaaggcgguuuuucccuaucucaguagauggagcauacaaucggguuuuauaccgagacauuccauugcccagggacaggcaggagacagaugccuuccucuugucucaacugcaagaggcauuccuuccucuuuuacuaauccuccucagcacagacccuuuacgggugucgggcugggggacggucaggucuuucccuucccacgaggccauauuucagacuaucacauggggagaaaccuuggacaauaccuggcuuuccuaggcagaggucccugcggccuuccgcaguuuuugugucccuggguacuugagauuagggaguggugaugacucuuaaggagcaugcugccuucaagcaucuguuuaacaaagcacaucuugcaccgcccuuaauccauucaacucugaguggacacagcacauguuucagagagcacgggguuggggguaagguuauagauuaacagaaucucaaggcagaagaauuuuucuuaguacauaacaaaauggagucuccuaugucuacuucuuucuacacagacacaguaacaaucugaucucucuuccuuuuccccacacugugagauacaauaauuugggcaaggucacacagauauuaagagaccaaguuagguggcaaguccagguccacuugcuguagauuucaugacauuucauagcacugauugcucugguccacuaaaaagacucagaagccuuuccacaacucuuugaaguaauagauaacuuaacacuguuaauuugaaaagaguuccaaggcugaaaauguagagguuucgggaucuugaguuuuguuuuuguuaguuuguuuguuuguuuguuuguuuguuuguuuugaaggggggugguuucauuauuuugaacuuuugauggucauaggaauuuuugauuuuuagaaaguguuugaaaucuauuagaaaacauuuuucugucucuauuuaacaucauagucuaacaucucugaggaaggguggauuuuuaaguuuuugaaauuacuauuugccaaaagcgcucacagauggaguuucuuaacaggccuuuaggccuucuuaaaguguuuguuugcucuugguuuuauuaggaauccuucacauuaagaaaaccccuaguuaauugagggauaaaagaaaugacaugauuugguuuacaaaaauauuuaucaaaacauuaggaaaauauuucaugaaaugauagagacaugucucuaaauucuucucagauguuucuguugaugugagauguaauuuaugccuaauaauaaauugcaaaauggauggaaauguuggaaaauuuaaauguaaagagggaaaauuuaaauguaaagagagaaaauugaauaauccagaauaucccagaauauuaccaaaagggugauauuucccagaguauucagagcaauaggaaagugcuucacaagcuuaaguauuuuucauuucuaguguuaguaggaaaaaauuaauggaaaugcuuaaaacaaaggaaguaaugauuccagguguuaauagagcuaaucuggaggauuguguuaauucuggguguccuaauaucugcaggucuagaccgguuggggacauguguaggauucagcaccuaggauagagaauuuuuaaaguaucaugagaucaaaguagagcagccuacagaagacagacauuagggagagacaagcacauaauagcuaaauagguucaaguauuuggaaaacugucauguaaagguauuaacugccaggcacugggguuacaacagugaauaacaggcauaaucccuauuucauuggaccuuuagagaagagggaaaggcaggaaaaucaaguuugugaaacuaugaagaacacaaacaugggacugagagacuaauagaagaaccaauuuuggauacuguggacaugcagagaguuggagagaagcacucugggcagugaaaauagcguguaugagaggaauguuacacagcuaguacauuggacuagagauucucugaaguccuuagaauuuaauuuucugcuguucaucgauggucuucacuaaaaucaugaagaggcggccucuggucccccugcuaguagguaguuauacaaggacaaaaacccaaaucuucuaauguucugcuuucaugggucaguuuucacuaucugguuuuagauuagcuuuucuggugggguucuguaaauacuguuagggcugugcccuguugauauagaaaacagaaaaacacuuggaaaagacaagaaaaccacacacucaaaaaugccuauuccugugucuguugcuguugguuuuuccuggugccaucaucauccuuuucuggucauugacuuccaucuuaccucuuagggcagggucucuuguucuaaaauaagcagcaaaguuaucccuaacuaagaugagguuaguagcuauuucuaauaugugaccauugguuguggagaugguuuuauacauaaauauuugaccuugguuuuguuuugcaggaagauguuggauccaggguugaugacguguuccaagcaagcuauguuucuuaaccuugucuacaaaucucugaaagcugacauuguguugcgccgggugaaggcuuuugugaagagguuacuucaaguuacuugucaacagaugccaccauuuauauguggagcuuuauaucuugugucugagauccuuaaagcaaaaccagguuuaagaagccaacuagaugaucauccgguauauuuuacaacugcuuuuuaaauugagugggugcugaaauauauugguuuuuguuuuguuuuucuuugcuucaaaugacaguaaccuaguucucuggagcauaugagugugaguucuggaauaggacaaaccuagauuuuaguaccagcuguacaguuuacuaggugggcauguugcucaacucuucuacuugcaauaaacuguacuauacuagaagcuaccauuauaugagauuuggaagacuauaaaacuuaguagaccucuuaagucuucuuccuuaacaaugaaauggaaauaauaguaccuaccucauaggguuauuuacaagucagaaauuuacuugagggcuaauuguuuucaaguauuagaguccuuaaggcucagggguucuuagcucaaaacuuaacuguguuauguuuagaaauaaggauguaaucuccucucuuguuuaaauaccauugauagccaucauuuuacuuuauuagaacuuucacguuucaccagaguugcaauaaguaaaacucugcaucacauaauggagcacagacuuuauugcaacuuccaguugauuuauguagauuuaugaaacuauacuuuuguuaggagucugaugaugaagaaaauuuuauugaugcaaaugaugaugaagacauggaaaaauucacugaugcagacaaagaaacagagauagugaaaaaacuugagacagaggaaacaguuccugaaacugauguagaaaccaaaaaaccagagguugcuuccugggugcacuuugauaauuugaaaggugaguuuuuuucaucuuuauucucuagggaguuuguuucucuuugauuuucauagaaaauagcauucuaccauuuuauuuacuuauuuauuuauuuagacagagucucacucuguugcccaggcuggaaugcagaggcgugaucucggcucacugcaaccuccgccucccagguucaagugauucuccugccucaaccucccaaguagcugggauuacaggcaugugccaccacaccuggcuaauuuuuguauuuuuaguagagguggaguuucaccauguucgccaggcuggucucaaacuccugaccucaggugaucugccugccucagccucccaaagugcugggauuacaggcgugagccacuguaccuggcccacaguuucuuaaaguaauguuuuagggauagaaaacuuucuguucaagauagaaacguuaagugguuuucuauacacacaccaaacuaaauuaaaagucuauuaauagaauguuagagucaaaaaaaaaucuuagaaaugcagccccuucauuugaggcugugaagaaaacaccagccuugagguucgagaaauguggugccagacccauuucuucagcuugcuuugggacucacagucaaauuaauucaucuacaaauuucaguuugugaaguacaaaagagaagucugauagcugccagaaaaguuugagaagaauccaucaguuccccugaagacuaaacugagaauaauccuuuagaaggaugaagagcuuguguguuggaagguagucaguuccuaguuuguucugaaaaaucuuuguuuuaaauuuuuuuaauccugaguuucuaaaaacaugaagauaaugucagaccuguuccaagugagaauuauuucugggcauacuuucaugacaaauauuugaagcacucuaaagcuccaaaagacuuuagaccuaguucaucuucagauuauuuccaucuuaacguuuccaccucuuuggccccaaaaugggcaccuuuuguugccauuuaggaaagggagaaguuugggguuuuuugguuugguuuuuguuuuuuuugagacagggucucacuaugucacccaggccaggcuggaguacagugggccauuauggcucacugcagccucaaacuccugaacucaagcgauccucccaccucagccucccagguagccgggacuacaggcucgugccaccagguauggcuaguuguguuuuuuguagagacgaaaucccacucugugcaccggcuggucucgagcucuuggucucaagcagccuuuccaccuuggccucccaaagugcugggauuauaggcaugagccauugugcccagccaaaggagaaguuuugaagggagcuuuuacuuacuuauuuuugagucagggucuugcucugucaggaaggcuggaucacaauggcacgaucuugguucacugcaacucccaucuccugggcucaagugauccucccaccucagucucccgaauagcugggacuacaggcacacaccaccacaccuggcuaguuuuuuuguuguauuuuuuguaagagaugggguuucaccauuuugcccaggcuggucucgaacuccugaacucaaaugauccacucgccucagccucccuaagugcugugauuacaggugugagccacugcaccuggccuugaagaaagcuuuugguguuugggauaaacauguucucugcuuuauucaagagcagaugcuagcuuaaguaccaagacaaauucuugagggagcucagaguuuuuaaucuagguugcuuggcuaaguaagaauguuggagauaucuguugagaauauuaaugguggugcuuuuaaugaccucuugggcuaggaagaaagcauuugagaaaucguauuuuuuuuguuauuccuaggugggaaacaguuaaauaaauacgauccauucaguagaaacccucuguucuguggagcugaaaauacaagucuuugggaacucaaaaagguaaaauaauuucaaauugucuuuuauucauuuaugcuauauauauauauauauauuuuuuuuuuuuuugagacagagucuuccucugucaccaggcuggagugcaguggcaugauuguggcucacuguaacguccgccuuccggguucaagccauucuccuggcucagccucccaaguagcugggauuacaggcgcccaccaccacgcccagcuaauuuuuguauuuuuaguagagacgggguuucaccauguuggccaggauggucuugaucuccugaccuugugauccgccugccucagccucccaaagugcugggauuacaggcaugagccacugcgcccggccuaugcuguauauuuuugcccuugaggauguaaugccuugaaguuuuuguuuuuuuaugauaauuauaagcauuaauaaacauuaaaaguccacauuugggggaagauacuaugugaaguguucauuuuguagaaaaucuuaagugugcacguaaaauaaggaugucaugcauggguuaugacuguugcuuuuuguagguagauuauugcauauagaguugagaaaauggauaaauuuugcuuuauuuauuagauaccucugaaaaguuuuaugauaaaauuuuuugcaaguaaaguuacuuuucugaauuuguaagaggaauucauauuuuuaauaaccuuucugugacuuuuuguguaaagccaguaaguaucuuaugcagcuauucucaaagugcggccagaccacuaagaguuccugauaccuuuuuagugagucggccaggucacagcucuuuccauaguaauaccaguacauuauuuguuuucaucacuguguugacgguggcacugauacuauaaaagaaaugauagguaaaacugcugcagcuuauccugaauaaagacagcaccaagcugcaucagaagccauuauauucaucacugccacauaugugcaguuaaaaaaaaaaaagccaguaugacuuaagaaugaugacacagggagaauuacugauuuuagugucuugaccuuaaaguaacaugucuuuuuaguauuucgugugcauacauagcaaguaugcguaacauaccugugcugccuaccuaaagcaugaagguugucacgugucucaaggacaagugcuuaccaguuguugcaagcucaucuagcugcucuuucaugaaagacugacaaacugguuauucaggcuuagguauuugggagauauuuucuugaaaaugaaugaaacaaaaaagcuggcaguauuuguugucagcaauaaaauucaaaaauaaagcuuucgagcaaagauuaaaguuuuaaaaaucuuguaaccaccaccuugagcuugacaguuucucaauuuguaaaacuuuucugaugaaaucagugguucuaacaaugugauuguugugguaaaguauaacgaaaugugccaguguuuggaaggacugcauaugguauuuuuccaaugaccaaugcacaauguuacaaauucuuuuuuuugaaacgagaagguucugucacccauacuggaaugcaguggcgcgaucucggcucacugcaaccucuaccuccugaguagcugggauuacaggagcaugccaccaugcccagcuaauuuuuuuauuuuuagcacagacaguguuuugccauguuguccaggcuggucucgaacuccugacuucaggugauccaccuaccucagccucccaaagugcugggauuacaggcaugagccacugugccaccugaauguuacaaauucuugagugaauaaaugauugauucaaaguagaccaaauaauuuuaaguagcaaguaccaaaagccaauugaauauggguuucagauuccauauuacaacuaaucuuugguuuugguauaguacuaaagaagaaaauucacagcuaugugaaagacuauuuucuacacaugaggccagauuguauguuucaacguggaauacagaagcagaugaaauaauccacucucuucuguuaagccagacauuaaagagauuugcaaaacuguaaaguaauacuacucgcuauauauuucguccugaagcauaauuauuuuucuuuuuuucuuuuuucuuuuuuuuuuugaggcagagucuugcucugucgcccaggcuggagugcgguggugcgaucucagcucacugcaagcuccgccucccggguucacaccauccuccugccucagccucccgaguagcugagacuacaggcgcacaccgccacgccuggcuaauuuuuuguauuuuuaguagagacgggguuucaccguguuagccaggauggucucgaucuccugaccucgugauccgcccgccucggccucccaaaaugcugggauuacaggcaugagccaccucgccuggcugcauaauuauuuuucauaaauaugcuacuuacuaguauguaguagcuuuaugguuuuuguuuuuguuuuuuguuuuuuuuuuuugagacagagucuugcucuguugccuaggccagagugcaguggcgcgaucucggcucacuccaaguuccgccucccagguucacaccauucuccugccucagccucccgaguagcugggacuacaggcacccgccaccacgcccggcuaauuuuuuguauuuuuaguagagaugggguuucaccauguuagccaggauggucucgaucuccugaccucgugauccgcccaccucagccucccaaggugcugggauuacaggcaugagccaccgcgccuggccgcuuuauuguuauuuuuaauggaccuauaaguauuuacaauuuuucuguuuauuuuuauaacauaggugucuguagauauaaaccuguugaauagaaacugauggaauuuuugguuuuuaaguguaggaaaugguccugagaccaauauguuuugagaaucacuuuuuuaauguauuggcuuaaauuucaaauuuuugcauuuucauuuuuguuguuguugaaauagggucucacucugucacccaggcuggagugcaguggugccaugucagcucacugcagccucgaccuccugggcccaggcaguccucccacuuuagccuccugaguagcugggaguacaggcacgcgcgcaccaucacacccugacuauuuuuguacuuuuuguagacaugggguuucgccauauugcccaggccagucucaacuucugggcucaagcaaucugccugccugagccucccaaagugcuggaauuacaggugugagccaccacacccagcccgauuuucuuaaauaagcuauaaauguacuaagagucgaccuuagaaauauugauauuauucacauuuuucuuuuuaguuaucugugcauuuucaucccuccguggcccuuuuugcaaagaccauccuucaggugagucuaaaauaaauccaaagaugagaaauaagaaaaaaaguaucauuuuagauaaucaauaauuggucauacaguguuuucucuaacagagagaaucuuguacauuuuacugcucguauaaagaagcagugacuuguuucauacagaguagcagauaacuuuucccacucugagaugaguggaagcaauaagacauugaaagccacgcaguuauuuauuuauuaccuucuagcuccucuccuggagaaauacugccucacuuucccauuugcuguguuugccacuucaggguuugguuccugauuaaugguuagauggccugcauuauuaauauuagucuauccaucaaaucaacauuacauccuagaauauguauguauauguaucuguguguuuaauuuuuuaaguauaaugugcaugagagagauauuugaagagucauuuauugcauauuuguaucuucaauacaguguaauagaaauuaucuuuuucuuccuuuuucuuacuuggauucauagacauaauuugaauuaaguuuuuaaauccccgcuccacuuuucagggaaacuauauucaguauucaggggacccacugcaggauuucacucuaaugagauuuuuggaucgauuuguauaccgaaauccaaagccccauaaaggcaaagguaugcuucuauuuagugaauuauuuggcuuucauuuuuaauacauaauaaacaauaugagcuuauaacuagguuuugcauuauacugucauaauuuuacauuucagaaaacacagauaguguugugaugcagccgaaaagaaaacauuuuauuaaggauauucgucaucuuccugguaaguauaaaccuuagacaguugaaacugaaaagacaauauaagacaaagaugcauaaauuguauuauucuuuguucuaauuuaucagaauaaaaccugagcaucaaagacauuauccaucuuuuuucccaagaauagguauucuuaaaucuacuguaucugacugggccuuuuuuuuuuuuuuuuuaacuuuauuacagcaaauuugaaacauauccaaaauaaacaaaauaguaugaugaacccccuccccauuaccaucacccagcuuugacaguugucaccauuuuaucauccguagcuucauccacaaccccuauguauauaauuauuauugcuuacaauucagaccaucuuaaagcucucuaauaucagcuuagcagcacaaaaacccacagcugguuuugucacagagcaucauuuuaaacuuaauaaccuacuucuauauuugcuagccaucuucuggaucugagucuguuguuguauucaaagcagacauuucuuugcauaccagaucucaucucccuuuuguucagagaccaggauuaaauuagaccuuauagaucauuuaauuuccagugacuuacuucacagagguccagagauguaaaaggacuuacccacaguuaguaaguuagaauuaaaagccaaaucuccuuuuacucaggaugagucagcaauuuuuauucugaagagguaaaacugauuucuuguaguuccuuauuucuuaguuuuccucaguauaaaggaaaacucuguuaacuuccuguuuauucccagaauggcacgcauuaauggcaagcuugucauuuuuugagcugaaaaugacaaguuuaaagugauuauuuauuaaaauaacucuuugaauuuuuuauuucucuugaaaguuggguccuggaugcaaaugaagaacaguaagagaacccuguuguuucacuguaacggcacugacagcuauguacugccuacuuuaugcuguagccagugaaguuucaaauguugggggggucuucacacagacuuuuucagagauugucccuugcacuccagagucccuucugucuaccuucccacacaauucugagauuuuuagaauuacagauuaugcuguauuuugucuuaagagcuugaguaacauaaaggggauugcuauaugaaguuaaaauguuuaaauuuauuuuuguagugaacaguaaggaguuccuugcaaaagaagaaagccaaauaccaguggaugaaguguuuuuccacagguacuauacauaauauaguuucauuuggggaaacugcuaaaauuuaaauuuuuagauuucauaaaaugcuucauuuuaugaaauaaucuacuucaauaaucuacuacuguguguaaauagaccauggaacauuagugggagaaguggccuuaguuuuaaaugcuucauuuuaugaaaucuaaucagcauauuuugaaaagaucaaaggauaugucuguguuuguuaagaaaauuuacaaauccgucauuuugcuaaucuuaauauaucuuaguaaaacuaaaguaaauuugggaguuuuguuaauuuagcauauaaauuuuguuuuaugcuucuuuuuggaauuuagccuuuaauuuccuuuuauaauaauuuucuuuauaggcuuaaaaucuaccuuuaauauagauuuuaauauaauacuuuaaguuuaauauagugauaacucauggguaauuuauccagaccauggcccuuagaauggauucagugcacuguuauagaaauaaguccuaaaccaacuaguaucauaaccuaaugccuuaggguaguaaaguaccucuuaucucaucugguugacugguuaauuagguuugauuuggcuuguuuuuuaaaaucauuuagaaugaauaauuuugaggguuugauuacaucuguaaauggcuaaguuuugcuguauucuaauauaagaauagggcugauaaaauauuaucuuugaaauguauuacacuuaaaagauuccagcuacuuuuuauugaguuaaacuauuuuuuguauauuagauacaaauuucagucauuuauuuccaauugaguauacuuaagauuuuacaguugugguuugccacuggucauaggugcuuugaugauauauaguaagauuagaccuuuaauaaaauugucaaauauauaacaugaauauuauagguauuauaaaaaaguugcuguuaaagagaaacaaaaacgggaugcagaugaagaaaguauagaagacguggaugaugaagaauuugaagagcugauugguaauuuguuuuguugacucuuuguaaaauaaucuacuacuauguguuaauagaccauggaacauuagugggagaaguggccuuaguuuuaaaaaaucacuuagcuaagaauaucaugcaaaucacaguggaagauuaagaaauauuuggggccaggcgcuguggcucacaccuguaaucccagcacuuuggcaggccgaggcaggaagauuguuugaggucaggaguucgagaccagccuggccaauauggugaaacccugucucuacuaaaaaccccaaaaaaugagcugggcaugguggcacgcaccuguagucccagcuacucgagaagcagaggcacgagaaucgcuugaauccaggagucagagguugccgugagccaagauuacggcacugcacucuagccugggugacagagugaaauccugucucaaaaaaaaaacaaaagaaacaaauauuuuuaugauauaugguaauucacccacauuugcaccagaaaaauacaugauuugugcuuuggauagucuauauaagaaaacauuuauauuugcuuaagucuauucaauuguuacagccaaaucucaugugaaaaagaaauccuuuuuacuauucauaaucuauuauaguauaucaguacuaauugauagcaauagucuacuguuugaucuuuuuuaucuuuaauccacagagcuacagaaauuuugauugaaacuuaauagacuuaaacaaaaaacaugguaaauuggaaagacuuacacugauuucacguuacauauuuuuuuguuguuguuuuuugggggguuuguuuguuuguuuugagacaggcucucucugucucccaggcuggagugcaguggcacaaucccaacucacugcagcccugcagccuagaccuucugggcucaggcgauuuuccugccucagccccacggguagcugggacuacagguacaugccaugauguccggcucguuuuuuuuuuguuuuuuuuuuuguuguuguuguuuuuguuuuuuuuuuuuuuuuaauagagauagggucuugccguguugcccaggcugaugaucacuccaccucggccucccaaagugcuggaauuacaagcaugagauguuacauauuguaucacaccuauuaaaaaugagcacuuaaguaguucuaauagaguaaaaaggacgacaauugcuaaauaucauuuuauuugauauuuauccucuuuccauaaaagaacuguagaaagagccgaaauuaacuggauccuucuuuaguuuugggauuuaacuaagaucaguauuucacagguuuguauacauuauuaaggcacacuagcaacaguaacauuuacauuguuuugguguucacuugucauaaacagcagaaucaugacuuagaauaauugauucagauacaagauauaugucaagcuugucauucuuuguuguaucucacauuucuguauugucuggcagacacauuugaagaugauaacuguuucagcucuggaaaggaugauauggauuuugcuggguaacauacuucuaucuucuccuuccuauuuuucuagcauuucccaaauuguugucccucagaacaguagaccacagaacuauaugauaaaggggaaauguagucaaguaaguuugggaaguggauacaguacuuucaucuuugacauuuauaaagcacguuauuauuuacucugagcagucugcaaagcuuucuccuucugagucauuuaauagccuacugcccuaguagucagcaaaacacuacuuuagaaaauacugccuccucuuguauuacaaguuguguuuuuuuccagaaacgugaaaaagagaacaaaaggagcuaaggauaacacauuagaugaagauucagaagguagugaugaugaacuugguaaccuggaugacgaugaaguuucuuuaggaaguauggaugaugaagaauuugcugaaguugaugaagauggaggaacauucauggauguguuagaugaugaaagugagagcguuccagguaagcauuuuuuaaaauaagacauaaacugugucuuccucacuuccuuagccuuaaguuuguuuuucugcuaaagguuuuuaauauagcccuguauucaaauuaauacucaugucagccagaaacuuaaaaggaccuuuucccuucucguuuggagcugaaggguuuuuauuguguguuauguguguuuucuuuuaagcagcuuuuugagcuuuggacuuuuacuuuaaccagcagcuagcuucucuguacaauacauguugagcugaaaugcugccauuuuuugauaguaauuagcaguuuauaaaaguuaaucaguauucaucauagcccagcauagaugaaggugaauauuuuaucuuguaaauuagcaaggaacacccagaauugucucuagacuguugucugaccuuucuguccuuucacauaccuccagcaugcacaugccugcccaacauucuucuuacuuauucugaaccacagcagaaguuucuuguuuuaagggguuuuauauuauuuggucuuauuaaugaagcuauuuagaaaauuuuguacuugcacaaaauauuagaacugugccaauucuuagagucuuuuucucagucuguccucaagccuaugcuaguggaauuacaaaacccacauggaauagcaguauagugccuuaccaucagaauaaagauuuuagcauaucuuggaguaauauuuuccagucuuauuguuuuuaaauugcuuauuagcaaauuuuuucguguaacagaacuugaaguccacuccaaagucaguacuaagaaaagcaagagaaaagguacagaugauuuugacuuugcuggcucauuucaagguaagaaaauacauuuaauaucuuuuaaaagcaguguccaugugaaaggugucauuaucauuuugggaaaugaacucuccuaaauuugauuaauaaaauucaggggugggggggguucuuuuuaagaaagauguuaaguggaaauuauuuuccacauuuugaauuguuucucgcauucagauaucucuggaucaucuuuucauucacuuuuuaaaaauuuguuaucauuauuucaguuguuuuuggggaacagguaggguguuugguuacauagguaaguucuuuaguagugauuucugagauuuuggugcacccaucacucaagcaguacacugcacccaauguguacucuuaucccccacugccucccacucuuccccccaaguccccagaguccauuauaucauucuuaagccuuugcauccucauugcuuagcucccauuuauaacugagaacauagaauguuugguuuuccauuccugaauuacuucgcuuagaauaauggucuccagcuguauucagguugcugcgaaugccauuauuucucuccuuuuuauggaugaguagcauuccaugguauauguauaccacauuuucuuuauccacucauuaguugaugggcauuuagguugguuccauauuuuugcaauugcagauugugcuacuauaaaucuguguguuugucuuuuuuauauaaugacuuauuuuccucuggguaguacccaguggugggauugcuagaucaaaugauaguucuacuuucaguucuuuaaggacucuccauacuguuuaccauagugguuguacuaguuuacauucccaccagcaauguagaaguguucccuuauuaccacauccaugccaacaucugaaauuuuuuuuauuuuuaaauuacggccauucuugcaggaguaaggugguauugcacuguggcuuugauuugcauuucccugauaaucagggauguugagcauuucuucauauguuucuugaccauuuguauaucuuuugagaauugucuguucauauccuuaacacacuuuuugaugggauuguuuuuuucuugcugacuuuuuugaguuccuuauagauucuggacauuaguccuuucucagaugcauaguuuacgaagauuuucucccacucuauggguugucuauuuacucugcugauuauuuauuuugcuaugcagacgcuuuuuagcuuaauuaagucccaucuauuuguuuuuguugcauuugcauuuagguucuuggucaugaacucuacuuaagccaaugucuagaagaguuuuuccaauguuauauucuagaauuuuuacaguuucaggucuuaucuuuaagucuucgauccaucuugaguuuucugcauaaggugagaaaugaggauccaguuuaauucuccuacauguggcuugccaguuaucccagcaccaaugguucaauaggguguccuuuccccacuuuguuuuuguuuacuuugucaaagaucagaugguuguaaguauuuggcuuuauuucuggguucucuauucuguuccauuggucuacgugccuguuuuuguacaaguaccaugcuauuuugguaacaauagccuaguaguauaguuugaagucagguaaugagaugccucuagauuuguucuuuuuguuuagucuugcuuggcuaugcaggcucuuauuuuguuccauaugaauuucaggauuuuuuuuccuaguucugugaagaaugaugauggcauuuugaugggaauuacauuaaauuuauagauugcuuuuggcaguauggucauuuucacaauaucgauucuacccauccaugaacaugggaugcguuuccauuugugugugucugugguuucuuucagcaguguuuuguaguuuuccuuuuagagaucuuucaccuccuugauuagguguauuccuaaguauuauuauuuuuuuuuuuuuuggcagguguuguaagggggguagaguaauugauuugauucucagcuugguugcuguugguguauagcaaugcuacugguuugcgcacauugauuuuguauccugaaacuuugcuggauuuauuuaucagaucuaggaucuuuuuggaugagucuuuaggguuuucuagguaugcuaucauaucaucggugaauagugacaguuugacuuccucuuuacugauuugaaugcccuuucuuucucuuguccaguugcacuggcuaggauuuccaguacuauguugaauagaaguggugaaagugggcauccuugucuuguuccaguucucagggggaaugcuuucaacuuuucccuguucaguauaauguuggcuauggguuuaucauagauggcuuucauuacuuuuaagguacgucccuuguaugccaguuuugcugaggguuuaaaucauaaaggaugcuugauuuugucaaaugcuuuuucugcgucuauugagaugaucauaugauuuuuguuuuuaauuguuuaugugguauaucauauuuauugacuugcguauguuaaaccagcccuauaucccuggcaagaaacccacuugaucaugguguauuaucuuuuugauaugcuguuggaguugguuagcuaguauuuuguugaggguuuuugcaucugugugcaugaggaauauuggucucuaguuuucuuuuguuaugucauuuccugauuuuggaauuagggcgauauuggcuucauugaaugauuuagggaggauucccucuuucccuaucuuuuggaauaguuucaguaggauugguaccaguucuuugaaugucugauagaauucagcugugaauccaucugguccuggacuuuguuuuguuggcaguuuuuuuauuacuguuucagucgugcuacuuguuauuggucuguucagaguuuccauuucuuucugguuuaaucuagaaggguuguauauuuccaggaauuuauccauuuuucucuagguuuucuaguuuuugugcauaaagguguucauaguagccuugaaugaucuuuuguauuucugugguaucgguuguaguaucucccauuucgucucuaauugagcuuauucagaucuucucucuucuuuuuuugguuaaucuugcuaauggucuaccgauuuucuuuauuuuuccacagaaccagcuuuuuguuucauuuaucuuuuguaguguuugcuucaguuuuauuuaguucugcucugauauuuguuauuucuuuucuucugcuggguuugaguuugauuuguucuuguuucucuaguuccuugaggugugagcuuagauugucuguuuaugcucuuucagacuuuuugauguagacauuuaaugcugugaacuuacuaaauguagugccgcuuuugcuguaucccagagguuuugauggguugugucacuauuguucaguucaaaaaauuuuaauuuccaucuugauuucauuguugacacaaagaucauucaagagcagauuauuaaauuuccauguauuuguauauaguuuugaggguuccuuuuggaguuaauuuccaauuguauuccacuguggugugagaggguacuugauacaauuucaguuuucuuaaguuuauugagacuuguuuuguggccuaccauauggucuauccuugagaaugcuccgugugcuggugaaaauaauguauauucugcaguuuuuggguagaauguuccguagguaucuguuaaguccauuuguucuaagguauaguuuaaguccauuguuucuuuguugacuuucugucuugaugacccgucuagggcugucaguggaguauugaagucacccacuauuauuguguugccaucugucuaauuucuuaggucuaguaguaaugguuuuauaaauuuggaagcucuggugguaggugcauauauauuuuggauuaugacauuucuuguuggacuaaucauuuuacuaguauguaaugucccucuuugucuuuuuuaacuguuguugcuuuaaagucuguuuugucugauauaagaauagcuaguccugcuugcuuuugguuuccauuugcauggaauaucuuuucccaccccuuuaccuuaaguuuaugugaguccuuauguguuacgugagucuccugaacacagcagauucuugguuggugguccaaauguaucuuuuaagaggagcauuuaggccauuuacauccaacguaguauuugagaugugagguacuauucuauucaucaugcuaguuguugcuugaauacuuugauuuuguuguuuuuucauuguguuauuguauaggcccuguaagauuuagguuuuaagaaggcucuauuuugguguacuucaagguuuuguuucaagauuuagaauuccuaggcugaguguaguggcucacaccuguaaucccagcacuucgggaggcccaggcgggcaucaccugaagucaggaguucaagaccagccuggccaacauggcaaaacccuaucucuacaaaaaauacaaaaauuagcugggcauguugguaagccccuauaaucccagcuacugaggaggcugagguacaaaaaucacuugaacccauuaggcagaggucgcagugagccaagaucacaccacugccuucccgccugggcgacagagcaagauuccaucucaaaaaaagaaacaaaaaacaaagauuuagaacuccuuucagcauuucuuauagugcuggcuugguaguggugaauucucagcauagauaucucuccuucauuuaggaagcuuaguuuuguuggauaccuuuuaaggagacuaaacacguugccacacgcuguucuguccauccaugugggagcugcacguuaguccuguccccuuauccgccauuuuccuccucagcacagcagaucaacauguuugccucuuuguuuuguucucuccagggccccagcagauuggauggugcccacucacauuugaaugcagaucuuccuuaccuaguccagagauucacaugcuaaucucugcucauucauuuuuaaaccauucaauuauaaaagccuugcauuuuucagacaccuguuaucuuuuucuuuucucaaccauuauuugccauuugacccuugcaauaauccaugcuccuuuauuaugauacgaacucuucuuucugcuaauuguuuuuuaacauuuuuaaaaguauuaucuuacaagauucugcuucacaguguaacacaaggugcuaauaaaagaaaaaagugcuguaucaggugacagucuuaagauuuuugauaaaaauguagaaagcacuguacauacuuugccuccagugccucucuggcuucugcuuacugcuaaauacugaugacuaaaaauagaucugcaaaguuaaauaauaauaauguuuuaaaaaguuucaugcgcgucuguaugaagagaccaccaaacaggcuuugcaugagcaacaaggcugcuuauuucaccugggugcaggcgggcugaguccgaaaagagagucagugaagggagauagggguggggccauuuuauaggauuuggguagaaaaaaggaaaauugcagucaaaggggguuguucucugccuggcaggagugggggucacaaggugcucaguaggggagcuuuugagccaggaugagccaggagaaggaauuucacaagauaaugucaucaguuaaggcaggaacaggccauuuucacuucuuuugugguggaaugucaucaguuaaggcaggaaccgaccaucuggaugugugcgugcaggucacaggggauaugauggcuuagcuugggcucagaggccugacaaaaaguuucauuuacauauugguaguagucuuucagagccucacgccuacaaaauuuuaucagcucuuucaaauacugcugucaauuucuuaguccuguaauaacuaugauuuaacugauacauauuuaaauuauaacacguuaucuuccagauuuugucuucccuugaguaucuaagaucauguuuuaguauuagcauaagaugagauauaggcaguuuuucucaaaagcaucccacagaaaaguguugcuuuacuucaaguucuacugagccuuuuauuaaaagaugcugguaaaaggaauuugaggagaagaaaaaaauuuuuuaauguuaaaaaagaugcucugagcuuguuucaaauaguaaaguacuguuucagaagacauuagccugaaaggauuucagaucucaauugauaauaguuuuggaugcagauuaaagaauacccaacagaauugacugaaacaaaaagaggcaaggaauuuuaaacagauuuauuaauugauucagauuuauuaauuuacuaauugaucacccuacauuuacagguguuagaguagauauccuuaagaauaaacauaccuuauagaaacuuuaaucagccugggcaacacaaugagaccccaucucuacaaaaaaucaaaaauggcugggcgcaguggcucacgccuguaaucccagcacuuugggaggccaaggcagguagaucacaaggucaagagaucaagaccauccuggccaacaugaugaaaccccaucucuacuaaaaauacaaaaauuagcuuggcgugguggcaugcacuuguaggcccagcuacuugggaggcugaggcaggagaaucgcuugaacccagaaggcagagguugcagugagccgagaucacgccccuguacuccagccuggcgacaaagcgagacucugucucaaaaaaaaaaaaaaaaaaaucaaaaauuagccaggcaugguguuacauacuugaggcugagguugggggugggggcgggauaaaagaaacuuuaagaaaccaguacaguacagaagugccuacucguugaggucacagauacaucacuacaggaugaauaaaacccaaaaaaaacuuccuaaugcaugcaaauguguauuauacagcuguuaaguaacauacauaucaccuuaauaaaaaucaagaugaaauguuuuagaaacuauuuuaucaaaaguggcucugauacaaagacuuguacaugauuguucacagcagcacuauuaaugccaaaaaguagacaaaaccuaaauguccauuaacugauaagcaaaaugugguauauccauacaauggaauauuauguagcccacaacauggcauggaguacuacaacauggaugagccucaaaaacguuaugcuaaaugaaaaaagucagauauaggaaaccacaugucauaugaucccauuuauaugaaauagccagaaaaggcaagucauagaaacaagauagaucggagauggguuggaggacuacaaauggcaccagggaucuuugaaguugauggaaauguucuaaaaucagacugugguugugguugaacaagucuguaaauuuaccaaaaugcguuaauacacuuaaaacagcugaauguuaugaucuguauuuaguaaagcucuuuuuaaaauauggcucuacuacugcuagagacauugauaucaaagaugcagaguuugaauaauuguuucaggaaaaguuuauauauucaguacuacagauaaguuuuuuuuuuaaaggagaaccuuuuucgcuguuauaaacaacuucauuuauagcauaauaaacauacuuucagucaauuucuuuacaaucuaaagaccccugaacuaaauuuuauguugugucuuaaguauuucaaaacccauccaugucaaacugauaauuuuacuauugcuugauacuauguuauuucccuuauggguaaaacuucgaucaguggccaaaucugaaaagcaagaagacacucuugucaucugaacaguucuauuaggauguuguuagcuuuuugaaaauauuauauacuaacucuuaaauuauauuuaaaugccagcuacccaauggugccagaagauuauugcaauuguuuuuacccaaguauaauuuuuaaaauaaaaucauguugcauugcauuuuucuaaaaucauuagauuuauaauugaauaauguagacuuacaauuuuuuuuagggccaagaaaaaagaaaagaaacuuaaaugauuccagccuauuuguaucugcugaagagguaaggcuaauguacuguuuuaacaagcuagcuauucuacauuauuuuuaguuuucuaauaaauuuaucguuuuuguuuaaaaguuuggccaucuauuggaugaaaauaugggauccaaguuugauaacauuggcaugaaugccauggcuaacaaagauaaugcaaguaaguaacuuaaauuuuuuuauugauguuuuaaaaauagcuuuggcuuggaacuucagaagauaggaaauuuucguuauuuuauuuauucuuuuuuuuuuuuuuuuuuuuuuuuuuuuuuuuuuuuuuuuuuuuuuuugagacagcgucucacucccuugcccagguuggaaugcaguggcaugaucuuggcucacugcaaccuccaucucccauguucaaguaauucuccuaccuuagccucccaaguagcugggauuacaggcaugcaccaccacgcccagcuaauuuuuguauuuuuaguagaaacaggguuucaccauguuggccaggcuggucucgaacuccugaccucaagugacccgccugccucggccucccaaagugcugagauuacuggugugagccaccaugccuggcugauaggaauauuuuugaaagaccuuuucaugguacuuuacaaccugaaaggaauggcuuuuucuucucucaggagaacauguaagauuaacaaguauuuagacuaaagcaaaaaaaaaaaaaaccuugcagacuacaaaaauuacuuuuuuuuagggaagugggccguuuuuacauauugauuguuacugguuuuuauuucaccaguaaaagugcuuggggagagaaaaucuuuagagcauuuguuucuuuuccuuccuuagucauuucuuuuugaaacauuuaucuuugacaauaaauaugagaagaaaagcaacaaacaagcaguggguuuguauagugggugggaaaccacaggccaaggcaggcuagaaguuccugugacucagcagcauguucugugggaccaccaagagucuacagugugguaguacacucaucuuuucuucuucucucaaaggucucaaacagcuuagaugggaggcugaacgugaugacuggcuacacaacagagaugcaaaaaguaucaucaagaaaaagaaacauuuuaaaaagaagaggauuaaaaccacucaaaaaacuaaaaaacaaaggaaaugaguuauuaauguaaauuauagauuaaaauucuacuuacaucuaauuuuugcuguucaaccauguuuuuugaucuagcucucugauuccauacauuccagacuucucaguggauuuguaauaaacuauaaauaaaaauagcucucauuuauaaagucauguggaagcauuguuaaaauuaaauguauugaaaaaaacaacuucuuuuuuccauauugcuacauaacaaaaugaaaaagaggacaguaggauuacagacuucacauauaaguccuggcaucucugaucauuguaaugagcacuauuucgucuaacuacaugaugucaucuuguucagucuuuaucuacuugacagagaaagagacagcuccaagaaguuagcaaaccugagaugaaacugaucuuuuaaaaccaaagguuuaaacugugguuugauucuaucaccucauauaugaaugauuccagaguuuacauucuuaaccacuagaagaauucagaauccagcccauuaccuaauucuccucucacuagaauagaugagaauuuagucucagaagaacuaaaauacaugugaauaguauuguuagaaauuccuuguaaagaaauuacuacauaauuuauagguuaccugaagaaguuguuuuauacuuauuuuuacuuaaggaaaaacauaccuuccaagaugaagggauauuucuugcucauuguuugccugaaaucugauggaaaaaaggaugucuugaaauuagauaugaacagaaauucauuauauuaacacagccacaauuuaaugcuagcuu

SEQ ID NO: 18434 - RNA, 85640 nt, Homo sapiens
aagaggaagaaaggcucuaaaaccucuuuccacaggguccaaaauagaacauuaauuaagcaaauaaaaaugacacauucacagaaaauagcaacaguuauuuaaaaaacaaguuggcuaugccacacauagcuauuaacaauaauaacaguagaaaguugcaacguaacaccauaacucaaauucggcccuaaaacuacauaugcuccuauaaauaucuaacuuuugcuuaaauuuagaaugaauuuaugcuguucguuuuauuuuuauacgugaaaacauucacaaaguauuuugaauguuuuaguaauacuuaguacagauugugaucauaaaaaauccuuucaacacuacgguucacauauaugcuauuguucagauuauaguaaauuagaugaacuaauccauccucaauuuuaauguuugggaaagcauuucaacagagcucaugauuaguagcaccaggccaagaguauaucuaaauuucccuaaaaaagaagauuaaauuacuuagcauagaauuuuaguaagacuaauccccuucuguuacugcccaaaccuugaucuuuuauggucuucccucaguaaaucacauaccuauuaugcagaacacuaaaguuugaauuuacagcucugugagaaaggaaaagagauuaauugccuuuuauaauaucuuuguuucguccuccaaaaaauuuccuucuaacaguguuagaucuguauuacaaucaggaagaagcacaguaguaauuuuagaaaggggaccaaaaggaaauuucauaagcaaaaaggaggggccauaagagaacuguacaucuucauuccacucugaggcaaaauggucuucucuugauucuauucuuugauuagagaaaaugaccaucaauuagagaaacaaacuaaugucucagacaggaaauaaaugacauuaaagacaaagccauaggccaggcaugguggcuuacaccuguaaucccagaacuuugggagaccgaggcaggcggaucauuugaggucaggaguucaagaccagcguggcuaaaauggugagacccccgucucuuccaaaaauauaaaaauuagccggguguaauggcgcaugccuauaaucccaucuacucaggaggcugaggcaggagaaucauuugaaccugggagacggaggcuguagugagcgaagaucgugccacugcauucuagccugggcuacagagcgagacuccaucucaaaaaaaaaaaaaagauugagccauagauaaagaaugcaguaacaauuauuauucaggauuuuuuuuuuuuuuuugagacggaguuucgcucuuguugcccaggcuggaguacaauggcacaaucucagcucaccacaaccuccgccucccagguuccagcgauucuucugccucagccucccgaguagcuaggauuacaggcaugcgccaccacacccagcuaauuuuguauuuuuaguagagaugggguuucuccauguuggucaggcuggucucgaacuccugaccucagaugauccucugucucggccucccaaagugcugggauuauaggugugagccacugugccuggccuauucgugauuuuuagagacugaaaauaugagggaaaccugguaaaguggauagacaauagccuaauuauaaaacuucucugugugcuacaauuacauguuaaucuuuauucaauuaugcagauagcuacagaauacuauuauuuuauaguacacacaugcacacaucuuuagcauauccuuugcagguguaaaaaaauuaugauaauauaauccuuaaauggcaggcaccugguaguauaguaaguucuugaaaaauguugugucuaaaaacacauaccuuaugauuauaaaaccuagugccugccacaaauauggagaaauauuugauucauuacaguauguaauguacagccuaaccaguaggcuaacgacaagcagacaaugaucuucccuugacccugauaucuccuuuaauuauuacucuuucccuucacuuccauuuuuuaauguaaucuacaccauuaguucccaaaugccaguuccauauuaaugccuguccaugauuaugcuugcucaguuuguugcaaaaggagaacauuuuuuaaaauguuguuaauaaggcaauuauauuuaaucaaagucugaucuuugaucuuacauucuuccuccauauuugggaauaaucaguuguagguucuuggguuugucuuuuauugucuugcucucuuguuguuucauugugguaaaauacauacaacauaaaauuugccaucuuaacauuaaauacauucaguucauuaaacacauuuacauuuuucugcaaccaucacuacaauccaccucuagaauuauuuucauguugcaaaacugaaacugcacccauuaaacaauaccucuacauucucucuuccccccagccucuagcaaccaccauucuucuuucugucucugugaauuugacuauucuaaggacauaccucacauaaguggaauuauacaguauuugucuuucugaaacugucuuauuucacuuaacauaaugucuugaagguucacccaugguauagcaugucucagaauuuccuuccuuuuuaaggcugaauaauauucuguuuuauguguauaccacauuuugcuuauccacccaucuguugauggacacuuggguugcuuccaccuuuuggcuauuccuaauaaugcuucuauggagauuuguguauaaauaucucuucaagacccugccuucgauucuuuuagauauacacccagaaguagaauugccgaaucauaugguaaccuuacuuugaauuuuuugaggaaucaccauagcagcugcaccauuucacauucccaccaacagugccuaagaguuucaaucucccuacaucuuugcuaacaccuguuguuuucugucuuuuuuucacaguagcuauccuuaugaaugugaggagauaucucacugugguuuugauuugcauuucccuaaugauuagugaugcugaaguguugcuuugcuucaguguucuuaauugguaaaacaagaaguuggcaacuugcuuagucuccauuuuuaaacaaauuuauggguuauugauaucugaaaaucugaaaaucaccagcguacucucuauguccucuucucaucuaaaaauuaccccaucaauucacugcagucuggcuuuggcccucaaucuucuccugacuucucucaucagaauuaacaaacuaacuuguaauugccaaauagaacggaccuucuucagucuguauguaauuaguggaaagugcagagucucuggggccaaaccuaaagucccgcuuccuucagcggaguaggaucucaacaaauguaauuccugcuccuggacuucccuaagggaaauuucaucccuucccauaguuucauucucuacccuaugcaaugauucccaaaccucuaacacucaaccaugucaguggagcauuaauacuguucaaggcacucugcaauggauauauggauaaauuaacuauggcuucggcgcuccagaagcaugugguuuaguaagauaaauaguugcgcaauacagugucacaggugcuaugaaggaacaugccaggagcacaaagaaaggaauaaugauucccauaugaccuggaguggacagggaaggucuuacagaggagaaacuugaagugaaugaauauuggaaguacuuaucagguagcagaggggagacagcuaucaccacauguaucaauucuuaaaauuaacagaagagaauauuugagguaggaaaccuuagaacaucauuucaguggaccaggugagggcuauuuaaggccugaacuaggagacaguggaaaagaagaaaagagauaccauacaagaaacauaaugguaugaaauugaugggacuuggucaccaauuagaucuagagaacaagggaaaagaguuuaggcugacuuaguggguucugucuuggauaaauagacggugguaccaugcacuaagauuggaaauauaggaagaggaacagguuacaaggaaaagaugaguucaauuagggacacuuggaauuuguggucuuucugugggacacucaggugcuuauagaaagaucaaggagagagaugcagaucuguaagacagacaucgaagcccuauguagcagaugcauuaggugcccugccaguaucccuccauacucaccauucccaugcaugcccuuucaggggcuuccaacagcaagcaucugggagucuuugccugagggcucccggcagaacccacugggugggccugccaacuccgagacuaaugguguuaacagggagugucugcuaauagauuucuuuuuggagguuaugaagauguucugaaauuacauaguggagauguggcacaacuuugugaauacacuaaaaacccagccaauucuacacuuuuagaaggugaauuuuagugcuuacuucgacagcacauauauuacaauuggaaugauauagagaagacuagccuggccccugugcaaggaugacaugcaaauuugugaaguguuccauauuaaaauuauaaaaaauaaaauaauaaauaauaaauaaaaggugaauuguauaguuuuugauuuaugucuccacuuguaacaauugugugagaaaaaauacauacgcuauggcucagcccaacugaaguauuucguccacaaguacgcccaaugucuucacaucugugugccuuugcuugcucuauugcuuccaccuagaauuucgaauuucucuuuucucccacuccucucccccauguuuccuaauccuauucuuucuuccaggcccagcaaaaguccuccuuuucuguucagucuuccccaggucagggauuuaucuuguacuucccugacaucuucuaacccuuuauuuuguuuccugcuuuuuuuucuuuuuuaacucucuucuccguauuauagauuuucacauagcuuagcuaauaaauuucagauuccugagaacaggagguguuuuaccuauagauccuaucaaaugucuugcacaugguagccucucaaaaauguuuagugaaucaauacaucaaggacuauaaaaucucgaggggagucuaggaaaaaaaccaagcaaccuaauuaaaaucaauucaccuucagcuaaauuagccaucaucauuuaaagaacauuaaaggaaacaauuuaaaaucuaggggaauauggucagaauucuuucuggaaauacuuaagguuuugaaauuugaggugucaugauaagaguacaaauuauaguaaaauguucaggucauuauauucugaguaacuauauuaaaaauaaacaaauauaaaucuauuuagugauuuuacccuuacuauagaauacuucaagcuguuaguacagaaaaugccauagugacagcuucuggucacuugaggaccugugcaguaagaucuuccucugaugauguaaagaggaacucauucuaugaccauagaaauuccuguuccuuuucaguucuuuauuaucuuucuaaauuucccuccauagaaucaagcuuagcaacuuuucuuucucugugcugccaaaggacaggaggagauacagagaugugaaaagcucuaauucuuuagcaugaauaacaauauuaauaguuaacccuuauugaccauucucugugugccaggcuuuuuaaaaaguguuuuucauguauuaucucauuuaauccuuauaauaauucauggaagaagaauuauuaucaucguaguuaacugacgacaaagagacugaggcacauagaggcuaauuugccccuggucacacagcuuguuaaaugguggaauccugguguauaaccaggcagaugauauuaugugcauaauaacauuacauuuauuuauuuauucauuuauuuauuucucacaacagcacugugagguaauuacuccccccucauuuuacauguaagggaaucaauuuuuagugagauuaaguagcucaaaacuacuaaaugguagagcccagauuguacucugucuuugaaaucacaucccaacccuuuucuucuaacugauuccucugggcugguguaguuugcacgcuccaggaaaggagucccaacuccucuguuuuggucagcccugguaagaguuuuuuuguuuguuuauuuguuuguuuguuuguuuguuuugagacagggucucccucugucgcccaggcuggaguguagagacgcgaucccagcuuacugcaaccuccgcaucccaaauucaagcaauucuccugccucagccuccugaguagcugagauuacaggcgcgggccaccaugcccggcuaauuuuuguauuucuaguagauacaggguuucaccacguuggccaggcuggucucgaacucuuaggcucaagaccccugggcucaagggauucgcccaccucagucucccaaagugcugggauuccaggcgugaguugccacgccuggcuggauaauuaacuuuaauacuggcuuccuauucaggucuguagcaucuuuguucucuuccucuguuggcuuuuuaaaaauguuauaaccaauuuacaguauuuuaagaguuuguuuguuuguuuuuguuguuguuguuugagaaagagucuugcucuguugcccaggcuggagugcaguggcaugaucuggcucacugcaaccuccgccucccggauucaagccauucuccuaucucagccuccucaguagcugggacuacaggagcgugcuaccgcauccagcuaauguuuuauuuuuauuuuuauuauuuuuuuugagacggugucucacucuuguugcccaggcuggagugcaauggcgcgaucucugcugacugcaaccuccgccuccaggguucaagcgauucuccugccucagccuuccgacuagcuggaauuacaggcgcucgccaccacgcccggcuaguuuuuuguauuuuuaguagagacaggguuucgccauguugaccaggcuggucucgaaauccugaccucaggugauccgcccgccuuggccucccaaagugcugggauuacaggcgucagccaacgcgcccagcccgcauccaacuaauuuuuguauaaaagagaccuuuaaaauuaauacucaguugaauaaaaucuggaauaaaagcaauaauccauaacucaagggaaauuaauguuaauuccauuuuaaaaucgaugagcagauuuauguauuaccuacucuuuccuggagaaacuuauuuugcagucacaaagauaaacagacauuauuggaagugguuaagguaauugguuuuuuaccacaaauuaucugaauauucauuuuuguuuuugcaacagggucucacucugucgccuaguggcacaaucuuagcucauugcaaccucugccucccggguucaagcaauccuccugauccucccaccucagacuccggaguagcugggauuacaggcgcgugccacaacguccagcuaaucuuuuuuuuuuuuuuuuucguauuuuuaguagagacaggguuugccauguuggccaggcuggucuugaacuccugaccucaagugaucugcccaccuuggccucccaaagugcuggaauuauaggcauaagccaccacaccuugccugaauauaaacuuuuaagaacugcauauaaaauccuaggugaaacauaugcaguaaccacucccuuuaguuaccagauuuuccuaaucuuuuuagucaagccauccuuaucacaccucucuuugauuauauacuauguuguaaauauauauacagacauauauuuacagauaccaugcaagaaacaugaugguaugaaauugaugggacuugaucaccaauuagauuuggagaacaagggaaaggaguuuaggcugaccaaguaguuucugucuucaaugacuagaugguggcacuaugcacuaagacuggaaauauaggaaauauauauggagauauaugaacauaguaauauaaccaaguguaaaauuauauaaagcuaaauauaagugcaaauaaaggaaagagaggaguuauauggaauacagaaaguuacauuaaaaacgaaugaaugugccuggcccagagcugguguucaauaagcaauagauauuauuaauaaccuuuauacccaagcagaagaauuuggacgugguaagguaggugauaaggaaugacugcagaguuuaucaugugguacuuuaggacuacuagacuaacuacuaucaucaagacauauugaaaaaauucucugauuuaaucaacauuuauugagcacuaugcuaaaugaugaauaaauuuaaaaaacggccggguacaguggcucacgcuuguaaucccagcacuuugggagacugaggcuggugaaucacuugaggacaggaguuggagaccagccuggacaacauagugaaacccugucucuacuaauaaauaaaauaaauaaauaaauaaauaaaagaucuggucuucuucaaguucagaaaagggaagggcagauagcgaucccaggaggaugugauaaacacucaguccacaauaaaaugugaugagccacaugagaauuaucucucaagggcuaucagaacacagaacaauuauugauagccugcaaaucagacaagacaguuccaaggauauaacaguuugagcuagucuaggacaccaacuuaaagucuguugugguaauccagaugugagauauggacuaggauaacggcaguggaaacugagacaggacauuuugagaacuauaucaucacguaugucucugcugauaaagaaauagauccuaaagcauuuucucccauaacuauuuuacuaacucuauauugauacccaaaugcuuuauugaauuuuucagcuguguuucaaggucauggaaaaagacacaaucacaaaauaauuuuccagugaccacauucuauaaauuaaaaccagcugcaguuuuaaaaugaugacaauuuccucuagcuggaaauugucaucaauuucccuagugaaaaaauucacugauuuaaucaacauuuauugagcacugugcuaaacgaugaauaaauaaaaauaagggccaugcgcaguggcucaugccuguaaucccagcacuuugggagacugcggcgggcagaucauuuuuucccccugcauuuagguuucuaaaucagaugucucuguuaucucaagucacaagaguguugacuuucuuugcuugcauuagguaacauauuugaauggcuauguugugugucauuaaguacaaggagcccaauaaugcgggacaagcucuccaacugcagccauagaagagcaauauuguaagcucguuuucauaaaacaccagcaagaagaaaaauccuuuccauuuugagcauucagauuauauuuucucucaaggauuaaaacauuucacauggcaauacacuuauuuauuaaauucaaucuuuaucucuguaaugcucaggaauggaacaccuugaggaaacuguaguucauguuaagcaaaaaauuagauacaaagauaguucuuugaucaaaugugcugaaagauuuacccaaaguggaggagaccgcuuuauuuuuaaaaagagaagcagaacaguggaaauaaaaugaaauauauacauuacauaucucuguuuucacacaugcacacaaauacuuaaaucucuguauaacagcaguuugaaucgucuggaaaaguuacuucuaggaagaguaacuucugucacuuuaaguacuacagcagaaaauggaaguuaauagugagauaagacuggcuguaaacugcuccaaugagguccugggaaucuugcucagaggcaaaauuuggggcuggacuaaaacgucuguugggaagugaaaggaagaaaagggcaaaguuaagcaagagaguccuuuaaaaagaaggcaaacuugaguaaaucuacuuucaauuuuaaaguaaaagaauagcugaauaggacucuaauaacaaaaauauaguaagauugaauuagauacugcuggauguaagacauuuagcaacuuccaauuccugagaauguuucagaaaucuuuuuuuaaauagauuuuuaaauaaaguaaucaagguuuuacacaaucuuaccugccuuauguuuaauauaaauuaucuuaauauuuucauuucuuaacuuuaaauccgaggacauccauuaagagugaugauuuuguaucaaaaguaggggcuaauuuauguuuauuuuucuuucuauucuugaaaacugcccucuuggcugggcgcggugucucacgccuguaaucccaacgauuuggagggccgaggcgggcggaucucuugaggucaggagaccagccuggguaacacagcaagagaccucgucucuacaaaaacuaacuuaaaaguuaguggggcgugguggcacacgccuguagucccagcugcuugggaggcugacgcaggauaaucacuugagcccagcagcuccaggcugcagugagcuaugaucgugucacugcacuucagccuggaugacagaguaaaaccuuuucuagagagaaagaagaaagagagaaaggggaaaagaaagaaaaagagagaagaaagaaaacugcccucuugauuguagucccucugauuguuucaauauauuuaaguacuuuugggauaaaauguugacauaaggagaaucauguggcuucugugacaaugccugucagcuucucaggccuuucucucacauaagacaucgaaaauuuaugcacaguguauuuucccucuagauccuuaugcugcugacucccacucccgccccacucacccgacacggucauacuuuguuuuggagcaaaacaaauguuaacauuguguuuccagacaccuggaagcccagguuuggugauucuggacugcacuccacuuuggugguagggucacauucgcguuuaaaggccgacggggaggaaacaccgagcaccgggaaaaccccugcagucaccggaacgucgggcuugggacgugccgguuugggcgccgagcugcggugccggcggccaccccgggggcaggcagcagggaggagcaugcgggagggcugugacaucucaggguggaagcagcucucugcucuggacgccuuacaagucccccguuccaacuaucaccucuggcccauugucgccaccgccucccucaagagugcacggcaguagaggaaaagacaguaccgucggcaacagcgcgaucaaguaccgcguguaacugauagacacgcucgcgacucccgcggcgccccugccccgugcccccgcgcucacgaagacgcccggaacucgagggugcggagccagcccgacuguacccggcgcucccggcgccccuucgcggggcagagacaaccccgaccucccgccgcggccaccucccggcgggcgcgggccgaggaacuacagcucccggcaggccccgcgcuggccgcgcgcccccgccccccgcgcgccccggccccccgcccuccggccccaggacgggacggggagggagggaggaaggggcgccggaggcgggcgggauccugcgaggcgcgugaagccucgcuggcgccucguccgguacucagacgcuggcgggcgcaguuucucacgacgggccgagccugccacuguaaguagucgccucggggagcgcugaacagacaccgaaaaaguucgcgccgccgccgccgccgcuuuguucucccggcccgucgggcugaggcggcggcggccccucccccaucccccaaacccccaaccccccaacugcacgcggcggcggcggcgacaggacucggaccccgcgccgggcugggcggugucagccgcgcugggcgggaaguugggggagcgcgcggcgggaggugggcggcugagggggagcgggggcgccgccgcagccgccagaggggccaaguuccggcguccgcgcggagggcaacuuggguucgcgcuccgcuggagaccaccgcgcccggcccaucggaggcgauccguucccgggucucccaaacuaguucccgaagccagacccgcggcgcucgcagugccgaauuuuggaccagcuuuuucguuucauuuccucacuuugcguuguagucgucucaaaggggugaguaaauggugcuuggagaauguaagccccucgccccaguaucccgacugcguuuggauuugcuaguugcagcauuguuccgaguugcucccuccugggagguuuuccuuaagcugaaacacugaggagugccacuguuucuuugagcagugaaaauaaccauauacuacuguauugccgguuggguauuuuauuucaggugaacgcagucagaggcauaggccuugccgucugcaggcacacauacgauucaagcgacaagugugugcgcgcgaccugccgacuuuuccacacacagauugauggcauggacguaacugugucuucaaucacacccauccccacaggaaauaagacuaucggugucaucuuugauuaggaaggauaaguuacacccugaacugcugcuuggugcgacacagcuuuuaugagacauagccacaaauggaacaagaacuuuuaaaugccuuaauuuguauccuagaaaauguuauuuuauuccucugaaacuuuuuuuuuacccuucuacuuaaugucgucguucuuacauuuuuagcgauuuucauuuuccuuagcuuugcugcagaaggcguccauaaaguucccccgacugagaucuaggccaguuuuuccuugucaacgaacccuugcuuccuucccuguuagauuccgaguuaagaucaagcauggacauucagccaagaaguuagaagauuuucuaaaaguaggauuugaaacgugucacacagaaaccguggaagguuuuucuucaguagguaguaauacaguuguggugggccugagugcaugagcuuggaguacuccuugacgagccagguuccauccucgguucuauaauuuaguauauagcauuucacauuucagggugacucagguucuguaauuuaguauauagcguuucacauuaagaauguugacugauguguaucuuaaaacuaauuuuuuaagcauccuagauaaugguaagucuuuuagagaaaauuuuaagcuuucaguuucaucagauagccacuuuaaaauagaaauuucuuucuguucguggauuuaaacacugccacacacacagaacuucauaaauaaaacuuucugauauuacauuuuuuuaaauuacgaauugaaaacaccacauacagaaaaauaugaauagguggucauuuaagugcaguuuucuuaagggacauuuuguucucauuuuuuuaaaagacucuaaaguugaaaauacuacaguggaguuaauuguucguuuuuaaaagaaacugcuuguacagagcuugauauauaaggaaauucuuugcuaguacaaguuuuaauuugauauaaugcugcuuauaauucacaaucuucugugaugauuguacuuugagucucgcugauuauguaauucagaucgaacuugcuauauauauauauguaucucuuugaguagcccucucaggaaaaacuugagauaaugugcuuaugagauauuuucauuuuaauguaggaaaaaaaauuuuuccauuucugugguuaguuuauuguggcaguaugugagaaauugcucauuggcugcuaaccaaucagauuucuuagcuacuacuggugcagagacuaacaucugucaagcucaacauggauucauauugcauugccagacuggcaguccauaaucuuauuacuggauaaacuuuucaguuccugagcagagcagauauggugugcucucucaguacucucugacaguggaaggacugagauucaacugucacugguccagaugagcagaauuuuagaggaaacaauuuagcaaaugcuaagcucuuaggaaaaguauguuaaucuaaaguaauagguauuuuugaaaauauauaaaucauugucgggauugcuacaagauaugauuuuuuuaaaaaccaacgacguagacacuugaguuuuuaaauacaacauacaauauaaaagcaagaacaauuacuaagcaaagucaaaccuaugucaaaacauggacauggacuuuaggacgcuggucagaauugcauugaaaaaggccacauacuuuuacgugguaaaagaauacuaauauuaauacaugucaagaggcguggacacaacccuccacgucauuagcauuucuaguacacaaaacuuaaguugaaccuggaaaacucuuuacugggaggaauucauguuauaauaaauauuguuauuccaauaggaaaagcauuuuaucucuucacuuuagccuuugcugaguauuguacaaaaagaaugaugcugcacuaaauaaugaacuucuuuuugaagaauuuaauaacuagaugcauuuugccuuccuggaauccuuuugucugucucuuugcaucguugacucuugcuuauccagagaucucagcuuaaauauuuccuuaaagguaccuuuccugagauuccagcuggaauugaguccccuuaguauacucugccauaucaccucuugcaguuuauaauuacccagcuguuuguaugaauguuaugucugugucucacaucacacuuugaauuucagagagagcaguggccaugucuguuucggucacugcucuauaacuccagugucucucauaacagucugggaaauaauaaguacuaauuaaguauuuguuaaguggaaauacugcuguuagagcuucuccuaauuagaguguuaaaaaugagauaaugugugcaugggggaaggggaaggagagggagaggaaguagauaaacuugugauauuaccgugagauaauccucaaguaaguccucucaccuccagggccuuuguuucaccuugucuguaaaauaggacagacuggguucaagaugccauuaauauccuauauuuugauuccaguaacaaugaugacagauuauguaagcucauuugaauggaauaugugacagcuagcuccccaaaagaauauuugacaaguucuaaauaaacauauuagaaaugcuugccaacuagaugauauuauuuagagccucguaccccuguuagaaacaagcauauauaauugguauauaguuuguaaauuaauaagauguacucuucuuucaguuuucuaauugaagcguaaagacaaaauuaagcagcauaucaagguucauguaaguuacaguuauuagguuuaauauuuaguuuuaauauuuuucacccaacaucuuguugcaucuuccagaguaaaucugggguccauaaaccaaaccaggagagggaaaauggaaagagugggcagaaaucugacagcucuuagguuucuucuauuuguguuaauacugagacuuuuaaaaaucauuuuuauauguaguguuuauuaugaauaguuguaauuuguucugauaaauuaguuguauuaaacacuguuauuuggcuaauauuacuagguauaauaaaaugauauuuagugggaagacauucaucaaaguagaaguaguuaauuugggccaggugcaguggcucacgccuguaaucccagcacuuugggaggccgagaugggcggaucacuugaggucaggaguuccagaccagccuggccaacaugaugaaaccccgucucuacuaaaaauccaaaaaugagccagguauggugaugugcaccuguaaucccagcuacuggggcggcugaggcacaagaaucgcuugaacccgggaggcggaggcugcaaucagucaagaucgcgccacuguacuccagccuaggcaacagagcaagucucugucucaaaaaaaaaaaaaaaaaaaaaaaaaagucguuaacuugcauacaguuuuauucauagauauuuuacuacuuuauuuugguaguucaucuuauaaaaacuacuuaagucagauacguuguggagcucauuaccucgugagacaaccuguuccauuguuagguuguuggauauggaauaaugugguagaaagaacuugggcuuuggagucagggaaacuaguuugaaucucauuucuaucacuuacuagcuauagucacaggcaaacaacagcuucucuaaaauucuuguuucuuuucuggaaaauagaguuaaaccuccuagaguuguugcaaggauuuaauaaaguaucauaucucacuuuauguguuuagcauaaaguaaaggcuuaguuguuaauuccuucaacuaauugcugugaaaauugcuaaaacuuacugagcacuuacuguuagccagguguuguuacagauaguuuguaccccguagcucaauccuugcaaccugugagguuaaguaagaagugcucucaucuucauuuuucgucuacccucugcagugauacugaauaaaaucaauucuccuauuaacacuuauucaaguauuugaaaaccacuuauucuguuugguuuuguuaagcacauuuuuaucacaugacauuauuuuuaccuuugcgugcaugauuuuuuuuuuuuuaaaucaguauggcucuaaaaauguugaccauagauauaaacauaauugugauauaggcugaguaacaaggaguauacagacggaugcugauguguucucagugaccuagggcauuagcuuugcauuagcucuuuuagucacccauuauauuagcaguuugaauuaaucuuuuucguugauaaauaccucucauauaaacugcuuacaaguaagcauuuccccauuucuguauugcacauuuuggggaaacuaaaugcaaagcuuuacacuuaccuuuaaguuucaguuuaauuuuaguuuauuucucccagauuucuucaaccugaggauuuuauaagcauauucuuuaugccuuuauuaucuaauaaauagugaaaaaugauauaaggcugaggacaguguuucaaggcaguuccguaaagacuuuccucaucuaaggugacacagagcagcaaacuuaacuacacuaacauccaacccacacuccaguaacauucuugcaaagguagcauggacaaucaucuuggauacuauuuuugucagaauaaacuaucuuuuuuuucuggcuuugcugauuuuguggucuugggcaaguacuuuaaucucuaaaccuuuguuuucucaaccauauaaugaguugcugugaggauuaaugagguaauauguauaaagugcuuagaacaguaucugacagauaguaagagcuuaauaaauguaagcuauuguuauuuuuuuccagcuaagaagccuaauaaucauuauuuuccaagauguaaaugugguugacuucuagugaucauuauauucuucucuaguuauucacaaaccauuugcuucauuauuuuuuauguuuguaauuucugaaauuugcuuuccugcuucuccagccgccagaacuugaaaccgcucuacaaaucuccaggccaugauuauaucugucuuuuugagcucuuucuccaagauugcaggagucagcuuugugauuacauuugugaauugcuuuaguaguauggaauggacugcaucuggacccagagacucaaacucauguaaaguuguuauagucuuagucauuugucucagguuucaguucucaaugccuuucugcaguuuuaguuuaaaacuguggagaagauaagcaaaauacaaguugagcagucugucuuucugugcgauuucucaaccuuagcaacauccucugagcagugauucuuaguuccuuguucucuucgagaaauaguguguucuuguggagacagcacugguaagaaaguacaaaaccuggcuucuaauucccgcuccaccuauuaauaaccaugugcugcugggcaaguugcguuaucgccuugugcuucaauuuucuugucuacaaaaaugauuucuacccugucaacuuucaaagaguuaugagguaaaguaugugaaacauuuguaaacuaucaaguguuguacauuauauaagauggaauaaugaucauuuacuugaaaguagcuaugaaagcuuucaucuucaguuuuuuuuaaagucucaguuuuuuccugagcuuucccauuccuaauacuauaguugugugcuuuugcccuucugucacguucuuccuaauuuaacccauuaacuacucugcagagaguuacucugcagccacauuggaugauuuacucuuucucuucauuggaauuauuuauggguauauagauggaacuuagaaagaaccaucaauuaugagcuguuucacgccuaagccauguggagggguugggucauaccuuuuuuuuuuuuuaacuuuuugaccugugcuuuccuagaaauuaugauacauauuuaacuauaccuacuguucucuuucuuacuguuagaaaugcuuuguggucuacagccacaccaccccaaaugugccugaucuugucugaucuuggaagcuaagcauuguugggccuaguuaggaccuggauaggagaaaucccuuauggugagaucccuuucucuuauguuccugugauaaguaugucagcuuucacacuuauugaucauuuaacuguucaguauauccccuccugcuuccuuagccuucugaaaggaauguuucaacaaagcaagucaagagucauguuucggcagaauuaguauuguaauauuaaaaaaagaauacucuuguauuaggaaaguauuguacaucuuuuguguggugggguggcauguauuguaugucuaugaaaaugucaguuuuacuguuuuuugucccuucuguuuuugauauaacucagucauguaauuguaacauagaaguguuuggucuucauugauuaaaaaugagguaaauuuuaaaaaauguuuaauguuuaaguuuuagguaucaguguagagugccaaggauauuuuucgagccucucccugaaauuauacuuauaguaaaaaaagucuuugcuaacuagccaaaaauugcuacccauuaggauuuauuagugaauuauaagcauaugaccaaaaauugucauuuaaaaaaguuauguucuuauuuuuaaauuaaugucgaaugaauauaaaguauuaaaaaccuuuaaaaaauuuccuuccaggcuaacuauaugucagaaagcaucagcuuuucucgauggacccauucaucuaaugaaauaugccuguacuauuuuaaaaagcuuuguauuucgucauagaaaaguucauccccccagaaugaaaaugaggacauuugagaaggugauuuaagguguggacauuugagaagguguccuaucaaauuaguaaaccaaaggaaaaguacugaauagauuaauccaaaacacuuacuguuuuuuaaacgaagaggauuucaccuugacagaaaaacaacuuuuauucaauauguauuuccugaaauuaaagagacaaguacagacugaaaggaaaauagauucguaaauaagcuacgucaacucuauccugcugaggauagcucagugauguuaaauccuuuacaaaucccugguugucuuccuacagacaagacugcuuuuugaugggacugauauuaagagaaauaggaccuuuggggcauucaacuccuugauaaaacuuaaaaguaucggcaugaguggcuuaacagaggaaauaaagaaguuuucaacuaaauccaaaagugcggucauuuucuuuacugcuguuauuuuaaaaaccucuucauaaccauugaaaaagaaucgacaacuauuuuaaaagauuaaagaaaggcagaugucugcaaauaauuccccuccaucagcccagaagucuguauuacccacagcuauuccugcugugcuuccagcugcuucuccguguucaaguccuaagacgggacucucugcccgacucucuaauggaagcuucagugcaccaucacucaccaacuccagaggcucagugcauacaguuucauuucuacugcaaauuggccucacacgggagaguguuaccauugaagcccaggaacugucuuuaucugcugucaaggaucuugugugcuccauaguuuaucaaaagguacugugugugcuauuaucaguaguaaauaauauuguuacugauguuuuucuauaaauuauacguguaccagugaguuaagacauacugauccaucaguaguuuauucugugcauuuuuggaagaguucuaaugaccucugaggcuaaagacugaaauuucagagucuagcuaauuggaacauauaucccagauuuaaaauacauuuauuuggcugggcguaguggcucacgccuguaaucccagcacuuugggaggcugaggcaggcagaucaccugaggucaggaguucgagaccagccuggccaacauguugaaacgccaucucuacuaaaaauacaaaaauuagccaaacaugguggcaggcaccuguaguccaagcuacucaugaggcugagacaggagaaucguggggagcagggcaggcggcggagguugcagugagcugagauagcgccacugcacuccagccuggcacggcaacagagugagacucagucugaaaacauaaauaaaaugcauuuauuuuagcuuuaaaguaucacucuucuguuugucucucaagagcaggaaaaucuguauagagucaaggcagcauaagaaaucucauuuguuuucagagaaaacaggagguagagggcacaaggcccccugggacacaguagcuagcagcugagucccaucuccauaccuuguuaucucuagguacccuguguucuggccccucuuuuuuuuauccauuuccuucucuuuagaucuuguuuaggaagauucugaacguccugaaaaauaaacugccauuuaauauaggaccaugcuuucugucuuuuaaaaaauagguaaauuaauuuugaauauacgacaaaauauuugaaaauucagggugguuuuauguuguuucucauucacccuccuucccuguaccgugccguuuucuuaaggaacuuuagcuaaauaucuuuaauaaucccgauuugauggaugaggcuaguauguuuucuguguuaucaaaagaguuuauauggguuguaugaauugguuauauuuuauuuuuaguagauuuuaaugaauuuucaagcauguuucagauuuguuucaaacaaauuguaaacuuucuauuugcaaaaaucaucucucucugggaauucaugcucuucaucuuacugucuuuguuucaauucuuuacgcuuuauauaguuuaucauucauuaucuucugauguaaauaauuacccauccaaaagauguugugcaguuugugaaaaugaccuaugcugccuuuguuuuaacaaugacuuguacauguggccuaaguuauuccuaaguaagaauaacuuuacuucuguagaccuguagagcauuguauccuuccguagcuuugcuuuuaguuucccuuccauuauccuuuacagacuguuuucaaacacuuuugcaacuagauuguaauuuuuuuauuuaauuuuuaaacuuaaauacauauuuguaacuuaaauauaauguucccuuuuuauuugaaaccauagaaacucauaaccaguguuuugaugacucucuaugauuuaguuuucaaucuuuggaaauuucauuuacuuauuuuuugcacaguuuuuuaauugagaaaaaauuguauauauuuauuaaguacaguauguucuuuugaaauauguauaugugguguaauggcuaaauugagcuaauugauuuacuucuacagagguuuaccaguuuucugcaggauuauucuagaaucaguguuacuucauuaauauaaaugugaggagugggucagugggugaaauucuuggagaaccagauuaaaaaucuugaucugugagcaacuagagugaugucagggaaauaggauauagcuuaaaaaggauaauuauacaaauauaaaauaguuauugauuguggacauagcagcauaaaaucgauauaguaaacugaauuuuacaaugacucuugcaggggaaucauuuuuccucaagaggaacucuccccauucucccgugucuucuacucuuguugagugcaguuuucuauaaaugucaguugggucaauugguugauaguguucaaaucuucuauaucuuuauugacuucuuucuacuuucucuuaucuuuucucgagaaaggacuauugaaaucucucaacuacaauuguagauuugucuuucuccuuucaguuuuaucaguucuuuucuuugauuuuuuggcgcucucuuauuauuugcaaacacauuugggacuuuuacagccuuugauauauugaucccuuuuucaauauaauuuuucaagaucuuguucugaagcuuacagauguuccuuggcuuacaguuauguccugauaaacccauggcaaguugaaaauauuaaguugaagguguguucugauauaugauauuuucaaucugcugugaguuuauccuauuguaaguugaggagcucccugaacguguaucccuuuugcacuauuguaaagucgaaaacuuguaugucaaaucaucuuaagugagggacugucuuaagugagggacuaauacuugguguuaaucauucuuuuuauaaaaaauuaguguuugcauugugauaucuuuucacaugcuuuacuuaugaccucucuguuuuccuauguaaaguaggauuuuuuuagcuugcauguauuaauaguuggguaugcuuuuuagauucacucugucaacuucugcuuuuuaaguguuuaggccauuucuauuuaauacuguuuuccauauagaaaacauguguuuaaauagauuggcuguuuucuauuugucccuucuguucucagguccuuuucugccuucuuuugaauuacauuauauaauuccauaguaccuccacugcugguuaauuauacucuuuacaguuuuuuuuuuuuucaucaauuccgcuaaugcaggggucagcaaucuguauccauaagccgaaucuggcccaccaccuguugucaauagaguuuuauuggaacacagggugcucaauccuuuauaucuugucuguggcuucuuuuguucugcagcagcagaguugaguagcugugacagagaccauauggcccaccaagccuaaaauacuacuguuuggccuguugcagaaaauguuuggaaaucccuguucuaguuuauauaauaugcaucugaucagaguaucuucaaacaauaucauagcacuuuauaauguaauauauaccuuagaacaguauauuucuauuuucuuccuauugucauuuuuauauuuuauuucuacaugcagucaauuauuguuauucauaguaguuauauucuguaaagucacugagaacacugaauuagcuaauagugaacgauugcuccuaguaggaccuaguggaaccuuuguuccuagugggaggauagguuccugcaagccucuggucacauuuucgucaaccaauaaauacauaaccuuguuuuauguguuucuguuugaagacacuuuauuuaauauauauaguugauucauuaacauuguacucacagcuaacagcgcuguuacuuauaccugaauguuauugaacacguguaguuacucuauaagggacaucauaaacuuuuugcacuugagaacacuagacugcuucagcacugugcuugggagccauuuuaaacagaagagucacuaacaaaagaugaaaaaaaugcagaaaauauggcacuaaauagacugugaaaaggacucuuauuuacacuauaagagcuggaacaagaaggcagagcuauaacaagacuuugacuugaaauauguaguacgauagaaaagcuguguuugccucugagcugugccaugaccacauuugaaauaauacauuguuuuaaauuuuuuucacucccagccuacuauuggaaauaaguugaaggggugugaaccaagcuccuugucagauauuuccacgauucaguaauuuuugaugaaauaguuauaaucaaaugaauaaacucauaacauauauuuugacaaaugcaggcuuuauugcuauguuugugucuauuuuuucccaacaaaaucuuaaccagucugcuuuugaacagcccacaagauuuucugauuacucuuaucauugagcauuuccugguuagcuuuuuuaaaaauuauaggcaaaaguucaaagcuuguuuugucauauuuauggaaaaagaaaaaaaccuaguuuuaaaaaaucuuuuacaauaggccacauguuacaaggaucaggauguuuacaaacucgaugcauguaguugcaagguuauaugcauuuuaaauguggacuugauuuguaacagugguuuucaacccagacugcacuggagaguaacuaggagguuaaacagguccuuccuagaccaauuaaaucagguccuuugggagugggagucuguuuaagaguucuaucuaugauucuaaugagagccacagucuagaaccucuagucuaauggaaauuugauaagccuaaggaccagauaaguaacaaucugaagauacauuuuuucaaauauugaaauuguauauuuugucccgugagugccaucuuauuuuccacauacugaaaauauacuuuaaaaaaauucuuaaaauuaaaaauuucagagaggucugcagcugauuauagguuaaugugauaauugcaaauucuagguagauuuucagucucccugguggcaguuugcagagagcuaaauaguguuauacaauuauccuacaccugggugccauuaucuguuauggcuuugcuucaguugaacaaauauuuauggugcacuacucuucagucacugugcuagauaacuguggaagcucccaagaugaaacacaaauucccugccccugugauuuaugcucuagaaaagaagaugagcaaaugucaaauugcccuaauauaagguagauguaaguccugaaauaaagguacaauaugauaaaaugacucaggaaggagagcugucaccuuguuggaaauaugaaaucauauuuucaauccuacuuuuugcuugccaucaccaacuguaguacuucaccuggagaaauaagcuuuugcugguacaaugccaugcuacuacuuugauagcuuguagcauggauaaagcaagauaccuuuaacauccucacuagucugugagacagcagauacuggucucuuuaugcacauauagagucugcuuucuuuugcuuggucagauaaaaaguuuugugauucugcuuccuaguggugcucuaaauuuuauuuguguuagaauuaguuauucaagaaauucgugauaaucucugcccucuucacucugcagcaguuaacuggacagacguguaguugccagcaaugagcaggugacagaaauaugugauugcuuauguauaagguauuauugcaagauuacuuacaaaauaaugcugaucaaucucugaucucugguccagauuccuuuccuaagcuucagacaugccauguucuaucuuuuaacuagccuugaacacccuuucauugccacauccucugcuuagaccuccagcaaguuuuuuucuguauggauguuggcauccuauccaacacauuguauuuuaacauucauaaugcucauuguaauugucucuuuucuugacuguauccacuauaaaacuaagcuuuaugaugccagauaucauggccacaguaggugcucagugaauauucuuugguugaauaaauaaaggaaggaauuaauaugaagcaguauaguguuauaguuaaaaccauuaguuuugggguuaaacuggaguucauuucuaccacuuauuaguuguguaaucuugauuccuugucugaaaaaugagguuaaaaguagcacucaucucucaucauuguguguguauauuaaaugauauguuucuaaaaugcuuagcccaauacuuagcaaauaguaaucacacaguauaugcuagcuaaucaauauuauuauguauuaaucugaucuuagugguuuccaaacucaaaagaaaacuugagcuauuacacuucgaggucccucucuguugaagauuuauuagaauuagccagugguaaucuagaaaugacugaaaacuacuaucaauuaaguuuauguuaauuuuuugauuugugcuuuauagaauauauacauaugucaaaaucuguuuucucuguagaagacagcugauuccuuccuugaucugaauagguacucacaguuuucuauuagcuuuacuaauucuccuuuuauugguacagaaaauuagagguuaaugguauaucaauucugugauuuauuuuaucuucuguucuugggcugcaugugaaaaccugugacuucuauauuagaauauuuugguauaauauauuccuaagggcauaaugugcugccuuuuuuuuuuuuuuuuuuuuugagacggagucucgcucugucgccaggcuggaaugcaguggcgcgaucucggcucacugcaacuuccgacucacugguucaagggauucuccugcgucagccucccgaguagcugggauuauaggcacgcaccaccacacccagcuaauauuuguaguuuuaguagagacaggguuucaccauguuggccaggauggucuugaucuccugaccucaugaucugccagccuuggccucccaaagugcugggauuacaggugugauuggccaccgugcuuggccaaauaugcuucuuuagauuaauggugauugcauaugugacuuaagaaucuuauaauuuugaggucaacugauuuaacuagucaguuaauuaccauuguugagcagugaguaaguaagcaugcuucucuguauuucuguacccuuaggcuguuauuugagauauucuugcauuguauacacaugcccaagaauuagacuguuggaaagagccuauagaaucaacucuaaagggauaggaacaguuaagugacauuguauaagaucuuuugaugucacaagagguacaggaaaacuaaccaagagugcauaaauaucuccauuagaaaaaaagauuaaaaauauuuagcaacaauuaucuuaagaaacggguaaguccaaauauaaauaaaauuaaaaucuuuaaaaaauuuuuuaaagaccuuguaaaaugaaugcgucuucuuauguuccugaaaaaggaagacugauaguguguaauuuuuacuucuccaguuaaauuucuuuccauuaaagauuuuuauugguauucuuuuuacucugacaauguuaaaguuuaucuggaggaaaaauagucaagagcauuaauuuaaaaaucugaaaaauaagagagaaagagaagaaaaaccuacaauaacugaaguuauauacuaucugaacauaaauagauaagcacaagguacuuuuagguaugccaaaggagucaugagaaauuaaaaggaaucauuuuucaaaaaaaaaacagagcuuaaaaaacuaguuuuaagcaguugaaggaacauuaacauagaccuucacuuaauaccugacacuagcugggcgcguuggcccaugucugugauccuagcacuuugggaggcugagguggguggaucaccugaggucaggaguuugagaccagccuggccaacauggcaaaagccugucucuacuaaaaauacaaaaacuagccaggugugguggcaggugccuauaaucccaacuacucgggaggcugaggcaggagaaucgcuugaacucuggguggggagggaggugggugggggugggugguggcagagguugcagugagcugagauugcgccacuucacugcagccugagggaaagagcaaaacucugucucaaaagaaaaauaugacaccaagguaaauuucagugauuaaaggugaaauguggaaacucaaaagaaaauuuacauauaauggaauugacuaucaaaccucuggacagcaggcagcucacuuucagaucaauaaaagaaaacaugaaaagaucaguuuagagauuuuauuaaaaauuauaacguauacauauauaaaaguaaaagcaacaagauugggaaaauguuacggcaaguauuauauagguuaaugucuucuuucuacauagagcucauguauugguaagaaaaacugaucucaacacuuggucaaaugauaugagaguuauguuuuacaaaaagauuaaauuaguaaacaagcgugcaggaagauguucaaaacaguuuuaaaauauaguuuagguaucguguuaaguugggggaaaaugaaauuggcguucgcaguaugggggagagcaugguaaaauuucauagaaauagagaacaaucaaugauucaagucuuauaauuuaaaaacuagauuaaauucuaacaagaauaucacaaaacauauacacugagguuuuugucccaagaaaauaucucuaacagaucauuuaucguugagcuuugcuuaaaacuuggauaugaccaaaagcguucacucuuugaauuucauccaguuucauuacacaccccaaggguggaguaggguggaguuucuuuuacuguuguuguuguuguuagcauaagccaaaacuuagcuuccuuuuuucaaagcuuugaaacccuuccaacauuuaugauacauugauugaugcugucuuauucaucuuuuauccucagagaugucuuacauuuaguagacauuugguaaagaacacauaccugcucuucuaaaaacaugauacuggaaauacaguuuuauugaugagaugauuuauaguuauuagagcugaaaagagauagaaaugagcagauaagcaucaguauucuuucccaucuuguuucauauauccggugccuuaguugugcccaagcugaucccacuagcuuagauugucagauaauuaguuuguagagcuuguuuuuccugggauugugcaaaaggccagggguucuucuagaaugcucugaaauuuuuaaaguuauuuauuuccugaacuuuuuccuuauuccacauaagaauguggauuaggacuuuggacuauuuuacuggcaaauguuauagucucaguaucugauuuuaauauauaagaucaaguuaaauuguuuucaucugaugagauuuugacccccugggaacauuuggcaaugucuggagacguuuuuggaugcacaacuggagcaggggggcuuccagcaucuaguggauagagggcaaggaaguugcuaugaugccccauacaacaaagcauuaucuggcccaaaauguuaauaaugcugagguugaaaaccccuggguuaaacugauggaguaauagcauuucugaaguuugaagaaaucuacaaugucucucuuuuaguaccauuguaggggcuuaguaaaauagggaauaugacugucuccuagauuaaaaucuuacaaauaugaauugcagcuugaggucuuaaacaggauuucuaguuuugccugggcauuuuuguuuuuguuuuuugagacaggaucuugcucugucacccaggcuggggugcaauggcaugaucacggcucacugcagccuugaccuccugggcucaauugauccucccaccucacccucccuaaguagcuggaccacagacuccggccaccacgcucggcuaauuuuuuuauuuuuuguacagaugggguuucaccauguugcccaggcuggucuugaacucucgggcucaagcguucccuccaccuuggcuucccagagugcugggauuacaugugugagccaccacaccugacccauuuuuguuuaacagugcacaguuuuuauugugaguauggauauaguuaaugugaauuuuuaaccuauauauauaaaaaguuccuauaucuucauauuguuuuauaaagcaaaauuaacaacaaacaagaucucugccuucuagagguuuauaagcugaagggaauguguuuuuacugauuaaacccgaagaacuaaugguacugggaaucaggagaaugcagaaggcagacaaaucugagcagcagguagaacuggaauugagccaaacagaaauuuccugaucagaucacagcugggaggccacuuaacgccugauuacaagggagaaaacugauauugagggaguaggccagaagccucgcccaucuuacagugauuguucaugcuuggauuuucaaccuugaaauuacauuaacucuguuacugguguaguauguuuaaaaaaaaaaaaaaaaagaauccaaggaagagauaacagaguauauuaugccauagcagaguuuuggaaucaaggagagacaccuggguuguaguugcuauucugccacugaugauaggcccuuuucaaguuacuucugacccucaguuuucucaggugugaaacuagugucauaaaguccaccuccauagaagaauggugguuaaauguaaagccccagguagugucuggcacauacuuagugcucaaaaguaguuaauacucaugauuucaaaaucuguuuagauauggaaagaucacuggucuuguagugaucuuaaagucccaaagccuucauuagguagccugccaacaugcuuacauugguuugcucuugccuuuugauuuuagcauuuaacguauaaaaaaacuauaaaaaacagagauaaaguguuuaucuuauuaaagggccuggauuacuuguuuuaagaguuuugaggaaauuaagagucuguagcaagugcuuugcacaauuucugaugcauauugacugcacucaauagcacuucuccaccuuuuugcuuucauauugcuaagaggcuuagaagauaccacuauaaugcuccugcuacuguauaauuuguugaaugaacauaguagauauaauuggagugagaaaggaauugguagacagcaauucauuuuaaguuauaaugcuguuuacagaaauuggaauaauucuuacaaaagcagauugucugcuuuuagcugauuuaaaacauuugguuuuaguuuugacgauuuacgugacacuagaccugaagguuguuugcuuauguagccuaauugaggaguuauuuuggucuguucuuuaacugcaucgucucuguagauacggauuggguauaauuuucagguuaugccaaaguacacugaacaccccagcuguaucuuuuguugucaaaaaaaacccaguugucauucuauguuguuuuuuuuucuauccauucuuucuacuacagcuguguugcagcagcuuagugacauccugcucuuuauucuaccccuacuuuuuuugucuaggcaaaaucaaugucaggcagccauuacuaaucugaaagcucaaacuggaagaagaaauuuuuuuuuaauucuacuauucaucauaagaccuuggcuagaauagaagauccuagaucuuuaauucggaaaguuugaauuaaagauaaucagaacuaauaacaaaacaagaaaaaaugagaaugaaaaaagauugcuuugguugguaucagaaaggcagguguuaaauaaagcagcuccucugguauuucuuuuuuuuuuuucuuuucuuuuucuuuuuuuuuuugagauggaguuuugcuuucacccaggcuggagugcaguggugcaauuucggcuugcuguaaccuccaccucccagguucaagugauucuccugccccagccucccaaguagcugggauuacaggugcccgccaccaugccuagcuaauuuuuuguaucuuuacuagagauggcguuucagcauguuggccaggcuggucucaaacuccuguccucaggcgauccaucugccucagccucccaaagugcugggauuacaggcgugagccaccacaccuggccucuuaugauauuucauauccaaaaaauucuggguucagguuaaugaugaaaguuaauaaauucaaguccauguugagucauuuucuaauugacucagcuaucguccuuaugucuguauuuagaaacagaaucauugagcugcuucucuccaauuaaauauuuuccuaaaauugguguuaauauuagauuuguuucuguguaauuuauuagugcuaaguuaguugcucaauagucaacacuucuuuuuuuuuuuuuuuuuuuuaguaaguaccuguuaaguacaaagugcuuggggauucaggaggaacaugaaaagagaauauucuuuuccucauggagcuuguuuacuaugaucgaguuuauguuuaaaaagacuugugaagauuuauuuggcaucaaauuuuaaaaugacguugguauucagugucacaaaugcauuugaagaaacuugugaugcugauuuuuaaaaugacguugguauucaaugucucaaaugcauuugaagaaacuugugaugcugauaauauucuguaucuugaccugaguggugguuauguggguuguguguauguuuaugaagcuaucaagcuucuaauuaagauuagugcauuuauuauauaucaaguacauuuuaaaaguaaauguauguuaaacuucgaucguuucccauugcauuuagaauaaaaccuucauucuucuuuuuaaaaaaguacauacuggcugggcacggcagcucauaccuguaaucucagugauguaggauuuuucuugaccucuucaucggacuugggacgggguacccuguuuacucaguccgccacacucaaccucuuuugggagggaacaugugagcaaacgagugcaggaucuggcuagcugccuugagugauggcaggagcagacuucauaccuguggggcccuucaaccuaagggccccacagcggcacuuagguuguggugccugaaaccccccagaggccccagaagauauaauacucucuuaggucugccauccauggacagcagcguguuaucagcucagugggcgccuugccucaucgugugggguggcugcccuccaccagcaaggggaaagggccuaugcaacagccuuuuuugggguacuggcacuuguugggucuccagugcuugucuggcaucuaagaacaaugagaucccccagacacuugaaggauggugaaggugguaagugaugggaaauggcucucagcagagugggaugugggagaggggacgggacgggcagguaaucuucuccugagguccagcggcucuucccgauagucaggccauccucugaaguccagcugucccuccaaugucaagucaccucucuccagucaagcugcuucucucucucuacuggcugagucuggggucuuuauaggcacaggacagggguugggccguggggccggccguagguaguuuuggaaaaggcaacauucgauugguaaaaagacauuuagaaagaaccaaucaggagagagcaggcaaacagagauagaaguucucacuuugggcaauggguuucaggcuuuucaucuugaaggugggguuucgccaggacccaccccugucugccuaguauuucucugccuucugucucuaucaucagcacuuggggaggcuugaggcagaaugauugcuugaguucaggagauggagaccagccugggcaauauggugagacugugucuaaaaaaaaaaauuaaaaguucauagugauaaauuauucauucagauaauguuaaauucagaaaccauuguuaaagugcaaaaauuauguuugaccaagugaaauaacuuggaagcuuccuaccuugccugacauuuuacugacagcauuuuaacgacaugaacuugaaacgguucaccuuaaauuacuuucaaaauaaguguugcuuaaaauaauuuuguuugcaacuauuggaaccuuuuacuuaaaaauguuaaguaaugcuguaaaaaauaacgucuaaaaugguuauagaaagauuauuuuuuaaaauuaucgaagucaucuuuaauacaaaagcaaagaaugaagugagcagagugcaugaggguggaaauuuaauaacugauauucuguugcauucccauauggacugggaaaauacuucauuuugcacagucaagaggggucaucggcacaguuuguaguaagcaaauccagaaaagcucgggggaugggggaacaguuggaaagaggccaaauuaaagggccauuuugcuucuaccaugcuguaucauuaguuauuucuuuaauuuccucuuucuuuuaaucaaggaugagguaggccagguaaggaauuauggacuugucugguuuucaaaagguugccaacuucuuccacauuuccuagccucuuuauucucuugacucuuuuauucccuaaagcaggauuucucagcuucagcacuauugacauuuugggugggauaauucuugugggggcugcccucuguguucuacagugcucuacccacugaaugccacuagcucaaguugugaaaaccaaagaugucucaggacauugucauauagcuucugugggcaaaaucaucucagcugaggaucauugcccuagaggaauaaacuaaauaauagccagugacaauuccugacaauuacuuaaacaugucaucaccucugcugcuuuucugaacuucuucccucucaggagaauagaauguuuagaagggauauauauacaccauuuuacugggcaagaauuguauuuugaagaauauagagacaacagcauuaguacagguuucugcccccgccccuuuugacucugugagcauagcagagucacaaauguaauuaagggccaggaaaggugacucgugccuauaaucucagcacuuugggaggcugaggcuaaaggauugcuugagcccaggaguuugagguugcagugagcagugaucaagccacuacauugugggcaacagagggagacccccacucaaaaaaaaaaaauguaauccagaauugguuuuaauuaguuugccaaaauauuuucuccuuuucaaauuauacaacugaaagaaaaaaaaaaggcucuucuccuuuguucuuuguucuccuggagucugauuuagaacaagaagcuauuaucuuaaaagcucucuuagguuucacugcugucaaaucauuuugagaaauucuacauauauacuuuggaauauaaaguauuuuuguuuaugguuuuuugauauguuguucaggacuuauuaaaggucuccacauaaugaagaucauucugaggaguaauuggauuuggaguuuuaaagaugaucaauccauuaaaaauaagcaaaaauaugaauuccuaauuuacagaaaagaaaauacagauucacuuaagcaugugaaaaauguucaacuucuuguaauaaaaaaagaaaugcaaauuaaaacuacaaaaauaccauuuuucaucuaaagucaacaaguuugauaauacacuauaaaaacguggcaaaacaaguacauacucaauauauuacuugcagaaguauaaauugguuugaccgccauaaagagcaauuuggcaguaucuacaaauuucaaauaugcguuuucuuugagccagcaaaucuccuagaaaguuaucucauauucagacucaaaaagugggaaaagauauguacauaggauuacucauuggguauugcucauacucacaagagauuggaauagcuaagguguauuuagcuuaugacgaguucuaaucucuuuuauuucuauuuuucuggauaaauaauaguuguacauauuuaugagguacaugugauauuuugauacaagcauacaaugcauaaugaucaaaugaggguaauugggauauccaucaccuuaaauauuuaucauuucuuuguguuaggaacaguccaauucuacucuucuaguuauuuugaaauauacaauaaauuguuguuaacuguagucuaccuaucaugcuaccaaacacuggaucuuauuuuuucuaucuaacuguaguuuuguaaucauuaaccaacccuuuuauuccccccacccacuacccuucagagccucugguagucaucauucuacucucuaucuccaugaggucauuuuuuuuuuaaauuuuucacauacaagugagaacaugcaauacuugucuuucugugccuggcuuauuucaccaacugaaauguuauucucuacuucuguccauguuguugcaaauuauaggauuucauucuuuuuauggcugaauaauauuccaccauguauguguaucacauuuucuguauccauuuauccauugauggacacuuagguugauucccuguuguggcuauugugaauuuugcugcaguaaccaugggaucgcggauaucuuuuugauaucuugguuucuuucggguagauacccuguagcgagauugcuggauccuguggugguuuuauuuuuggcaaccuccgugcuguuuuucauagugacuguacugauuuacauucccaccaauaguguauaagcauuccccuuucuuugcauccucaccaacaucuuuaauuuuuugucuuuuugauaaaagccauuuugagaugagaugauaucucauugugguuuugauuugcauuucucugaugauuagugauguugaguaucuuuucauauaccaaucgggcauuuguaugucuucuuuugagaaauguauuauuuagaucuuuugcuuauuuuuuaauuggauuuucuuuuuuuguuguuguugagucauuugagcuccuuauauauucugguuauuaaccccuugucaguugaauaguuugcaaauauuuucucccauucuguagguugucacuucacuuguuaauuauuuccuugcagaagcuuguguguguguguguguguguguguguguguguguguguguguguguguauuuuaguagaggugggguuucaccauguugaccaggcuagucucgaacuccugagcucaggcaguccacuaccuuggccucccagagugcuaggauuaucagugugagucacugugcccgacuuuuuagcuugaugugacccccuuuguccauuuuuauuuuggcuaccugugcuuuucaggucuuacucaaggagucuuugcccaggcuaauguccuggaguguuuccccauuguuuucuucuagaauaugaggaugguucagcauacgcaaaucauuaaacauaauaugucacgucaacagagugaagaccaaaacccauauggucaucucaauagaugccaaaaaaacauucaguaaaauucaacacaaugaaaacuucgugauaaaaacugucaacaaacuagguauagaaggaacauaccucaagacaguaagggccauauaugacagacaugcagcugguauacugaaugggaaaaaacugaaagccuuuccucuaagaucugaaacaagacaaggaugcccacuuucacaacuuuuguucaacauaauacuggaagucuuaaguagagcaauuagacaagagaaagaaauagaugguauccaaauuggaaaggaagaugucagauuauccuuuuuugcagacgauaugaucuucuauuuagaaaaaccuaaagacucugccaaaaaaccauuagaacugauaaaugaauuaaguaaagauguaggauacaaaaucaacauacagaaaucaguagcauuucuauaugccaacagugaacaaucuggaauagaaaccaagaaaauuaucccauuuacaauagcuauaaauaaaauaaaauaccuaggaauaagcuuaaccaaagaagugaaagaucucuacaaugaaaacuauaaaacauugaugaaaaaaauugaaaaggacacugaguucuuuguauauauauauuaacguauucucaugauaauuuuaugaaguaggcaaguaggcacuauuuuacagauggaaaaacugagguuaaguaacuugguuaagauuauauacuuagaugggacuggugaaagaaaacuauacaucuguuuuuaaaaaaaaaaauaacuuuguuaauggaaugaucucuauauugcuaagugaaaaaaagagcaagcugcagaacaguguuuauagugugcugccauuuguguaaaaugaaggaaagauacauucauguguauuugguauguaaaauauuuucagaaggauucugagaaaacuggcaacacuguugacuacaggacgguuaaugaggcagcuagggcaugggugugccgucuacucuuuuuugccuuuugaacuuugaauaauugccuauucaaaaauaaauaaaauuauauuuuaaaagaguacauauuauaucugaaaguauaaaguaaauauccaugagucuauauugauauauauaaauguugugaauaaauaagugggggaaaauagauaaaucucccauuuggaagauuuucaaauaauuuauguagauacuccaccuucaaggaaaggaaacaaacaaaccuuuccacuucuuaagugcucugcucauaaugacuuacuuccaaagaguauguauagaaaaggguggggggagaguaguuuugcaguggagaaaccugacaaacacuaccucaaccaacaucaguggugaugucauguugacaguaggugcccuugguagagugcaaugagaauggcacuuuaccucuguggucugccuccccaaaacccauuaccccaguaauaaugaaaagaacaucagacaaauuccaguagaaaggccuccugcaauauaccugaccagaacuucucaaaacagccaagauuguuaaaauccagcaaagucugagaaacuaacccagcccaaaaggggccuauggggacauaacaguuaaaggugaugugguauggaugggauucuuaaacagaaaaaggguauuagguaaaaauaaggaaaucugaauaaaguaugagccuuaguuaaugauaauguauggauauuggguuauuaauuguaauaaauauagcauguaacuaauguacaauguuaauaauaggggaaacuggguaugggguaguauacaggaacucuguacuauuuauugucuacauuuucuauaaauuuuaaacuauuuuuaaaaauagauuauuuuuaaagaguauauacaauacauacauugaauaauauuuuaaaaguaaauuuaaaauucagguguucgccgccuauuccucaggagcuuaaccauaaaccugaaaugauagccuaagcauccuuuguuuuaagcucuacaggugguucugauguguggccagaauuaagacauuguuuagagauccacuccugcgugaaaaccuauuuucugaauuuuucaaaaucaggaacaguaaauccuuguauauugaauucauuaacaguuugguuuuuguuuguucuguauaauucuucauaaugaaugugugcucauuaugaaugagggguguauuucuuuuuagguguauaucuuuaauauacacgucucaagaauucucauguuuuuaguuuagacucuuacauaauuuuuuuuuuuuuuuuuuuuuuuugagacagagucacgcuuugucgcccaggcuggagugcgguggugccaucucagcucacuacaaccuccgccucccggguucacgccguucuccugccucagucuccggaguagcugggacuacaggcgcccgccaccacgcccggcuaaauuuuuguauauuuuuuaguagagaugggguuucaccguguuagucaggauggucuugaucucuugaccuccugaucuucccgccgcggccucccaaagugcugcgauuacaggcaugagccacugcgcccggccugacucuuacguaauuucuaaauacccuaccaaacauaccuauaaaucauaaucacgaauagcagaaaucuuuuucacaggcuggcuauuacauuuuuuuuuuccuuuaugaacucuaauuugucugucguauagaugaguauaguaugaaaacaugcugaaaugacuuuauucuuuaucauuaccaacagcuuucuagccucuaauauacauaugucuauuuuuaauguuuuguaauaucucacuguaauuucuuuacaagcuuuuaagucucuuaauaccaacuucauguugauauuauuuuucauuaggccauguguuuauuaagaagguuauauuuauuuuuuccaagucauacauuaauuauuuugauguuguuuuccuucucuugguguguuuauuauuuaggucuucaguuaccauuauucagaacuucugguuuggucaaaacaguauugaugagccauaugauuuauugaugauaguuucuggagagaaauuuccuugucucuuuccauuuacuugcuauaguuucuggagagaaaguuccuugucucuuuccauuuacuugcuguaguuucuggagagaaaguuccuugucucuuuccauuuacuugcuguaguuucuggagagaaauuuccuugucuuuuuccauuuacuugcuauauaauucagacucugauacuuuucugacugauagggucacccuuucuucagcaucuugcucucuggucucuuucuguuccuguuccucuacacaaugcugucagcauuaucuuuuuaaaauacagauuuaaucauguuccugccuugcucugaaaccuuaugucucgucucccuuuuagguauacauuagugauauaaaucacugguauuuauggaucacagugcugagacuuuuacagccaucaaguaauuuaauuuugauaagaacucuauaaagccagccuauaacuccuauuguccuccauuuuauaaacaagaaacugauuuagagaaguuaagcaacuuuucuaaggugcuauaguuaguagguggcaaaguuugaacauaauaacagguuucuuuguuaguauggugccagugggguucccugugcuuuucugcccucucucuacccagcuuucccccaucucauucuuuagucucaaggcuccacuuaccgucuuccauuuaccuuguaacuucucauugaugaugcuuacacuuucaaccuauggaaacucugcuucucuuuuuuaguucugcucaaguaucauacugaaucccucuacuccacugucccaguuaacauuuuuuauuccuccuccuucuauaauuuuuuauuuuaauuuuguuauuugccuuauacuauauauauuuguguuuauuucugucuuccuacuagauuguaaguuccuggaagauaaggacuauucugucuuuacaaacuguggggccaguaucuugcacuuaccggacaugcaagaaguaugccuuuuugaaaucaguuuuauuuauacaaauaguagagugagugaguuuguuuguuuguuugugacggagccucauucugucagucacccagacuggagugcaguugugcaaucuuggcucacagcaaccucugucucccagauucaagugauucuuaugccucagccucccaaguagcugggacuacaggcaugcaccaccacaccuggcuaauuuuuguauuuuuaucagagacaggguuucaccauguuguccaggcuggucucaaacuccugaccucaaaugaucugccugccuuggccuuccaaagugcugggauuacaggcaugagccagugcaucuggccuuagaguuuuaaugaggauggaauguggaguccuuuguccuuacaaauuuuuguaacuagguuaugaagauauuuuauucuccaacugaauaauuucauaaaauuuaguaaaauuuuaauuuuaaaauuuaaaugaagauuuaauuuuuugguucuguauuuuuacuuguaucuuuuuaauugagaauucuuacacucuuagauauauguuaaacauacuaugagguuuuacaaauacuguuggugacucaaaaggagaauuaguauuacaaaaauucuaaauauuucuguacuuucccauuauuuacccugguuacaaaaacuauaaacuuguaacuuucuaauuaaucauuguuuuuaauuuuuuuuuaauuuaacuuuaaaaaaagauuugagaggccaguugugguggcucaugccucuaaucccagcacuuugggaggcugacgugggggaaucacuugagucuagaaguucaacaccagccugggccacacagcgagaccccugucucuacagaacauaaaaaauuagcugggaguggugacaugcaccuguggucccagcuacuggggaggcugaggugggaggaucacgagccugggaguuugaggcugcaguguugaacugugaucacaccacuguacucauccuaggcaacagaacaagacccuaucucaaaaaaagguuuugagaacucuuuagaaauauauacaggacuuuucuaaugagaaaauuaaggucagaaaaugagaugaaacuagguuaguguuugcaccuaaaacacaucccauaagauccaagacugaugguaaaauugggcuacaaauuuggcugugcuuuuuccauuuggcaaagcaaacaggaaaacauguuaacuuacgugagcaaauuguucauguuauaaaaucaacuagauaaaguuauuuugugggugggucuucacaaagaagggcuacaguaugaaauagguaaacgauaucagcagcagcgucucugugacaaaugcauuuaguuuagugaaacugauucauauuagaccauuugaugcaggcaggugacauggugucauuuauuaaaggauauucuaugaggagcccaaauaagucagugagcauuuauaauucugagaucuacugaagaauuuugaaauauuuagagcagcauguccuaaggcgcuggaacgacugcuuaucuuucaggcuaagaguggaguagcaguaaguuuaagauuauauucuccaucaguaacugaauauagaaauccuguauuuguaagagacauguauuuuaaaaucaucaaugauuauuuauuuguaaguuuacuuuucuauuuuucuugaacuuuaaaauuaaccaggaugcuugaguacguggaucaccuuuuagguaucaauagaauuguuagcaaauaguguuagguuaaaaacacuauguuuuaaauucuuugauaaaauugaaacguuuacuuauaaaaauagaaaacuguggucauacugauauaggacuauuaucccucaguuuccagaguguggauucuuuggcauguaugacaaaauucuucucuuucgccaugacaugaacucagaaaacauuuugcagcugauuaccucagcagaugaaauacaugaaggagaccuaguggaagugguucuuucagguaaguaaguggcuuuuuagagugauugccuuuuccccucaaagagccuaauuuucuguacuaaaugcugcaauucgauuauauuuagucuuuguauuauuguuacuuaauuucuuucaucucuaauaauggucaccauaugauuuuuccuuucaggcauguuauaucaccauuaagaaagaaaaauaccuggcaacgguggcucacaccuguaagcccagcacuuugggaagcugaggcgggaggauugcuuaucucaggaguuugagaccagccugagcagcauaccucgucucuacuaaaaauuuaaaaaaaaaaaauuagccaggcauggucacaugcaacuguagucuuagcuacuugggaggauaaggugggaggauugccugauccugggagguugaggcugcagugggccaugaucacacuacugcacuuccgccuggacaacagagcgagacucgucucuuuaaaaaagcaaaagaaaggccuggcgcgguggcucacgccuguaaucccagcacuuugggaggccgaggcgggcggaucacgaggucaggagaucaagaccauccuggcuaacaagaugaaaccccgucuguacuaaaaauacaaaaaaaauuuggccaggcgugguggugggcgccuagucccagcuacuggggaggcucaggcaggagaauggcgugaaccuaggagguggagcuugcagugagccgagaucgcaccacugcacuccagccugggcaacagagugagacucugucucaaaaaaaaaaaaaggaaaaaaucaggauaggaaaauaaacugaauuacuugaauguuacuaagcuuaggaaauuauuuggucugaaagaaauauacucuucucugagucaaagaaauaaaacaguuacacugaaauucuguuuuuuccccuucccccacccccauuucuguaaagagcauaaaagaagaaaauugggguuuagaaaagagaaucaggaaaaaaagaaguaaugaagauauggaagaggaaauuacaaugcugguuauuucuguggcuuuaaaauuaaaaaugcucuuucccuuuuugucccacugggcuuuuuucuaccuuucacuuuuuccaccucacgcauucuugccauacguuguuuuuuaauucccacuauuugccaucucauccugcagcaaugugggcaagauaauaaggagugaaaaggaagaaagaaugccauaauaaugcacauaguaggucugcaguacuuuuuguuuggcaaguaggagaacugauggaagaaaggaagcaagcuggccagccaugggucagagcccugcuaccaaguucccuuuucucaaauucaccuuugagccuuuucuugagauccucucuguccuuauuaguccccacuccucucaucuuauauuucugauucucucauucaucucacucccugcuacacugaucauucaucuucuauacaacaaccccaaaccaucucuauauuucccaauccuugcccuccucuucauuccugaggaguuucacucccugucucaccuggaaguccugcucacaucucuuccuucucuacucuggacuccaucagacuacuugcagguugaggugagaggaaguuccuugggucuacugucccgacguucacuaaggggaaaggaguuucuuucucauauccacuaggacuguggagaacaaacagacaaguauauccugggauccuaaauuaggacucaguaucuuuuuccacagaaacguuuccauaaauugaaguuaaguuccauaguaguuuuuacuuuaguguucuauuucccacuguguaaguuaagcaguuuuuaauugguuaaaguaaccuaaugucuguuuguaaucuugucauuaugagaaaaugcuguuggaguuccaaauaacuaaccuaugaccuacuucuggagcucaaaugaugagaaguaaauggacuugcuaaacuagaguuugaaaucacaauauuaaauaauuuacuuuuaugguccagugcaacuuucagagaaaaaaugauucuguguacuuugacauaagugaaugugugagcauucuuaaucucaucgcaguacaaauacaacguguauuguaauacuuuucuuuuuuaaagcuuuagccacaguagaagacuuccagauucguccacauacucucuauguacauucuuacaaagcuccuacuuucugugauuacuguggugagaugcucuggggauugguacgucaaggacugaaaugugaagguguguguucuaaaauuuuuguggucauuugaaauaagauuccacauuugcauuuuuuauuaucagugaaaaagcaagaugacgagcuguugacuagggugguaacgaggauuuagaauuggagagaucaggacucucauuuuaucucugccaccuacuucauauucuugggcaaauuacuaaaccucuuaagauuaauuucucguaaaauacauucugccccacugguuucauaaagaguaaacgguuaaaucagguaauaggguuaaauauuuaguacaaaauaauggcuccauaaauauucauguuguuuuuuguuuuuaaaaguuuucuuggccaggcacgguggcucacaccuguaauccuagcacuuugggaugccgaggcugguggaucaccugaggucaggaguuugagaccagccuggccaacauggcgaaacccugucucuacuaaagauacaaaaacuuagccgggcgugguggcggaugccuguaaucccagcuacucgggaggcuggggcaggagaaucgcuugaaccugccugggugacggagguugcagggagccgagauugcaccauugcacuccagccugggugaaagagcgaaacucugucucaaaaaaaaaaaguugucucuuacauacaacuaaauugucaaauuuguucugaauuagaauugcuaggaguaggacacaggugcacauuucugaugaagaaacagucuucuaagguggagggucaaucaacuuuuucuguaaagggacagagaguaaauguuuuagacuuuguuggccauauggucucugucaugauuuaacucugcuauuacaguaugaaaccaaucauagacaauauguaaacgaauagauaugguuguguuccaauaaaacuuuauuuagggacauugaaauuugaguuucauaaaauuuucaugucacaggaggaauuugguacagaggccauaguuugcuaacuagugcuuuaaggcagugguucucaaacuguauugugcaucguaaaacacacuuugcugggccucauccccguaguuucuaauucaguagaucugggguggagccuuguaauuuacauuucuaacaaauuuccaggugguugccuuagggaccacacuucaagaaccacugcccuagcugacuuauccuuuuuacacauuuccuuuucuucuugaauucauuagcuuccacuuagccugcugucuggguucuuaauuaggauagguauggcuaacagaaaauauguuaaauaaaagaagcagugguuuuuauguaucacacuuaaauaguaaauuuuuuuuuaaaucuuauauuuuaccuuguaaaauauguuuaggcuguggauuaaauuaccauaaacgaugugccuucaagauuccaaauaacuguaguggaguaagaaagagacgucugucaaauguaucuuuaccaggacccggccucucaguuccaagaccccuacagccugaauauguagcccuucccagugaagagguacguauucuaagguaauagacauuuuaguaguaguuauucucuguguuucuacaggguguaugacaucacucuagaacauaauuuauaugcuaaagaaugguaauguuccuacacuuaagaaacauaaaauguaguaauggagacaggacuuaccgguaguaaugaauugcauuuuguacaccuugggaugguauuauggcuuguaccacugcuuuagccuucuagucaguauccuggcuccuggucuccauacuuaaaucuuuuuuuuuuuuaauuuuuuuuuuaauuuuuguuuuuuugagauggagucuugcucugucgcccaggcuggagugcaguggcacggucucugcucacugcaaccuccgccuccuggguucaagcaauucuccugccucagccucccaaguagcggggauuacagaugcgugccacuacacccagcugauuuuuguauguuuaguagagaugagguuucaccauguuggacaggcuggucuugaauuccugaccucgugaucugcccgccucggccucccaaaguucugggaucgcaggcaugaggcacugcuaucugcagaucuguauacagaugagacaguugagacacagagcagcuaagugacuugugugaagucagagagcaaauuaguaagagauaguggaauuaaacccagaucucauuauuaauaaaucagugauuuuuuuuccuaauacaguguaccucucaagggcaaaggcaguagauccaggaaaaaagaaauaacucccuuguacauuucauaguauuugaaaugacuuccaucuguagguuguaaucuuauuauuuaguuuuuucuguaacuucucugaucuucuguaaauuaauggcaaaaucaaggccuugucuugguacugugaucauaauauuuugcuaaguuaagacaccagaguaaaagcuuuugaaauccuuucacaaaaauuccaucuucucuuacugcuuagcccuagugugagauuuuuaaaggauaaaaagagugcugcggcauaaaggacugaaaaugagggguugguauaaaccuacagaagagccuggaaaagauuaguaggaaaaaguuagugcaucuuauacacugaacugcacagagaacuuaccuaggaaugaggacaguagaauagagguaugucaagagccccacaaaugaugcuguuacgccaccuaugcccaguugaguauuacuagauuaggaaauagcagaaggacagagcaaguggauaagguguuacauuuuucauuaguuuauauuuuaucuugaacaugaaagcuccuuagggaaguauaagaagugcaguuacaugucugaauugguuagauuguucaggguauuuuuaaacaaguagaacuuguagcauggaagggcuuucaggguuuacuuuagucaguucaagcauagucucaaaaagaagaacuuuauuuuccaacuguuuggguuuuucuaccaggugaacaaaaagcaaaauuaaagaaggcaugaauuaaaaauuuuuguaaccugagggguaaguagauuuugguaacuaugacccuuucuauaugaagggaauaaucaaacuaaauuauagaucacccaguucaauguggcucauuucauucauucaacacacauucaccgauuauuguaugccaggcccuguuauauacuagggacacaaaauugaauaaaacauaauccaaauacucaagcacaaaauccuaauacccaacuaccaucuagcuauaugaacagauuuugcuguaccugcuugcauccucacugccagaacugauguccugagaucuuucagcugccuucuauaacuagucauguuuguaauucagagaaguuggguaauucuacauuaauauguucaaccaagggaaggaaaagaagucagaaaaaaacaagagacagagaagugcaagggagaaguaaggggaggagaaaaaagaaaaaaaagggaagaaaaggaaaagaaaaggacaaaacaacugguuggagaagagcacuauaaaaugccucagauugauaguguaggcagguauuuuucuuuuucuuuuucuuuuucuuuuuuuuuuuuuuuuuuuuuuuuuuuuuuuuuuuuugagauggaguuucgcucuuguugcccaggcuggaguccaauggcaugaucucggcuuaccggaaccuccaccuccuggguucaagcgauucuucugcgucagccucccgaguagcugggauuacaggcaugcacccccacgccuggcuaauuuuguauuuuuaguagagacgggguuucuccauguuggucaggcuggucuugaacuccugaccucaggugauccgcccaccucggccucccaaaguguuaggauuacaggcgugagccaccacgccuggccagaagaccaggcagaaaaccaacuagcuagguucuggaauagucuccaaaauggguaaacaaaguuuacuucuucuuaaagcugaauuacugaaacuuguuuuaauuaguuuuguaucugccauuguuuaucauuauuaauuagacuuaaaauguauguauauauuuuaguauuaagauaaauuugaaaaucuaaaauguguuucaaaauauauucagaugucacauucaguaaugcaaaaugagcagcaauaauacuuucuucauuuauuuguuuuaaaguuuguguauuugauuuguaaagugcugaaaugugccuggcaaauaaucaucagugaauauauaccugagaauuaacauaucuuagauguuuuuaagcauaaauauuagcaaaaagaaucugcauuuuucucauucaaagauugguaaauuaaacauugcaaaggaaacugcugagaacaacauuuuuagaguuuuuuggcuuuaguguuugaaauaaaugauucuugugguuaagcucugcucccacuacucuguuuuuaauauugacuuacacuuaugaaaauuacuuauguuauagucacauguccaccaggaaccaaguaagagaauuccuucuuggaguggucgcccaaucuggauggaaaagaugguaaugugcagagugaaaguuccacacacauuugcuguucacucuuacacccgucccacgauaugucaguacugcaagcgguuacugaaaggccucuuucgccaaggaaugcaguguaaagguaggauuagguguuuucccuaauuaaaauuuaugucuguuuuuguuauuauauauaggcuuaaaauauuuauauuucagaagcauuagccaaagaaauuauucucauaauuguuauauaaaggaaagagaaauauaaacaaaauauaaauguguguguaaacuacuauuacuacuaucugcaguguguguuaggugccaggcacuauaguagaacaguaaaccuuuacaugcucagucuucaaagcaauuguaugugaauuaugcuuuuguuaauauacuaguaguaauaggaguuacuauuacuauuaacuacuaauaguaauaggaguacuaguaauaggaguuaguaguaauaggagucauauuucauuuuauagacauagauuagguaacuugcuuaagaucauguagcuaguaaacagaaaaacuagaauguggaucucugaggauggcuucuucaccuguaugcuuaucacuucccaauacagaauagcuaguaggcagcaaagcugauacuugagguuuuaugucuuuuugauuccagagccagacacuaaacaaaauaaaaauaacgcuuuccucuuuucauuaaacauuuauuacacacacauauaagcauacugcaagaguuuuggguuuuuuuuguuuuuaaguauguaguuuggagaauuauacaaaaacugucauucccgagaauaaucacccugaaauagguaggacguaauaaaagcuacuaaaauuaugauagggacccacccguauuuggauacuaacccagcacacuucuauaguauucucaaaacaucucuuaaugaaacaaguuuuuaacagcauacuggaauaauuauuugcuuauaguuauauaaugcuuuuaugcuuuuuaaagaugauuuuaucuuuuugucucauaccuucucagcaaugcuguacaguagaaacuuuucacaguagagugaaaacuaaaauagaauguaaaugucuuagauuauuagucauugagccaggauaggauauaaguagucuaacuauaaucuuauauacuuuuuucauguaauuagcaguucuugguauuguacuuuuuauauaguagaaguauuuguggaauugaauuaucaagugaucuaaauaaaacauuaggguugaggguuuuguaacaagaaauucuugcuuacaagacagaguaagauaauuguauauaagcuuaagcauauaagaaaauaaagcuuuucugaggggggagggauagcauuaggagauauaccuaauguuaaaugacgaguuaaugggugcagcacaccagcauggcacauguauacauauguaacuaaccugcacguugugcacauguacccuaaaacuuaaaguguaauuaaaaaauaauaauaauaauaaaauaaagcuuuucuugacaguguaugauagcacacaagaacauuaaauggggaauagauuauacauuuguugucagguauuugauaacuauuaggcauuauaacaugaugaaauuuuauuucaacagcuugcuuugaauaugaguuacuacauaaauuaauacuuuaaaauaucaaccuaaaaauguauuggcaagcagccacugagaaauguuuugggaaagaacauuaguaacagauguacacauucuagccaacaaauaaucuuaaugaagguaguuaauauugcugcucugcuaagcagaacagaaacauucuuaaaccauaugcagaaaaguacaguauuuuguagaggaacuaaaauaaauacaaaugaauuuuuacauaaaccuguuaauucugcuacuggauuauucaacuuuuuaggguucuggaagaagaaucuuuuaugcuuauauugguucagaaaaugguagguuuuauuucaguauagcuaagcuauuucauuuauuaaaauaauuauaauucagugauuucccuauuuuaauaguaugaauuaagauacuuaaaaaauaaaaauauuuucauuugucagucuacgaaagaaaaaugauuuuguuaagauaaaaccauuauacuggaucauuugagaaaauacacaauucuaagaauucauuaaucuguuugucuuuauuuucuauuuugauguguaaaaacuucaagguagcuuaaaagcguauguaaaguauaagagagcauaagcaaauuaauaaaaacauggguaaggacauagagaacuaaaacugccugccugccauucaaaccuacauacuugcagguaguccacaaauucggcucugaauuuuuuuuuuuuuuuuuuuuugagacagagucuugcucugucgcccaggcuggagugcaguggugcugccacacccagcuuauuuuuguauuuuuuuuguagagacaggguuuugccacguuggccgggcuggugucaaacuccuggcuucaagugauccaccugccuuggccucccaaagugcugaaauuacaggugugagccgcugcacccggccugaguuuucaaagggaaaauggaaaccuuguuguuuucacaguuugcaaaguucaugagauaaaacacaaaucuauuguuuaagagguagugcaagauaauauuaauaucacaugaauuuucccuagggccugucuuaacaaggauaguguuuuaaaguaaauuuuauucuccaccaaauuauacauuucauggggcuuaugucauauaaugaucuuuagccugugcuguuggcaugauacccaggauuuucuugacucacaaggguuacaaaaacauucuaagucaggacuuaaaguuauuuuuacccaguuauuacucauagaugcauuucaaaggugguauuagacauagaccagugggucucaacuucaguaugacuuacagagcucagcccuacccuccccacccgcuaagaguugcugauauaguaggucugggauagggcgcaagaauuugcauuucuaacaaguuuccuaaugaagcugaucugggaccacaguuugagagccacuguguuauacaguaauuuuggacagauuguaccugacacugaucugcaaugcuaucaacucugagguuuguuuuaggcugaagagaaccauuauguaaaagugggaggccuugugcuggagaaacucaguccuuccucacaggguuguaugugaaagcccuuauuagguuccucauaaauguuuguuggaucucagucucuuuccugcauauacauuagguccugauucuuaggaauugaaaguauguaucugacauauguuggauaggaauuuaaucagcuugagaaacucucaugggagauguggaaagaugaauaugacauaagagaaggaaauauggagcugccaguacauuucggcgguguuguacacaugguauuagccucauuauacaaaugaagaaaaugaugggggggugcagaggggugcuaaagugacuuguaggugguuauuauuuuaauaucaucauuacuaauaauauucuguuugugagugauuuaaagaaagucuaaccauaucugauacugcuugacuuuuacauaaauuaauaugcugaauauuuucauuuuagauugcaaauucaacugccauaaacgcugugcaucaaaaguaccaagagacugccuuggagagguuacuuucaauggagguaaaauuauuuuucuuaauuuuugugaaagaucagaaaaggccaugauucuuugguguauuaucuuuggauaagguucuguuuuccugauuuauuuuguuucuuaaagauuuucuucugauuuaauaaucaaacaaaauacacagaccacugacaguauacauuuauuaguaaucacgccuucccgucuuuccucuggccaccuguuacuuuguagucuaauauagccagugguacuccauauccucuuucauuuuuagacauaaaagaacuuguuuuaaaacccugcucuugucucuauucuuucauaguucuaauauguacuaacugcuugcuauaccaggcacuguucuaaacucuuuaaauauauugacauuucaaccuaagaacaacccuuugagguagguacuaagagaugaguaaacugaggcacaaauacaugaaauaacuugccccagaaauauagccaguagguggcagagcuggaaguuaaacccauauggucugguuccuuagucccuagugauuagaacacacuauacugccucacugucccuuucucugucaaauaaucguuguccauuuucccuuuggggucuuuuuuuuucuuuucaagauaauacuaagcaaggcaguuaccuuuuuuuggaaggaagcaguaaggacucuagacuuucagcauaauuuuccuuuaacaauuuacaugacugguaaaaauuuuauguaaguaguucuguaaaaggaaaagcauaaaaggaaugaaaauucucuuggggagaguuuaauuaacauuuucucuuguggcuuguuuucugugguucuugguugucuuagucuguuugugcugcuauaacaaaauaccauaggcuagguagcauauaaacaacagaaguuuauuuuucauaguucuggagacugggaaguccagggcacuggcagauucugugucuggugagggggguccguuuccugguugauggcaccuuguaguugcauucucacaugguggaaugggagaaggaacuccuguggacauauuuuauaagggcacccaucccaaagauaccaccuuccaaagacccaccacuaccuaauacccuugccuugggaguuaagauuuuuaaggggaacaaacauucauaccauagcacugauuaacaccuugacagagcaugauugguuuucucuuucgguuaaucugaauuaguauaguuugucuaugacuaaagucuuuuauaaauuuauacuucauguauuuguguuuucguguuuuucuaccuuauaacaaauggauacgaaacaccauuuauauuuaucuuaaugugcauuugauuacuagugagauguucaaacucacuaguaaucaaagaaaugcaccauuuuacauuagcaguuuaugaggauucugauuucucuacaucccuaccaccacuuguuauuguauaucuuuuugauuacaaccauccuagguagugcgaagugguaucucauuguaguuuucauuugcaguucccugguggcuaauaauauugagcaucuuuucauguguucauucgccauuuuuauauauuguuugaaaaaagcaccuauucagauccuuugcccauuuagguuacuuaucuguuuauuuuucauugagcuguaagaauuuuuaaauacccuggauacuagucccuuaucuggcauaugauuugcuuauauuuucucccauucuaugggcuuucauuucacuucguaagguguuguuuguagcacagaaguuuuguauuuugaugaaauccaauuuauuuauuuauuuauguugucacuuaucuuuuugguguauuaagaaagcuuugccuaaccaaggucacaaaaaucuacucucaugcuuucuccuaugaguuuuauaguuuuagcucuuagauuuuuaugugauccacuuugaguuaauuuuuauauaugauuuauauguucauucuuuugcauguagauauacaguuauccuagcaccauuuacuuaaaagacuauuuuuugcccguugaauuuucuugacacucuugucaaaaaucaguugaccauaauggugguggcuuauccgcauuuauaguaucuuuugucauguggaaauuuaaaauucugauguaaucaaauuaauuaacuuugugccuuaugauuuguguauuuuuuaucuucuuuaagaaauacuuuaucuuaggccaggcgugguggcucacgccuguaaucccagcacuuugggaggccgaaguggguggauccccugaggucaggaguucgagaccagccuggccaacauggcgaaaccccaucucuacuaaagauacaaaaauuagcugggcaugguggugggcgccuguaaucccagcuacugaggaggcugaggcuagagaaucgcuugaacccaggagguagagguugcagugagccgagaucacacuccagccugggugacaagagugaaacucuaucucaaaaaaaaaaaaaaagagaaauacuuuacuuaacucauaaagauauuuucuuacauuuuaagacucuuaagacuuuuuucacauuuaauggacuuccucuauuaauauaaaacucugaaauucauuuaaaauuuucccagaaccuuccagucugggaacagauacagauauaccaauggauauugacaauaaugacauaaauagugauaguagucgggguuuggaugacacagaagagccaucacccccagaagauaagauguucuucuuggauccaucugaucucgauguggaaagagaugaagaagccguuaaaacaaucagguaauauauauacauauuacaagcuacuuccagaugcaaggucaguucaggaucucauuaagaaaaagccacgucucuuuaagugggaccuuaaaaguaauuuaaaaucuaaauaaauuguggcuaauucuuuuacaugcaauguaguauuucugaaauaaauuauaucacccuugccauccacucaagauggggagguaugagaauccuuguuuuuuuuuuuucguuuuuuguuuuuuguucuuaaagaaaaaugcuuuaaguguggucuagauguaaaaccuaguuguggaacagccacugcaaggugucaguauugaacuuucaguuaaagcaaccuguuuuucacacaggcagcuuuaacugguaguagaaauggcaauaaagaauauacucaugaagauguugcacaaggauaauggugaugaaguuuagggcaguuuucauauugccacaguuaauccgacuauuagcauuuuguaaaaauacuauuagacuguaaaaccauucuaaauaugccacuauguucauagaaauucaauuuuuguagccuaaaugauauacuaccuuguagcaaaauguccccauuuuggcagguuuuguuuuucauuggaaacaaagaguuacuuaaagaaaaugagucauuuauuucagucucagguggcugaguugucauuuauucaguuuggcuuaucauuaaauaacaguuauuacuaucauuaacauuauuaacaaaaucuuuguuuagccauuuuggagacuauuccagaacccagcuaguugguuuuugguuucuguuuuuuuuuuuuuugagacagagucucgcccugucgccaggcuguagugcaguggcacaaucuccacucacuucaaccucugccucccgguucaagcgauucuccugccucagccucccaaguagcugggacuacaggcaccugccaccacgcccggcuaauuuuuguauuuuuaguagagacgggguuucaccauguuggccaggauggucucgaucucuugaccuugugaucugcccaccucagcuucccaaaguggugggauuauaggcgugagccacugcgcccggugaaccuagcuaguuucuuaaucaugaauacuucauaguuuaaaaaagaaaguauuuaacuguuugagguucacauuucaaaacaguguauuuuaugcauacaucccaaauuuuauugagccauguuucagugcugauuugacuuguuacauuuucuuaauuaguaucuguaaaucauuuuccuuuaaauaccuucuaguagaaguacauuuugcuaacaacaugauuaacuggauuugauauuugagccaugugaauucgaguuauauauauaguuguauuuugccuuguuguggauuugcuaguccaucaugcugccuagggcaggaaaacucuucaacagcaagcccaaaugagaaccucuccugggcuccaaauauuccaguuugggaggguacuuucuauuccgcucauuguuuuuaauuuuuuuuuuuguggcccuccagaaaacauucaugacaaguaaauaggauuuaaaauauuagcuuaaaauagaaucuuuuauguaucaucauaacaggauuaauuuuucuucagccauuguuuauuuuacuaagauauuuugaaaaauuuuagcucaguugucuuuaaaaaggcuucauguuccuacaguauuuauaugauuuuuuaaaaaucuacacaaacuuacaaauuuuaaauauuuuuuaguccaucaacaagcaauaauauuccgcuaaugaggguuguacaauccaucaagcacacaaagaggaagagcagcacaauggugaaggaaggguggaugguccauuacaccagcagggauaaccuggucaguaaucaaauacauuugaauaugcuaguaagacuuuguuaugaguuucauucugugcauuuuuuaaaucaaaaugaugaugagauacauauuaagacauuauauacaccacagcaauuuguaaaagaugcacuggaauuauaguuaaauuuguaaggaauuuuuaacaggcagaauauuuaauguauugucuuuacaaacugguagagcagucaauauucaaaaaggaucugggauuguuccacaauaaaaaauaauuaacucgaaacacaguggagccacaaauagagauagaaggaacuaagacuucaucuaaaaagucaucuuauuaccaaagauaggaaggaagcauguuugguuuuauguagacuuuaacuuaguguaaaugugcaacguuuuuuuuuagauccagcaaagacgaggaaugaugacauucuaguagaaagacaauagauuugaagaaucagcguaguguaauaacuaagaacacagacuuuggagcuagacugccuaagucucuguaacuuacuauaaaacuauaugaacuugggaaaguuacuuaguuucuuuaugcuuuuguuuccuuguguaaaauuggcauaauaaugguaaccaccuaauaaauccaaaucaguuaauauaugagaagaucuuggaacagugucuggcauacagaaacacucaauaaauguuaguagcuaguauuuuauuuuuaaagucugcugaguagauuauugaaacaagcuuucuaauaaaccuuuuaagaauaaaaugaaguacccaauacauuuagcuggccuaaaguuuuguaugauaacaacaguauagacugcaguguguauguguuuuauuuauaguucauauccuugcgaauguaacuugaaguggugugccuaccuuugcgaauuuaaugguauaucaaaggugcuuuuacaucaaauuaauggggaaaguaguuaauucaguaaaugguguugggacaagcaucuagccauuuugaaaaaaauaaaguuauauauauguauauauaugaauauauauguauauauauguguauguguguguguguauauauacauauauacacacaccucauacuuuauacauaauaaaccuaaauguaucaaagauuugaguguaaagaaauuaaacagaagaaacuuugggagaauuauuuuacaaauucaagaauaaaagaucaauaaauucaaucucauuaaaaaaugauauguggcaaaauccaaaagcaaagacaaaugagaaacuggaaaaaauauuuucagcucauucuaaacaaggguuaauuccauaagaugugaagaaugccaacaaauugauaagaaaaagaacauaacgcaauaggaaaauggacaaagaauaugaacagagaguuucacaggaaauacaaaugacucuuacacauaagaacuugauuucauuuauaauaaaaggaauaucacuuuaaccuuucacugaaauaccaguguuuauuuuucaguauagcaaagaucaaaaaguuauuaacauacugcauuaaugagggugugaguaacuagggacucucauacguugcugaagagacuauaaauugggucaaaucuuguguagaauaauauaacacuaucaggcaaaauuacaugugcacaugucuguugacccagcaaaucaacuucuagaaauauagccuauagguaaauuacauauuuuuauguguguguguguaugugucauauauauauauguauucaugugugcauguaugaaauucucuacaaggauucccagaaaccugauaacaugcuuugccuggaguaagggugaggaguggggaugagugaugguggaagugauacuuuucaccauacauccuuuuuauaucuugagaauuuugaaccucaugaaucuuaaaguuauucaaaaauacaaauuuaugaauguaaaugaagggaaaaguuagguacaagcacuuuggaggaaucauuuuugaaccucacaguuuuccaaucuucauuuuauagagaaagaggcauuauuggagacuugacagcaaaugucuaacauuauuucagaaugaaucuggaucaaaguauuauaagguaaggauuuuacacuuuaaaaaauauaagcauuaagauaguguauguuuuuuucagauaauauucauuaacuguuauauuugaauauauaugacucuagcuaguaugguuuauagaagucacuguuagguuccuuguugaagcaacuauuucccauaccaaauuucacucccccacagcagcucuccuuccagacuguuuguuguugucguguauuuauuuauuucuggcuugccugucagguugcugcugcuuuccuucuggauacucugauuuagauuagacugcuuagaaagucccaucaucauugacuguccagaagaggucagugagguauuuaguauuucucccaccuuccaccuuaccuugggugccaauucccaauugcuuguuuggcucuuaaucuccuuuuuacagucuuccuugcuuggcuuauuccacguuuugccacaucacaaacugauagcaagcaagauuauaaccaagcaguuaggucaguaagagagaaugggaacuaauggcuugcuuugagcagguguuuuuuuguuuguuuguuuuuaguaaguuuuuuuuuuugccuuaggaaguggacuaaaaauauaaugauugcuacagguuacuccaguggacagaaccagaaugggaguggcuuaaacaacugaccaagauucugcuuuuucugccauuauuucugcuucuuacuugcuuuggggcuauaucuuguagacuacagucacuagauaaguaguugugaagcugaauuaaugacaguuggaaguuacaaguguuggauauaguggcagauuacucuccuauaucuucuuccuugcauccuaaugaucugcuacuggcuuaguuaucauaguccaugcucugcgucuggcauugcuggacauugcagcucauucaagacaggccaugucauaagacucaacuguguauuaaauguugcauacuuguguccgucuuaauggcauucauugaaaugcauaucucugguucuuuaguguauuuaaaaauaaaaacaaagaucuauucuuauuuuucaaugcuuaauuuuuuacuucaggaaauuccacuuucagaaauucuccgcauaucuucaccacgagauuucacaaacauuucacaaggcagcaauccacacuguuuugaaaucauuacugauacuaugguauacuucguuggugagaacaauggggacagcucucauaauccuguucuugcugccacuggaguuggacuugauguagcacagagcugggaaaaagcaauucgccaagcccucaugccuguuacuccucaagcaaguguuugcacuucuccagggcaagggaaagaucacaguaagcaauaaacuucuugauggcuuuuucuccucuuuaauucuuaagcauuuuguggguaugguuguguuccuuuguuccuuuuaauguucauccuaagcuuagucuuuaguaaccaauacuuuaguaaccaauacaauuaguuaacucuuuuauaaaauuauauugguuauaguauauauacguacauacaaugcccagugcuaggcuccagagucaguuuuccuacaugaaaauccuggcuauaccaucuguuauaugaucaggcaaguacuuuaccucacuguaguaguaaguacuucauaagguugucaguauuaaaugaaagagaaccuguaagauacagaacagugcuuggcauccguaaagucucauuggauuaugccugcuacugguauuaauauuuugcuuuauagugggauauaaacaggcaauaaaguauuaugguucacaucacacucaugaaaucugugaagucagaaaugcuguauuaaaacauacagaaauauuuaaaaaucacugaaacauguuuugcaccaacaaaacuuauauaauuaagccuaaauuggauaaaguuucaaaaguaaacaguuaacaaucgaaaggucacuauaaugucacuucucccccauuaacauuauguugcuuauggggacacauaagucauucauuugagaaauauacucaaauugaaauaaguaucaacaacuuuccaaagguaguuuauuuuaguuuagcuguauuauuuuguacaacuauuaugcuaggcccugagcuaaaauacaaaauaaauacagaaaucauaaaagcucuuuagggagagaugggauauauaaagguauuagaugguagcauaaagcaguacagugcaaaagugaggaauacauuacuuaaaaaacucagauacagacagaagaguaaacaagacuucauagaagaaccugauuugaaccucagguagaaauacaguaggcagaucucagugggagggguggagggguaacauuauuuaguugagacaagugugaugaggaucaugacaacuguguacauguuugguguucaguacugauuugggguuggaauggguguaaguagauggauguuucacagugguucuuaaguuuucgagguuuuuagacagaacucuaugucauucuaauuaaaacuaggacuguuuccucagaaaacaauacaggcacuuacacacucuuuaaaagauaaaugaggugauuuauuucaggcaauaaauguauuaaaguaccaaaaaacaacauuauaaaauuauaaaaaugcaagcaauuuagaaguguauaaaaacucuuugucccccaaccccaccucuuccacucaccaaaaguaaucacagauuuuuguuuuuaauuuaagcacugcuacccugcaauucccuugacuccacuucccccccuccccccaccaagagacagggucucgcuaugucgcccaggugagagugcagugcgcaaaucauaacuugcugcaaccucaaacuccagggcucagauccuccugucucagccuccugaguagcuaggacuaccggugcacaccacuaugccuggcuaauuuuaaaauuuuuuuagagauaggguauccuguagcccagguggucucaaacuccugggcucaagugauccuccugccucagcguccuaaugcacugggauuacaguaaaacuucccuuuuuaacucaguaauaaucauaacuagcuuucugacuuucugauucaguauuuauaguccuacaucaucgauuaaauguugagauaguauucuuuuguauggauguaucauauuuuaucuaguuuccuguugauggguuguauguguagauuuuguuaauguacauaauuguauuaacugugugcuaaacuuuuuaaaguuugauauaccaugagcauucacaugucaguaaagauuaauaauauugucauauacuaaauuuugucuuuuuuauauuuuacagaagauuugucuacaaguaucucuguaucuaauugucagauucaggagaaugugguaaguaaucguuauagcuaauguguaaacugggugauuaaaauaaggaaaauaaaaggugaaaaucuuuauuagagaaauugguucaucgcccaaaguacuaggcuagacuuugcgguugguaacuucccuaaggaguucugcuuuauagaggaaacuagggcagauuuuuaaaauuaaaaauaaagcuaacuuuuucacuagaaaaaguuacauuacaguguuacaaagugauaagacugguucaaagagaaggcagacauuacuucuuguggggucagcaggggaagcuuccuaaaggaagugcaauuugagcuauaccugaaaggauggaauggauuacugacagaagugcugaauggaugaggguuggggaacaaccuuucaugcaaguacaggagcacuaggaugaacaaacagggaagcaggaaauggacucuuaaggaauuaugaauaaauuaaguuggcugguguauguagguauguugaggguuuuauaacaggucagcaacuuuuuccguaaacuuuuuaguaaguaccuuaggcuuuguagaccagcagucccuaaccuuuuuggcaccagggacugguuuuguggaagaguuuuuccacggagguaggggguugggagaugguuucggaaugaaccgugucagaucaucagauucucauaaggaacacacaaccuagaucccucgcaugcacaguucacaguaggguuugcccuccucugagaaucuaaugccucugcugauauggcaggaggcggagcuugggcaguaaugcuugcuaaccugcugcucaccugcugugcagccugguuccuaacaggccgcaaacaguuaccagucuguggccuggggcuuggggaccccuguuguggaccauauacaacuaugcagcuaugugguugugacaagaaagcagcuauaggcaauacauaagugaacaggcauggcuguguuccaauaaaacuuuauuuauggacccugaaauugaauuucauuuaauauuuacaugucacagaauauuauuuugauuuguccagucauuuaaagaccauuuuuagaucggggccauacaaaaaagaggcaacaggcuggauuuugcccacaagcuggaguuugcuaaccccuggacuagagagaaaacaggcuagaaaaggaagucagaaaauuguuaaauuguuauauauaauuucucagauuaaaaucucuauuuuucuacuuggggcacuuagcuguuauaguucucuaacauguaaauguuaagauuucuaagacugcaaugaagauuggacucuaguaguguuauuggagauagaacauuucagagauauaaucuaugagucucuuguccuguugagagguagaauagacagcauauucuuggggagauaaggaggaauaucaaaaaucaugagcacucaaauuuugaauaaucccaugggaacugaggauaucuccauccaugucaugggggaaaaggauucagaauuggcuuuuguuuaacaaauauauauacacauacauacauacacauacacuuuccuagcaguuauuauauaugcauuggaugccuccuaaucugauuagaaccaaaauuugguuaaacaaaaagauuaaaguggggaggcuuauaaaaaugguucuuacaaaccuuaaaauuuuaauuacaacuuaacauauauacaugcauauucacuggcuuuugcugcagggcugaggcuuugucuuuauaagugugggucugcuaagugaaguuccacuuuguuuuucuuucaucagucacaccuguaaugcaguuuugacaguaaacaucccaaauuaguauauuaguucuguuaguucugacagcaacaaauacuacaaagaagaaaaaaaaagggaagggggcgaagagcagugaggaaagauagaggaauggauuucaguuacagacuuucucucauacauauucuuuucuucagucucucaaaguuaggcuaaucccaguaauaugaacuuuugaguuuuuuuuuuuuuuuuuccaaaaaucaaugagagcaaaucuccuuaaagguaaaauagguaaaauuucauuuuuaauuuuuuuuagguagauuugcuuuuauagaucacuacuuaauaaauacaagauuuuuuuuuuucuugagauggagucucgcucuuguugcccaggcuggagugcaguggcacagucuuggcucaccacaaccucugccuccuggguucaagcgauucuccugccucagccucccgaguagcuaggauuacaggcaugcaccaucucaccuggcuaaucuuguauuuuuaguagagaugggguuucuccuuguuggucaggcuggucuggaacacacaaccucaggugauccaccugccucagccucccaaagugcugggauuacaggcgugagccaccacgccaggccuaaauacaagauuuuuaaaaugcaaagcauuuuuuuccugaaagucuugcacaauacauuauacuugcacauaaaauuugggcuuaaccucuuauuagaacauagaaagccuguguuuucauaaaauaguuugcacuuuauggaaauuagcugcuucuaacauaaaaauguauugaaguauuuggaugaagaaagucagagauguugacauuguauuauagaaauaaauaauacuaacuccuuacuuuauccuaccaggauaucaguacuguuuaccagaucuuugcagaugaggugcuugguucaggccaguuuggcaucguuuauggagguaagcaacuacagccguuugcauauuguacacauuauuuuaaaaacuggaaaauguaaaacaucugccagcuguuuugucaucucauaguuuuguccagugccuuuuuuuuaaaggcugacuuguuaucuuucagcuaaauccuucucacuguaauuugaguauucuucccuuaaugucauugcaaacuuuaaaaauuaacagaaucagaaaauuuuacaguguguuuuaucucuucuuguagcucacacauacagauguuugucggaggcagggggggagaugguuugaaguuuauguugggcugagugggcuuauucauugaaguauauucccuacuaguuuuccaacacaaauggcaccauuugucuacuguuggcaugauuguucuauuaagucugaaaaccugaaccugaaauccaacuuugcgauuuaggauauugaugaagucauuuaaccuuacugugcguuagcaucuucaacuguuuaauggaacuaauaaaaccugaccuguguagcucauagggcuuaaauauuaauuaaacuuaauauauguaaagguacuaagaaagaaauguuaaacccuuguuaucccuugcuaagacuugguacaguaguuuccuaguuggcuguucugccuccauucuuaccuucuuuucauacaacucuuagagucaaucuuucagaaaauucacaucugauauuaguauuaccucacauagaacccuuaagugguucacagucaucuacagauucauagccaguuuucuuagcagaggauuucaaggcugcuguaauuuaucccugcuucucuagccucagaucuaauugcagcuuccucuuugcuuucuaucuuucaguccuguuuacaugccuccauacccuuugccucucugcuccuucuccaucccuuugucucuucuagugcacauuuuuucauacuucagggcucaacuaaagggcuuucucuguggaaauuucuuguccccguaccuauuucuccaucaaauaaaaacaugguuccccuuugguacuccugcuacccaacauacuucucucacaauaucuauuacccuuuggguuuacauuauugucuucccacugaacuuuauuggagcguuggcugugagaugucuggaucuucuuuguauuccuagcaccuaguauugugacauaaagcagucgccuagaaaauguguugacucugcaugcauauauaauaucuaugguuugcaacuucagauuugucaguuuuaagaguaguuacaucucuggaggacuuccugucaucagaggaacaaagaacuguccgagguaccuuuggcuucuuaccaaaaaugcacacauuuguucagucuuuucaaguagacuuacgauugugccauugagacaaaugaguuaaucuaaaauaaauagcuauguagagaagagcaagucagauacauauuugaagaacaaauaccaaaaauauaccugucauuuucacugcuuaaucuguagcaucuaaaggcauaccuaguacauaauagguauaacuaguuaauuugaauuaauaaaugagggaaugacuguucauuauaauaaacuucuaccuuuuuuuaauaucuagauucuagaauauagagacaaauauaaauuuuuuauaucuagauucuagaauauagagacacccagaguuuguggguacaugguuaaaucacucugugcugacucauugaaucuagaauaaaauugauucauucauacaguauuuccaucuugacagagucucugaaggacuaggucaggguaauuaacuaucauugauuuaacaagguagauuacuuuucagcaacaaguucauucaaauuuucuccuguuuagauaaugcagcugacuuuauuaggggcaaauauuauguauggaggggaaaacaauuuuuuccuaaauuaaaggugagugaaggaguguggagaaagaacaaaaaugagccaaaaagaaaauucaagaguaaauacauauaaauuucagucuguggacaacucccuaauaaagcugucaguuugcuucauucguuccucuucuuuuuuucuuaauaggaaaacauagaaagacugggagggauguggcuauuaaaguaauugauaagaugagauuccccacaaaacaagaaagucaacuccguaaugaaguggcuauuuuacagguaaaaauaaaaaauaaaaaacugguuuauuaaagaggcugguaagaaucugaauuaacugcuucucuuuuuuuuuuuuuuuuaagaaggcaaaauuagauuaugguaauauaggcauuauagggacugccaauaucuugcuuuaugguaguaguuuuagaacacauuuucgugaguaaaaucuuuuuuaaaaaaguaaaauuucauucuuaauucauuccaggagcuuaaaauacuuaggauacuuugccacauuuugucagaagguugcuguuuuacccauccaguuuucacaggugacaugcuugucauagcaauuacugugcaaguaaagauugcuuuaaaauuauguaccuuuuaacagcacuuauuucauuaauuaaaaacucuaauuuuguaauggcuuagucgauuggggcguauuuuaaagauauauuggcaaugauuucaauuccauaaauuccuauguguuuuucaucuagcauuuuuaccccuugggggcggucaucuagaagauuaaaauuuagcuugauccuuggaucacuuucugaauaucauauaaauaauuuauaauaugcaaauguacguuauauaguuuuugcauauuauuaaagaaaucauggucguauaauagcucauucuggccaggugagguggugcgcaccuauaaucccagcacuuugggaggccaaggcggguggaucaccugagguuaggaguucgggaccagccugacuaacauggugagaccccaucucuacuaaauacaaaaaaacuaggccgggcacgguggcgcaugcccauaaucccagcuacucaggaggcugaggcaggagaaucgcuugaaccuggaagguggaggcugcaguuagccaagauugugccauugcacuccagccugggcaacaacagcaaaacuccaucucaaaaaaaaaaaaaagccgggugugguggcacaugccuguaaucuaagcuacuugggaggcugagacaggagaaucacuuguaccugggaggcagagguugcagugagcugagaucaugccauugcacuccagccugggcaacaagagggaaacuccgucucaacaacaacaaaaaaugguuaaugcugucagagccccauuugcuuugggugaaauucaagacagccuccuucugaacuugaguuuccuugaagaagguaagaaacuuaaaugauucauuuuacauuuauuauguuacuuguugcuaauaguaacauuuaccucacuuuuucagaggcaugauaaucaaaaagcuuguggucaaguagguaccuguggucauaucaaggcugucuccuccuauaaagcuaccuuuaaauagaauauuaauagcauucauacucuguugaauaugaauaguaugaauauguugucagguauuuuugcguaucuaauuuuggaacccucauuguccaacuaguaagcgaaacaauaaaaauuaaggauauauuccuauggauugauuucuucuugaucacaaacacagcucugaguaagcacugaagcuuuuuuccucuuaucagcuauggaucauaauaacuaaauuuaggaauaaccagguaaugcacaguaugaaaaacuucauuauuauaucauuuugguuacuuucaucaauauugcccaaacugggaauagauuguaggaugucucuaugcuauuuucauacuaaauuuaauacaagacuaucuuuguuguagauucucuucaaauuguuuaugucagauauuuauacuuuuauauuuggcuuuccuuguggugucagcauuuauacuuaaguacuuuuucucaacaucacccagcaggaaggcagauucagaguuugaaucuaagucugucugcaaaccauaugcacuuucuacuuuacaucauuggacugacccacucuguguguguguuuguguguguguguguguguaguauaaagaugaacuuuagcuaacuuuguauaugaauauuauucauauagaauauugauauucuagaauauucuauuaguacaaucugaauucauguaggaaauacacuucuuaaaaggaaucuuuuuaaaaaucacaccucauuuacugaaauuaguuucauaagauuuaguuaugugagcaucacagcuaaacuuuuucacauggguuggaaguaaccuacuacacuguuaaacgcacucacaccaccuuuuggcucuccucuuccccauccaacuguaucaucuuuccuuuuccaucuuugccccgugucauucuuaccuguaguccucccucaucacccaaaccugaaaggcugucugaacuccuguaguucauccugcuguugauaccuuuaccugcaucccuagaggcguccauagcuuuucuuucccaugcccacauacuuagagaaaagauggggugaagauugcgcauauuauuauuaagacuacagcuuuggccuuuccgguggcaaggaggaaaaaucacaggaucacugauuuagaagugaccuuacaguuuaucccggaguauccaaucucuugagcucuuggugacaggcuuuguaauucuguuuaacagaaaugagcacaucccauuuuuagauaccugugauuauucuuuaugaaagugaaucaaaaucacuugaaaaagaucccacugcagacaauauacacaacaaauugagucuuuuuuuuucccccccaaaaauagccauguugacuuucuugcuauaucucaaacaugccagacaugcuucugucucaaaaggcuuugcauuagcuguuuccucugccuggaaugcuuucucccucaaauaucugcaugucauacucccuugucuccgucaggauuuugcccaaauaucauuuccucaaugaagccuccacauucuauucagcauuaaacccacccucccaccccuccacuccccuaccuuaacucuuuuucuuuucuccauggcacuuaucaccuucauacuagguaauuuacuauuuuauuucccauugucugucucaccuugcugcaauuuauaagcucugcgagacaaggcaucuuugucaaguuuuguuuaauaaugaauccagaauacccacauaguacuggguacacggcaaauucuuauuuaauauuuaaugaauaaauguauuaugugggaaauuacaauacauuguuagauugaaaaaaacuuuggaaugacucccuuuaacuuuuuaaaguaauguguacauuauguaugucuauauacaguuacacagaaaaagagccaugccuacauaaacugucaaccuggccacaucuagggaggauguuguagagcaggaaaaaaauuggggaggggagguuccuuuuguuuccuagauuaugugguaauguaaaauguuucuuuugcugucuugccugaagaggguaguagaguagugggagaaaaggugugguguucuuguagguaccuauguaauuagaaaacguuaucaaaaaccuagagggaaauuucugguuugaacauugugguguaaauucagcauuuucccguucucaucuuggaagcuaccccaaagcuauaagaaaaaugauuaacagaagugagcauacuuuaaaaaaaagaugagaauucaaaacuauaaaaucauguagauuuccaacaacagugaagaugaagcagaggugcaugucucuucaggaagagacaacacaacuguuuuugcugauucuuucugaaaucugcagcccuuauguccuccaaaggucccuucuccaaacaaaaagccauuugagggucaugaucugauaagauuuaacucaagggaaaacacauuaaaugaaaugaaagaaggccacuuuaacaguggaagagugaaaaucauacuacaccaaauaacaccauaaacauuuauaaagaaaaacuaaaaacaaggagaaacagacaaacacaucaguaguccaugagaaauggaguagacaaaaauaauuaagaacguacaaggucuaaacauaguaagguagaucuaagcagauuauacugaccucuguacccuaaaaacaaagaaugccucauuaauucaaaaaagcagucguauaaacaguauucuuugaucucaaugcauuaaagcagaaauaaauuacaaaaucagaaaacaagcuccuacaugaaaacuuuaaaauacuaauuuuugaaucaaagagcgaaaucaaaauuucagaauauuuagaaaaccugaaaauacugcauauauaucagcgccuuuguacugucuuucagaaaaagcuuuauaaccucaaauauuaagcaagaaagaaugaaaauaagugaauuaagaaucuaacucaaggaguugaagaaugaacaauaaaauaaaccuaaagaaagcagaaaggaauaacagaucaaaaaugaaaauuaauaaauacagaaaagaaauaauaaagccaaaagcugguuugcugugugggggaagggaggagguauguaaaaauaaaauggccauccuaagcaaagaagaauauacaaaaugaucuuagggagauaaccacaaauacgggggggggaaggaaucuuaggauacuuugcucaucucuaucagauaaauuuggaaacuuggagaaaauggguaauucucaaugaaaguauaacuuacuaaaacauacuccagaggaaauagaaaauguaaaccaauagaggaaguuguuaagggagaaaaauaauguuacagcauacuucuauuuuuguguguccacguguuuuuaaaggagggcaggggggaaaaagcauagagccagccaacuauggccuagcaaaacagucacauuucaaccucuguugauaaaaguuauaauauucugaaucuuacacugcuuauugccauugucacaccccaccacuaugggguauuugaguuucauuuaucuacuauaaaauguugucauuuuguauuuugcugcuuggaaaacgaucucauaaaauggguuuaaaaugauuagcaaacaagucuauuuugcauuuguuguuauuucacuuucuaaacauuuuugaaaacaccuacuaugaugcagauauugagcuaaaauaacugaaacaaucugugccucagagaguuuauuaaacaauggaguagaauacacacauuauuacaauacaguggaaacuauugcaguagucccaaagagagagaaugugggcuaaaauuaaggcuucaagaaacaucuuagacauggaacucagccucacauaggccaaaaacaugugagucccccuagcauaaucagcuagccauauuaaggaaaaaagcuaaagaaaaauguacaggaugcuccucauuuugcgacggggucauaucuccauaaacccaucuuaaguuugaaaauaacuaaguagauaaaaauaccuccugaacacaacuuagccccguguagccuaccuuaagcacagucgcuuacauuagccuacaguugggcaaaaucaucuaacacaaagaccauuuuacacuaauguguugaauaucuuauguaauuuaugaauacucaaaaaaacggaaugguugugcagguauucaaaauacguuuuuuacugaaugaaugcauaccacuuuuguaccauucuacaguugaaaaauuguaaguugaaccauuguuaaguuggggaccgucuggguuuuuuuguuuuugagauagaguuuugcucuuguugcccaggcuagagugcaauggcgcaaucucagcucaccgcaaccucugccucccagguucaagcaauucuccugccucagccucccgaguagcugggauuacaggcuugcgccaccacacccggcuaauuuuguauuuuuaguagagacuagguuucuccauguuggucaggcuggucucgaacucccgaucucaggugauccgccugccuuggccucgcaaaauguugggauuacaggcgugagccaccgcgcccggccuuuuuuuuauuugagacaaagucucgcucugucucccaggcuggagugcaauggcaugaucucggcucacugcagccuccaccucccagguucaagugauucuccugccucagccucccgaguagcuggguuuacagauaccugucaccacaccugguuaguuuuuguauuuuugguagagacaggauuucaccguguuugcuacgcuggucucgaacuccugaccucaaaugauccaccugccucggcuucccaaagugcugggauuacaggcgugagccaccacacccagccuguaucuuuauuaauaaggaauaaaaauuguuuaagcacuugguucauucaguagaacauauuuaagauuaaauuggaagacugaaaccagguuauugaagaucucaaaauguugacaaaggaauuuagauuuauguccagaaauaaagagccacugaagguguuugagcaaggcugacuucaugaauuuguuuuugaggaaggauuuucuguaguagaacaaaagauaaauugcuuuuuuauaagcauaaauaguauggcauucaucuuuguguaucuccaacccuuguaaccuaguugugaucaagaaacaugauaauguggguagagauguugagccuaaaaaaagggaauuaaugauuauaauauuauaagaaucaagacuuagauaaauaacuaccuuagaaauaaaacucuuaagcaaauaccaucacaaauacagcccccaagagucaaagguuucuguguaauugacuaaaaauuuaugggcaguuggugccuauucagggaaagcaugaaauuagagcagugucagauuuuucaagugagaaggaaggaaaaguaguaguaauggacaagagugauuauauaaucaaauuaggagaacauucuauccccucagugcggcuacucuccaguacacaacuuggagaauuaaaaccuaagauccuuuucauugauuguaauuuuuauuuuguuugcuuuguuuacuucucuaggcuuucuuucugugccauuucagacaaucauagcacaucuagauauuaguaaaacuguuucucugcuuaaguugcucauguaucuugcaaccucucuucagaauuugcaccauccugggauuguaaaccuggaauguauguuugaaaccccagaacgagucuuuguaguaauggaaaagcugcauggagauauguuggaaaugauucuauccagugagaaaagucggcuuccagaacgaauuacuaaauucauggucacacagguauuuuaacuccuuuuuuuuuuuaaacuagcgauuaaaaacuaauuuuuuuuuuuuuaagacaagagucuuacucugucaccugggcuggagugcaguggugcaaucuggcucacugcaaccucugccuccuggauucaagugauucucaugccucagccucccaaguaucuaggauugcagaugugugccaccacgccuggcuaauuuuuguauuuuuaguagagcugggguuucaccguguuggccaggcuggucucgaacuccuugccucaagugauccaccugccuaggucucccaaagugcugggauuacaggcaugagccacuguauccagcuaaaaacuaaaauaauuaaauagcaguacuuuuacauguugggugauugugggaauuguuaaccuuaaggagcagaauaacacacuuuuagcuaagucuugaugaacuauaguggaguuuucaaauuaaaucauucaaggagucacaugagguuuacuugugauuuuccagacauugaaaagaaaaucuuuuuucauaacagauacuuguugcuuugaggaaucugcauuuuaagaauauugugcacugugauuuaaagccagaaaaugugcugcuugcaucagcagagccauuuccucaggugagauauucuccagaaccuuuuaaaugauucuggcaacauuuucaaagcacccacauaauaaaaggcaguguacuaaguacuguugguuaaaaaugcauaccaccuuacaaaaauaguuuuuagccuguaacuaccagugaggauuaauaacuaaaugaauucagauguuauuaguuauacuguuuauauucaagauuuuuuaagauuuaacugcacauagauucugcaauucaccucuccccaggggcugggaacgaagugagcaaguaucaaccuugguuggugcaugguacuuaggauaaauaccucauaaauaaaacaaaugggguguuacuggaaaugggagauagauuuugguugaggcaggcagccaccuccuuuuucuauguagaguauuguauucaaacaaccuacauaaaauaacauuucucaucaccacacauacacacaauggcaucgugcuucuguguccuggcuacauguagcacucucugauuuuucuuaauucaguugaguuuuuuuuuuuuccaaguguucaucuugauccacuaaauuuauugcaugaccuaugaaauggaucauaacccaaauucugaaacaaccauccugagaaauaaguggugguggugguacccugcagccauuuuccauaauuggcaaggaugauuccuccgaucagcucaaauaucuguugccaaacuauuguuuauauacauuugaaacauguacauuuagacaaauggcaagacuaaggacaacagauagguguuuucacuugguaaauauaacucaaauugucuuuucaaauaaaaagauauauuaaaaaucguucagcuuuuaaaguaguaaucauauucuuuuuauguuuaugugguuaaaagugauucccuaucauuuugaggucgaaaggguugccugauaguuggugcaauguuuuaaauaaacugcuuccauauauuaucucauuugaucuucaaaauaguagacaaaagaugcacacuccuacugguaacauuaaaacucccacuuucugaccucuauuuuagugauccacaguguuccaaugagaagcaaagggaaaauaaugugauuuacuugauacgcuuuuuaugcucaaguguuagccauggcuccacuucuuuaaucaguugccaaacuuccaagucaucuuuaccuuaucaagauguuagcugaaaucuggcauuuaacaacaaaaaaagaguuuguauuucuucaggcucaguauucguacucuucaaagacacugaaaucgagaagcagccagauucaguaaugauuuugagcaaauaucauucauaaaaauaugugucagaguccaccaucccagaaauagcagcauuugauaacuucacuucguuuucuaggcacuguuuguaccacuguuuucuacagcuuaaaucuuuuuccucucaauuuauauuaaugcuuuugcuaaagacauuuuuuaagucagagcauuuccuccagaaaguaccuggcauuugcuuguucagcauggauguggucauuaaucccccagauuugagccucuagaaaaaucugggcagcaagauaaguguucugaguucugccaagcucaucaacuucuagaacucucuuuugagaggaugugguagugacuauggcucccuuuacauauaacuguuuucaaaucuaaacaucuaacuagaaauaauuuguuccacagugauagaaaaguguugcuguuacucacuggggcagucuccagcauuauuccacugguguccccauuuaaaauuaccuuuaauacaccucaguuuuauuuacuugccaguuuauaacauccuuaggaaaagagauucuaggauuaagcaaaacaagggauguuuuuaaauacuguaacuuuuuuuuuuuuuuuuuuuuuuucuuuugagacagagucuucacucugucgcccaggcuggauugcagcggcguaaucucgacucacugcaagcucugccuccuggguucacgccauucuccugcuucagccucccaaguagcugggacuacaggcacccgccaccacgccaggcuaauuuuuuuguaucuucaguagagacgggguuucaccgcauuagccaggauggucucaaucuccugaccucgugauccgcccgccucggccucccaaagugcugggauuacaggugugagccaccacaccuggcuaauacuguaacuuauuuuuccuucagcaaacauugaguaccuuuauguguccaggcacugugaggccacuaaggauucagaaaugaaacaauuccugcucacagaugauggaagagugaucuuacaagacaaaugauagaaagcagcauacucuauuucauaagaaaucagaacacuuauaacaccagucugguauuugguauucuggaagcuagaacuuuugaaauauguacuaggaaagcucuucauacugugucagucaggaucacagggcuauaaaugugucugccuuuugagaaaaggauauuuuacaauuuccuuaucugugauuaauauucauaaucaguagagcuggcaaguauguugaaaugauacauacaguguuauauuuagggacagguaguuacauauauaacacuauaauacaaaauuaacaucauccuucaauuuccaggugaagcugugugacuuuggauuugcacgcaucauuggugaaaagucauucaggagaucugugguaggaacuccagcauacuuagccccugaaguucuccggagcaaagguuacaaccguucccuagauauguggucagugggaguuaucaucuaugugagccucaguggcacauuuccuuuuaaugaggaugaagauauaaaugaccaaauccaaaaugcugcauuuauguacccaccaaauccauggagagaaauuucuggugaagguaaaaaaaaaaaaaaaaaaaaaaaaaaaaaaauuuuggcuauguguuuuaagccuaaacaucuuucucaucccaaaucagucugucucuugcaacuuaucuuuuuaguacaucucccauucaucuuccaaauucaacuaguuaccaguuuuuugagcacucuucuuuuuauacuuuuaucugugucuucuguauaguucccaggcauagcacuuacauaggccccaguggccucauugucaaaccacuaaaauaucuuuuuaacugucuuaccuguuaaacucuuuucugguccuuccuagucacuacugccaaaucuaucuucaggaaacauuacuuucauuuauggugcucccaaacacuucucuuuaaccaccuuacaggcauaguuaucugugauaugguccaugcuuaccuucuagccucaucucccacuacucccuacacaaaccuaguuguuuacucuucugaacuguuuucugcaauuugcuugggacuguuuuucccuugucuacaauccuuccuauuaaaauucgaggaccccuuaauuuguggcucaucuauaaaguucccugacuacuccucuacacugcagaauuuacuuaggcuaaaaaacauuugggcuuuuuuauuaucuuuuuuuauuuuuauugagacggggucucccucugucacccaggcugaagugugcacaaacacagcucacugcagccucgacuuccugggcucaagugauccucccaccucagccuccugacuaggugggaugauggguaugcaccaugggccacccacaccuggcuaauuuuuaaauuuuuuguagagauggggucccacuauguugcccaggcuggugucaaacucuugcacucaauugaucuucccaacuugaccucccaaagugcugggauuacaggcaugagccacugcacccagccccauuuuuuucuuaaguauucauucuuuucauaauugacuuuucuaaucuucagaacaagacugugagcuccgugaaugaauaccuagcuccgguuccuuauaccuagaaugaacuuuauaaucaccagacacacugcaguuuguuuuccucucuccuguggaccucugcugggaagcugcauacaucucuuuuuccugccuagugaaggcuuuugaauuugcaacuccugguucuguacccgucaagaauaaguuggcuggcccucuuuagucugcugauacugauaggaaggacaaguacacuacuuaaaacauuauuuaacugccccauagaaguuaauagaaccagugcuggggaauacccccaucuggauuuaaccagcccauguaauagguagaucuuuuuuguuuuuccaaaaguacuaggccuaaucauaggauuaacuaauauuccaucaaacugggaaaaguuuaagaacaacaugugaagacaguagcagguuugcuugguaaugaagaaagcuaauugaagaagcucauaagagauguuuuuugauguuaaccaguguuaucucagaccuccugaggcaguguguucuguagaccucuucuaucagaaucacuuugcuaguuugguaguauagagacaagaaauagaacuaggaugguacaagucuuuccauuugguucgugucugggucuagccuuuuguuaccaauauuucaaauguaccauuauauagggcuguaguuaguauguaguuauugguugccuugguuuugcaauugaucauucuccaaauaagugaauaaaauauauauaccaagaacucaccauguacacuaaaacacccugaaaccuauuuguuaaaaguguaaacuuuugguaguuaagcuaccaccucaaugugaccauauauagaggcaaggcagugccuuuccagaccaagucagggacuagagugcucucuagcauuggagcgggguggggaggaucagagagucuguuucauucaucuucaaauaauaauaguuaauacuuagcacuuaugugcuaagcacuguucuaagcccuuaacauaugucagcaacuucaugaggaaacugaggcauaauauaauuuaguaacugacccaguaucacacagcuaguagguggcagaaccagacuucagcccaggcagucagguuccagaguauauacuuuaaccuguacucuauacugccuuauaaaggcaaugaaaauuugacagauacacuuaaaucaguaaacauuuaugauucauuuuacauguuagcuaaaaguccacguccuugagaagcaaaaauuccucaacccuguauuucuauggguugaacugccuucuaggcagucacaaguuugggguacucugugcacccaaauucauguaucuuguuuugucuuuucccuuagcaauugaucugauaaacaaucugcuucaagugaagaugagaaaacguuacaguguugacaaaucucuuagucaucccuggcuacagguaaaaaaaaauguaaucucucuuuggcaauccucauuugaguaguucacucugauuugucccaccuaaugagaccacucuaagaucagcagaauaauaaaagugcucuuaagugauuaauuuguacuauggcugaaucucuggaaaccauacagcauucagaucgguaaugacaggcaauuaaacucccaugaacugaaagcaaugacuuagccuuucauagaccuauguguucauuucaccuuuuuguaagauuaguaugacauauuaauuuaucaaauuuauuuuaaaugucuacugaaggauuuauuuuugcauugaagagauuuuuuaaaaauguuuggcuuaauucucccaaaguuacuuuauagauuuaucaaaagauacccuccaaacuucagaguaaggagggaagcuuuagaacuauuuuauagggagugagaggcagaauuagcuuuaaaacaaauguaaucucaucuaccaguuacuaaauuauccuaauaagcauccaagcacuuucccccacuuugaguaagguuuaggccucacguuguauagaacaaaauguuuuagugauuauuauuagccaccuaagaagccugaagcaaauuuuuuuuaauuucagaaauuaguuacguucauucauuggagacucugaguuugaaaaauuucuuuaaauugcucauuuaaaauaucacaaguagaacuuaguacauaguagauacuuaugaguagcgccugucaauuauuugacuagggcacuaaacaacaacaaaaaaaaacacaaaacaaaaaccagguugacaguauuuuguuucuuuuguuucaucauuacaauuucauuuucuccuaggacuaucagacuuggcuugaccuuagagaauuugaaacucgcauuggagaacguuacauuacacaugaaagugaugaugcucgcugggaaauacaugcauacacacauaaccuuguauacccaaagcacuucauuauggcuccuaauccagaugauauggaagaagauccuuaaucacugagcuaaccuaaauaaggaaggauuucauuuuauggacugauauuuugcuguguaacuuguucuuuguagauugucaucugcagugcugcaaagauaugaagaaauaugauaacgaauaagugacaccaguacuguaguucauaaugaguagguacaggcgggaaacugaauaauaagaagucauaauggaaucaaggugaagcuuuuuauaaacuuuuuuagccuaagcaauaacugguuuuguauuuuuucuuaauccuucacuuuaauacaauaggcucacuuaauuugucuucccauuucucuuuauauauauauauauaaauauaaauauauguuuguuuguuuuuuuaaugaaaaacaagucaagcuagcauccaguuacuauauagcuuggcuaaauuauacaagacuuacaagauugauuacucgacaggcuuguauuuaagagguaacugugagguuaccauuaugugauguuacuauaaggacuuuuaacauugguuuaacaaaccauagaggcauugaaggguuuuucuuagaugccuagaaaaagcgcacugggcuguuuuaccuuucuuuuuuaggucaaucaagacuccaaaauagugauuccuaaccuuuuuggaguugcucugcuacucugaauauguucuauacagcauaaggauugucaccuucuguguguugcaacagcuucuaagauaauuagggacaaaugauguuacaaaaggaagaguacugcuggucuaagugcugaguuguaugucuuugcauagcuccacucugcugcuaaauaugcauguucugacugacaccaucuugaugccaguacuggauuccagcauucagcaggugcagaucucggcuuuacacaauuuaucuuuaccuaggguucagucaguaauuucugcuuuuuagcagggccagugcagggucaguuaaugcuacaguuacuguauagcaaacaguauccuuuuuucuccuuccccuagccuauugggcuuugcagauaucuggaguguuuuaaagucaauuauuuuaagcaguuugaggggauguguaggaguggagcaugaaacaguuuauaaggcuggggcuguauuaucagcacagcaaauuaaagaaugaaagaaguacuucuuuuuacauuucagcuccagcagccagcuauuuaaaaaauauuuuuaaauaucuuccccaaaguuuaagaugugggaccaucuacuuguaagaaacaguggcuuauuucuucauuucucaguaaucauuguaaaccuuuuuuuuuuucuucuccacucuaacaaaaguaaaagaacaaaacuuuugcugaggucuuggacuccacuacuuguuaguuauguuggccuggacagauggcaggucugucggcaguuccucagucuguaaaaugaagauuaucauucuugccucucccuuugucacaguguugucgugaagaucagauauguaugaaugcagucaaauaaacuaaaaacuaggaaaguguuaacuaucguugcccaccgaauuugagguagcaaaaaaaaaaaagaauguucugguacaugaacagacugagaaggccuuucgacaucccugaagcuagucuccugucuagacuaaaaauauccuugaaagaauaguagcaaacaguaugcaguacuccuguguucuaaguucuuuuauguuuuaguuuacccucacagcagccauaguguuaagucauuaugagcuucaucuuaaagauaagaaaacugaggcaaggggagauuaacuuacugccaaauuucaaacaguuaguaguauuugagaccaguaguauggcucuaaucuuacccuuagcccucccaaccauuaugcuguacuaucuacccauaaauaccuccaggaaacauuccccucuugguaauuuguccuucuauagaagcuucaaagauuaaaucaaauuaauuuucaaaaaaaauuuuuuuuuagaaauguuauuuucccugugauagaggaugacuucccaguuucaccaaagucuguuuauaucaacacacacaaaauggaauaauucugagucacuaggcaaucaaucuacugugguuuuacuauguaaggugaaaauuaacuggaacgauguuuguuugcuauacuuacauagucaaacuuuacaagccaugaaauuaauugcacucuuuguauuuguuguuaaaugccuaagaaguuuucuaaaaauuuuguaaaggcacugucagagaaucuggaguugaaugauuauuccagauacuguauaaccugcauaacuuuuugucuuuaagucguguuuguaaaagaaguaauugcuagaaacauuugauaauguacaaaguagucuauaaugacuguucaguacauuuuuaauauuuuuuugguuauauccaacuuuuuguaaauauacuggaagcuugauaauaaaauguauuuccuaucaccaua

SEQ ID NO: 18435 - RNA, 18131 nt, Homo sapiens
ccuucuacccaguccuuaaaacccggaggagcgggauggcgcgcuuugacucuggagugggagugggagcgagcgcuucugcgacuccaguugugagagccgcaagggcaugggaauugacgccacucaccgacccccagucucaaucucaacgcugugaggaaaccucgacuuugccagguccccaagggcagcggggcucggcgagcgaggcacccuucuccguccccaucccaauccaagcgcuccuggcacugacgacgccaagagacucgagugggaguuaaagcuuccagugagggcagcagguguccaggccgggcugcggguuccuguugacgucuugcccuaggcaaaggucccaguuccuucucggagccggcugucccgcgccacuggaaaccgcaccuccccgcaggucagucugucugccgaggcgcugcccggcgaccucuucagauggauuauuacagguagcggguggcgugguagguacuuuaaaggaaaucaagcgccaccgccucgaugcccgcagcguuguccccagauugcaggaaccguuacgcgccuugcggggaggggaaggguuuggcgcuggguuacagcgagguggaaacacgccccuucucuucuccaagggagaguggguuggggaugggaaggggcgucuucggccauuucuccagagagucagcuccgaccucuccacccaacggcacucaguccccagaggcugggguaggggcguggggcgcccgcuccugucucugcaccccugagugucacgccuucuccucucuguccccagcaugggcaccagccucagcccgaacgacccuuggccgcuaaacccgcuguccauccagcagaccacgcuccugcuacuccugucggugcuggccacugugcaugugggccagcggcugcugaggcaacggaggcggcagcuccgguccgcgcccccgggcccguuugcguggccacugaucggaaacgcggcggcggugggccaggcggcucaccucucguucgcucgccuggcgcggcgcuacggcgacguuuuccagauccgccugggcagcugccccauaguggugcugaauggcgagcgcgccauccaccaggcccuggugcagcagggcucggccuucgccgaccggccggccuucgccuccuuccgugugguguccggcggccgcagcauggcuuucggccacuacucggagcacuggaaggugcagcggcgcgcagcccacagcaugaugcgcaacuucuucacgcgccagccgcgcagccgccaaguccucgagggccacgugcugagcgaggcgcgcgagcugguggcgcugcuggugcgcggcagcgcggacggcgccuuccucgacccgaggccgcugaccgucguggccguggccaacgucaugagugccguguguuucggcugccgcuacagccacgacgaccccgaguuccgugagcugcucagccacaacgaagaguucgggcgcacggugggcgcgggcagccugguggacgugaugcccuggcugcaguacuuccccaacccggugcgcaccguuuuccgcgaauucgagcagcucaaccgcaacuucagcaacuucauccuggacaaguucuugaggcacugcgaaagccuucggcccggggccgccccccgcgacaugauggacgccuuuauccucucugcggaaaagaaggcggccggggacucgcacggugguggcgcgcggcuggauuuggagaacguaccggccacuaucacugacaucuucggcgccagccaggacacccuguccaccgcgcugcaguggcugcuccuccucuucaccagguaaagccucugggaggcgugggccaggucuuuucuccucugaaaaaggcggaguagagacagaauaugcugaguuugcaagcagggccccggguuugggguuucgcuccagguccccaccccucaaaaccaagaucgcgucgguaaagggacucacagugagggcugcgacacgcgcacgcgccccacccagcggugccccgaccccuccggucuccuaucuugucucuaucguccccuccccugcuugcgagugagaacacauuugcaaagaccccuccaccccccggaaaaacaagaguuuuuaaaugcuuggagaugagcccugauaucucucucccuggcgcauuacaaucagaacuggaauaguuccgaaagaaaagguaaugucauaaauauguuaaacacagcagccucuccuaggcuaguccucggcgugcauccgaggccgcccagcccuggcgcuaaaagcgggccgcccgucagggcuuuguuccaggccaaggaagcccauggaggccgggccagccgacagguaacccgcacagaaacuuucagaaggcggccacaacuagcgggcagcgcuagguuuauaaaaccuccgcgcuaggaguuugagaaaugccgggguagaagacaagaagcagucacuuuuacgaaagcagaguagcauucagaaaggcagaugggauauccaggaggcgccugcagacguuucuggccccugcgcuuggcucaguuagcggacccccugaugcccacguuggucucuacuaagcacggauucaacaggucccuggugucggguugccagauuuggcaaaagaaaaguaaguuuuacacgggaauacucacacuaaaagauuagcccuuguugaucugaaauccauauuuaacugggcggccuguaguauuuacuguggaaacacuaucccuaggggcaaauguuucgcaaggcaaauuuugauugccgaagagaccagaaauccugguuuugugucauuucuuggagcacaagugagcaguuggagaugcugaaucugcaggcgccacagaaagguguuuggaaggcagagaaugacucuuuccuuauuaaaauccacugcaaucuauauuuccuuagauacuguacagcuaccuucacaaauuaaaaguuucuguauacuuaaaauggcuuuuuaguauuaaaaucauagaaacacccauggugggugagggagaggcagaaaucgaauaaagaaaagucaaccagagaucagggaaaaggaaaucccggaauagguuccauagguuuuugugcauccgcagauaggcauuuuaacuuuugaaacggccuuuguuuuucauuagaaccacaauaguucuccgaguacuccaauuaggcggcaaaaagaaauaaaacaauuuggaggucacuuucaauucaauaugcugauacuuuuuuuuuccuuuuuagugaaaagacguaugacagggcuuggcaaauuacacgaucuguuuuuguauauacguuuuauugacgcagucaugcccauucauuuauacauugucgauggcugcguucacucuacaacacaaggcagagcagaguagugcaacaaagaggguuugguccacaaagucuaaaauagauacucucuggcucuccccaccauacauguuucuaugaaaaaaguuggcagacuccugcaauauaauguugaagaagcgauucuaaaaauaacuccacuucaucacauacguguauacauuuuuuuucggaguugcaaacaaucaguuacuuguuuuuugacuucuaacacuuugacucaagguaguggacauuucuaaucuuuuaauauuuauuuugguaauuuuugauggcuauauaguauuuugcuaugauaauguauaguuauauauaaucauuuauugaacuuuaauguuggucauuggccuugauugcauuuuuaaaauuuuuauuuuaauuuuauguauuuacuuaccuuagagacagggucucacuaccuuacccaggcuggucccaaacuccugggcucaagcaguucucccgccgcugucuggcagguagcuggggcuacaggcguguaccaccaugccuggcuaauuuuuagaauuuuagguccuguugugguuacauauuuuuguaucucuuaaauuauuuucugaaaauacauuucuaggcauggauuacuggguuuaaaaugaggcgggaagagguuaccuucaugucucuugccucguauuaagauuuuguuuuuuaaaaagauuguaucaguuuguaucaucaacagugaauaaguacuacaguuuguaccauaauuuuaugaacauuggguauuugcuuucaaauuuaaaaaauacaguauguagcuuuauccaucaggacaccaauuaucuuuguauaaaaugagaacagcaugucuguuggaauuguccagggaaaugagggagaaaaaaaauuuacuuucacauuguaacuuucgugggcccugggugcuuuugccuuuguagauuccuuauacuauaaaaaaauuaaaaauuaaauuucaugacuacccugauauaaagaugaaugcauuaaaaugauguaugaaaauauuuucuucuaacuaaaagugaguuuuuuuaggucugaagauuguaaaagacguaaaaauauuuucaugggccccuaaaaaguguugugagcccuaggcacugucccugcgguacccaauggaaaagucagccuuaucuacuauugugcuuuuugaggcugggaaaacuuaagaguuuuuugacuuauaaugggaaagacagcauuagucaugcaaggccuauuacaggaaauauaauucuuaaaguccaucuuguaauuuagugagaaauuaggaagcuguuuuagauuuuuuucccagaaauauuaauuuagucacugagcuagauagccuauuuaagaaaaaguggaauuaaaauaaauuauaaugugcuuucuagaugaaauaagaauuuugcucacuugcuuuucucucuccacauuaaacaccaaacagguauccugaugugcagacucgagugcaggcagaauuggaucaggucguggggagggaccgucugccuuguaugggugaccagcccaaccugcccuauguccuggccuuccuuuaugaagccaugcgcuucuccagcuuugugccugucacuauuccucaugccaccacugccaacaccucugucuugggcuaccacauucccaaggacacugugguuuuugucaaccaguggucugugaaucaugacccagugaaguggccuaacccggagaacuuugauccagcucgauucuuggacaaggauggccucaucaacaaggaccugaccagcagagugaugauuuuuucagugggcaaaaggcggugcauuggcgaagaacuuucuaagaugcagcuuuuucucuucaucuccauccuggcucaccagugcgauuucagggccaacccaaaugagccugcgaaaaugaauuucaguuauggucuaaccauuaaacccaagucauuuaaagucaaugucacucucagagaguccauggagcuccuugauagugcuguccaaaauuuacaagccaaggaaacuugccaauaagaagcaagaggcaagcugaaauuuuagaaauauucacaucuucggagaugaggaguaaaauucaguuuuuuuccaguuccucuuuugugcugcuucucaauuagcguuuaaggugagcauaaaucaacuguccaucaggugaggugugcuccauacccagcgguucuucaugaguagugggcuaugcaggagcuucugggagauuuuuuugagucaaagacuuaaagggcccaaugaauuauuauauacauacugcaucuugguuauuucugaagguagcauucuuuggaguuaaaaugcacauauagacacauacacccaaacacuuacaccaaacuacugaaugaagcaguauuuugguaaccaggccauuuuuggugggaauccaagauuggucucccauaugcagaaauagacaaaaaguauauuaaacaaaguuucagaguauauuguugaagagacagagacaaguaauuucaguguaaagugugugauugaaggugauaagggaaaagauaaagaccagaaauucccuuuucaccuuuucaggaaaauaacuuagacucuaguauuuauggguggauuuauccuuuugccuucugguauacuuccuuacuuuuaaggauaaaucauaaagucaguugcucaaaaagaaaucaauaguugaauuagugaguauagugggguuccaugaguuaucaugaauuuuaaaguaugcauuauuaaauuguaaaacuccaaggugauguuguaccucuuuugcuugccaaaguacagaauuugaauuaucagcaaagaaaaaaaaaaaagccagccaagcuuuaaauuaugugaccauaauguacugauuucaguaagucucauagguuaaaaaaaaaagucaccaaauagugugaaauauauuacuuaacuguccguaagcaguauauuaguauuaucuuguucaggaaaagguugaauaauauaugccuuguauaauauugaaaauugaaaaguacaacuaacgcaaccaagugugcuaaaaaugagcuugauuaaaucaaccaccuauuuuugacauggaaaugaagcaggguuucuuuucuucacucaaauuuuggcgaaucucaaaauuagauccuaagauguguucuuauuuuuauaacaucuuuauugaaauucuauuuauaauacagaaucuuguuuugaaaauaaccuaauuaauauauuaaaauuccaaauucauggcaugcuuaaauuuuaacuaaauuuuaaagccauucugauuauugaguuccaguugaaguuaguggaaaucugaacauucuccuguggaaggcagagaaaucuaagcugugucugcccaaugaauaauggaaaaugccaugaauuaccuggauguucuuuuuacgaggugacaagaguuggggacagaacucccauuacaacugaccaaguuucucuucuagaugauuuuuugaaaguuaacauuaaugccugcuuuuuggaaagucagaaucagaagauagucuuggaagcuguuuggaaaagacaguggagaugaggucaguuguguuuuuuaagauggcaauuacuuugguagcugggaaagcauaaagcucaaaugaaauguaugcauucacauuuagaaaagugaauugaaguuucaaguuuuaaaguucauugcaauuaaacuuccaaagaaaguucuacaguguccuaagugcuaagugcuuauuacauuuuauuaagcuuuuuggaaucuuuguaccaaaauuuuaaaaaagggaguuuuugauaguuguguguaugugugugugggguggggggaugguaagagaaaagagagaaacacugaaaagaaggaaagaugguuaaacauuuucccacucauucugaauuaauuaauuuggagcacaaaauucaaagcauggacauuuagaagaaagauguuuggcguagcagaguuaaaucucaaauaggcuauuaaaaaagucuacaacauagcagaucuguuuugugguuuggaauauuaaaaaacuucauguaauuuuauuuuaaaauuucauagcuguacuucuugaauauaaaaaaucaugccaguauuuuuaaaggcauuagagucaacuacacaaagcaggcuugcccaguacauuuaaauuuuuuggcacuugccauuccaaaauauuaugccccaccaaggcugagacagugaauuugggcugcuguagccuauuuuuuuagauugagaaauguguagcugcaaaaauaaucaugaaccaaucuggaugccucauuaugucaaccagguccagaugugcuauaaucuguuuuuacguauguaggcccagucgucaucagaugcuugcggcaaaaggaaagcuguguuuauauggaagaaaguaaggugcuuggaguuuaccuggcuuauuuaauaugcuuauaaccuaguuaaagaaaggaaaagaaaacaaaaaacgaaugaaaauaacugaauuuggaggcuggaguaaucagauuacugcuuuaaucagaaacccucauuguguuucuaccggagagagaauguauuugcugacaaccauuaaagucagaaguuuuacuccagguuauugcaauaaaguauaauguuuauuaaaugcuucauuuguaugucaaagcuuugacucuauaagcaaauugcuuuuuuccaaaacaaaaagaugucucagguuuguuuugugaauuuucuaaaagcuuucaugucccagaacuuagccuuuaccugugaaguguuacuacagccuuaauauuuuccuaguagaucuauauuagaucaaauaguugcauagcaguauauguuaauuuguguguuuuuagcugugacacaacugugugauuaaaagguauacuuuaguagacauuuauaacucaaggauaccuucuuauuuaaucuuuucuuauuuuuguacuuuaucaugaaugcuuuuagugugugcauaauagcuacagugcauaguuguagacaaaguacauucuggggaaacaacauuuauauguagccuuuacuguuugauauaccaaauuaaaaaaaaauuguaucucauuacuuauacugggacaccauuaccaaaauaauaaaaaucacuuucauaaucuuguuaugaaguuuuauguuguagcaaauauagucuaauguaucacuuuauuucaacuauuacuauggauuauucaauuaaaauauugcacuguaaacauuuuauuuguccauucuacauuucaggccgaggccacaugcuuuuuuuucccguagguuuucaucaaccaaauuucuaaucucuauauuuuugaauuucuaagaaccaacacggagguuacauuucaaucaaacaaucaagccaaaugagaauuaauuugcaauguugaaagauugaauagauugcgacuuuaaguugcugaucgauuucugcuucaucuaaagaaugcaguacacauuuuucuuccucagccucauaccaguccuuucucugaguauuuucuucuuucauuuuuuuaaagguacaugugccucaauuagugcaauuaauguccaauaaaauaagauggguacaaguauucugucauguacuauguggaaauguuuuauugccaaucuuuuuacuugguaaaaauacuugacuucacagggccuaggucaugacucuccaggccuucacugugccacacucacagaugacagggcuugcgguaccaaaggcucuuuaucuuccagacuacagcuccuauuaaugugaaaacaggaaaagaaguaaaaauugcacaaaauggcauugaaacuuuggcgugggaaccucacuuuagcagccagaagguauggcuauggagugguuuaagagaauacucacuaguuuuccagauguaugacaguaggaucuuggaaaugucaggacaguuaagaauaagugaaggaaauauuuucaugggaaaaauauuccuuuaaauaauuauaauuggggccaguuuuugcacaacugucuagcagaguuggauucuacccaaucaauccaacagaguauaagaccggaguacagggugggaaaugaaugcagcuuuggacauaaguaagacaggcgugguuguuagaaacucacagagguuguuucuucaaccucaacgccagucuguuuuucugcaccagugcaacagaaguucacuggcuguuaacucuccguuuuuuggcucagugacucucacaugcucucugcucuccaguuucagucuauuaguuauaaaucucagaaagugaaaaggaaagaagaaaaaaauuaaauauauucaaauacauuuaaaagcaauuuuuuuaacuuggaauuauggaggaaaauaaucuaguuuacauagguauggacacgcuauggguaacagcucaugcuuguagcaccucugcuaagcgacauacaggcuuugaggacaaaugcugugcucuucaugcacacuuuucaacaugugucagauauggagggaagaaauggaacuaaaauauguugagcacuuacaauuuuugcaucacuaugcuaaacucuaaugcauuauugccuaacagucuucagagggaugcgauaaaguaaugggccaaaauuauauauuuagaaguauucucauccagauuuucccuggagaugaacuaauucaaagcccauuaucuuuguacccuaguuugucccuucccagugugccuguguuuggauuuauaggguaguccgucuauuuuuuuaggccauaagauccugggaguuucgcaagcaauuuacuuccuuugucuaaggcacauuccacacuacagacaggcaguaacugacauugugcgggaauccucaccacacugcucucuucugagaaaagccccuuuaaacuguucuuuaggcaaaaccaaaagccaaacaaacaagcagucaugcuuugucuuauaauccuaaaacuucuguccuagaaccugucuggaccaagguuccuuguuggagccagggccauccuuaggcugguccaguuuccugggacauggccuguccaucugauagccaugcaucaccuaaguguugguguauguggcucaucagaacccuuccgucucucagagcccgugagcacuggccagagggagagagaagaaccaaggcacgaaacaagcuuuuugaugggaagcuugccuuugcaaacagaaugacuggaccuaccagaacuaguuuugaaucauuugaggccccuuuaggugagacaauguuauacaguagaagccuaacagcacugagaucccuuugggucagagcuaagagucauugagcaagcccgaaaaaucagccagccucuuucuuuuucuuuuuuuuuuuaaaauuuauuccuauuuccuuacauuuguuucucucucucucaauggauaaguauuacaauaugcuuaauaugcacuuuuuguuugcguguuccagcaaaauuuguauuauuguuuugaauauauauguuuuacuuuauguaagugcuguacauaucucauccuguugcuuaaucuuuucucagcuccaucccuguguaauuccauagcuuauagcugcugccuaguauuccaugguacuuauccaccacauuuuuucuauccacucucuugggaauagauaccuggauaacuuccaacuuugugagccccuaaaugaugcagcgaggaacagcuugguauguguuuacuugcccuccuauguaaacuuuguaaugcaugccauacgcaugauuagaaguguugggucagcaagugagugcguuauguaauuuaaauauugcauguucuccagaaugccaaaucuguccacacucccaucagcugugcaugaggggaagcuguacccacuuccccaccaacacauggcaugaccucuuuauuuuuaaaugaaauauauccucuugggagagagaugcauuacauagauuuuuuuuuuuuaacgaggaaaaagacaucuacccucauuuuucaauacuucccauagucauauuuguguuuacaucauaucuccacuauucgaugguauauucauugaaaagcagggacuaagucccaacaauuuuguuauggaaucauauuguauauacagaagcaagggugaaaaaaggggagugaguuuugucgcaccugcuucucagcacugaugaucucuucaccuucuccaugacucaguuuucaauugguacucuugaagucuaaccuguuucuuucuuucuuuuuuuuuuugagauggagucucgcucugucacccaggcuggagugccaugguaugaucucagcucacugcaaccuccgccucccagguucaagugauucuccugucucagccccccgaguagcugggacuacaggcauacaccaccaugucuggcuaauuuuuguauuuuuaguagacacgagguuucaccauguugguuaggcuagucucaaacuccugaucuacccgccucggacucccaaaguacugggauuacaggugugaaccaaugcacccggccccuaaucucaguuucuucucuuugcuuacaaauugagcuuauucaagguuuuuagguuucugcuuagucacuaugaagaaagcagaaaugccaacucaauggcuuccaauuuuuuaaaccauagccucacaguaugcaauauauuuuacaugauuuaguacauaucucuacaugugauuguguguacuucauagauauauauuuauguauguauauauacacacacacacauacacacacacaaacaggauucacuauuguuuucugugauggaauauauuuuuaaauuuuuuucauaagaaaugcagcacagugaaauacuacuacaaaccuaucauaguggcuaaauuuuuaaaaaaaugacaaaacugauaacauauaccaaguauuggggaggaugugaaacuacuggaacuuucauacauugcuugggaaagugcaaaacgcuacaguaugagaagugucuguucauauccuucgcccacuuuuugaugggguuguuuguuuuuuucuuguaaauuuguuugaguucauuguagauucuggauauuagcccuuugucagaugaguagguugcaaaaauuuucucccauucuguagguugccuguucacucugaugguaguuucuuuugcugugcagaagcucuuuaguuuaauuagaucccauuugucaauuuuggcuuuuguugccauuacuuuugguguuuuagacaugaaguccuugcccaugccuauguccugaaugguauugccuaaguuuucuucuaggguuuuuaugguuuuaggucuaacauuuaagucuucaauccaucuugaauuaaaaacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccguuguagaagucaguguggcgauuccugagggaucuagaacuagaaauaccauuugacccagcaaucccauuacuggguauauacccaaaggauuauaaaucaugcugcuauaaagacacaugcacauguauguuuauaguggcacuauucacaauagcaaagacuuggaaccaacccaaauguccaacaacgauagacuggauuaagaaaauauggcacauauacaccauggaauacuaugcaaccauaaaaaaugaugaguucauguccuuuguagggacauggaugaaacuguaaaccaucauucucagcaaacuauggcagggacaaaaaaccaaacaccgcauguucucacucauaggugggaauugaacaaugagaacacaugcacacaggaaggggaacaucacacacuggggacuguuguggggggggggaaggggggagggauagcauuuggagauauaccuaaugcuaaaugacaaguuaaugggugcagcacaccaacaugguacauguauacauauguaacaaaccugcacauugugcacauguacccuaaaacuuaaaguauaauaauaauaaaauuaaaaaaaaaugcuacaguaugaccccacuccuggguauuuauccuagagaaaugaaaacacauucacacaaaagcuauacaugaauguuuacagcagcugcauucaucaugacuucauacugaaaacaaccuaaauuuccuucaaagggcaauuaguuauacaaaaucuguuacauccacccaauggaauacuacucgguaauaaaaaagaaugaaccauugauacacacaacaacuugaaugaaucucaagggaauuauguugaguaaaauaagucagcuucaaaagguuacacacugcacaauuccauugcuacgacagccucugagagacaaaagugucaugaugaagaguagaucagugguugucgaggguuaaaggggagggagaguacuacaaaaggauagccugguggaguuuuggaagguuuucugauugugacagugguuacauggauguauacauguguuaaaauucacacaacuacaccaaaaagugaugaaaagugauuggaaaaaauguuaaaggggaauuggugcaaaugaacuuaagugaagcugaacugacauuggcagguagcauggcagcugcuggcagacaaggaaacgagauggcaacacugaacaaagaaggucaggccuagagaugugaacaaggaucauggccugugcugaaguccuugcaggagagguaaaguggugccagauucucagagcagaacaggaggcagaauaccagccuuugggaugagcaacagcuggaaccucccagccgaggcaauuuuaauucaaugucauaaguguuaauugagcaccuauuaguaggcagacacuguuuggggcacugaugauauaauaaugaacaaggcacccaggcccugaccucauggagcugauauucuagugggauggguggcaggagagaaaauaagauuucaguuaauuauaagugguauauguguguauguguguguguguguguguacugugugugagggggcacuguuuagaaugaguagucagggaagccuuccugaaggaggcaacaccaaggggugggcauuaaggacaagcuuccucuuacauccucuccaugugaagaaaauacaggcacugaguuaccagauaguauaauuaccuuaaaaaaaaaagaggguugcaauucauuaaauugauuuuuauggucacaaaaucagggcagucugaaguaaaauaaucucagcgcacuccacagcagaugacauuggcccauaaucagcacuggcuucuggcuuggccgauggcacugguggguccagaccguucccugccauugacucuugagcucauuccaaucaucuuccccuuggagcacugaagcaaaucugauaacucagugccugcauuuccuucacauggggaggauguaagaggacacuuguccuuaaugcccacuccuugguguugccuccuucaggaaggcuucccugacuacucacuuguuccuaaagaauaaccagagaacaaacaggcucuuggaacuaacauacuuuucaacaaugccuuuaaauauaauuuaaaauggccugaugauucuuuaauuuuaugugcaccaaaggacuccacacugauucuuuuaagcacuuaauggaacuucuccuggaacauuuucuacacuaugucuagccuuugagucaaaguuuuauuauaucugauugaaaaagauuuccacccucaucccagugggguugcugagaaaagcaggcagccucguguucuguuuggggggaucucccauccccugguguugugcuguguacccagcaugcuuuccuggcugucucuaacuuuauuguuuaaccccacagcccuuggccauuaucuaggccauuggaccccacaagucaggucauaucagcuuugagagcaccacucagcucccagacccacaauacugaaagcugcugguguccacuggaucugguggauguuugugaaucccaggaugcucugagcuugucuuuccugcaccuccccugucacucucccugcucacauucagaaggccaaagggccaccucuguucucuuacugcacaucccagcaaucaguauuuaaauuugagacucuuauucugcaauucccacagcccgcaagcaaauccaguuggcauucuagagcuuggcacugauauugaggaaaaaaguggggaaacacaggcuggacaaagcgguggaagaauaagguuaacuuuucacuguguguuuuccaaugugguuuccaggaaugauugcuguaaaaaugggcaagccugccugcucucuuguuuugauuucuaacuucaagagauagcucuggaaacgucuaucaaggccuuguuaauaaaaaacaaaauggucgggugugguggcucaugccuguaaucccagcacuuugggaggccaaggcuggcggaucaugaggucaggagaucgagaccauccugcguaacacagugaaauccugucucuacuaaaaaaaauaaaauaaaauaaaauaaaauaaaauaaaauaaaauaaaauaaaauaaaauaaaauagcugggcgucguggcacacaccuguagucccagcuacucgggaggcugaggcaggaaaaucauuugaaccugagaggcggagguugcagugagccgagaucgagucacugcacuccagccugggugacagagcgagacuccgucucaaaaacaaaaaaacaaaaacaaaaacaaaaaaaaccaacgacaacaaaaaaccacacacacacaaaacccuguccuucuucuucagugccccgccagggcuuauuuucuuugcaacagaguguaggggaguuuaggucaucauacagaccugcccuuggcucugcagaggucagcaccuuucucauuuucuuugcccacgucccuacaucagucuagcuugaguucaucucucaucucucuaaugaagccuccucugaccacauuauuuaauacuuagccugcccccacaagcucccucgacaugccuaccuugcucuacuuuuucuguucccuacgcucccaacacauaaaacauuuauuuccuguuaauauaacauaaaauaaccuuuacauuuugaugaugauuuacugucugucuccguccccacuccaguucccaggauauaaacucuacagggguggacauuuuuauguuccuuggaaaguggaauauccaaucaucuugcuggauuuucuacacaauauccaaccacugguuugcauuauauuuuaaauucugaugguaugaucacugcccaaauaaucuacucacaaaaagaaauuaguuaagccagcuguuuauuguccuacugaccugugcuguacaauguaguagccacuagucacauguggcuauuuaaauuuaaauuaauuaaaauuaaaaaaauuaaaaaaucaauuccuuauucacaucagccuuauuucaggugcuuggaagccacauggggauaguggcuacuguugugagaggcacagauauaaaacgcuuccaucauagcggaaaguucuauuggacagugcuucuauaauugaacccauuucaauuuauuggacguuuuacuuuuauucaauugguaacuauuuauuacuacuuuggguaaaacacuaugauaagaaucaugagaaauacucagggaggauucaggggccccuccuccgaguaagugagugugaacauaaauauaauauaaagauacauacacaagaguuuucagguaguuucagauaaugugcuucaaggaaaggagagauuugcguuuuccaaugaccuggcuuuuucccauaggcagaggagccaacaucuccaguggaaaauaaacucaggucgcaauaggaaauaaaagaaagcuucuuagaguagguaggucugaaacagaaaacugcccauaaccucaguucugaaacacagaaaacgaacaccuugauaaaaguaaggaagacgauccacauaagguuauauuuugguggaaaaguuaacuccaaacaaggaaauucaaagcuaugguuccuuauguucuauggguucugcucuugcuucuccuucaccuuugccuugggacaagcagcccccacaccugcagacacaauuucugguccugaaguccccugccugagcagagcugagaaaagcugaugagggcuaacagaaucuggggcguugcuucuccaagccuucccuuccaaggcugggaauuaaaguucaaagagggucuuccccucaugcugcuucuuccugcagggcaaagcuugaaggcuugaccuaaagagcuaugucaauggaugaugagagauugaaugcuauuuuucagauaccugagauuuuuccacccugggcuccuucacccccuucccuagcccacagggcugacucacacugaccuggguuuuucccaaaggcagagaagucaacaucuccaguagaaaauaaacucaggucaaaagaacaaggcaugugaggagcacaauuauuuccaaagaaaaaagguuaaauuuccaagaguuaagguggcuuucuaaugcugcuauuau

SEQ ID NO: 18436 - RNA, 1462 nt, Homo sapiens
uagguuuguuagaccuuuuuuuugacccuugguaucuucagcuuucugaaggccagguaaugucugcauucugaauauguuaggggacauaugaauccauaggacauauuuuaagcagaauuguaucauuguuucccuuguugcuauuuuacuuucccaaaccauugcagagcuuuuugccaaugacauuuucucauccgcagccagcucugccacucuuuugcuauuucuucugucgacuuccauuuuaauuuaaaaaauaaauuuauaauuuuuuuaguucuguuuugucaauguauaccugcagccgcacacacauuugauuauagcugcauaguguggaaaaucuugcaauuagauuccaaaaugacagccgguguaauuuacaaaguacaaaaguguuauguuaaagcacucucagcaauaaauaaaaauagcuuuuuuggaggaggaaauaacuuuggagagaacuaggcuggaggaggaagcaaucuacacucuuaggaaaggaagagccacaucuaggaaagcauccgagggacaaggacaacagaaacacaagaggcucuugaucucaggcaguccuccaagaggcaccugacagagggcaguuagguugccuugauuugccaguuucuguccugaaagauacacuggaccuuuauuucccaaggacuacucauucagcauuguugagcaccuaaauugugcuggagaucgcacaggaacugggcuugcgaaaaugaaaauugcacacaguuccugucuucaggcgcucacagaguuuuuaaaacagaacaucuuaagagggaguuauaaggggcccuguugcaaaaagagagcagcaacuaaaaucuuggaaaagcccucaggacaccacagaggaagcaagcugugaucacagaacuuugaaaggcuuuuguaucuuucgacaauaaaugaucaagugaaguaaauacauuguccagaagagaaagaauugggauggaggaugagauuuuauauggaaggauuaaaacauauuuaacuggagcagggacuuacagggacaggcaagucaguaaagggcccagguuacaaacgaguuauaaccgaucagaccgacgagcgcccgcgugcagcgccuccugccgacgcgcgccucgcagccuucagucaaugcugacagcuguucuccaacacccagcuaggggcgggaggguccgcccacuucuaccagauuuugcacacaaaacaguggaaagaccauucucauggcuccaagccguuuucucccuucaucgccugcaauuuuagggcuuuucgggggguaugacugcagggauuuuagagguuuuuuuccucauucucuuuuuaagaggugauaaaaagcauuuaaauuagcggcagggcgguuaacacccgcagcccuagccucuccgcacuucucgucgcucguccguguucacuccacgccuggccu

SEQ ID NO: 18437 - RNA, 7773 nt, Homo sapiens
uaucaggauuauuuguucaaucucugcagauuuauuguugaguaaacuuaucuuuaaauaauacagaacaauuaaagcuaaccaagugcaacagauaaauaagccugccaguuauacacauaacuuuauaccaaccauaauucagccagucaaaauuccaaaaacaauccaaauaacuuccaacauacuagcggucaaacuaccgaauaaacuugaugcagaccaguauucccaaguugcaauaguauccaaugacuuugcugaaaugcauaaaauggacaagccuagguaucugcgcaaccagcagguuuuuuuuuuuuuguaccaaggcuagagaaugccugguaaaagcuugaccagaaaacucucaaaaguaacuguuacugcccuacuauucuuaagauacuuaaaauuugaauaaagaaccuacuggcuauguaacauucuaaggucuaccagaugcuaccaaaaaauauuagcuacauggaguguugcuaaauauagcugagauuuacaaaaccacuuuagucucauugacauuucugauugacaucuuuaauuacuuugcaccagccuggcaaaauagaagaauguugugguugggaacugcaaaaccuagcuugaagauuaacaacaggucuuugcucagaauaagacaauccauuugaauagaugaagaguaucugggcuggaaaauuuugcaaagcugguuuacaugaagguguuuugucccaauuucagacaauuccucaaacaugcauuuuuugguauaaaacugguuaacuaauguagaaagcaaagaaacaagaccauugagaguagaacuccccauaucuuggggaguccuaauuaacacuaugccaccuaguagccugaaagcugcaauuaguauaaagaucauccagaaauguuucuauuucucauacauuuaaucaguuucguuuaguuccugucaugcucauuuagacacaucagugguccuacuugcuucaccacugaucauacaauaccuacuaacaccaacuucaaacggauuagcuaacuuaaggaucugucaugaugcauucaggcuguaucauaagggacucaggucaucuuacccagagcuacaaggguaagauggaauuuucaaagucccuuaagauccuggccaaguuuuaugcauagaauagugauguucaagacuuaaccaacaccuuucaauucugaauguagguauguaugaauaagguuaacaauuauaaugucugacucucaaauauaucaaauuaagaaguguuaauauugaacacaaaucaaaaaucuaguuagaaacauuuuauuuaaaugugccaaauaaaaacccacauuuucagaccauaugauguuaauacauucaacaaaauuuauauuaucuuacugcugugaauuuacauaguaauccagauccauuuugauuagaugguugaauuaucuuuccuagguuacacuuuacagacaucacaaaucccuuauaauaauguaaacaaaauaacuuuucccuaaagggugaacuugagagcuucaguccauucuuucaggacuugcacuucugcgaggacuuccugauggggaacgacuaaaaagaaaaacauuagguuuggauccaauuagugucaauugaaacucucauguacauguacuaacuuucaauaacuucaaagguggccuaagguacuaauuuccuauagcaaagaccuaaaaaugacaugaaacuuacauauauucaucuuuugucccuggcuuaagauuaggcuacccuggccaggcacgguggcucacgccuguaaccccagcacuuugggagaggccgaggcaggugaucaccuaagaucaggaguuuaagaccaaccucgccaacauggugaaacuccgucucuacuagaaauacaaaaaauuagccaggcuuggcggugggugccuguaaucccaacugcucaagaggcugagacaggauaauugcuugaacccgggaaucggaggcugcagugagccaagauugagccacugcacuccaagccuggggacagagcgaaaacuccaucccagaaaaaaaaaaaaauuaggcuauccuccuugucaaaauugcaaggucaaccugcaguuaaauaugacaacuauuugaagucuucuggucauuaagaagcacuagauaaauaugacaacuauuugaaguuuucuggucauaaagaagcacuaggcagguaacuauuuccaagacuuuucuccacacuuuguaucuauuguacauguggggaaaaggcaucuaucuuaccaaaauuucuaccaaguacucacaggaccaaucacaucuuaauaaucacccuaacauuuuaugacuaaguauuuccagcaaaaguauaaacuaauguuacugaaucaaaaaaaaaaaguauuucagaaacuuagcauaguauuuuaaucuauauagcaccaauucuccaaagagcucaaagacugcaaagcaguaagcaaacaaauucugcagaggccacacuugacaggcaagauuuggcaacaaaacauuuagcuuaccuucuuuuuggagauggagaucuggacuuugaucggcugucaaaacaugagaaauucuauuaaagaaagaguacuaaccaaucccuuucuuguagucaccaauaccguaaaacccccaaauguccuaagcuuaaaaugucagacugcacuuaaacugaaaaacauccuaccaguuguugcuaacaaaagccaaucuuucaacaacuguuuuucaaaaaaugacucaauuacuacaucaugauuaaucuuuuacauucugcuuuaagcacaucgauuucaggaugcuucuccaugcaccuaucaguucuaacaagggccucuuuaauauaaucccccaagucauaagcuucuuucucacuauaguuuuacauucccuuguucagggaaagucagccaguaauaaauaggacauacacaaauaagguacuguguucccacuaaaaccuaaguuuagaguuaacacuuaaaauuucaacaauuaaaaacacuuugaacucuuuggauauuggugccauauaacuagaaaagcauaaucaaauuuuuacccuaccugcuucuuggucgugaaauagaccuggaucuugaucuugaccucgacggggaucuuaauaaaaaaagugaaaaacacaauuauaucaaucaguccaaaggaauuuccuuaacuacucaacacuguauuagguuggucaggcauaaagaagcuaaaacuaaacaagaugcaacacuugccuuauucugucuaacacacugucaaacaaaguguuaccagacauaaggaacccccauuucaauuacuuguuucuaucacucaauugguuaguuucuguacagguauaacauucucaaacacuguguaauauccaagggaaauacaugguuuucauuugaugagacugguaugaaggaagcaaaacuaaccucacuuaaggcacagaucccucagcugggcacugugguacacaauggcagucccagcuacucaggaggcuaaggcaggaugaaaauaaccagaccccugaacugagacuaauucaggugauaaggccagacgaaaagaaagccgccccccauuuguaaggcuuuauuccuggaucaaguuauguuugagagccaucaaucugucagacaaaccaaaucagacugacauaucuaucuuuuaaauuuaucuaaagagaugguucauagcuuucucaaauagaccacaagauucagaauuccugcauuuaaagguuuugugcuauuaaacagcaauuuaacucccaguagcauuccguaccacgguuuuaucguugguacagauaacaauauuguuaauuacauguugcaauacuuauuuuacaauuuuuuccauucuaucuccuuuuaaggccuucuacaaauaguaaagcucugguucuuuaguuuuuucaggucugaaacggucuaaaaaaaaaaauccacauucauuucuguguacacacuacugcccuagucaacuuuccagugucucaaaucaaccccaucauuccaaaaaugagaaauguuucuacuugcuucugaucucuuuuccuggugcuaauaggccuuuuugucgggaaaaucaauuaccaucuuucagagcuaguaucauccaaucugaagccagaaaaguuuauagcaacaugccuacccagaguguugaguagaacuguauugcuugggacccuugucuaccacacggccuaacaagccuuaaaaucucuaguagcccuuuucuucaucuguaaaacuagguuaauauuuauguuacaaguuacacauaaauuccaaacuuuuacaucucaaauauucccugaagcaauccauuugaauuauguccuuaagacacucuacugauaagaugugaacaauccaaacacaaguaaggaaaaaaaguguuacauacuggaaauaccucgauccuuuuauagaaccagaccuagaucuucugagugaagcugaucuugaucuacgaagagagauagaucuugaucgucgaggagaugcugaccuugaccuaaaauaaagaacuuuaaguccaucuccacaguuuuuuuuuuuuuuggccuguuaagacuucaacuggggaacggugcaguggcucaugcccauaaucccagcacugcgggaggaucguuugagcccaggagcuugagaccagccugggaaacagugcaagaccauuucuacaaaaauaaaaauuagcuggguaugguggcagugccuacagucccagcuacucgggaggcugagguaggagaacugcuuaaacccaagagaucaucaaggcagcagugagucgugguuaugccccuguacuccagcccgggugacagagcaagacccugucuccaaaaaaaauaaugagcuuuuucuguguuggacuaccagugaauuuaauaauaauacagaaagacuucaguuaaacaagaucucaccuucguccccugcuccugcugcgugagcgagaguaucgccuuccucuggaucgagaaugugaucuagaccgugaccuauuuuucaaguuagagaaaaaacaaaaugucagacaauaacucguuuuuaagaguuugugugccucugcugaaaucaaaucucaaaacuauuuaaauuuagugucucauuuggaaauaaacucugggccuauuaguuguugaguauuuuuuuuuuuacuaccuaaaaaaagauuuguuaaaagcugaauuacaacuuagcauuacauaauauaaaacacuguaauguguauuuaaaauaaaccuugcaaguuugcaggucgacccucuuuggcccauggucuaguagaucuagacgaucuagaaguaucuauagccgaucgcugcaucuagauguuuucuucaaucuaacgacgaucaaacugacagccaaaugagccaggugaggcuugauugacgcaagaagauuuuucuaguugggaauguggucaaucugguguuccucuuucuaaaccggaggggggccccaauuguaagccaaauuuacuguuacggcgaucaccgucucaaauuuucugcccuuuaaagaauaaggugaagcuagguguagaugacucgaggggaucuggccucuuaugcugaucaccucaaggucuaggaggaucuuaauugucggauuugcaaggcgccucagcaugauaucauaaggcucgugacauucugaaucaaggcgacugacucaaacgaagaaaccugaaagguuuugaccagguugauuauuaauauaguaacauuuuuuuaauuaaacaaaaauuguaaaauacaccuguacaauuaacauucaaguuuauagaaaaacacuaguuucugccuugcuaauaaaagaauuacuugauuaacuagaauaccaaccauuccuuuauuaaaauaaauaccugcuucuucuucgccggcuguaacgaugacaaucauaagcauaaugucccuuuucgccacacucauagcaucuaucauuuggaucaaagggacgucgggcagguggucuaucaaaacgugaucuccgaggcaugccugucgauaguucaacccucacucgggagccacaaaucacccuaauaaaagcaaauuaacaaaauucuaaaguuaaaaauauauucaggacuuauagauuuaaaaagaacucuuuccaaccacucacucuuuccaaccacuccuucccccccaacaaacuuuggcggucuuuaccaagcccuaacuccaucuccgcuaucuucuuuaaccuucgugugccuuuagcauuuaacacuaugaccagcuauuuaaggucucuuccagacuucagaauccaaauuuagcacuaaguucauuaucuagccacaguauauuuuaaugaacagaagauucauaacaucuuacuuacuuuccauccaguccucguacugcaucuucugcaucucuaggaucuucgaauuccacaaaggcaaauccuggaggauuucucgcaauccauacaguucuuaaaggaccauaauaacugaaagcccuuucuaacucuccuuugccagcgccaguucccagguuaccaacauacaccuugguuucuguuuaaaaacgcaaauagaagaaugcacguuacgcaaaaucuggcccaaguuucaauuacuuauuugccuuaaaacgggccauccucaagauuggguaaagcacauuuaaugcccucuauccaagacaaaacuuagucguaaaacuggugaaaguccgcaaaucccugagaaacuagacuuuugacaaaauucuuaacguucuaaauaaugcggggugacccucccgaacacaagcagaaacgcgugguaggauacaccgaggcguggggcggaaccuggcccggccccacccaugagucccggcagccccgggcgcaccgggagcgcgcgggcccgcagcggcagcggcgucggcggcgggagggccucgguaggggccgggccaggagagcagggcugcgccggcucucguccuccgcggcaaacgucccaggcacaggcucgcccaagacuccagcuccccgccccagagccauaaaccgcgcuggaaauaacuaaaaaaaacccagccgccagucgcagauuacguccccauucccauuccgcaauuuaaccgauuguuugacgagaacaugcagcucacagcugccaauuucguucuaucucaaacacaaccacgaucuuacagcugcggccagaucuguccgcugaaguggcgggaaagcgcugaggaaaugcgccaccacgguccucaaugugcgcaaaauggcagccgccgccgagggcggggggggaggggggccggcgggcagcuccgagaaaggcaacgcgaaaaccgucaucucaacccugcuuuaggcuggauugggccacaaaaaugcccaagaguacggaacucggcagagauguacacccgccaucccgucucccuucagcaccccgccuccgcugccuccggcuucgucuggcgugcuccuaagccgccauuacgcacgcggaauaaccgucucccaaccuccgcgacaacccuacggccucgcagugcucacuacacccacaccaacgucccucaccggacuccagcuucuuaccuccuccguaccgcccguaacgcgacaugaugacagacccgcgugcucggcucuuuagcaagcagcgcccagggcucgagugacgcaaaagcugacacacaccuucacccgccaagagucccggcggcacuacga

SEQ ID NO: 18438 - RNA, 29765 nt, Homo sapiens
uauugaacagcuuuugguauuucuacacauuacuuuuaauuauaagcaauuuccagcuaagacuuuucaagguaaauaaaugaaauaaaauuccuguggacuuuuucuuaaaaauuuaacaucccacaggaucugcuucuguaucaucuauaaguuuaaccaaaggcacugaugaagugccugucccuccuccuguuccuccacgaagacgaccagaaucugccccagcagaaucuucaccaucuaagguaaaguaagaaaucuuguuguguagaaauuggaaucauuacaguucauuauaauaaacggcugucuaguuuaguucucacuaggauaaguuaacauuucagaguauacaggcuuaauaguuuaaacaaggauuacauauagauuuagcaugcaguaauguuucuuucuucugaagguaguuuuuugguaugcauucaagacccuuguaaaccuaaggcuaugguuauuuucagaaaaaaacaaaaguuuuaaucuguaaaguaagaggaauuugguuucaagcaguucuuuaaaagcauacagagaaaguccugaagcuuuguaugaaggcacauuauaagucaaacuguauuuugacauaugcuaaaauuuacuuaucugagcccuuaauaguaaaucugacauacuuuuaaauggaguuuucaugaaaauucuggguuuggaagagaccccaaaggcucaaaauagcuauuauuucuacuuauuuaauuuuguuuuuuucuuuuuggccagcuguuaaacuuaauucauuaguucuuaagcuguccagagugcagagcaccaggauaagucaagacaagacacucuuuguagaacuucaugaauguuaacauaguuaacuuaaaauuauaaaauagguacuuuaugcuaaauuagaaaugaucuuagauugagugauaagcuaagcaagcaguagcaaacaaaauuuugaggaaaaaaauuuaaguaaaaacuacggcaaacuuuuuuuuucuaugaauugacagaaccucccauuuaaaacauaugccagccuuggcaacagagcaagaccuugacucuacaaaaaaugaaaaaaauuagccaggcauggugguacaugccagugguccuugcugcuugggaugcugaggucgggggaucacuugagcccaggaaguugaggcuacagugagccaugauugcaccacugcacuccagucugggcaauagagcaaggcauugucucaaaaaaaaaaauuuuuuuuuaauuaaaaagaaaacauauggcaaaacucccuguuccacacuuagcauccugccaauagcauguuugaaaaccccaacuuaauucuuauagucaugauacuucauaaauuuauuaauaaauguguauuuuauucuuuucauuuguuagauuaugucuaagcauuuggacagucccccagccauuccuccuaggcaacccacaucaaaagccuauucaccacgauauucaauaucagaccggaccucuaucucagacccuccugaaagcccucccuuauuaccaccacgagaaccugugaggacaccugauguuuucucaagcucaccacuacaucuccaaccucccccuuugggcaaaaaaagugaccauggcaaugccuucuucccaaacagcccuucccccuuuacaccaccuccuccucaaacaccuucuccucacggcacaagaaggcaucugccaucaccaccauugacacaagaaguggaccuucauuccauugcugggccgccuguuccuccacgacaaagcacuucucaacauaucccuaaacucccuccaaaaacuuacaaaagggagcacacacacccauccaugcacagagauggaccaccacuguuggagaaugcccauucuuccugaguuccucuguacugggauguauauuuuccuagccccaaauccauugcuggcaauggaugcacugaaugugccagcacugaggaguuaaaaugagaacuccaaacacuaacgacucuucuucaagaugcaguauaagacaaugaauuuuaaccuagauguaauuauacaauggaaaugguauuccaguuuagaauauggaaagaccgaccuagaggaauuggacaacugauugcaccugaaaaucauaaagggacuuuuucuggccaauaggcaggaguccucuuuuugugaagugaucuuuugugaagugaucauuaaagggauggaaaacacagucuaguguccagcaggcccacaugacaguuuuuguaauucaaauuaugcacuuuuaaaaaaaaaaacuuaaacagggaucuuaauaucuuccuuuguuuuccuuugcuuuacucuucuacuuuagaauauuuucuuaaaaaucacucaaaggacugugaggaaaggcugugguaccugaccuuguugaaaucaaggcccggcacuguacuacaggccuguuuacagauuauuacggugaacugaauggguaccgaggcuucaccaaagagguacuuuuuuguuguuguuguuguuuuaggaauaauuguaccaauuuuaagagcauuccccccaccuguccccacacacccaaacaaaauguggugguguugccuucaaaaaagagaaguuuugugucauuaacaugacagaagaacuuuuuaaaaaaaaauaacugucaacuauucuauuugcauuuaggagacuguucaucuaugcuagauugucauuuucccuccuucucccacagaaguuuacugguaguccaugucauggcucguagcuaucccucuaaccauaccauggaaaugcaggcacccaaugugaaaaggagcacuugcugggcaucacugacaccgcucauguuuuacacauaguugaguaaucagcauaucuagaauuaucuugcauugccuaaaucauauguauauagugaauguuauauaauauaccuggcaggucuguuuuaauuuaauugaauaaagauacaaauacuuuguuuggcuggcauauauuaaauuauuauaugaagaaaaugguugauucuuauuucuuuuaguugaaaaacacacaaaaacacuaaacauaaaagcacguuuugugguacgccuugguuucuaguucuggauauauguauuaaucuuaaagaaugaucuaaagucacagcuuggcauauaggaagauacuugguuagaauaggauggguaucuuuuaagcagaacuuuguaaguaaguuuuaaguuccuaagcaacaaguauacaguuuguuaagguuuauauugaacauucuaccuugcuugagguuuucugcuuuaucaaaacuauucauaauagaacaucuaccugcaucauuacuaucauaauauggauuauucauaaagcguauguacuguucuucugagucuaacaaauacugugacugaaaugcaugcaccuuguugaagagaaaacauuuuauuaaucuccacuauaaugucugugaaaugugcaguauuccauccuuagagaguuuaucugguucaucagcaucugcauguauccucugaauaaugaagcaacauuucagcaauucuguuaaccacaccauuagagacauuuuuagaagugcugcaacauggugggaaccuaguacuuuaauaauuuccuaugauauuuauuagagcauaaaauguacaucacgauaguacaguauguaguccuuuaagaccagaagguauguuaacugcaccaucauuaagcagucuauccuauuuucuuauuuauuuguuagaauugaauccuuucucaauaucuguaccauuccuaugaugguagccauucuucucuuuauaaaauauuuccucuuugaaaagcguccuaaaacauuaauuucaaauccccucuuggaugcaaagugucccuaagaccauccauucaacaguauuuaugugagccaacuuacuagagccgcuacaacuaaucaugauagacaguccagaaucucccuggacuuuauacugggccagccucauugucccuaagauuucucuuuuuaugucucauggauuacuucucuuuuuaauugccccaggcacauuccaaaugagaaccugguaaaagucacauuggacccccuucaguaugucuucggcuaauguguuagccuucaauaaggugauaaccccuuuucaaccuaucuagucuauaaagaggaaaaauucagauuuggaguucuaauccuauuucucccaaagggaacuauucuucuaccccaugguucuaggagaccacuucacugugcaacaguuuuacaugcauuguggauggaggauauuuuuauucugaacuguuacauuuagguaaaaauauuuucugcagugguaacugauuagaaaaaugccaauuggaugcccuuagguggaggugagaaaauggcauccuugccuucuucucaauaugaaacauuaacuaguugacaaauuuauccuuguaguaaugaaaaucuauuuaaucagggaccagaaauggcugaggagauaaaugcaucauuacaaaauucugcuuuugaauccuggacauuacaaggggguaaaugcagcaugacuuuuuguuaaccacauuccaaaauguggaacauuucuuuuagaaaugaaaauauuucaaggcugauguauuuuaagacuacacauuaucaggaaacauacauugagaguucgcuuaauuaaagguuguugggcaucaaauuauguuuaguagguuacuauucucuaacaacucaaggaugcuuuaauggaucugaauuugacaaagagcaugccacacuaauacuacagucaacaacagcccagagaacaauuacuaugucagcuggaggcuauauuaugauucuaaauucuuaaagguuuuuuucccuccauaaaucaaaaauuaccuuauguaaaccaaaaauuaguugguauuuauggucaugaucuuaauucucaaguuuagcuuaaucuuguauuucauuguuugucuucuaauaugacagcuuaaauucagauuuuuaagugacucagcaaaauaggaggagugucccaauuuauuaguguuguacauauugaagaaaaccuuuuuguuccuucagauuuagaaagaaacaguuuaaccauuuauuucuugguauucugcugcugugaauagguuuacuuauucuuuuaacauauauugugugacuacgcaaguauagguccuguuguauugcauuaaucuuuaccaguaacuaaacaucacaagguuaauauugguuuggcugaaagaauuaugcaguaaaguuauuuauaagggaacaugaugacuuuauucaauauuuuucuucuuugaaacaucucauuacuaacuuuuaagauuauuucauaaucccuuauacaugagccaaugaaauauuuugagcucuacuuaagaagcaugaagucuauauuauaaaucuaaacaacaaaagcacuuguaacuuguuuaguaaauuccaugccuuauuuuccauuuuugacaccguaaagugcauuuucugucgacugugagcaaauuucccuuuugccuuuaaugaaaauagugcauuaaguagccaauugcugcagaauuauaaagcaaauuagcuaacagugggucacauuggacuaccacucaaagaaacaagaugcauaacagaugauggaagguacaugugguguggcuuagggagagcgcaccugugccagaugcaugccacuuucaguagcugccaaaugugccuuuaauuaagaacaucucuaauuuuuuucuucagaucaagucagcauuuggggucgggauuugggcagggaacuuuggggugcaaauaucuggugaaaccaccagagaauuuguuugucaaagugacauguauaauuuuaguugagacguguuuguguauauauguguauuugccuuuguuuaguagcacgguuauuugcuaaaauaauugucaaaaaauugcucugucggucggucuuugauguaagaacaaaguguggucuauacaucuaauauggccuuuguaccuaaccauguucauagguaaucuuuguacucugugugcagcaguauuugguuugcauuuaaagugaaaauaacggcuguuauuuuucuggcauuacuaagauaaacugaaaaauaauaaagaaaaaugccuuacauagcccacaaguguauuauuuuugcauguauuuauuuuagagggcaguauuuuugaaaucauuagugauucucauuuagcucauauaugccauauagaaauauuuugcauuuuuauuguggucuuucuuuggaggcacuuuuuuccuguaucaaguuauaaaaggauaaaagaaguuccacauuuccucugugucaaaucugcugauugauuguagugagugggaggccucugggaugaaaacuaguaauuuaaagugaccuugagugucaccuggaugaaguuucagagugcuaaggcauuuguauuccauaaaagaaguuuugagauaucacguucccugacaggcagcuuuugcugagaucugcuggaaugagguagccugaccuuuagcaauucuuuuucuaggcuuggcaugaaaaugugaguuuaggguuguaacuaaagaaugaugcaaauguaccgucauucagugugaacuauaggauguaaaaauugaugaauccuuagagagccaauccccugauuuaaaaauuaagguagaugaggccuagagaaaugagaugacuuagccaauaucauguggcaguccaagcaugaauuaucgaguauauucuagguaauaaauuuaauaguuauaggacaauaauguuuuuguuaaacuugauucugaauuuucucuugaauuaucacuuauucugagcuuuaacccagugauuuacuuuuuaacuuauuuuaauccucuuaggucaucgcagauuagucuguuugguacaguccauaguuaagccugccuuuuugcugauagcugcacaugguguccagagggaaggauggcuucaauacagaguacaauuccaaaaaagcaguuuauggccauucuaacauuuuaggacucuugauucuuacuggaggcaagaaaaacuguagcccacuuaacagcuaauuucucuaccucaguaacucaucaagaaaaggaagaaucaaugugauaggaacaagcaggugcuuuggaaucaugucuuugcagaaguuaguuauuuaaucuguuucucaucaauacaaggagguuaacagauguacuguuugaggcuauuaugagguuuaaagguaauauguguaaagcacaugccuuucacagaguaggugcuuaguaaaugcuaacuaaaguuacgagggaugcauugucaaaguuuacuggcuuuuagguaucuucuaagagguugguugcuuauucugaagcccucauaauuugauucuuuaugauuuccuuugcuguuuaucaucacuuaaauuaguucugagugaccuuagguuauaagcauuugauaagggcccaucugacuauucagcauucaacaaauauuuauucuucagguacaauucugauauuaggaauauggcaauaaacaaaacaggcaaaaguacaugucaucaugggguuuuauaaucuagugaggagaugcagacaauaaaaaguaguaagcauaauaaauaaauauauuauacauucgaauguuuucacuuaugaacaaaaaaggauauggugacuaggaauguggaaguccaggggaggugaaauuuaaaugggauggucagaagccugccucauagagaugacauuaauagacuuggaagaggugagggaacaagacaugcauauaucugggagaagacuaugucaagucacaggaaacagccagugaaaagcccagaggcaggagcguacuugguacaugugaggcagagugacgcugcuuguaucuggagaagaauaaaugugggcagaagagaaggagaugccaucagagguuugacaaagcucacuuaaggcuuuaaaagcccuuguaaugacuuuugacuucuuaguggcagaguaaccagggacaagaucugauugacauuuuaacaggaucacucuggcugcccuguugagaauaaaacagugggaauagggaggcuaacccaauagaaaauagcuuggaccagggugauagcaguggagcugccuuauaagaagaggucagggccuagauauauuuuaaagacagccaauaugcugauagacugaaugugagguguaagaaaaacagaauuguuaaagaugacuucaagguuuuggccagaguaacuggaaggauaaauuuaccauuaacugggguggggaagauaugguugaagcaggcuuggacauacuaaguucaauaaauauauuagacaucuucagagaugucaaggaggcaguugaagauguuagucuggaguuugggagaauaggcuaaagauagugaauugggagucacuuucauaaagacauuaaagcuagcagacuggauaaaaucacaaaggaacugaguauagacuagaaaaagaagagcucuaagcaaaggagagcccuggagcauucuaauguuaaaagagaggggacaagccaggccugguaacaccaccuacucuggaggcuguggcgaaaggaucacuugagcccaggaguucgagguuacagugagcuaugauugugccugugaguagccacugcacuccagccugggcaacacggagauccugucucuaaaauuaaaaaauuaagaaaaaaagaaaaaaaaaaggcaggaagagauggggaaucagcaaggagaccaagaagaaacucccagugaagaaaaacgaaaaccaggaguauguugugucuuugaggccuaguuaagauagaaggaggacgugaucagccugucaaaugcugcuugauagaguaagaugacugagaaggaaccauuuguuugacaauguggaagucauuggugaucuugacacaagcaguucaggggaguggugugggcaaaagccugggcccuaguaugauaaagaauggcaagagaggaacuggagcaguuuccucuuugagguuuuaugaaagggaagcagaaaacuggggcauggcuagaaccgucaagagaggauuucuuuugcuuuaaagaugggagaaauaagagcauguuuguaugcugaacgguuugucccaguugaaagaaaaaugugauaaugagaagagacagaagcacagaugguaucuaccaacaguccuuuacaguagauccuauuaacaucuucagauagauaggcuuacauacaugagacgaaacccaacacauucaguuuucuugauaagaauuaagagcauuuacagcuacuauauaucugaagggaaugaggcaagaaggcauaaaaaucucuauuuuguagauaaggaacaaguuuagaugacuuauuaaagauuauguacuaagcucuuggaaaacaacagauuuuaaaguuacuugguuugggaauaaaaauuuugauuauuuugaacaucugacaaucucccacaaacauauuuuuaguauugccuaaauucaucccuuuauguucuauauuuaaaacucagcuguaguguuacacaucaauuucuauuuuuuucccuuaaaauauauacgucuccaucaguuuucucaaccuucuuuuuauccauaccccuauuugaaaaacuguaccucucccuuccuuuccucccaacccauccccaccaggugagacucaccagcccauauacuauaaauaucaggcugcucagaugcugagaaugcugcucucacaccuccaaaugaacuuucaggauaagagaaucccaacuguaccaaaagcauuauuuuucuaggcucaggcagaaaguuauuaauggugauguuucaagaaaaaguuuaaucugaaaacuagaccuaauuuuaugauacaacuuaaugcagaaaaauuugucauuuuucuaagugcaugcaauugguuaucuggaauauacagucaauuuuaccaaguuauagaguaaugaugaugugcauauguauauucuuaaaucagaaucuuacugugugugauagcaaagguuacagacaauuacgaauacaaaaauacucacuggguuucaaugaacaguuuguuuucuguaucucaagaaucaguucuuuauucuguuuuaaaaugcagucuacgaauagaaucugagugcugaaacuuacauacuagaucauacuauuuauuggucuaauaggugguaucucuaaaauuucagugggaaaaugacucgcaggacugcauuaaaaugcagauuccuuugggaaacuaccuaucggguccuaugcuuauuaccuaggugacaaaauaaucuguaaaccaaacccccaugacauacaauuuaccuguauaacaacccugcacauguaccccgaaccuaaagguuuaaaaaugcagauuccaggcccccaccuccagauauucuaauacagugggacugcaauggugcccaggaaucugcauuuucuacaagugcccucauggaggugauguauuaguuaagacuuaaaggcagugaggaaaugagacaugaguugcuauagaaaacacacucaaaggguuucccugauguucuaguuucaggucccagacuaaacuauuucuuaugggaugaaauagcccacuggggagaacccuagaguacugguccacaaauccuugguucucaaaggcuccaauucuguagucagagaaggagggcaguccuugcuugggccuauauauacugaucucgcaagccuguagaaagggccuauugcgacuccuagccugugcaaaauaucuacuucaucuuuugguagagugcuucuuucugauuaucaacccaaauacuucucaaagacaucuguggucuccuauguaaagugcacuucuccagagggcuggaggucacagauguagucauugucaaguucuuuuccacacugcuccauccaugcauuauuuaauguaaugcaacaguacauuacuaggccauaaugcaacauuacauuacaggccugguggcccacacccauaaucccagccuuuugggaggcugaggcaggaggauagcuagagcccaggaguuugagaccagccugggcaacacagugagaccuugucucuacaaaauguuuaaaucagccaggugugguggugcacacccauaguccuagcuacucaggaggcugaggcaggaggacugcuugaggaguuugaagcugcagugagcuacgaccuuuuuuaaacuggagagauguuuucuaaugcuagauguugugaaaguggcagugguggcuuuaacugcuucugaaggcaacuauauuuccuucaugacugauauuuuuucuuuaaaaaaaaggcagggagguagagugauaacugaauucucugucaaauuaagaguaaaaauuauuuucuguagcuuucugcuuauuaaagcaccaccauuaauguuggcaucagcuacuuauugagcaccuacuaugcagucuucuagagguggaaaggaauuuaaaaauauaugccauaguuccugcccuugaggggacuugcauucuuacugggaagacacaacaaacacauaaagagauaaacaaguuacaccacaagaagucacaaaaagaugaagacacuuaaacugggucuuaagaucggcagagaggaaggaacuagagaaagggcaugaagcaagagugagccuggggaaggugcacagcugacugggaaacgguaaaaacccaguuuacuugagguaagucaguccaccuaggacucugaaaaauaugagaugguagccagaaagaaagaaagccuuacuggagagagcaagccuuggaugucacaucaagaaguuuggaauuucacuguagacaaguaaaaacagaagaguuucacauaaagcaauauuugggaauaccguauuagagacaugcaggauagaugggagcaaagaguacuuggagacaguuagaaaccucaggaaaacuucagguaucaagugaugggaacucaccuggagaguaggcaaguacguagcagcguuaauuauuacuaguuucauaagcuaguuucauaaaauacaacucaauuauuuuggaguuaugcuacagauguagcaucaagauuuuucagaggaugcugccaaaauaaaauuggugaagugugugauaguuuuuaaaccuuucuacuaacugaucaauuuuagugauaaacagaagaugaaagggaaaagaauuuuauuauguuaacauuuuauuuaauagauugugacuucuguaguauuucacuuuccacguccagucgauuuggcguugugcuugcaagcacugccggccacauaauaagagaaaaaucuaauuucaaaugaauucauaaacuucugggaaacaaaaaucuuggcuuaaacuuagauccuggaaacucaaaaaacuuggcagugauccuuuauguguuccagacaacuacuauucaaaacgcaguaggugaguuccuaauuugucaucagacaaggagaagaaaacuugcaacacuuacaugugaaccuuugccuauuuuaucaacaaacgcuucaauagaggaacagcuucugaagacaccaguuugaguaccaagauuuugaaugaacagaaaccaaauaccccuaauuuacuauaccgaacugccugggaauaaagacaaauuguuuaaacccaauuuuuuuucuauuauaaaucugauguuuggggcauaucaaggaugcugaccaucuugcacauauccauguggaaacagagcacauuuuaucaccccagagccaggcaggccucguugcaaucugauuccucuaagcuuuaagagcuugguuucuuuacaaaauaggaaaacagucaagugcugcaauccugaauuuucacuuugaccugcuguuuguagcaacugcugugugugagccauugaaguuuuggugcuauugccaccuucuuuucaggcugcagaaagucuuuuuaacaagauguggcuaaaucacugcuuuuuuccuaguccaucugguugugagugugugugacacucaagaucacgagugggucuugaauacugaguacucaauaaaacacagacuggacuguuuccauccucagcucaacccacacaagggaaaauguuucuuugccuuccucucuccccaguuucuacagaaauccuuguucccuuuacugauuuccauaaccacagaacaaguuuggagaucaauguguuuuuaagcuuugaaccuucugaaucaugguuuaagcacaaauucuccauaacucagauaugcaacauauaaaauacaguucuguuaauuaauccuuugccuuaagggauguuagauauugccuuaggguuuuuggaagacaugaagcaagacagaacuggccccuaacauaguguauauuaguuuaagaacacuggaugaguuaauaaguuaaaugccuaggaagcauaaaauucaaauccauguuaaauaugaacaugcucaguauuauacucggggaaugacuucaaguuggaaguuuucauucuuacaaacauuuauuuuccuccaaauuuauuguguuuuucuguaaugaugugaaaagucuucauuucccuuuuccccaguguugagguucaaaaagccagaucuuaaccagaaacuaaucuucaucucuucaaugucuuguauguuuaguuucauauguaaguauuuauauuaguuuuccucagggauuuauacaucgauauauauauauauauagauauagauauauauauauauuccuacacagauauauacaagcuuuuuauccucaucuuaccacuugacaauacaacuuuaaguauguuuuacacagcuguuccuuggucaaggucauuugcaagagcaagucgguuucugaagaaaucuuguuuggugggugaaggauccauugagggauucucauuaguuuuuucccuguauucugauccacuggaccuaaaaucucagcacacagauaaaguacagguugauuugguuuuaauuguuuucaaauauuuuuaucuaucccaauuguuuugcauuuguaaaacaguugcuuccuagaacuggaauacuuuuuacuccccugaauuucaugacuuaggacauguguaucuaagauuugcauugaacauaaagagaauaucuuucuaaugcuuuauggggacaauugugacaauuguauaugucaguguaagauauuguguaauaacaucauaauaggggaacaaaagcucagaaaauucaagaaauccuguuuuugauucaaugaaguaacaacuccacaaauuaucaaggaucuuaaauuaaaauggauggaaaucaugguucucaaccaagguuaucaaggaccuucacugaauuuggcauuacauuacaaacucuugcuuguuuucauuguuaaaugaaagauuuauugaagccaaccacacauauaugcuacauuugguagaaugcagaaauucguacaguaaucagauugcagagauacuauaaucucaaccaccacaaaagagaccaaagccaaucaauagucaacaacucagaucaguccauuugaguccccagucgagggugcauucuuccuuuaucuugcuuaagccacuuggguaauccauuccagcucugcaccuucuccaguuuucucaugucagaagucccuggagggaggaggcuuucuggaaauaaccucugauaagcuagacuggggcccuuuggcuagcuuaaacucugaccuagaauggguaaaacuaguccagacacuaagaaccaauaucaaaaaaccucaugcaggguguaugaaagugauguuagacaugaaguugcuuguccaaagcuucuauacaacugaccaaguucuccauaugcugaggcugucagguaugcuuccacuauccaccaaagaaggauccagggccuccgaguccuuguacuaucauugguuugcuacuguugaguccucacucuuguuauuagauaaguuaaucaugacuaucauuuacugaauuaaugggcagaauucaaacaucucuuuacauuauucaaagaaagaaguuggauccacaaagacuaaaaacccuaaugucuggaaaccugaugacugacuagguauuuucacuuugcccucugauauucaauaucacagaugaagccauagccgcccaccaugcuuucuacuucugguugguaaggaacacuuuuccacuacaucccagugcagagaggaaaaacuacucuaucucucaacuccaguacaucuggauacucaucaagcaagauaucugggugggaugagguucucuuccuuuucaggaacccccccgaguucucccuugaaagagccuccacauggcccacccuaaaacuccgggccuucucuugucuuucacagaucccccuuaccuccaguucaaaucaucccugaugagugcaguugugccccaaauuuaggaagauauauuuuugaccaucucauucuuucucuaugucuuccauuauucagaagacuaggaaugccuauguuuuaggggcaggaggucaggggcaggauuugaauugggcugcuauuucuucuuguucccccacaggacaguuucucaucagaaagucauuacucaaaacuugaaaucuuugccucguauuuccccucuuagcuacaucuggucuauccaaaacccaacaugucacacuuugaugguuccaacaugcaacuguuuaguguuuaccugaaaauaggaaagcuuugaugucaccaccagccccaaggaccacagaaaucuucaccaguugcguucccauuucugaaacaaaugccaaaaucgcccugucuaguuuucaaaguccauaaacucagcuuaaauuuuuuuaacugcucuucucacaaauuguaccuucccuaugucuccaaugucugaauuucucugcauuucuugauauuaauuaaacuaacagcuaaauugcucauccuuuucaaaauccagcauucuacuauagccaugacuaaaagcucauuuucauccuuguaaagaccauuuuaacugaccucuuuauaacgcuuacauauacguggccaccuggacucuuccaaagguguggccauuaggcucugaaguagugcauaccuugcauaccuaaauuacuaggaaauaaccugcaggaucaaggagaaaaggccagcagauuugcuuuuauucccuuucucuauaaaacaaaaauggcuuuugagcuccuggagccaccguggccgacugcagggcacaucugagcagacauuguagggacaggcaaacacucgcuggggaaggguaccauggcugccaggacauacugacacauaaccauccaaguauuugauggaaagaggaaaagacaacagaccuguugcuaacuuuuccuuucacucaagugacaaagaaaauagcaaauucaguaggucauaccaagucuagauuugcuauaaauaaaccuuuuguuuggagcuggggauggggguaguugaauccagugcugcaaaaaccucugauuuaagaaggcuugguucucugauuggaaagacuauccuccuugaaagcuuuaggagacaugcaucugucucaagaaguaaaggggcaaggaaacacccauccuguuggccagucagucagcccugguaaucaaagcaacagcccugugugacuccaccuuuacuuccacucagacaacacuucagauuuuaaauacaaaggacagcaccaguaucguggaggcaaucugauugauggaggagggacugauauaugagaaaggacaagaggacuaagggcauccacuggcccuuuaccuaaggagaauuccaaacagcugcaagaggacugacagcaauuaaccaacaugaguuuggagagcccaaaggaaaugagcauucauuuaauaaauauuuguugagugccuacuaugugcuacguacuauaccuuguaucaauaguuagguuauccuuaaauugaucuguaagcuccuaaugggcaggaacuauuucucuuacaucuuuugugcuggacagaaccuaguacauugaagacacuuaauugaaugguugauuucaaauggcuuauugagaaacauuuguaauuaagguuaaguaaucuaaaauguuuaccccuucaauuauccccuuuaauguucaaguuauauaggaaaugaaauggaaaaugagagagaaccccaaaguggguaagagugggagagggacuugaaaugagcuuuaaggagacagaauaggugagauaaacuuaucaauggauucuuuagcagcccugcuuucuauuacauggucuguucaacagcugaagcugggcauauacaaaaacugcugggaagacaccaaaagaagaggauucacugagauaaaaugauuacauacggggcccuguagaaguacucucucugugugugauuaagaaaauagacagugaugggauuaauggagggugaugaugagaagggagacacucugacacauguaaauuuuaaagugcuaaagaggaagagaaugagcgaggaaguagaauuaaucauuuggaagccauauuccuuaucuuccacuaucccaaaauuuaaggauaaaaagagagaguaccaucuacauucccuacuccuaaguuaucucacgugauccucuuccccacugccacaucugccaucaagaauacgcguuaacauuaaguguugcaagauguauauauuaagaugaaguaucauuugccucagacuucacaauaaucuagguuuaagucuuugacagccucuguauagauccuucuagaaugggacaguuugccuuccauccugcucaaaggcaggggaauaaguauuggucuagcuaacaucagccuaccacaguaagucuguucccucuaagaauccucauuuaaaauguguaaaaucacuuaacauuuccaaacuuuaagauauguagccuuuauucugaucaauuauggauaccuuucagggacaugugaccuugugucugcccaggacaaaugugccugagauggaaacaaucagaaggucauucuuuuccccaaauauuuugggcauuuuucaggauuuuuuuaaugaugucaacuugacucucccuuuugaauccuuguggguaugagccuucggcccucccagccucagagggaagagaacccuuucucagguuuucugcugcaucuggcuccaugccuagcuucaucccgaagcagcauucuggguguguggggccaccagccaaacaagccccuauggaacaaaaagugugucaguguagacaggaauaagccuccagagggcugugggggaggaagguagcaagccccagacaugacacaaguggcuuugcuggcacuggcccauuuggaccugugaggccaggcucugcaaugguuccaguacucaggauuggccacuucuuaaagucccagggcuugcugccagccugaccuccugacacgcaggaggaaaaugggcugaaugucucuucugguuccuuccuauaccuguccacaggccugacuucagagugcaaguuccuguguaauggcugggacuaugucgcucaugguuccuauacaagugucuugcauagugcaugcauguaagauugaaugcuuaauugaugagaagaaugguguguucucaucugaguuaaaagccacugcccuuccugugcuacacuggggccucccugaccuuccucucuaccuuauaauggagcaaauuuuccaugguccucauaugaaaacacucagaaaacgcuacuuaagcugccucuucaacccaugcaaagucuccaaagugcccacugcagcacccuaagcaccugaugguacugacugcccuaggccagaucuaaaaagccaggaaauccugccagacagacagucuucuuuguggcuccaccuuuacuuccacucagacaacacuucggauuuuaaauacaaaggacagcaccaguauuggugguggcaacaugauugaugcaggagggacugaucuaugagaaaggacaagaggacuaagggaauccacuggcucuuuaucuaaggagaaucccgaacagccacaagaggacugacagcaauuaaccaacaugaacuuggagagcccauagcaaguccucuacauuauaccaaggucaguggggagcuacagaaagauaaaaccuggucuucuacaugcuagggcuucaaaauuaugggucccaaggcuucauuaauuucuuguuucaggugauauaaagaugugauuacucagaucaagcuacaacaaagucaaacuacagauaaagcaaaucuccacacuagaaaggacucuggugauuuuuuaaacaaucucccacuccaugcaggcaccacuuucauagcaucccugaccagaggcaucccaugaauccauuccuucaugacgcagccagcuccaguuccacgcagcugcauuuuuaggaaauucuuccucuuagccacugcuccuaguucugcccucugaauccagagaggacaaauccacucccucugccucaugucacuggcaaaacauuuucuuacaucucucugauaaauaggaauuaguaaagggaccaguggugaaucuauugcucauuguuuuccaauagacagcacccagucauuauaaaugacagugggcaaaaaauggcuguuuguugugggaauacugugguuuaaaaaaaaaaaaaaaaaaaaaaaaaaaagauaggcucaagcugugcccuuaggauuuugcaguccuuagaaggauucaggagucuggccgggugcgguggcucacgccuguaaucccaacacuuugggaggccgaggcagauggaucacuugaggucaggaguucaagaccagccuggccaacauggugaaauccugucucuacaaaaaaaaaaaaaaaaaauagccagggcgugguggcgggcaccuguaaucccagcuacucaggaggcaggggcaggagaauagccugaaccugggaggcagaggcugcagugaaccgagauugcgccauugcacuccagccugggcagcagagccagacuccgucucaagaaagauucaggagucuaaaucagggugggcuggagaggugucuguuuccagguucucccaccccugucaacuugacagauguuggcgcugggucaagaaagaucuaagucuauaugauccuagaaagaggaauacaauucucaacucuucaaauccugaguaagguggguugaggauccagcaaagcagcaugcaagcaugcacuggguuccuuagcaaaacugagagagaaugcagggcuauggcuacaugcagagcugucgcucuuccuuccucuucccccuucuccaguaacaacagggagagaccaacagucagaggcccacuaaucucaguaccacccuccccacaggaggauaauuacaauuagacaaaccagcaaaaacaaaguccucacuccaggguugcccccaauuccuccaugaggaccacagucuaaaucagccagugaccucgaccuucaaggaaaaggugauuucccugugcuuccucacuuauuggcaacucuccaaaggcagcaauaaugccucuguuuaacuuuuccaucuacuaaaauaugaagacuuguuauuuaaaacugacugcaagaacauccuccaccaagaguaacuaagcagcaggaaaaaucucucuaagggagagggagguaggcugagccaguggagauugaaacagcagucucucaggcaggcaguggcuggacuggcagaucccucuacagucaaaugcuaaugcucaccucucucuuccuuacauuuuaugcugggguuuggccacugccucccagacuguaagacagugcugaccaaaaugccugugggugauguuuuacacaacaacgacuuagaaucucagaaggaccacaggaggaaaaugccuuauuuuugccuccuauggaauacagaaacuccauuaaagugauuucuaacuagggccaagccaaauccacucauucagggaaagcacuaacagaaguccuaauaaacaugaauuggcacccaggaugacaacaggccccuaaaugcagaagcgcugagaucccuuagaaaacuuuccacagauggggagaucugauggagcacccaugacacccaaccccaauaguggaucccacuccucccagucuaaaagggcuuugacugucaccagcucauuucucaagggaaccaccucugcccacuccucucaagacacaugacuuugggaacaaggaaggagggauaaaagacagaagaggcagggcagagagcugaguuugcuucuacucugggauauuacaaugagaaacaucuucaccccgccggaacuguggcuacugggugcaggcacuguacuugaagcaguugugugagaccaggcuacuugauacuuauuauuguuaaaaccucaagauuuagcccaaagggaaaugaguuacaaugcugucuugucuaagggcuacucacuucuuuuuaaagagcuugcggaaggagcugcgaaagccccccuucuggucuugccugggauuuugaucgcugaaagauguuuguucacuuucucuuucuucuuugggacagaaucugguaguaucuucuaaaugcaucuccuggaaacaaaaaagagggauuuuuuucuuuacuccuuccaauguuauuauggauccugacuaugggacaauuuugugguguugugacuuuccucucccaugccaaaagacuaccagugggcacccaaucccaacuaaagcaaaccuaggcuaaugaagaaaccagcaggcgaaaagaggauaauuuccugcugaguguaguauuuucuauguaucaaggcaaauagucuaguguaauauauaacaauaauuaaagauaaggaaauaaagaacauuagcuaauguuuaaaaaguggacuuuaaaagaagacugcaagaacguccuccacgagugaauaaauuauuauuuugacaccaacacugucgugcuagaaaaccaguagcaguccccucuuaucuccagguguuucucuuucuacaaaauaaggauguuccuuacuuguaaugcuaguuuuaaacucauguuccuaacucuccauuuuaagcauaaucgagggaaggcauuuuugagaagucagaccuguuuagaaguaaaugucaacuaauacuuucaaccugaaaauaugccuguaauacaguuuuuacaauucuuaacccaugcuauuuggaguauaaaguaaaauaaguuaaaaauaaggcuguaucuuuugugaccucucuaguuuuuucuaagugugagaugugcuaaauagaagugcauguauauuuauaugcauacaagccagauaugcacuuauauacauguuuauauuccauacgaacaaaguauuuaccuugaggugacuauaauuuaagagcaacuuuaaaaacagcugcugaauuuugaauaaccuuuagagaaccccaagaagucaaagcaaaaaccacaccaaugaugcccuaaaagucucaugaauuagauaggugacugcuugcugacagagaagcaaaguguuaggguggauuuuuuuuuuuuucgggaaacauaugggucugacuuugagaacuggggguugcagauacagaaauucucugagauucuacuaagauucauaacuagaccauggagcuagacaugcaguguuucuuaaagugcgguccugugacuacaggaucagguugggccuuuauuuaaaauguagcuucuugagccccaucccagacuuugugaaucagaaucucugcaguuaggccuagguaauccuuacgcacacuuagauuugaaaacgaaugauuuaagggaggguuccccaacucccaguacuagucugugaccuguuaggaacugggccacacagcagaaggugagcaguggggugggugagcaagcgaagcuucaucuguauuuauagccgcuccccauugccugcauuacuaccugagcuccaccuucugucagaucagcaguggcauuagauuuucauaggugcacaaacccuauugugaaaugcacaugcaagggaucuaggaugcgcacuccuugugagaaucuaaugccugaugaucugagguggagcugagacaaugaugcuaaugcuggggaguggcugcaaauacagauuaacauuagcagagagguuagacugcacagagaccauaauaaaucaauugcuugcagacucauaucaaaacccuaucaguaaguggcaagugacaauuaagcugcaucugguggcagucuuuacaguugcaagugaguugaugaacuucaaugguacagcugcaucugguggccuuaaaaguagguuugagauaauuucaaaucuccauacguucuggauuaaagucaaggcagaauaucaugagacugccacaaagcacugaaaagccugcuuccauuuccagcaucccaucuuugugaagcaggguuuucugcagugacagcaaccaaaaugagauuacagaguagauuggacauaagugacacacuucaggugucacucucacccaucacccccagaugggaccgucuaguugcaggaaaacaaacucagggcucccacugauccuagauuauggugaguuguauaauuauuucauuauauauuacaacguaauaauaacagaaauaaaguacacaauaaauuguaacgcacuugaaucaucucaaaaccaccucccccuccgcagucuguggaaaaauugccuuucccaaaacuggucccuggugccaaaaaagucggggaccacugacuuaaggcaugcuucugcccaccuacacuuaauguuuauaucaaucaccgcgaaugauccuaaauucugauucaguaggucuggggugcaaauucugcaucuauaacaaguucccaggcaaugcauuugcuaauacccccauauuuugagaaaugggcuuuuagagacuauuuagugacuaaaucuauuaaugguuuaaggaaaaucguucuauggaaccaugaucucaauagcauuucauacuuuauaaagccuacucaaaaauuguaucuucuuuggccugauccucccaacaacccugugagauagguuguuuuauuuugagacaacuggaggcacagagaagccaagugacuuguccaaaagcacacagcuacugugcagcagagccaggacuagaaccuagagcuccugacagucacguguucucacuagagcauaccaucuucuuucuugacucuaaaagagacaaaacacuaaagacuaggucucggcuagcucugcugggcugggugaaagauauacagaguauuuaaagggaagaaacacuaggaguuuugcacaucucaaaagcaaagaguugauaccuuuaaggauagagcuuuuaagggguuuaucuuuugcaacuaaaacaccauuccaccaucaccuccaacacacacaaacaugcauauauauacuuagacaugcagacgugcacauacaugcccaugcacauauguauacccacauggucucugcccaccugcacucugcaugcuaccucucucuaggacuucuaauaaccagggccuuuuuuuuuuuuuuuuugagacagagucucacacuuucucccaggcuggagugcagugaugcgaucucggcucccugcaagcuccaccucccggguucacgccauucucucgccucagccuccugaguagcugggacuacaggugcucaccaccaugcccggcuaauuuuuuuuuuuuuuuuuuuuuuuuuguagagacgggguuucaccguguugaccaggauggucuugaucuccugaccucaugauccgcccaccucggccucccaaagugcuaggauuacgggcgugagccaccgcacccggccacaaccagggccuuuuaaguuuuuagaaagaaaaauugugucuagaaacagaaauaaguaaugggaacuuugcaugcuugaaaauuuuaaugauauugcuagagaaaaugccucuuuuaacugacuuccauuugcaauuuccuugguaucucauuuugaacugacuugacgcaugucuuacacuguuaggagaugaaacuugcuggccaguaugugcaauuaacgguuccugauacacuguuauuguuauuugguaugucugguaaacagccacaaauauauuacucauuguuugcuucucagauauauuucugauuaaugguuuuugccuuacaauuguugaaccccaaauuuuucacaaaucaacuacaaaaggacauuguuauuacauacgaaauaaaaguucuuuacaguacagacuauacuaguuagaagguuuuguauguaaaccucugcuuaucccaagucacacugaauuggcacuauaauuuccauuuacuuccccuuucaauaaacuucuaaacucugacacaugccuaagauugauuucuccaagaaauucugccuaaucaaauuuuacaaagcuugggguugaaaaucagagcuagaggaaaaucugagaaccccagggaaccucagcagcuuuagcugagcacacuauuacauguuuuuguccucugcagggaccagacacagacuuucacugcuggagugcaggugggcagcaagcuccaaggcucuucaugaucccgccccuuccuguuccucuggccuaauuuccaccacuuugacauggcacaguaugccagagaaaaggcaucaccaugcuuuucucacgcuucccuaccucacucuuccccuagccaacuucuaggcagcuuuuacaaucuaauucggacauucaacuuaucuaggaggccuucucugaccaccaugaccccaaagguuuuaaauauccuucccaugugcucccacaguuuauuacauaauucuguguuccugugucuccuuccuguacuaagccaguggucccggaggauagagacugguuuauuucugaauuuucagcaauuagcacagagccugguacaagacaagaacucaguguuugcugaaaaauuaaugaaugagaaaagucagugucaucacuguuuccauucgaaaaugagaauaguuggaacggaaggguggucgcacaggucagaacuaucauguuacuuaugcucugcuuaaucagaucagagcaauuauuugcucagaaacuauuagcacuucauggauaaguauuuaaagaccucuuuaaaugcccuccaggcuugcagacaccacaauuagacaccaaaauaucaaacaccuguagaccugcagacacagggguuggccaucagaauaccucaacauucacugaggccaaagaagguuucuauuuugggaugucccugacccaauagaguuugcaaauuaauaggacacucuuuuccagucaaaagaaaagcaagcagaaauaaagcuggcuuugcagcaaauugcgcagcgagucuaccuugagcuagggcaacuugccuccucccuagcuacaagcaagaaugcugccgggaagaaguggaguaggcuggcgcaccguguuccauauucucaacauagaaacgacaccucacagacagaagaaacacacuggcccgggaccugcgugcggggcucugaaaaaagugcaacucuucacauaagcaggaagagauuacccauaacucccuaaaugcguguguguuaaucaggucuaaagaguggcgggcuucucugcuaccucugccaucccucguguaccauaugaggcaagcucuuuggguccugguacuggagaacaggcgcugccacucgccuuccagggcccagcagccuacagcucgcagggcgcgggggcugccccugcucucccuccgccuccacccgccgacggcucgcgcagccgcccccuagccuggcccggccccgcuccucuccacgcuaggagaacucgggaugcuuccugcagaucuaggccuggggccgucgacgcuguggguuucgguucgguuuuacuuuacccuccuuacuuccaaauaggucuguuuuucgcuuugggaccucuguugggggaagaagguccuggaugcgccgcgggcggcgacggcggcggcggccgggccgugcgccugcgcggcgcgcucggccuugaugggcgcgcggccgccgcugcugcugcgcgugcuguagaggcguggggccacgccgucggcuggcggcgcacgcgggaacucuuugagagagcggcucagcggcuuggccuugccgugcgccugcgccgccgccuccaguuuguaggcgcugcugcugcccgccggcgacguagcgcucuugggcagcggcugcagcgggugcuccggccgcucggccuccauggcgaagcugacgggccgcaggaagcagauguccaggcuggacucggaggaggcaggcgagcaguucucgaagagggccggagccuggaacggcuccucgucguagggcgcgggcagcgcgaagaucucgccgccguacucgaacucuucguaggccgcgggcacgaagccgcgggcaucgggcaggagcucggccggggcgcgcagggagcgcuccacguugcccagcggcuccgccggagaggacucgaaguccaucuccgggauggccugcaggggcccggccagcgccuucacguccugcucggccgcgcagaacugcgucggugccagaaggcucucgggccgcucgugcuuccugcccuccagcucccagucacugggcuucccgggcugcaugcucuccaucaggcuuugcugcuguuggcuuuucuucacugggggcaucagaugucuuuagggggaaaacagaguacaaaagagcugugcuuacggccgguuagugcaggccucucgccugccggcgccccucggggccgcgcuccgaggcgccugugcaugccaccucccgagcuccacaaacuuccacuaaggcgcucccacgaacccccguucccaggcggagaguggacaaggcaguccgucgagcggaggcccgaagguauugucugagcuucugggaaauggccugcgggccagggacugucaucaccccgcguggaagcccugacccuccucaccaccugcggugcuccaaggcacaccuucaacucucuucucucccuugcuugcccuagcagagucauacggaauaauggaaaacucaacuucuguucgacuuguggaucuucacacucagaaacaaauuacguuccuagauaaaguaaacguggcaugaucuugauaacuguugaaucuggaugagggcauguggaguucacugaacucuucuauguaaauuugaaauuuucauaauaaaaauuuuaaaauauuccuugucacuguaaagcaugcuauauaauuaaucucaaacuuccacccacaaagaauuaccaacauguaaaagcugucacucgauaugcccaauuucauggaggguuuuugguuuuggagucauggguaauggauaauuuacacaguuuacaaacuaggauaggguaccaucagaugggauguccaguuguucuggacuuaaauugacagauguaaguggacacugaccagaagugguuauucugcuaguuuauguauucauauuuuaauucuaccacaaaaaugcauaaagacuucgggaggccgaggcagacggaucgccugaggucaggaguuugagaccagccuggccaacaugguaaaaccccgucucuacuaaaaguacaaaaauuagccgggcaugguggcagccuggccaacaugguaaaacccugucucuacuaaguacaaaaauuagccgggcaugguggcaggugccuguaaucccagcuagucgggaggcugaggcaggagaaucccuugaaccugggaggcggagguugcagugagcugagaucaugccauuguaccucggucucaaaaaaaaauaaaaacaaugcaaauauaaaugcuaaaaccaauaucuuacucugguggucugaaaaugaaaauuaggucucacguuaacaugugaaagagugaaacaaaauauugaccucauuugaauucucuuuuaacuuggaagaaagauuggggguuuuauuuuccauacgcagagugcaguggcagccauauuguugagucuggguauaaucucuagggguuucauauuuuggcucuauuuguugcauuucaaagaagaugaaguuuuguaacugcuucaagaguugaagugauccaugaaguaaauaucuacuuucugccucucuucccacuuucuacaccugucccuuaacauuagugccuuccucugggacccaagaaucggguuggcugcuugguuggcacauauaggccugauggggaaaggggauggaggaaucuaggcugcccugcuaacccgcacagacuggcugggucccaaaggcauuggcauuaaccuucccacagcaacaggugcuuacgugauggcagggccagaacugggagcagaaggguaggguugcagcaacucuucugaguggaucccagugucacggacagccucaggaccugcagugggggaagcaucuugcccagcauuggcacacugggaagccagcccuuuguacagcuucgccauggaugaccuaacagaauggaaauaacaguucucagguuguacaguggcaaacuggcucucugaacacauauuaugccaaaaaaga

SEQ ID NO: 18439 - RNA, 147377 nt, Homo sapiens
caguagcgagcagguucaguucgcuaguaggaagcuccagcgcuacaccggcggcggcgguggcggcggcggccgcggcggcaccucagggcagccagauuccccaacaacgaccuccgguccuuccccuuccccgcgagaccuccgccccagcuccgccccgcccggggcucuugcguuucggagucccaacuacgcggagcgggcgccgcggccggagcgucccuccacacguccucccccagccgccagcuccgccgcggggccagaccgggcccgggagugcagccccggcgggcgggcggcggccgcggcagagggcagcccggggcggcgccggcgggccggggaggggcggggggccuggccccggggcgguggugcgggaugccgccgccuccgggccgcguccguucuccacggcugguaccugugucggguggguggccaggcgcgggccucgccccccagcccccucgccagggcuagcccggcugcgcggcgcccggagggggccgggccguccgguggggccgcggcccuguuccgcgcugcgagcucgcccucucgcggcucccuggcccggccgccgccgccccucuccccgcccagaggcgccccgggggcaccaugcaggcgcagcagcugcccuacgaguuuuucagcgaagagaacgcgcccaaguggcggggacuacuggugccugcgcugaaaaaggugaggagcacgcgggaccccgcuucccggccgcagccccccagcgcgggcgcuggggaagggcuggggaggcggggcgcgcgcagggccgucuuucuucccggucucgccgcgucuccaaaaggacggcgcacacggagaggccccccucauacggcuggcucucgguguugacauccaccgggugugugggaaugccgcagggagccggggggaguuuauccggauaauccaaccccugagaggugaaugcuuugcccuuugauuccaggacaacaacaguuggaggagccucaguuuucagcggaggucaaagcaggccacuuuuccgucuucuuggucuuagcccggagcugcugucagccuaccguuuuagguguccaguacgcugguuuuaguggcuugagaaugcccuggccguaaggcuugcucaaaggaauugcgagcucgccugccaguaggaacguggccugcucugcucgccgucaguauucacuccucauucuccugguuucccccgcuccuccgauuaacaggggcuggugcacaugcuaccaauuucagggggguuuuguuuuguuuuugcagcguucgagauucuuggugcugucauuuggcuuguuaagaauuuuuagccuuuguauguuuaaguuugcuacauuguuaccugaaguuacauacccccgaucugugcuuuuaaauguuuuaguauaauuaggaaguguucuuacguuuuuaaagcuucuaaagcagcagugugacaaccagacuauuuuuguuuucuuuucuucauuuaccuuuucuguaaagauugcuuuacucuucuaauaguguuucuaaaucccaguuucuugcugcucaaagaauguuucaugcuaacugcuucuacuaagaauggagauuauguuuuaccuuuuaugcuaaacauuaaaaggugucugauauuucucaaaggccaguaacuuuuacuuucccuuuugcccuguucuccuccggucccucuugcugucuuacaguggaaacuauuugguuuuucaggagaauuugcucauauauuucuggcuuaaauuacggacauuuuccccuucaagugucugacuagucacaaacaucuauguaauuuuuuuuaaaaaacagaagaaaagaugccauauaucuuacauacuuuacuccuuagaaaucccuucaggcucucacuccuuacuuuugcuuuacuugcaaguuugacuucuuagcuuguaauggaagggguguaggaggucucugugaugcuagaagcugguguccggauagaguaaggggagacacggaaauuguuuaaaaacguguaaaggaacucauaaagcauugccaaauaggggccauuuugcuuagaggcaaaagcagcuccuuucccaggggaaucaccaagguaucagcugaggauccuuugaagcaguggaaagaauauuguaggaguugacagacguuguuuaauucugccacacugguggcccuugcugaaaucuguccacaaaagcauuuuguuuggcuggcauaguguuguuuuauuuuuaaauguaauuaguugcuaauauuugaaaaugggagauauuacauaaaaccugaauuuucggcuuuucuugaagaauaggaaggucuugucauuuagggccuguauucaagcgaggcacuaaacugcuggaguugaguaaauggcucccuucuuuagacaggucauguaucuccaccuuaccacagcccccacuuguccuuuuugcauauuuacauaaaacagcuuuugacuuuaaguuagagauacuuuugcaguagaagugauaggaggagguggaaguguacauaaucuagcugauauguaagguucuuccaauucuuauuuaaauagccacuaacaaugauucuaaacaagauugaaaauacaguauguuucauaucuggauaugcuguugguagcucaaaaccuacguuuuuacuugccugcuggacauuucauguggauaucuccauaucuugauuucuuccuuugauuuguuauugaauuauucguagauacauccgacuuguguucucuuacucuuaccugaggcucuuuggauaugcuagucccuucauccuucuuugccugguccaacacuacucauccuucuagacucacucaaccugaacugucaaaucaucagggcugaguuggauauuacuccuuuguuuucuuuuugcacccuguccuagcucugugaauuuuaaguuccuauuuacuugccuauaacuagauuggaugcuccuugagaacagggaugauaucuuacccacauuuuauuccccauacuuauagugcuugacaucugguaggcacucaauuugaauaaauaggugaggggauauacaaacuaaaacuaucacuucucuccuccaccugucauuucaguuuuucuucucgauuaauggcuuuauuguuacauuugacugguuuaaaauguuggggucaucucuggcuucuuuguauuacugugcacacucagguagagccuguauguucauuucccuuugacauguucuucuagucuauuccuccuccgacuucucuaauugagucuccuuugucagacuacugugauaacuucuuaaugggguucacuggcccccaccucaccuucuguuuuucaaaucucaccaguuauaggacacuucugaacaugucacacucagaauuguugaugucuuuugaguucaaccuaugcuaaagugcacuuuuuagcauagaauuaacagcaauugauauuuggcuucauccugcuuuucugacuggauugucuaccauaaccuuuuaucuccuuuuugcuuuagccaguccggacugcuacuuuuccugaauauggcuggaaugucccacuguaucuguuucaccgcaucuaugagucuaaguccuaucuuaucuauugcacaaauauaucaugccuacuauagaccagguauugcccuugacacucaggcuaaaaagguaaaugacagggccgggcgcaguggcucacgccuguaauccagcacuuugggagagcaaggugggcggaucacgaggucaggaauucaagaccagccuggccaacguggugaaaccccaucucuacuaaaaaauacaaaaauuagccuggcgugguggugggcaccuguaaucccagcuacucgggaggcugaggcaggagaauagcuugaaaccggaagacggagguugcaguggggcgagauugcaccacugcacuccaaccugggcaacaagagcaaaacucugucucaaaaaaaaaaaaaaaaaguaaaugacauaaucagaaaagacuaaauuagaacaugaugggaaguggcagggcaugucuggagagacaacugguuuaugaacaguuuuuauauauguuaagcuaaggaauuuaaauuuuuucuuggguaauuagaagccauugauaaaguuucuuuuguuuguuuuuguuuuguuuguuuguuuugagacagagucuuaacaggcuggagugcaguggugcgaucuuggcucacugcagccuccaccuccugggcuuaagcuauccucccaccucagccuccugagacuguaggcacacugccacauccagauaauuuuuguauuuuuuguagagaugggguuucaccaggcuggucuugaacuccugggcucaagccaucugccugccucagcuucccaaagugcuaggauuacagggugagccacugugcccagccaauaaguuuuaaguaggggaguaacagcacauuuuaauuuuagaaaauucacuuuggccauagaauggaaaaugguuuggagaagaaugagacguaaagugaggagaaaaguuagaagccuaguuuaauaguccagucaagagauaauacacauuugaacuaagggugcauuugaacaaggauggaaauauggauguggauuuuauuugaaagaaguuuacaaggcaaaauugacaggaucuaguaacucacugagugauugggggaaugguaauggaacaggaauagucuuguuucugacuugauugucuuuagucaggauagagaauguaggagaagcucuuaggauggagagaggaguggcauaauaagaugauuuuuggaaauguugacuuaaaaguuuggguuauucaagugaacuucuccaacuggcuauugguuguugguaucugauuaagcagauuuggaacuucuagauguguaaguaaagccauaaauauagaugaagccucuacaaagacuuauacaugaauguucauggcagcuguuuucagucaaaaacuggaaacaauccaauguucgucagcaggugaaugaauaagcaaauugugauacaaacaguggaauacuauugguuguugguaucugaugaagcagauuuggaacuucuagauguguaaguaaagccauaaauauagaugaagcuuauacaaagacuuauacaugaauguucauggcaucucuuuucagucaaaaacuggaaaaaauccaauguucgucaacaggugaaugaauaagcaaauugugauacaaacaguggaauacuacucagcaauaaaaaggaacaaacuggcugggugugguggcucacaccuguaaucccagcacuuuaggaggccaaagugggaggauuacuugagcccaagaguuccaggccagccuaggcaacauaaugaaacccugucucuacaaaaaacuuaaaaaauuagccaaaacauuuaaaaaaauuagccaggugugguggcaugagccuguagucccagcugcuugggaggcugaggugggagcauugcuugagucugagaggucaaggcugcagugaggugugauugugcuauugcacuccagccugggcaaaaaaaugagacccugucucaaaaaaaaaaaaaaaaaaaaaaaaaagagagagaacaaauuugauacaaaugacaacauggcugaaucucaaaauaauuauacucaaugaaagaagggaaaccaaaaaagaguauauacuauaugagucuacuuauagaacauucuagaaggugcaaacuagugcagaucagugguuguuuagggagaggcuuuuuauguuuacuuaucuugauugugcugaugguuucagggguguguacauauccugaaauuuuucagauuguauauuuuaaauaugugcaguuuauuguaugucaguuguaccucaaugaagguauuuuaaaaaguagaugagaccacacgcugaaaaugauuuuaguaagacugaaaaagggcuggcauaagaagugggggaagggagugggaaauaguguauagggagauagcagaggaaaaggaaugauguaaggagaccgagaagcaaggagucaggcagaaggaaugaaacccuagugucugagaaguugagagaggaaugcuucaagaaaagaguuggcugugugcgauggcucacaccuguaauccuagcauguugggaggccaaggcagguggaucaccuguggucaggaguuugagaccagccuggccaacauagugaaaccccugucuuuacuaaaaauacaaaaauuagccugacgugguggugcacgccuguaaucccagcuacucgggaggcugagacacaagaauccugggaguuggaggcuucagugagcugagaucacaccacuguacuccagccugggugacagagcuagacucuguuucaaaaagaaacaaaaacaaaucagccgggccagguggcucacgccuguaaucccagcacuuugagaggcugaggcgggggaucaccugaggucaggaguucgauaccagccuaaccaacauggagaaaccccaucucuacuaaaaauacaaaauuagcugggcgugguggcgcaugccuguaauccuagcuacucaggaggcugaggcaggagaauugcuugaacccaggaggcagagguuauggugagcugagauugugccauugcacuccagcuugggcaacaagagugaaacuccaucucagaaaaaaagaaaaaaaaaaaagaaaagaacaaaaagaaaaacaaaaaacaaaaaaaauuagccaggcuugguggcacgcaccugugguccuggcuacucaggaggcugaggugggaggauugccugagccugggauguugaggcugaggugagccaugaucgugccauugcacugccgucugggugacaggguaaaacccugucucagaaaaagaaagaaacaaaaauagaaagaaaagaaagagucauugaucauaccaggcuauagaaaagucaaagggccugaaaaguguuaaguuuggcagcuaaggggucauuggucacuaugucagagcaguuuuauugugauaguagaagauggaagaacaugggaaaaguaagaauagcaagggcugcugaccuuuuugcucagauuauuuuuuucuagaagcuuggaaaggaagggaaaagagauagugcugaggcaaaaaagagauucaagauuggguaagacauuuuugcuucuugcuuggagaugacaaaaacuuacuaagagccuuugaggaaggagcuaauagagaaugcuggugaagauucaggaacacaaagcaaugggauuugccuugaacuguuugggagauaagguaagcacuucaccuguguucucauuuaauucucauaggauacuauuacggcuuccuuuuuacaggagagaaaaucaagguuuggaaaguuaaauuugcccauguaauuuaguuacagaaucuuuauuuuuauuuuuaaaauuauuuuauuuauuuauuuuugcaccauggccucccucccccaacucuaaaaucuguauuuuuaaacacuauauugcugggcaugguggcucaugcuauugacgccaacacuuugggaggccaaggcaggaggaguuugagaacagccuaggccacauagugagacccugucucuacaagggaaaaaaaaaaaaaaaagaagacagguauggugguacaugccuguagucucagcuacucaggaggcugaagugggaagauugcuugagcucagguguuugaggcugcagugagcuaugauugggcuacugcacuccagccuggguuacagagugagacugugucucuaaauacauuaaugaauaaaacacuaagugaugcuaccucuggcaggggugaugacaucuuuucuuaugagauacaggagggaaagugauaaagauggguuuguagguuggggagcagggaguucaugcuaaauaaucacuucuauuuucuuuucuuuucuuuuuuuuuuuugagacagagucuugcucuugucgcccaggcuggagugcaguggugugaucuccgcucacuguagccuccaccucccagguuccagcaacucugccucagccuccccaguagcugggauuacaggcgcacuccaucacacgcagcuaaucuuuuguguuuuaguagagacaggguuuuaccauguugcccaggcuggucuugaacuccugagcucaggcagucugcccgccucggccuaccgaagugcugagauuacaggcaugagucacugcaccuggccaaaucaccuccauuuucaugaugaaaugaaaggcaaauuuuuuuuacagagugaagaaaaggaaaguaguaaggacuuuagaaggaauaaugaagucugggaauugcugcuguggaguguagaggagccaaccagugccuuagaaaggaauugcaagccaggugcgguggcucaugccugcaauuccagcacuugggagccugaggugagaggaucacuugaaaccaggaguucaagaccagccugggcaacauggugaaacaccgucucuaccaaaaaacaaaacaaaacaaaagccuggcauggugguacgcaccuguagucccagccacuugggagacugaggugggaggaucccuugagcucaggaggcugaugcugcagugagccaugggaaagaaagagcaagagagagagggagagagaggaauugcucagcagugcugaauguggagaccauaaacucagaguaggguugaucuggugguugugagauuuuccuccaauagcgcuuaucuguucagguaagccgggagagaagacaguugguugcagguagcggcaguagagauuaagaagauagggauauuucaagugauagagaggaaguaaggguauauaagagaaauaauggauuggaagaaaaauuagggcuccauggauucaaaaucuuggugaguuagaagagaaggauagugggaguagauaggggaugugauuagagaugaugacaauuguuauauuuuggaguuuuaagauuccagagauagaggccaaggagggcagaucacuugagcucaggaguucaagaccagccuggccaacauggcaaaaccucacuucuaccaaaaauacaaaaauuaucuggaugugguggugugugccuguagucccagcuguucgggaggcugagguaggagaaucgcuugaaaccuggagguggagguugcagugagcuaagguugugucacugcacuccagccugggcaacaagagcgaaacuccgucucaaaaaaagaaaaaaaaaaaaaaaggauuccagagaugaagcagguaagacaauuaggagcucuaaaguugauguauuggguugcauaugggaaugaugaugaaguccacagagauuauggaguguacuguagcagagagggagacuguauucuaggaguggcaggaagguccagaaguaacagcaguaaggauguuuuaaacaaauaauaguaaaaguggcaacuacuucucaccuccucugauguaguauuuauuacagcuauagacaaaauaggaagaaacuuuguacuucauuuuagaauuuugucuugugauaaaguuuuuacccuaacauuuugucaugaagauuuuucaauacacagaaaagucuaaagaauuguacaguaaacacucguauacccaucacccagauuuuauaauuaacauuuuauuacaauuuuauuauguuugcucuauggcaugccuauccaucccuucauccuugaauccaucuuauuauuauuauuuuuuuuugagauggagucuugcucugucucccaggcuggagugcaguggcacaaucucgucucacuguaaccuccgccuccuggguucaagugauucuccugccucagccucccgauuagcugggauuacaggcaugugccaccacaccuggauaauuuuuguauuuuuauuacagacaggguuucgccauguuggccaggcuggucucaaacucuugaccucaggugauccaccugccucgcccucccaaagugggauuacaggcaugagccaccaugccuggcccauuuuuguauuuuuaauagagaugggguuucuccauguuggccaggcuggucuugaauuccugaccugaagugaucuacccgcuucagccucccaaagugcugggguuauaggugugagccucugugcccagccaggaguuuuuaauacugauggagucaaauauauguuuuuuucuuuuaagguuauugcucucuuauaucuaagaacccuuugccgauauuuuccuaauguugucuuuuaaaagcuuuauacuuguagcuuucauagacucugugguccauuucaaguuaauuguuguguugugauacaagguaggaauugaaauacauuuauuuuuaaugcugauaucuaguuauuucagaacuauccguugaagaaacccucuucuuuuuuuuuuuuuuauugcuccuugcagagcagggcugugccauaggcaguaugccuagaguaguagccuguugaagagauuuucuuuucucuauuggauuguguugauauuuuuaugaaaauuacaugauucguguguauguauauaugcagucaguccucugcaucugugcauucaaacaacuguggaucaaaaguaucugcgggaggaggauggggggaaauugcaucuauacuaaauuuguacagauuuuuuuggucauuacuccuuaaacaauacaguacaacuauuuacauaguauuaguuauuauuaguaaucuggagaugauuuaagguaugugggaggaugugcacagguuguaugcaaaugcuacaccauuuccuguaggauuacugagcaucugcagauucugguaucugagggagguccuggaaccaaucccccauggauaccgagggaugacuauauacauacaugcacauacacacacacacacacacacacacacacacacacacacacgcacacacacacaacuguaucuguaucucugucaguuuauuucuaggcucuccauucuccauuuaucuaauuguugauuucucuacuuauaguaaguuuugacguuagguaguguaauacuccaauuuuguucuuuuaaaagcuauguuuuaguauuucuagaucuuuuugaauguuaaucuuucauugcuguguuaaugaaccauggcagauaguauuuuauugaguuccugcuaugugccaguauccuaggcaauauuguguacaugcuuaucucuguuguacccauugacuuuugaaagugguaaugucccaguuguacagcugaggaaauagauuuuaugaggacaaacugcacaagauguuaugacuaguaaggaguagaaucaggauuugaaccuaagucagaauagcuucaaagacaacucuuuauauuccaguguguugccuuuuuugaguaggaaguauaaugcaguacgauggugcucuaauuguccugaaccuuagcuuuuuaaggaagaaguaucucaggagagggggaggcugaauggacagggcuuugaaauccccuacuuuaagcugaggagcucagcccuuuuacauauuggggcuuugcauagaauuucauuuggaaaaaaaggguucuguugcauuaaaaaagguagaauuuuaaaagaugcugguuaauggaaagauagcacagaccauaaaggaacuggcugagauuaauggucuuuagguggcaaugagaagcuaggagacuguccuuguaugcuuauguuuggaagugauggaagugacauuuaauuuauuuuauuucauuuuauuauuuuauuuuuucgagacaaguucucgcucugucauccaggcuggagugcaguagugcgaucauggcuuacugcagccccaacuuccugggguccagcaauccucccaccuuagccuucugaguagguaggacagcagacacaugccaccacacccagcuaauuuuuguauuuuugguagagacgggguuucaccauguugccuaggcuggucuugaacuccugagcucaagcaguucaccugcgucagucucccagugugccgggauuacauaugugagccacugcacccagcccauauaauuuuuuuuuuuuuuaaagacaccaggucuuacucugucaccgaggcuggggugcaguggcauaaucauagcucacuguaaccuugaaccucuaggcucaagcaauuuuugcaccucagccucccagguagcuaggacuacagguguguaccaccacuccuggcuaauuuuuaaaaauuuuuuuuguagagacagggucucacuguguuacucaggcugguuucacacuccuggccucaagugauccuccugccuuggccucccaaagcacugggauuacaggagugagccacugugccuggccagaagugacuuuuuaaauggaagugggaccauaaaugggugaaugaaugaaugaaugagugaauggaaaugagaguuagccaguuaaggauuaggaggaaauaaauuccaaggauuugugguagcuuggaggccaagaggaacucagcauuuuuggaguucugaguagcugaagucuggagugggggccagaucgugugaaucaaauuauugcauuuuaucuugucagcaguggggagcaacugcaggguuuuaagcagggaacugacacacaugaauuuugaaggacugcuguagacuguauggagcauggauuaaaugggaacugaacuguaggcaggaaagccaguugaggagauuuugcaguaguucauggaagggaugauagguggcuuugauuagagcaguagcuguggggauggagaaaaguggacaaauuaauuagagagauuuagaggcagauuggugauugaauugagcagggcagugagaggauucccagguuucugacugaggugucuaaguggggauggugaugaaagggggaauauugggagaggaucacguuuggagggagacuaaggcaccaucaguauucuagagauuagagggcugugagagaauugugauaggagggauuuacucuuuggcagauauccaagcguggaaggccuguuugauggacuguccuugauaaucacaggcagguauagccucaaggcuuugaggauggcucuaaaguacauuucaaacaccaccuccuccacaaagccuuucuacuacaacuccauccccugaguagagugaaucucuucauauucuuaguaccuacagaauuuuggaauagucauguuuaguauauuuuguuuuagcaaauagggaagcaaauacuauauuuuagaaauaguuaauguaaaauggcuagguuuuuuuuuuuuuuuuuucuuuuuagugugaugcuucaaggggagccuuugucauuguauuaguccaggaccucuuagaagcagaugccaagaugggauuaagcacauaagaaauuuguuaggugaaaugcuugugaggggggaaaaggaaggagacagggagaguugucagacugaugaaagucugacuccaaguuaaaagagagguaaggaaggaaggaacuuugagugaaagugucuuagacuguagugcaauacuaaggaaaguuugcaaggccucagaaagucuuugagugaaaggugccuguuggaaaaaugaugugucucccgggaacaggccugccaugcucagucagugacugggaggagcuagugagaaacuggccucgacacaaacacagugauggauuugagugcagcugcugcagcacucagucuauuauccuuccuguagucagagaucugagaggcucguucucaugaucaauuagggucaucucuggcuaugaauugccuaauucgggauaaaguacaguuuuuccccauuucagguggguaauuuguucccaaaaaaccccuguauuuaaaagaaaaaaaaaaggaugccuuaaggugaauucuuaaaagucagaaauuaauuuucauugaaauuaaugguacacaauuuacuucaguagcuaaucauauaaacuuugcauucauauucaauguuuauguaauuaaauacuuaauaugcaaaaccacaaacagaacaguaagacaaaagaaaacaauucaaguaacaccccaaauuuuuacucuaugaacuggugaaccaggaguacuugaggcaaaccagcaguaaguucgugaauaguccaaccauguggccacgaagaugacuccuuguugguuuuccuugcuagucugggcuaccucacaggcagaaaggcgcaaaccagugaaugaaauuccucagaaugucaaauucugguaacuuccuguuggaguugggaguggagauauacaugggaaaauaaguaauuuaaagauuugguuuuauggacccugaauuacucagauguuuuguuuuuuuuuuuguuuuuuuuuuugagacggagucucgcucugucgcccaggcuggagugcaguggcgggaucucggcucacugcaagcuccgccucccggguucacgccauucuccugccucagccucccaaguagcugggacgacaggcgcccgccacuacgcccggcuaauuuuuuuguauuuuuaguagagacgggguuucaccguuuuagccgggauggucucgaucuccugaccucgugauccgcccgccucggccucccaaagugcugggauuacaggcgugagccaccgcgcccggccacucagauguuauuuaagaaaguuuuuuuuuuaaaacuguaacaggaagauuacuugaggaaccuuuaaugcuacuuuaaugcuucaugcugauuuguguguguguguguguguguguguguguacaguagcacagucucagcucacugcagccuccaccuucuaggcucaagugaaccucccacaucagccuccgaaguagcugggaccacaggcacguaccaccaugcgcggcuaauuuuuuuguauuuuuuguuagagacaggguuuuaccauguugcccaggcuggucucaaacucuugagcucaggagauucacccgccugggccucccaaauugcuaggauuacaggugugagcuaucacgccuggacugauuuuuacuguuuugauuuuucuuuuucuuuuugagacagagucucacccugucgcccaggcugaagugcaauggugcgaucucggcucacugcaaccucugcacccagaguucuagugacucuccuaccucagccuccccaguagcugggauuacaggugccugccacuacacccagcuauuuuuuuuuguauuuuuaguagagacaggguuucgcauguuggccaggcaggucuugaacuccugauuucaggucaucuacccaccucggccucccaaagugcuaggauuacaguugugagccagcaggccuggccacugguuugauuuuauuuaccaaauuaguugagcacuauuuguauggcaagcauggauauaaaauuuaaaaauaaaacauaauuguugcuuuuaugaaacuuauaugugguguucaaaaaaaaucuguaaucuguccauaugaguuaagcagcccaacuguaaauaugaucaauccuaguauguagaaaguaguuuggcagccagccuuggugccucacagcuguaaucccagcacuuuaggaugcuguaccagcuugaggccaggaguuugagacagccugggcaacauggugagaccccaucucuauuuaaaaaaaaaaaaaauaguucaggauuuaaaaaaaaaugaaaaacaagucuugacagaauuuaaguuguuuuuaauugauacaaacuuuuuguaguaagcuaacuuaaauuucaguuguucuuuuuuaaugccugaaacaauuauuuucuguguacggcucaguaauuuguaauggaaugcacuuacugauaauuaauucauagauguuuuguuuaagagcuuugcuagggcugauuucuauagaacauuuaauaacuuuuucuuugauuuuuuuuauuguggugaaauauauuuauacaacauuaaauuugccauuuuaaccacuugaaauguacaauugaaggccauuaauuacauucacaauguugugcaacgauuacuaccaucuauucuuucccaaucccuaguaacuucuaaucuacuuucugucucuaccaauuuaccucuucuagauauuuaauguaaguggaauaauaaaauauuuguauuuuugugucugacuacuuucauuuaguauaauauuuucaagguucaucuguguugcaguauguaccagaauuucauuccuuuuuaaugcucaguaauacucuauucagguggacauuuugcaccuuuuggcuaaacuggauacugcagugaacauuggcauacaauuauugguuuaagucccuauuugcaauucaucuggguauguuccuuggaauggaauugcuggguuguuuuuguaauucgcugugguuagcuucuucaggaacugccauauuguuuuucacagaaccugcaauauuuuacauuccuaccagcaauguacacaugucaauuucucuaccuccuugcccacacuugcuauuuucuuucuuuucuuaucccaucuuaguugguguccuuuugguuuguauuucucuaaccaguaaugauauuaagcaucuuuucaugugcuuauuggccauuuguaugucuuuauagaaaugucuauucaaauucauugccccuuuuuaaauuaguuauuuauuuauuuauuugagaugaagucuugcuguugucccccaggcuggagugugauggugugaucuaggcucacugcaaccucugccuccuggguucaagcaauucuccugccucggccccaugaguagcugggauuacaggcaccuaccaccaugccuggcuaauuuuuagguuuuuaauagagacgggguuucaccauguuggccaggcuggucuagaacuccugaccucaggugauccacccccgccucggcuuuccaaagugcugggauuacaggcgugagccacugcgccuggaccauugcccauuuuuuaauuugguuguuuguguuuuugauguugaguuuuaggagauccuuauuauauauucuugauauuagaccuuuauccaauauaugauuugcaaauauuuucucucauuuaaacccaaucaaaaguuuaucuuuuuaguuucuugauaauguccucugaugaacgaaaguuuuuaauuuugacgaagucagauuuaucuguuuuuucuuucauugucuugugcuuuuugugucagaucuuaagaauucauugccaaauccaaggucaugaggauuugccccuauguuuucuucuaagagauuuaugguuuuagcucuuauauuuaggucauugauauauuuucaguuaauuuuuguguuugguaugaguuaggaguccaacgucauucuuuugcuuguggaaauccaguugucccagcaccauuuguugagcagggucuuauuucuccauugaauggacuuggcacaaaucaguuggucauagauguaucaguuuauuuugguaugcucaguuuuaugcuguuggucuauaugucuaugcuuuuucaguaccauauuauuuugauuacuguagcauuguaguaaguucugaagucagaaagugugaguguuccaacuuuuuuuuuucuugauuguuuuggcuuuucagugucccuugcagcucugugaauuugagggucagcauuuccguuucugcaagaaaagauuuuggaauuuugauagagauugcaucgaaucuguacauugcucuagguaguauugaugucaacaauauuaagucuuccuacucaauaacucagaauggcuuuuaauuuauuuugguuauuuuaaauuuucugcagcagcguauuguaguuuucaggguaaaacucaccuccuugguuaaaucucuuucuagguacucuuuuagauguuauuguucuuuucaauguuaaauggaauugcauuccuaauuucuuuuucagauuauucauugcauaugcauagaaacacaacuacuuaaauuuuuuuuuuaaguuauuuauuuuuuugagacagggucucgcccugucacccagacuggagugcaguggcgugaucacagcuaacuguagccucaacuuccugggcuccagcaaucuucccaucucagccuccugaguaguugggacuacaggugcaugccaccacaccacacaucacacuggcuaauuuuuguauuuuugguaagacaggguuuugccuuguuggccaggauggucuugaacuccucugcucaagugauccaccagccucagccucccaaagugcugggauuaugggcgugagcuaccaugcccggccgcaccagucuuucuuuuccagaaucuauauaaccugaucuucuggacuucaaaauccuuguuguuuccccucaccuauaacccuuuuaaaacgaagcggaauucuucuuuuuuuuuuuuuuuuuuuuuuuuugagauggagucuugcucuguugcccaggcuggagugcaguaguaugaucacggcucucuacagccuuggccuccuggguuuuagugauccuccuaccucaaccuagucuagcugaguagcuaggacuacaaguguguaccaccacacccaccuaauuuuuuuuccccuuugguaaagaugaacucucauuauguugcccacacuggucuugaacucguaggcucaagcuauccuccugccuuagccucccaaagugcuggguuuacagguaugagcuaccacaccgggacaaaguggcacuuuuuuuuuuuuuuuuuuuuuuuuuugagacagagucucgcacugucacccgggcuggaaugcaauggcaugaucucagcucacugcaaccucugccucccagguucaagugauucuccugccucagccucccgaguagcugggauuauggggccugccaccacgccuggcuaauuuuugcauuuuuaguagagaugggguuucuccauguuggucaggcuggucucgaacuccugaccuagugauccgcccaccucagccucccaaagugcugggauuacaggcaugagccacugagccuggccuaaaguaguacuuuuuaauuaaaaaaagaaucaaaaugaaacucaauacauaggcaggucauaaaaaaugauuuuuucuuuugcucaagcagugaguagcauuaagcuguucccucaccuucaccugguguuaccuggaguacauuugggaaguccucaacuuugaaaacccuuuuucccuauauacugcugguaauuaaaagcaaaaaauuauucugaaguuugucaagcauuuuauggaggagacauugcuaguuuguuuucuguuuuuuuuuaaguauauuuuaaacauuuccuuauacuccuaauauaaauguugcuuugucagaaauuucaacauuuggaacaaaauuuuuauaguuucuaaauaaauauaauucaaaccagguauaguuaggaugggugccuauaaugcugucaggauacauauaaugcuaugcauaaaguuuauuucuguaucaucuaguuguucaacaguugaucuaggcauaauaaugaaacuacuuuugcaguuugauauaguuuggauauuugaccccuccaaauuucauguugaaauuuguccaccuccaaucucacgucucaguguuagacagugggggccuggugggaaguguucggggucauggggcaggucccucaugaauggguugguaccauccuugucccagagguaaugugugaauuccugcucuauucguucaugugagaauugguuguucagaagagugugacacacuuccccucucucuugccaugugacacauuugcucccccuuuggcucugccaugauuggaaaccuccugagguccuuaccagaagcagaugcuagcggcacgcuucuuguacagccugcagaacuguuagccaaguaaaacucuuuacuuuauaaauuacccagccucagguauuucuuuauagcaaugcaaauagacuaaaagacaguuaaacacauuuuuguuuuuguuuuucuccaugucuccuugcuguauuuuauuauuuuuuugagacaaggucucacucuguugcccaagcuggagugcaguggugcagucucggcucacugcaaccucccccuccugggcuuaagugauccucccuccucagccucucaaguagcuaggacuaaagguguguaccaccacacccagcuauuuuucuuuaaauuuuuuguagagacagggucucacuguguugccuaggcuggucuugaacucuuagucucaaggaauccuccugccuuggcuucccaaacugcuuggaucacagguaugagucaccacgccuggccugcucuuuuguuucuauauguuagacuuuuugcagauuuccauauauaagcgaugucaucaguauuuucuuucagugucuggcuuauuuuacugaguguaauguccucuggguuuauuauccguguaguugcaaauggcaguaucucauuuuuuaaggcugaaugauauuccauuguguguaucuguguguaucacaauuucuuuuuucauucaucugucaguugacacauuguuuccauaacuuggcuauugugacuaauacugcaaugaacacaguagcacagauaucucuaccaggugcugauuucauuuccuuugaguacauacccagcuaggucauaugguaguucuauuuuuaaguuuuugaggaaccuccauuacuguuuuccauaauggcugugccaauuuauauucccauccacagucuacaaggguuuccuuuucuccacacccucaccaacacuuguuaucucuuaccaaaagagucauucuaacaggugugagaugauaucucauugugguuuugauuugcauuucucugaugauuaaugauguugaguaccuuuucauauaccuguuugucauuaguaugucuucuucagaaaaaaacagucuuggccgggcacaguggcucaugccuguaaucccagcacuuugggagggcgaggcagguggaucacuugaggucaggaguuugagaccagccuggccaaaauggggaaaccccaucucuacuaaaaauuagcagggcccguaaucccggcuacuccagaggcugaggcaggagcaucacuugaacuggggagguggagguugcagugagucgagaucgugccacuucacuccagccugggcacagagugagacucugucuccaaaacaauaaaaaaagauauaugguuuguaaacauuuucucccagucuguagggugccuuuugauuguguugauuguuuccuuugcugugcagaagcuuuuuaguuugauguaguccaaguuguuuauuuuugcuuuuguugccugggcuuuugguaugccauccaaaaaaauaucaaggaacuaguauuaaccuauacaauucaguaguuuuuaguauauuuacagagcugugcaacuauugcacaaucaauuauaaaucauuuucaucaccucagaaagaacuccauacccuuuagccaucauccuccaaaccuccagccccagguaaccauuaaucuauuuucugucuuuauggauuugucuguucuggacauuucauauaaauggacucauaauauguagucuuucaugacugccuuuuuucacuuagcaaaauguuuucaagguucauccauauuuuagcauguaucaguacuucauuucuacgacuaaauaguauuguguugcauugauguauacuacauuuugcuuauacauucaucaauagaugaacauuuggguuguuucuaccuauuggcuauuaagaauagcugcauauuuucauucccacuagcaguguggaaggcuuucaguuucuauauuuucaccaacacuugucuuuuuuauucuagccaucuuaguggauaugaggugauaucucauugugguuuucauuuguauuacccuaauaacugaugaugaacauuuuuucaugugcauauugaacauuuguagaucuuguuugaagaaauaucuguucagauccuuugcccauuuuaaaauuggguugucuuuuuacuguugaguuguaagaauauuuuuuuuuugagguguggucucgcuuuguugcccuggcuggagugcaguggcacaaucuuggcucacugcaaccuccaccuuccggguucaggcaauucuccugccucagccuccugaguagcugggaccacaggcgccugccaccacaccuggguaauuuuuuguauuuuuaguagagaugggguuucaccguauuagacaggauggccuugaucuccuaacuucgugaucugccugccucggccucccaaagugcugggauuacaggcgugagccaccgcacccggccaaauuuuuuauauauucugaauguaaguuccuuaucaaauauaugaaucgcaaguauuuuuucccauuaugugaagugaagucuucuuauagauauaguauugugauuaauaacaaauaguuaauuuaggagaguagaguacaagcuguagcagugggaguuuugucagcacacgcuuuuagaagguuucuuccacuguaugaccguguauugaugaaaggaaugugccugaaacuguaaccaaaggagacaugcuuccagaaaaaucucaaggaaaaguauuguaagcaacaguagauguuggaucagacucuaaaguaaaggguggagaguuaaccaguuaacauguaaguuggagauagaguucucccagaauauguaggcaccaaaguaguucuagacaacaaggauuacuucucauuuaaagauggugacauucuugcaaacuauauagacugaaauaaaucauauugaaauggcaucaacaugaagcugcccauucuguaauucugaaaucuucuaucauguaaaauaauuuucaugucuuucuuuuguaauaaacuaaugauaucuaaacuaaugaugcccaguguuucuaaaauuuaguuuugcuguauugauauaaacauuuccuaauaaaaauauguaaauuuaaaaauaguuaauuuaaagcuuauauagauuccaagaaauaauaauguucagcacuuaaacuguuuuaaucaaggguuaagaauuaacuucacugggcaaaguggcucacaccuguaaucccagcacuuugggaggccaaggcacguggauugcuugagcucaggaguucaagacaugccugggcaacauggugaaacuccaucccuaccaaaaaugcaaaaaauuagcugggcaugauggugcaugccuguaaucccagcuacuggggaggcugggaugggagaaucacuugagcccaagccugggaggcagagguugcaaugagcugagauggcgcugcuguacuccagccugggugacagagcgagaccccaucucaauaaaaaaaaaaaaagaaaaaaaagaggucuugugcuuuagaucagugguugccaaacuuuaucaagcaucagaaucacuuggacagcuuguuaaaacauucuuugcuagccugcauucccagaguuucugaaucagaaagucuugaguggggcauccaggaauuuacauuuuuaacagaacauguugaugcuuugguucauggaccgcuuccuuaauggucccuauaacugucauaaagaauuagcuauaugcugauauguaggaaauucuaccugauaaaaaugacaaaauuuuaauuuauagcucauauuugcaucucuucaauuugcauauauuuguauauauaaaguguuauauagucaugguuggugccuaaauuguuggauuucuuuuaaaacucuugccauacauaaagucuacuuuuuuccguaggcuugucuccugucagauccucaugaauuuccuugaguuuaagaaaauaguaaagaauguuacagcuuaaagagauuuuauagaucauccaacucuucccaucccucauagagauugguuaaaucucuuaauccaagauuguguagcuaauuauugguagguauagguagcucuuagggauuuuauuucuggcaauucuuuauauugcuugaagaaaaguaaauauguauuucagccaagauuuuuuuuuuuuuugagauggagucucgcucuguugcccaggcuguagugcaguggcgcgaucucggcucacugcaagcuccaccuccuggguuuacaccauucuccugucucagccucccgaguagcugggacuacaggcgcccgccaccacauccggcuaauuuuuuuguauuuuuaguagagacgggguuucaccauguuagccaagauggucucgaucuccugaccucgugauccgccugccuuggccucccaaagugcugggauuacaggcguggaccaccgugcccggccagccaagauauuuuuagugacuuucaaauacagaucucuuugguaacauuuuauuagguaauaaauaagcuuaagauauuugaaaugacuugauucugugcuaaaugcuauuugauuauuuuacaccaaaguaauacaugaauauagccugauaaauaauuuuuaaaaaguaugucucauaggcaucucuuuuauucuggucuuaaaacauaugagaaagaagauaguugaagaguaugugcuagugagauggggcacagauuuccaucaauaaacuuauguaaaauugaguagaaugaacagguuguuuccuagagaugucuuaaaccuauuagaaaguuuagagggaaugaugaggaagggauauguaauguaaaaauauaaggcuauccucuuccuucuuuuaaaaacuuuaucucuagccaagucugcuuaaggagaaagucuugcuuuccccugucuagguuauagcuuguagauguucauuuuaauacuuacugaauuauuaaaaucuuuuuuuccuuagcccuucaccuuaguagucaaucaagguuuguuuuucuaaauuagaugaucuguguuguuucuuuuauaggaggaauuuggguagccaaauagcuccacauaaacaucuagcuucucagguaucaacuguaaaaugcauagaaaaugcuauuaaacacuaaaaagagauugaaagcaccguugacugacuugugaaauuauuuccuaauugccuuuggucagcacauaccuagacuucuacacacccaacagucuaucucaaccauucuguaauguugcuaaaauaauuuuccugcuucauuguuaaaacucuaaugauuccucucuguccucuuugcacauggcucuauccuauauaaauuucagaauauguggaacugaaauaauuuuuaucucagaagcaaguacuccuauuaaggcuugguguguuuucaucauuuuaauuuugacuagaauagagaacucauuagaguaggaaacgcacuucugccccagauucaggagaaugaggacuuauuucagugucucaaacacaaacuuucgaauguagccugcagaacucugguacuuaugagccacauuuugccuggcuguuaguucucuugauaaccuaggaaauaugccuuaccuuagcuuuuccuaacugaaucucucuucucugcacuaagacuuuuccccuagcuuaaucauagugugucuuccuacaggaagccuuuucagguugaccuguacccaucuaccaguccucaaguaguuucucaaacuggagucucuagauauucucaggagucugagaauucucugagauauaaacaguuuugugguucucuguguagaugcaaacaccauacaucuggugucuacuggaggguggaguugaaaaugaucauugugaaacaaugccagaaucuuucugaaacuuuugcaagcagcaaauuugaacagcugguuuguaacugagguuuuuaaacuucauucagucuaacuguaugaagugccuuacguggcuguuaugguagcugagaggaaggaugaacuggagacugaggacaccacccccauuuuaaccugguuggcccuacuuuuauuuguauuauauauuguggcucagugaagauuucucuugggagcuucucuccaucuaaaaguuuugaaaaccacuggacuaacagguuuauggcuugugguuuugguaggggaauagggaaaaguagcaauguauccuuauaaagaggcuguauguggcuaaguuauuuguaaauagauuuuucauaguuaaccaaacaaagaguccuuagaaauuuuuacugcuaauugggaauguuauuccaggguuaucuuagauugguagauaguaguucucaaguuuuucggucucagaacccccucacagucuuuauuuauuuauuuauuuauuuauuuauuugagaccgagucuugcucugucguccaggcuggagugcagugguacagucucggcucacugcagccugcgccucccagccucccggguucaagcaguucucugccucagccuccugaguagcugggauuacaggcucucgccaccacaccuggcuaauuuuuguauauuuaguagagacgggguuucaccaucuuggucaggcuggucuugaacuccugaccucgugauccaccugccucggccucccaaagagcugggauuacaggcgugagcuacugcacccggcccccuucacacucuuaaaaaauuaucgaggcuccccaaaaguacuguuuguaugcauuauacccaucaauuuuuaaauaaaagaaaaaauuucaauaauuacugauuuauuuaaaaauaaugaacccauuacauuuuaacaacaguaacauuuuuaauauuaagauaacuguuuuccaagaaagaaaaaagaaaaagagaaaacuguuuuccaaaacaaacaaaaaaaaaauuagcagagaguggcauuguuuaguauuuuuugcaaaucucuuaauaguacgaucuggauucucauuuucuguuucuacauucaaccgguuugugauaugcuguuuuaguugaaauauaugaagaaaaacucagccuccuacauucaauauuugaagagaguuaagguauguaacagcuuuuucagauauuaucaauacuguauuuuucuuuaaugucaaaccccacaagugguaguuucuuuuagguuaauugcaacauggaaucugaaacuauagcaaugaacuuuugguuccuuccaguaaaaguagcaauguauccuuuuaaagagacuggaaaggccuuccauuuggcuuuccaugauugccacuccaucacauucaaaagucaaagucguuaagugaucuggccuccuacuaucucucugaucucaucuccagcucugcuggcucugcugacucugcuguagucacacuggucuccuugcuguuugcuccucuaaacaaucucgugucucugggcuucugugcuugucauucccucucauuucuuaacaaauagauuagauauuguguuaaauaaucuuaauuuagugaagaccuaccagaauauauuuguugagugugaaaauuaucucugaacagaacugcuuauauacuuggcaauggcauuguaaucagaaagacucaacaccuuuaugucggacucugacccucuuaugucuugguggaagugaaaguguaagugguaccaagucauuuggauugccaguacuuugcuauagaguacacaaaugugccucauugcaauaacacuagaaguuguuuacuacuguaguuuacuaagaacuaaccacauagaugaucaugcauuucaggaaaauaugauagaaauaggaaagauucuaacccaggucuuaauuauucacauacggaagaauggccuguauaucuucauuauauguguaggggaaaauagugccuaucuuucaagaucauuggaagguuagagauccuuuuguuaaaucauguuaguuuaaaaaaugcauuuauuuaaaaaaguauuucuguaguauuaauaacugauuuuuugacaucuuuguauaugcuuaacguggcuuuuuaagagucacaguuuaccaaagaaguaauauugccucauuaaauuucugaaguuaacauuguagcacuuugauauuuagaaguaaauuaucauuuucauuuuaaacuuuuaauuugggaauuuaaguauuaugaaguuuuucucaaaugccuaguuuggagagacuauuuuuacaacuaauuuagagcuuucaaguggauuuaaauuugucuugcuuugaagauauuuuauuucauaucacgcuuucagauuucuuuuaguuuuguaaaauuucaaguugcuuuuucuugaauuauaaauuuauuuaguguguuuugguuuuuaaucauuucauuuauucauucaacccaccaacagaaaugccaagcaguguucuagauaccaggagaaaucgggugaugagacaaagucucuuacauucugguaggagaaagcagacaaauaaacagacaaagaaauacuguaguuuuagauaacaguaaguaaaauaaagaaaauaaaggagguugugauaaguagggucugagaggcaggagagcaggggauacucuuaaaaauaauggucgaggacagccucucugaggaggugacauuugagaagagaccagaauguucagaagcagccaauaaugcaaaaaaucugguggaggagcacccuagaagaggguaguuaguguaagaucuugaagcaagacaagcuuggggugcgcaagaaacaucaagacaagcaguaugugcagugagccaugauccucccacuacacuccagccugagugaaagagugagacccugucuccaaaaagaaaaaagaaaaaaaaccaguaugacuagaguauagcauaugugaagaagagugagaaaaauuacguuuggagacagagacagggaccacuucauguagggcuuuagcacuagugauaguagaacacucaaggauuuuaggcgaaggagugacauaaacuuaaguuaaaaauuuauggucaauuugugaagaaaaacagacuuuugugggcguaauaaugaagcaaagugauuauuuuagaagaaagaggugauggcaguaugaacuaguaguguagguggugagaaaugaucauaauugggcuauguuguguccauuggaguaaaccauuaggagagaauggugacuuggaaguuaaaugaagaaggaguggcaagaaaguggaaguggucaacugucauacugccaagaggucagaugagaugcgggcagggauuuaguccuggccguauuauagaauggcauccccuggugaccaugacagcccuggguggagaagccuggggggcugguauagaaaaggugacuguggagauccuuuugaggaaucugccucugaaaggcaaagaauguggugaacacugggggaugugaggacaaggaaaacuuuuuuuuuuuuuucgaguucuuuuauaugccaauaggagugaucccguuauguuuaaguucauuuuuuuguucaugaaugaggugaggcuuuccugagcuaaaacaguagaaaaaaggaguuggaaaagaguuaaggggcuuauagacgauuauuuauaccuaugggaaaguugaauuuuucauuuggauucacaggugaaacaucaaaaguugaacacgcugcauuauguaauuucauucacuuauucauaguguaguacuugagcugcuuaaguaccaggaacuaggguacaaagguaagacaugcucacuacccucaaggagguaaaaauccagcaaauaaacagauguguacacucucacugcacaaaggacauuccucagaccagcaguguuggucccaccugagagguugauaaaaauaccaaaugcuuggccaggccuaguggcucauaccuguaaucccagcacuuuggcaggccaaggcggguggaucaccugaagucagggguuugagaccagccugaccaauauggugaaaccccgucucuacuaaaaauacaaaaauuagccaggugugguggcgugcaccgguagucccauuuacucgggaggcugaaacaggagaaucgcuugaacccaggagguugagguugcagugagccaaaaucgcaacacugcacuccagcuugggugacagaaugagacucuguuucaaaaaacaaacaaacaaaacaacaacaacaaaaaauguucuacccaagaacuacugaauuggaagcuguauuuuuuacaaaauugcuaggugauuuaaguuugaaaagcacugauauacauaaacuauacauuaaaaagaugugauaagcacuaaaguuuuuguuuguuuguuuguuuguuuguuuguuuugagauagaggcucguucugucgcucaggcuggagugcaauggcgcgaucugggcucaaugcaaccuccaccucccagguucaagcaauucuccugccucagccugucuaguagcugggauuacaggcgccugccaccaugccuggcuaauuuuuguauuuuuaauagagaugggguuuugccauguuggccaggccagucucgaauuccugaccucagguaauccgcccaccucggccucacaaagugcugggauuacaggcaugagccaccacaccaggccugcuaaagauucuuacaaacaaaaaauacuguauguaagagcucaguuacuauguuacuaugucaaccagcccccagcccccacaaagaagagaaaugaucauagaggaaaaaguuggaucagacauuucucuggauuggcauauuaaaaggugcuugauaagaguuuguugaacuaaacuagcccuaggcgcuaccauuugaagaugaauuauuugcuauuuaguagucugcauuuaguguuuaugcacagaguguuuuuuuuuuuuuuuuuugagacagggucucacucuguugcccagacuggagcgcagugguguuaucucagcuuaccacaaccucugccucccaggcuuaagugauucucuggccucagccucccaaguagcugggauuacaagcgugugccaccaugccuggcuaauuuuuuuuuuuuuuuuuuguauuuuuaguagagacgggauuucaccauguuguccaggcuggucucgaacuccuaaccucaaaugauccaccuuccucugccuccuaaaguacugggauuacaggugugagccgcugugccuggcccagaguuuuuguaaauagauuauuucaauaaaaagagugagauucagaucucagaaagagaggauaaaugaaagccaagauuacaucaguugauugacuauacuaguaccaugaacaugggaaguguuaggauaugaagauaagugagacagucacugcccucuaguaggagacucaaggacauuuauuuuacuuuuuggguuauaauccaauacuauugcuacuuauuuuguuguguaaauuguugcagcguuggucauugggagcuuuuuuagguuggcuucuuuucuuucuuucuuuuuuuuuuuuuuuuuggagacagagucuuguucuuguugccuaggcuggagugccauggcacaauggcucacugcaaccuccaccucccaggcucaagcaauucucaugcuucagccucccgaguagcugggauuacaggugugugccaccaugccuggcuaauuuuuuguauuuuuaguagagaugggauuucaccauguuggccagucuagucuugaacuccugaccucaaggugaucugcccauguuggccagggauggccaaagugcugagauuacagguaugggccacugugccgggccagguuggcuacuuuugaacacuacuuuaugagucaacuuucuugcucguuucuucccuauuuugagggcugccuaauauugaaucaguguuuuaugaagaauaugaucucuuaacuggccacucugucaguaucacgagagguguuuuguuuuguuuuguaaaggcacacucaucauuagcgaaaugggaaugaaaaccacagugagauaccacuucauaccaauuaggguggcuauuauuuaaaauaaaaaaccaaaaaugaaaaccaaaggacagccauauggauguaaagaaauuggaaacugugcauugcuggugggaaucuaaaaugguauagcuucuguaaaaaacaguauggcaguucaucaaaaaacuaaauauagaauuacuauaugaucuaguaguuccacuucuagcuauugaaagcagggauuugaacagauauuuguacaccaguguuuauaggcagcacuuuucacaauagccaaaagguagaaacuaaccacaugucaguuaccagaugaauagauaaauguaguauauacaugcauguaauagaauacuauucagcccuagaaaggaauagaauucugaugcugcagcaugggcgaaucuugaaaauauuuuacuaagugaaagaagccaaaaauaaaaggacaaauacuauaugauuucacuucugagauaccuagaauaguucaauucauagagacagaaaguagaaugguaguuuccagagccugcagggaggaggaauuggggaguuauuguuuaacaggugcagaguuccaggccaagaugaugaaaaaguucuggagauggauaauggugaugguugcacaacaaugucacugaauuaugcauguagaaaugguuaaaugguaaauuuuguguuguguguauuuuaccacaguugaaaaaaaaagucacuuccuucgcuccaucucaggcauacuaaaguagaauuucuaguggucgggcccagaauccugcauuuaaaaaaaaagaaaaaagcuuuucaguuuauuguuaugcaugguuuaagaaccacugauaggugggauuaucuaauggaaagugggguaaacuggauuuuguugguauuaucuuuaaagagaaauuuauccgauugaugaauuaaaguauaaucuucaucuagauuuuuauguuuaauucagcuguuaauauuuacacauuacuucaugugguaaugugaauaaugacuacuaauaauuauuuagcauucuaccacauuuuaaagcacuuucggcugggugcaguggccugugaucccagcacuuugggaagccgaggcaggaggauuacuugagcccaggaguucaagaccagccugggcaauguggcuaagccccaucucuaaaaaaauuuuaaaaauuagcugggcaugguggcacacaccuguagucccaguuacgcuagaggccgaggugggaggaccucuugauccugggaggagaggggaggcaaagguugcagugaaccaagauugcaccacugcacuccaaccuggguuacagagacucugucucaaaaauaaaauaaaauaaagcacuuucugauaugugaucucauuugaucaucauguuauccucugguggugauaauugccauuuucaggcgagacgcuugagacuuuggagauugaaugaguugccuaagaucauacagauaaagucagauguccaagauagaucugauuacaacuccucuuagcagucuccaagaaaagagcagguguuauucaggccauuguaaauauucuguguuuaauuguuuugugacaaaaauguaaaauuacuaaguuaaucaugaaccauagacuuaagaccacuuuauuauguaaacauggcuguuaucauaugacagcuccacuguucuugccauguuggcagugguuaauauuuacgaaacuaagauacuuuauuuugucuaggaaaguauucuuaugaaguauuacuauguuaauacuuaauaaauacuaauuaauaugauuuaucuggaaaucuaaagcagaucuaugauucuguggcaguuuuucuucccuugcauugaagcggccucuauacccaaccauuugugcauaauacuauaauuuucaaaaacugucaccagaugcaguggaucaugccuauaaucccagcacuuugggaggcugagguggguggaucaccugagguuaggaguuccaagaccagccuggccaaaauggcaaaaccccgucucuacuaaaaauacaaaaauuagccagaugugguggugggcgccuguaaucccagcuacuugggaggcugaggcaggagaauugcuuaaaccggggaggcagagguugcagugagccaagaucaugccacugcacuccagccugggugacagaaugagacuccgucucaaaaaaaaaaagaacaacaacgcaacugugacuauuucccuuuugaagaauguauuugccacaguugagcccaggagucagcagacucccuuccuuuccuagaacauccagccauguuuuaguaaaguagaaagauguggggaaaagccguuucuaguguuccuguuuuacacuaauuuuccucuggccuuccuguuuaccaacauggaauugucggggaagggcauuuuuauuuuauagugauuuaauaucuaaccacuucuuauuuugauaggauagggcauuauaugauaaaaucauuaaaaauguaauucaggcuugcuuaccaauaucuaauauguuaaacugccuauuugcuaauugcaugucugaaagaucucaagcauaauggaguccagaacucuugaucucuuguucccucucccacuuaugaaaacaucugcucaucuuacaguauuccuuauccuaguauaugcaccuguaucuggccagugaucugggcccuaccuaacuccauuucauuuccuuuacucuucccuucacuuguauauagucugcuuccuuugccuagaauguuaucccucucacuucaccaauauacuuuucaccuaaauucugcucacccuucagcuuucaacuuuaaucuuuuccgaaccacuagauuaacuuaggcacccauuuaguagccucuugguauccuguacuuuaacaagaacaucaauaauggcuacagguaacguuuauuaaagauuggcaauauauugguauguaauauuaccagaaggaguaaguaauucgugcaggguuacacucugguaauugaaagaacaaagauuuuaauguaggcaauguagcccacacuuaaccuuuuuacuacucugccucuuacauaguuauacuuuuguuuauuauuauguuuaaauaaauuauuuguuuaaugucuaguuccccuauuguacuucuaagcuccuugaggguggggccugugucucuuauacuaucuguugaaugugugcauauaucauauuugggauauagccuuugcauuacucagaaagucugaaaauugauaaaaauuuguagguggaauucacagaugacauugaccguuuuauugucuacaaaugaugguuucuauaaaugugaagcaaucuguuuaguucaucuaguaaaucaguuuacugugaagugguuguauaucaaggaacgugauucauuuggagaaguuugaauuugaaaaguuuuuuuccuugcuuguuauggcuuugguuuacuaaaaacuagaaucuccugcuuagagguuaugggcaaauuaauuggugaagauaguagaaagacacuuggaucacaguugcuaucuguuggcauuuuaaggaagacugccaaugauagacaguagacacacaucacauguauugugaauugccauuccagcuuaaaaauaccucuuaaaaugugguugaaacuuaaaauaggguaggauaacugcaugugguggcccaugccuggaauaccaauacuuugggaggccaaggcaggaggaucgcuugagcccaggaguuugagaccauccucagcaacauagugagacacccauuucuacaaaaaaaaagaaaaauuagcugagcauggugguguaugccuguagucccagcuucucaggaggcugaggugggagaaucacuugggcccaggaggucaaggcugcagugagcugugaacacgacacugcaguccaaccucaugacagaguaagacccugucucaaaaaaauaaauaaauacaaauaaaaauaggauaggauagaugggaacacuagcagagaaaacacugggaauuugauaaagcgccccaucugugucaggacaucauugauaaagggauacaugccacuuuuggaagauaaagagcauaguugaagaggaacuaaaaaaucaucagagacucuuuucuugagucaguuccuugcuuuauuggugggaacucuguuaucacauaguaauauuuuuaaaaaguuguuuaggaaggucauacuguuuuuaaagcaaaacacaugaaaaaugauaugaauuuagcacuugacacauguuuggaauuugauguguauaguuauuuucugugggaaaggacuuuaaauaugucuuucccauggcuaauauauacacuggcguaaaccacauaccaaugaaaauuuuuaauuaaauuuauauuuuauuuuauauacacauagacauaaauguuauaaaugugcacaaauaugaguaauuuuuaguagagcuuugggggaggaaugauucauucuuucccccuuuuucuucucuucucuucacaucccugccuugcccaggaccauuuauaacccauguugacaacaaagguuauauucuuccauauuuuucuccaugcuguccugcucguguauaaauauauacuuaauuuauaauuacacauacacguguauauauguauaugugguuuuuuugagaauucuauguauuuuacauuuuuuaaugaguuuucucacuuaagaauaccuucuuuuuucacuuaagaauaccucacuuaauagcucuaauauguucuuuuuaauggcuacauauauaguuguauuaguuugcuaggggugccauaauaaguaccacagacuaaguggcuuaaacaacagaaauuaguuuucucauaguuuuggaggcuagaagcccaagaugaagauguugguggguuguuuuuuucugaggucucucuccuuggcuuauagauggcugucuucucccuguuucuucacguggucugucuucuguguucaaauuuucuccucuuauuaaggauaccagucuuggauuggauucaggccuacccuaaugaccucauuuuaacuuaauuaccucuuuaaagacuuuaucucaaaauacauucacauucugaggugcuggggcuuagggcuucauaugaauuuuggagggacacuauucagcccauaacaaucauauuccacaguguauccaaccauucccuuacugguggucauuuacauuauuuuuguuuuuugccaccaugcaauaaaaucuuuguauguauauccuuuuauuuuuacaggauaaauucccaaaaguggauuuucugggcaaaggauauauuuuaauuuugauagugguugccagauuacuuuucaaaaagucuuaucaguuagcauuucuacuuguaagguaugagaauaacuuuuuccaagaacagucuauauugaggaucccucuucccaucuuucuccucccaucuacuccucaacugcuuauaauuuggguuuugcuccagcuacucuauucauauucuucuccaaaggccacuaauuaugugcuauugcuacauuaauuguucuuuuaaaaauauucuguuugcguuuugcaacauuugaagcuccuggagacugguuuuuguauauuacuucuccugacuuccuuaagaauauacccuaaccaccauuuccugauucuuuugccucaucuucaucugcuugcugcuuggauguaggugcuucacuagauuccauucugcuuuaaauugcuccuguccaccuuggacugggagauuuuuaucuacuuguacuauuucuauuaccugugugaaaguuaaucauccgaauugggucauuuuugucauacccaacuaaaucaguagaggggccaaggggaaaaagcauucagggucuguaacauugcucuagaaauguaauucucugcaaguccagcagcuagaacugccuauuuauauaaacaaaaaccaauuuuaucuacgucugcugagauaacuugcuacaacucugggacuaauuuugcucaccaacuggaguuugccagcuccccaaagccuuacuaauaccgauaaacuuucuaucaagaccacauauaacauuuccucuucuuuauaaaacccccaaccauaucuuuguuguuuggacauacugaagaccacccagucuacguguaugccccaaaguacaauucuuucuucccaaauaaaacguuaaauuuagagguuugcaucuacauuuuuauuuugaccuugacaccuguaggugauugguugaauuccagauccauguuuucggccuuaagcucucuuuuuuaaaaaaauuaaaauaaaaguaauggaacgcuucacaaauauacaugucauccuugcgcaggagccauccucaucucuguaucguuucguuuucaguauacgugcugccaaagcgagcacuaagcucuuuuuugagccucagaccuagcuagauuucaaccuguacucuaauaaauuuaaaguaaaauuuaccguaagauaccucugggguuuuucucuguuucucuuuauucuuucauuaacauagauccaguuuuuugguuuuuuuugccagaaauguagaggaaaaggaaaagaugcaguaccacaaagcuaacaauagagcaagugauguaaguucugugaggacuggaacuuugucuuauucugcuuuucccagaugccuacuauacugcuuagcauaugugaacccaucuaaaaacaaaauccaccaaaaaacucuuaugaauuaaauauuaauaauuaacuauuuacuauuuccaauuagucuuaaagauugaacaggcaaguuuuguagcggggauguggggauggcuacuggguacaaaaaguaauuagaaugaauaagaccuaguauuugauagcacaacagggugacuagucaguaauaauuuaauuguacauuuuuaaauaacugaaaguauaauuggauuguuuguaacacaaaggguaaaugcuugagggaauggauaccccauuuaccaugacauaacuauuaugcauuacauaucuguaucaaguaucuuauguaccccauaaauauaugcaccuauguacccacaaaauuuuuuuuaaaaauugguuuuaccaaaaaagguugaauaagcaaguuuuuauaaaaauauuuaccaauauuuauuaauuuaauaacuaugaacauucuuuuuuuuuuugagacagagucuugcucuguuggccaggcuggagugcacugaugcuaauugcaaccucugccuccuggguucaagugauucuccugccucagccuuccaaguagcugggauuacaggcgcccgccgccaagccuggcuaauuuuuguauuuuuaguagagacggcguuucgccauguuggccaggcuggucucgaacucuuaaccuuagguaaucugccugccuuggccucccaaagugccgggauuacaggcguaagcuaccgugcuuggcaaauuuccuuuaucuuuuuuuuaccgaggacagucucacucuguugcccaagguagaaugcaguggcgcgaucucggcucacugcaaccuccgccuccaggguucaagugauucuccugccucagccuccccagaagcuggcauuacagcugcacauugccauggccggcuaauuuuuguauuuuuauuagagacgggguuucaccauguuggccaggcuggucucgaacuccugaccuccagugauccgccagcccacgcuucucacagugcugggauuacaggccugaaccaccacacccagccacuaugaacauucuuuacuaauaaauaaacacuaucuugcauuacagcuacaaaaauuauuuuuuguucuuguuuuugagacagggucuccagccacuccaggcuggagugcaguggcaaaaucauggaucacugcagcuuugaacuccuggggucagcuuccugaguagcugggaccacccaaacccagcuaauuuuuuuauuauuuuuuuuuuggagagacaaggucucacuuuguugcccaggcaggucuugaacuccuaggcucaagcaauacaccugccucagccuuccaaagugcugguauuauaggcaugagccacuguuccuggccuuacaaaaauuauuuuguagguuguauuuuagcuagccuaucacaauucuuccaaguuuuuaaaugguuucuguugcuuauaaaauauuauuuauugauagccaacaaauucuaauuuggguauugcuaggcuaucagugcaaaaaaaaaaauugcaguuaaaaacuuguaaaaucucauaugccuaaauaccaggaccgcguuuauaguuguaucaauuuauuuguuuuucucaauacucagcauccaaauuaaaaauaggaguauuuuuguuuacuuuaaaaagugauauacuguuuauguuuuguaacauucauugaagaaaauacuuaagacuuucaaaacuagaaaaauauuauuuuaauuucuuaaagcuuugaaauauacauugaaaagaguacauauaaccucaguuuaaauguucaguuuaaaucagggguccccaacccccaggcuacagacugauacugguccauggccuguuaggaaccaggccgcacagcaggaggugagcagugggugagugagcaaagcuucaucuguauuuacagccacucaccaucauucgcauuaccgccaaaacuccgccucuuuucagaucaguggaggcaucagauucucaggagccuguugugaacugugcaugugaggcaucuagguugcguacuccuuaugagaaucuaaugccugaugaucugucacugucucccauucccccccauaugggaccaucuaguugcagaaaaacaagcacagggcucccauugauuguacauuauggugaguuguauaauuauuuuauuauauauuacaauguaauaauagaaauaaaguaaacaauaaauguaaugcacuugaaucaucccgaaaccauccuccccacccgagucuguggaaaaguugucuugccuagaacugguccuggugccaaaaagguuggggaccacugacuuuaggcaugcuuccccacccaccuccuccuagucuguggaaaaauugucuuccacaaaaccagucccucaugccaagaagguuggagacugcugguuuaaauaauaaugaaaugaacauguauguaccuaacauacagguuaaaaaaugaaguauuucuggccaggcacaguggcucaugccuguaaucccagcacuuugggaggccaaggugggcagaucacgaggucaggaguuugagaccagccugaccaacauggugaaacucugucucuacuaaaaauacaaaaauuagccgggcaugguggcacgugccuguaaucccagcuacugaggaggcugaggcaggagaauugcuugaacccaggagguggagguugcagugagccgagaucacacuacuacacuccaaccugggcgacagagcgagacuccgucucaaaaaaaaaaaaaaaaaaaaaaaaauucgaacacuuuuaaaggcuucuuugguuuccuuacugauuacaucuucuuucccuuccccuggagguaauagcugaguuuuagauuaaucaacuacuuaaauuacuuuauaguuuugucauuaaguauaaauuaauaaacaaugaacauaguuugguuuugcuuuuuuaugaacuugauauaaauggaucguauuguuucuauuguucuguaacuuauauuuuugccccauuuuauguuuuggagauuucauuuauguuauuguguaacuuuuaggucauucauuugugcugguaaguaauauucauuuucuaaaucuacugcaauguauuguuaacauuuuugugcuuguucaucuguugugcacauauaagaguucuauaauguagcaguccucaacuuuuuuuuuuuuuuuuuuuuuuuuugggagacagagucucccucuugucacccaggcuggagugcaguggcgcaaucuuggcucacugcaaccuucaccucccagguucaagcaauucuccugccucagccucccaaguagcugggacuacaggcguaugccaccgcaucuggcuaauuuuuguauuuuuaguggagacaggguuucaccauguuggccaggaugaucucgaucucuugaccucaugaucugccugccuuagccucccaaagugcugggauuacaggcaugaaucaccgcgcccggccaguccccaaccuuuuuggcaccagggacugguuuuguggaagacaauuuuuccauggugggggaauguuuuggggauaaaacucuuucaccucagaucaccaggcauuagauucucauaaggugugcaaccuagaucccucacaugcacaguucacaguaggguucacggucccaugacaaugagaaucuaaugcuccuauugaucugacagacagagcucaggugguaaugcuccccgguaggcugcucaccugcucuguggccugguuccuaaugggguuugaggagauuuauugguuggcagccagguguuggggacuccuccaauaauguacuuagaaguagaauugcuggaucauaauguguguguguauuugacuuuacuaaguaauguuaaacuuuaauccaaauuguuauuuuauauucccaccaguaaugggugaaaauucacauuucuuuaugucuuuaccaauacuugauauucuuagauuuuagaauuuuugucaaaauaguagguguaaaauaaugucuuaugguuuuuauuuguauuuacuugaauacaaauaaauacaaggcugaggcuugagauugagauugagauugaggcugagcaccuuucuaauauuuauggggcaguuguguuuccccuuccaugaaaugucuguacaugacuuuugcccauuuuagaaaacugaggauuuguuuuuauuaaaacuuuguuauuauuuauccuggauauuuccuuuauagguuauaugugucccagugugugacuuaucuuuccacuuuuugugauauguugauuaagcaguaguucuuaaugaaauugaauuagaauuuuucuucauuuuauacuucuugugucuuucuaaauaaauucuuuccuaacucagguuauaaagauauccugcuaugcuuuuacuaaaaguuucugaaucuuuugcuuaucaccguuauguacuugauccaucuucaguugguuuuuauauaugguaugugauagggaauaauuugccaauguccuagcacuauauauuggaugauccauccuuuccucaugaaucuauacuacuggcucuuguuuuauauuauuuucauacaagaucuguauacaagcucuccauuacgguggucuuucuguuucugcacuaauaucuuaguaucuuaaucacuguagcguaaucaugucuuuaucuggcaggaaaaauaguuuuuugccugauuuuucuuuaggagugccuuaguuguucuuggcucuucuaaauuuaggaucagcaucucaauuuuucagaaaauuguuucaauuuuaauaggaauuauaauguuuagaguauaggacaauugacaucuugagauauuaugguacuuccuuaauacuauuuaaggucuucuaaaugucauucauuaaaguuuaaaaauuuuucuucauaaaggauuuucuuucuuuuuuuuuuuuuuggagaaggagucucacucuggcacgaucucggcucacugcagccuccgccuccugggaucaagcaauucuuagccucagccucccaaguagcuaagauuacagaugcacaccaccacacccaguuaauuuuuguauuuuuaguagagacaagguuuuaccauauuugucagccuggugucgaacgccugaccucaagugauccaccugccuuggccucccaaagugcugggauuacaggcgugagucacugugcccagcccauaaagguuuuauacacauuuuauaagauuauuuuccuaauuauucuauuacuuuauuuuugcaacuaucauuaaaaaauuauauuuucuguuuguugcuuauguaggagugcaacuaucuuuuauagauuauuucaacaauuuuacuaaacucacuuauuaacucuuguaauuuuucuauagauucuuuuggguuuucaauuagaauaauuauauuaccugcaaauaauaacaguuuuauuccuuccuuuccaauccuuuuuaucuuauuggcuaggaccuccagacaauguugaguagacauugugauaguagguauccuugucuugucccugguuuuaaagguaguucuuuuaguauugcacuauugauuaugauuuuuguuguacacuuuuuguuuauauccuuuaucaaguuuaggaaauguucuucuauuucuaggcccugaguuuuugcuuguauauuuguuaggaaccaugaauuguuaccuuuucugcaucuauugucauuuuucuccuuuuaucuguuaaugugagaaucacaaaagauuuacuuuuguugaaccagucuuaguuccugaaauaagcccaagucggucaugguguaguaucuuuucuaaacauuccuaaauuugguuugcuacccuuauuuuuuuuuuuuuaagguaaggucucagucugucacccaggcuggagugcagugguugaucuuggcuuacugcaaccuccaccuccugggcugaagcaauucucccaccucagccuccccaguaacugggaccacagaugugugcuaccaugccuggcuaauuuuuguauuuuggguagugaucgguuuuugccuuguuacccagacuggucucaaaacucuugagcucaagccucagccuccuaaaguggugggauuguaggcaugagccaucacacccggccaaguuugcuacuuuugcuuaugauuuuuuuucaucuauguccaugaacaguuauucuuuccuagauaguguugguuugguuuaaugucaguuguacacagcacacauuguauaagguuggaauugucuauuucuggaaagguaaaauuacauucuuugugggaagauuuuaaaccuuugauacaauuucuuuaaugauuagaaaaccauuagaaauguuuuauuucuuuuugagucaguuuugauaauuuauaauuuuuaggaauuuguucacuuuaccuaaauguucaaagcuugauuugaaguuuuucauaauuuucucuuuuuaaacuguuauguuuguaguuaugccccuccuucuuguguauaauacaguaguauuugugccuucucuuuuuucuugaucuuuuagcaauuuuucuauuaguacuuuucaaagugucaacuuuguuuuuuauuuuuuuaauuuaaaaaauuuauuauaauauuuugagauggagucugucuguuuucuccaggcuggucucggacuccuagacucagguaauccuccuguuucagccucccaaguagaugggauuauaggcgucaaccaccacacgugacuuucaaguuuguuuuuuauuuauuaacuguugcuuuucuuuauuucuuuccuucuuuuagaggagaaaaaaaggcugaaaaaauuuaggagccacuugauaaaaaaagaauuucagguuuguuucccuagauguaauacaagaaccuuaaauucauaugucaaacuugaauuucuuaucuuuccuggaaaauauugucuucuaguauuuccuguccuaaguuggugguucacucuuguugcugcccccaccacccaaaaaaauaguuauccaagccuaccuccuucuaccuuaacaggcccuucuuucccaccucccacuguuugugccucgguccaggucuucaaucucucuucuuauggagccuguggcaucauuccaacuaguuuugcuuccuucaaccucaucucuguuaacccauccuucauacugacauuuuugacuucagcaaacaguccaaugauguccgugucucacuuaaaaccuuacaauuauuuucugcuacccugaucacuucccaacuccuuagcaugauauacaaccugcgccuuccagucucccuacauguacuuuuugguccaugguccaacuuaguuuccccaacacaucauuuuguucuuagucucugugccuuuuuuuuuuuuuuuuuuccuguugaggcagacuuuugcucuuguugccuaggcuggagugcaauggcacgaucuuggcucaccacaaccuccgccucccggguucaagcaaaucuccugccuuagccucccaaguagcugggauuacaggcacgugccaccauacccggcuaauuuuguauuuuuaguacagacaagcuuucuccauguuggucaggcuggucuugaacuccugaccucaggugaucugccugccucgaccucccaaagugcugggauuacaggcaugagccaccgugcccagccagagaaaauauuuuuaguuuauuuuauuuaugggaaagauguaagugcucugauuuguuugauuuuugucuuuuuuuugucuuuugcucugccucucggguucaagcaauucuccugccucaguugggacuacaggugugcaccaccacggcuggcuaaguuuuguauuuuugguagagaugggguuuugccauguuggccaggcuggucuauuuuuuuuuuuuuuucuuuuuucugagaugcaaucucacucugucacccagacuggagugcaguggcaggaucucagcucacugcagccucugccucccggguucaagcgauucuccugucucagccuccccaguagcugggauuauaggugggcaccaccgcaccuggcuaauuuuuguauuuuuaguacacacgggguuucacuguguugcucaggcuugucucaaacucgugaucucaggugauccacccaccucggccucccaaagugcugggauuacaggcguaggccaccgcgcccagcccaggcuggucuuaaauuuuauuucuugaugaaagauuuuugccuuguuuuuuaaccucagagugauaagcaccuaaagcaucaaacauugacuaaagaauuguaacacuaagaaagagauuugauuauuccgaucuuuauuacguuuuaucucaaauucugucuuuauauuuuuaaauaaaaguaacagaucugagcucaagacaugacagagcauaauuuagaagcuuuuccaauucuccagaaagccauuagcuagcaagggauaugaaagauucaucagaauucaacagaguauuuucuggcaguuuacccaagggguucuugaauacacuuggagaacucauguaucaaacaacuaggaaucgauauacaccuaaaucccuuugccuuuucagacuccacaaaaccuggcaauaauagccaauaaaguugcuucagaaucugcuggaacuuacuagagacaaaaugaacugucaagauagaaucaaguaguccuuaaggaagguuuauaauucaagaguuuucaucuuuaauugaauauagugauuacuccuuaaaagaacaguuacuauaaaauucuuauuaaggcuguuguuaauuauuuaguaaaguauuugcauuaauuguacuuaaauuacuuuaagaaaauauaaagaaguauaugaaauuuucugugucaguaaacauaaguauaaaauguaauguuuuuugaaaacuauuagguuggugcaaaaguaauugauguuuugccauuaaauggcaaaaccgggaaaacccacauaguuuagucccaauuugaaaugcuuauuuauaauugcucauaaacacacaugcaacucugaaucagcuguacauggcuucugaagacugccguaagauuugacaggguaaccuauucuguauagaguuaaauaacuuggaucauuugaucuauuaaaugucucugaguaccauuuaugauggaauggagcacuuuggcuguaacacuaucucauggaauagaaguguguuuauucugccuacaugugaaauauaauacuacuucuguuugcucuuuaaagaaauauccuaacagcaucuucuugaaagaauaaagaacagccuguguauuuuuaggaguugguacucugcuugcguuuuaaguauggaccauugccuuuguuuuucaguuagaguuuuuaaguuuuauuuuuguuuuuaaggggguaaaacaauuuauugaucucuuaaauacauggaugaguuuugugauucccauuugacagauuuuaagaugugaaaaugguuaaugucuagaagcuuagaagugcaguuggcaucacguguuauuuucuguuuaagcuaauucuuuguuugauuuauuuaauaguucuuauuuggauauuaguaaccaucaauaaauaaaacugaauaugaauuuccaaaauuuugcuuauacaaagugccaaacuuaacauuugaauuauaugugcuagaauuauaagcaguaucacguuguugucuuuaaccauugcauuuucauugcauuguggcuauauacaacucuacauaauuaacaucuguuuuaguucuaacugcuuuuguguugugaaugguuucugcuuuaaaggcuuaugcuccugaaaucaaccaaacaaccaaacagacucucuagucuuaccaucacaccuuuucaauuuuaauuccaagaaagaaauauuuuauuccccucaccucuauaacacagaagccuugaguauccccugaaugucagggguuuagagugaaaagcaaggagaaaauuauaaguacauaaagcccugcccaguuggaacaucacuauccaaaaaaggaaacagacaagggaacauguaauuauaagucaacaugauaaacccaauaacagaaaugugauauauaguauagggauuaacccaguaagaguauaaggaccauacaagcagggauuauauuugauucauaucuguauauccaauaccuaacagagggucuaguauuuaauagauucaacaaaucaguuaaaugaaugagauuaauucugccuuagagauaagaaacaagaaagucuuccuaaaugggguguaaucuggguuuugaaauucaaauagcuuagaagaagaaaaggacaaagaaaacaaguugaaaaaaaaaaaaaagccaaauaggcagauaaaaaaacuugagagaaugaaugacaggcauggggaacagugugagcgaaacugcaugccguguuuuagcaaacugcgaauaguucagauugcauuagcauaaaguguaaauugaagagcagcuggaaauggagcuauauuagugaagaauuauauacauggguuucuuugaaaaacagugaacuuuacaaaaaaaacuuaaucauacuuucuugaauacuuucuaaaacaucuuuucgaaugucuagaccccuucuucaaaggccugugauauuuuuaaaagguaauucgaauuauugaugaaauacuuucauuuuaacauuuauuaucuucucuaacauuugagauuuauaucagauuuugaauauaauuuuauauaacuuauaaacauugggauccuuuguguaaccaaugaugauuuucccuuuucaaauuguaaagauuuauaggacuguaguuguauuuaugacaugagauagauguuuauuaaauaguaugacaacauacuucaagccaaguuuuauauggaagcccacuauauaaguagauaugguccaugggcauccacuccguacacuaggguacuccgcagauuccuccagguucaacagucaaggguuuaguggaaagaggcaggaggcccagguucaauauuugcaguauuacuaguuagcaacaggauuguggguguaucauuuuucuuucucaucaucuaaauagagggacuggcugggugcaguggcucacgccuguaaucucagcaccuugggagguggagguggguggaucacuugaggucagggguucgagaccaaccuggccaacaugguaaaacccggucucuacuaaaaauacuaaaaaaaaauuagcccaacgugguggcaggcaccuguaaucccagcuacuugggaggcugaggcaggagaauugcuugaacccaggagguggagguugcagugagccaagguugcaccacugcacuccagccugagugacagagcgagacuccaucucaaauaaacaaauacaauaaauagaggacuuaguuaaaugacuucuaaagucccuuuuaacucuuaagucugugguuuuauaaaucuguagcuauaguuuaugugaugcuggggcuuugaacuggaauguaacccccaauuauagcuacauuuucuaggacuacaucuaagugaaaucaggagcagucuauauuguguuuuucuaaaauacuuaaguucuucuuuuuuucauguuaaguuugagauuuugguagaauagguggaacuauccuacagguaauuugaaguuugggucuaaaacugaggagagaaaucaggacuagggauagauuugggguuauccaugcaggugacuguuaaauguggaaguaaaugagguuacuuagggggcagaagagaagggagugaacauacaagaguagaagggguggaggaauggaggaagauauggaacucuacaaggacauggaaaaggaauaaggaaauuagggaagaaauugaauagaguauguccuaauacuaaggaaagaguuucagaaaugaaaggaacuugacugagaaccagauagaaauagccuaccauguggugguagcauucacugcaaaaugaagaucuuguucauuaagauaaagguuaucugaaaagacaguuuaagccauugggggcaugcaaaucaguguacaaaaagaaaacuuuugcaaguuccaguuuuguuuuuuuuaaaggucaugcuaaguauugaagaggaauaaguuuauaugguuugauaccuacacacguuagucagaguguggugguauggugaauggagagcacagaacucagaauuaugaauucugggcuguaguacacacugucuauuauuuuaacuguacaaccauccagucaccuaacagggauacuuguaaacagauaaauuauaaucagauugguaauuguuguagucaauaugaucaaaaguucuugggcaaaugauuuaagccuucuggguuucuucaccuguaaaauuaaauuguuaaaaaaauuuguuuuaggccaagcacaguggcucaugccuguaaucccagcacuuuggaaggccaaggcggguggaucaccugaggucgggaguuugagaccagccuggccaacguggugaaaccccgucuccacuaaaaauacagaaauuggccgggugugguggcaggugccuguaaucccagcuacuagggaggcggaggcaggagaauugcuugaacccaggaggcggagguugcagugagccgagaucacaccacugcacuccagccugggugacagggugagacccugucucaaaaaaauaaaaaaugaauaaguuuuguuuuaaagcucauacucuguguaguaccucuucaugcaguucuggauuguuacaaugcuauuugccuuuaaaauguauaugaaugcauacguauguauauauacauauauguacuuuuaaaaaauuauuauguaggauacuaucuuuuauuguuguuuugagacagggucucccucuguuggccaggcuggaguacagugguuuaaucauagcucacugcagcccuggcauccuggguuuaagcgauccuuccacgucaccucagccucuggaguagguggggacuacuacaggcaugugucacccuacugggcuuuuuuuuuuuuuuuuuuuuuuuuuuuuuuuuuugcuuuuugguagagacagguuuucccuguguugcuuaggcugguccugaacuccuggccuuaaguguuccuccuuccucagccucucaaaguguuaggauuguaggcauuagccaccacacucagucuaguacacuguuuauaaaauuuucccuguacacugaggcugucacacccucucagcuaaugaaguguaguaggacaggccauacugugugcucugagccagugaguacugugcacuuucauccaguaagugcccuaccaccuguuggagaguugagcauguuuuggaacauguauuguuucucuccuggaacugucuuuucuugccauuuauuuagggaggaacaaagggaugcaaguaaagacuaucaugcuguuuauuaacaugcaagcuuuacagaggccacuggccugagauucaacuaaagaaauggucaaggcuucuuuccaguguggacucuuaaguaaaacuuuucauaaaaaaaaaaaaaauuaaagaaaugguugaggagaaagaagguaaagauuuuuaggccaccaauauuccugaaguauagacaguuacaaauuuuguguccuuugauacagggugacuuuguguucacaaauacuauuuaaauuuaucaagcuuguaauaugcgugccugcacagugcuugcugccauagauacacuggugaacuugaugagacaugccccuccuggauuuuaucauuuauuaggaaugguaaaguuaaacaacagucagaggcccauaggaggucaguuuugcccaagcagaauguugaauaaauguucuaacugguuccuggcaaaaacauacaaacuguaucuuuuaucaucaccucagccucucucuuccuuuccccauuucugcaucauauuguaaccauaguaugagaaaaaacauacugaaauuauuuaguuagguaaacuggaucuccaggaacauauaagcauguggcugggaaaaaggguugagaacuccugacuucuaggucaguaucauucaaaucuguauuugcaagccagaccacauuuuuaaauacaaacccacuucuuauuuuugagacagagucuugcucuguugcccaggcuggagugcaguggcaagaucuuggcucacugcagccucugccuccuggguuccagcaauucuccugccucggccuccuggguagcugggauuacaggcgcacaccacaaggcccggcuaauuuuuguauuuuuaauggagacaggguuucaccauguuggccaggguggucucaaacuccugaccucaggugaucugcccgccuuggccucccagagugcuggcauuacaggcaugagccaccgugcccggccacaaacccacauuuuuuaaaguuuuaaaaauuuguuuaaugauauggaacccacauuuuaauuacuuugcuuuuuguuuauagguccaggggcaaguucauccuacucucgagucuaaugaugaugcucuucaguauguugaagaauuaauuuugcaauuauuaaauaugcuaugccaagcucagccccgaagugcuucagauguagagguaugacaaauguugucuuguauuuacuuuauaucuaauuuguguguugguuguaaugucagugaacagggaaagaauuugcucucucuauauauaugguauauaagaaaaugaagccuggauuuaacucuuuacagguugaguaucccuuauccagaaugcuugggaacagaaguguuuuagauuuugagguuuuuuuuuuggauuuuggaauguuuucaguauauuuacugguugagcaucccaaauccaaaaacccaaacucugauguguuccagugagcaucaugucagcaucuagaaguuuuggauuuuggccugaugugguggcucaagccuguaaucccagcacuuugggaggccaaagcagaagaaucacuugagcccaggaguucaagaccagccugggagacaaagugagaccccaucucuaaaaaaaauuuguuuuuaacuagcuaggcaugguggcaugugccuguagucccagcuacucaggacgcugagucaggaggaucacuugagcccaggagaucgaagcuacggugagcccugaaugaaagaguggaaccaugacuccaaaaaaaaaugcuaaaaguuucagauuuuggauuuuuggauuagggauaaucaaccuguauugcauauaggauaguuuguauauauucuagcuguuaaacuauacauuuuuuuguuuguaagcuaaaacgaacaauuucuugaugauagaaugauauacccauaccuuuaggaguggcauauguccaagcauuucuuuuauuaaagccagcuaacauuccaaaaagauuucuguuaauguuuugaucuucaguuguuacauguauuuuaggugguaagugaauuauuucccaccaauugagagagagggagacaucuaaacaccuaggaaggagauuguguaaucucuuagaaagaugauauggcccuugucuuuuuagggcuuaugauuuaauggagauacagagagauauguagucaguaacauaaugugauauucuaugaguaaagaguauaugggaaaccaugaaaggggcaacugauagaugcuuugggguuugggauagcuuccaagaaaaagauacaucuaaacugaguucggaaggagucgaaaguuggagagaagaauaagguuuuugaaguaccaauuguagaaaaugggagauacagcuagaaauagaaagaguucccuggcaaugaugaaggaccguuugacuuuaaugacuucaaguguacaguacuucaaaucuuuggguuucugugacuuugcuuuugcagcacucaagugugagcacaaaaaaagauaguuggacugaaugguguuuccucauggauguauagcaggagaacagcagggcaagggaauuguaaaaacugguaauggcagugcuuugcaaccuuuucaggacacaacacacauagaaaguaauguuuuuauggcacacauaaaacauuggguuuuaugugugauuggguaggaaguaaucucuagcaaccucaggccuuguccuucuacccugaaggcugagggauugauagacaggcauauccaaugagaaacugcugagaagagcaucacugaaucgaaauuggauaaggaaaaaagugaaaugugauaauagcugauggguuugcuauauaguauuaugcacuagucugaauacuuccauacuuuacauuucauuuaaacuuuguaauaaucccaucaagaugguauuaguuuuuucccuacuagaauguaagcuccagggaauuuuuguuguuguuguucacuguugaaucaucagcaccuagagcaauaucuggcacagagaagacacucagaaaauauaaguugaaugaaugauucaacugaagcacagagagguugaauaaccugcccaaguuauuaaguagugaagccaagacuuuuaaccagaaagucuagcuuuuugagcaugcauucugauaccagguaggagagggcacauauaauggaaaaacauggagagaaaaggguacuagaguucucaguaaggucagagaacugauaauauuaggacaucugaaagagagaaauagagcagauugagaucagagaaagaguuguuugaauguaagauuucauaaguaacauaguuacaaagcaggauauggcuagaccaggggugaaggucuccaagaugaggucuuuauagaauuaagaggcugggguauuuugugugucccuaauguaaaccauaaaguuggacagaaugguagcaggacuuuacaugagaauggaagagugauguuaacaccucuuaauaccaccacaguggaguuuagguuucagcaugaauuugggaggggcacaaacauuuggaccauagcaaauggugucuuacauucuuuuaucgggaaauaauuuuccauuuuccucauugacuaggauucgguauuucuuuaauacacuuacaaagcuuucuauuaaaauaauaagggcccuaaauuuagcaagcccuaaguguguuuugggaugagucauaaaauauuuuucuuaaguuuugagggucacauaagaaaaauguauauagagacugggcauaguggcccacaccuguaaucccagcacuuuggaaggccaaagcaggcggauaaccuaagguugggaguuugagaacagccugguuaacauggugaaaccccaucucuacuaaaaaaaaaaaaauacaaaaaaauuagcugggcaugguggcaggcaccuguaaucccaacuccuugggagcugaggcaggagaaccacuugaacccgggaggcagaaguugcagugagccaagauugcaccacuguacuccagccugggugacagagcaagacuccaucuccaaaaaaaaaaaaaaaaaaaaaaauguauuuuaaaaauagaucaaucugaauuagcagaauauacacauuuaaaaaucuuucugaagaauacgcuucauaaugguucccagaggcuguguugauuggagagaaagggaacuggggaagauucguucaaagaauacauauuuacaguugggaggaauaaggucaagagacccuauuguacagcauggugacuauaguuaaugaugguauauucuugaaaugggcccuuauuauuuuaauacaaagcuuuguaaguguauuaaagaaauacugaauccuagucaaugaggaaaauggaaaauuauuuccugauaaaagaauguaaggcaccauuugcuaugguccaaauguuugugccccucccaaauucauguugaaaccuaaaccccacuguggugguauuaagagguguuaacaucacuugaaaaugcuaagaauugguauuuauuguucucaccacaaaaauaacuaugugagguaaugcauuuguuaauuagcuagauuuaacuauuccacaguguauauguacuucuaagcaucaucauguuguacaugauauacauguacaguuuuauacaucaauuuaaggaguaaauaaauuuggccggugugguggcuggaucacacauguaaucucagcacuuugggagggcaacgugggcagauugccugagcccaagaguucaggaccagccugggcaacauggcaaaacccugucuuuacuaaaaauacaaaaaauuagcuggccauggggcuacaugccuguagucccagccaccugagagguugaggugggaggaucgccugagcccaggagguugagguugcaguaagcugugaucgcgccacugcacucuugacagagugagacccugucucaaaaggaagaaaaaagaaguuugaaaaaaaaaauguuuaaagaauacacuuugcuuuaaaguauaagcauaauucaaaguaugguagcaauuacugcuuaauuugguagcuccuaggggauaugucuaagagugauuuuuaguugcuguauaguuuuaggaaaauaggugcuucaaaaguacuugaaaacagauagauugcauacauguuuugcugaugguaauuaaaaaguuuugauaaauuguacuacagauuaucacaaauuauaaaguaucauaguccaaaugaauggaauuuuguuuuauugauguagccaauaaucacuaaucgguacugccaauauauuaguauuuaccaucaggcaguguugcagaugaauaaggaaguagagucgugcuucaguuuccaugggggauugguugcaggcugcugccugaagauaccaaaauccauggaugcuuaagucccuuauauuaaauggcauaguauuugcauauaacuaaugaacaccccucccauaugcuuuaaaucaucucuagaauacuuguaauaccuaauaaaaaguaaauguugcgaaguguaguggcuugugccuguacucccaccuacuuaggaggcugaggugggaggaucacuugagcccaggaguucaaggcugcaggaagcuaugaucaugccagugcacuucagucugggugacagagugagacccuaacucuuaaaaaaaaaaauugaauucuauguaaauaguuauuacauuguauuuuaaauuuuguauuuuuuuauuuuuaaaaaaauauuuuugaucugcaguugguugaauccacagauguagaaccauggauauggaaggccaacuguauuauauauauuuuaaugcuggggaaugcagaagaaggguauauauuauuuggcucuguugauuccaauucauucaaguauuaaaagauaguauaaaaauugcuucaaucuauuucuuucccucuuuuauaauaaauauaauuuucuguauuuaaacuuugaaaaaauagaggcaaaagcuaauauuuuuuuccuguguuugacccuaguaaaguauauucuuuaauuucuuaggucuuguccuuucauaauuguacuuguucuuuacuugacuggacugauuuccuuuguuguuccuucccuuucuggucuauauguaccuauauuuaaccagcuuugauuucucaggacagugauacauuuuucuuuuccucauucaucucaggcuuuuuuuuuuuuuaacuucuuuaucuuagacuuuuuauugucauuagcccuucaucguaaaauguaaaacgucugcuuucguuuuccguucauuuuuuuucuuuagcuuuuuuucccuuggaauccuaaagaauccuuauaauuucuuucuuucuuuucuuuucuuuuuuuuuuuaauuuuuuuuuuuauuuugagacagagacucccucugucacccaggcuggagugcaguggugugaucucagcucacugcaacuuucgccucccagguucaagugauucucgugccucagccuccugaguagcugggacuacaagcgagcaccaccaugcuuggcuaauuuuuguauuuuuaguagagacaggguuuuacuguauuggccaggcuggucuugaacuccugaccucaagcaguccgcccaccuccgccucccaaagugcugggauuacaggcaugagccaccacgcccagccaagucccuauaauuucuaauaagcuuuccauuaacauuuagauuccccaaauaauuuauccauauuuucuaccuuucuaaacaaaaacaaauuucucccacacauaccaaaguauguggggaucugauuuuuuuuuuaacugaaguacauauguaagaauuuauauaggaccuagaauauuuauauuggaauugaucaagauuaucuuuuuaaaccuauuuauuauguaaaggagaagacaggguucugcuaauaauagaggugaaucuucagcuuagcucuguaucucauuaauguuucccagagguacuagauauuaaucaagauagaguuucucauuuaauacaaauaaaauuauuaaucuugaaauuaggagaguaauaguauucuaauucaugaaucuuucauuguucaguccuccuugggcuucuuuuuaaaaauacaugaaggccgaaugcaguggcucauguguguaaucccagcacuuugggaggccaaggcagaaggaucacuuugagcucaggaguuccagagcagccugggcaacauagcaggaucucauuucuacuaaaaauaacaaaauuagcugggcauggugcacguacuuauagucccagcuacuugggaggcggaggcagggagaucacuugagcccaggaggcugaggcuccagugagcuaugauugcaucauugcacuccagcucgggugauagaucgagacccuguucccccccaaaauaaauaaaaaguaaagaaauauaaaguguuugugaaagaaauuuuauuuuaucauaaaauuauaaauuugccacuacaagaaauaaaguaauuccuucaguauggccucuccacauucaaaacaccuuuuuuuuuuuuuuuuuuuuuaacccuacgaaucuuuccgcaugcauuuugacccuugacauugucuccuaaguauguauuugguaauuugauuucauuaauacccuuguaaguaaguuuaaaaugugcuaugcuucauuauuaccacuuugccuuuuuaaaaaucauucgagauuuucuuuccucuucuuuccuuccucaaaacaauaaaccuggaaugagguagacauaauugauauggacagggguugcuguucuguuuucuuuuucuucuaccucaaccccugccuacaauuagucucuguaauuccaccgcuggugauuuuuuuuuuuuuucaaagacauguaacucuauuuagaauuaauuguuagguugaguucaacuucuguccuucucuacugcuuuuauuuuuuuauuuuuacuuuuuucuacugcuuuuaugucuacacuguucaccaguguuuuuagacuccaggucauggccauuaguaagucauaaaauuacuuuagugcauugcccaacccucauuuuaaaaaauaaaacaggccgggcacaguggcucacaccuguaaucccagcacucugggaggcugagguggguggaucaccugaggucaggaguucaagaccagccuggccaacauggggaaacccaucucuacuaaaaauacaaaaauuagcugggcaugguagcacacgccuguaaugccagcuacuugggaggcugaggugggagaaucacuugaaccugagagugguggucgcagugaacugagauugcaccacugcacuccagccugcgcaacagagcaagacucugucucagaauaaauaaauauacaaauaaaaaacagaauagcaaaugccagugugcuacauauaauaaggacagguuuguuuuaggaaacuguuucauuugaguaugugugcaguauguaaggguauaauguaaaaauguguugaaaauuuauucuuacuaugaguugagguuuuaaaaaauguuggaaagccacagggucauaacaugauuagguuuguaccaugguugcacuuaguuaaucauggguuaaacccaucacuauaaacauuuuaacugaaaaccacguaaguuaguccuaaauaucuugucauuuuuggauuaacaagucuguaaaauaaacuuggaaaaaagaaaagaauucuuguuuuggauguucccuucucucccuuuaccccuucccuuuucucccuuuucaccugcgaugccuccucaauauuuugggccuuuguauugcguuuuacugcaugaggcugguguccuggcaaacagcuuuucaacuagacaguugaaaagguuuguaaaccccauuuuuaacugcuauaauuucuuucaacaugcuucuaauuccauuaauuagaauuaaaauaacuuuauuuggaagcugacuuagccuuggacauaauggaaauuuauuaaaauugaauggauuacacuccuuaauuuauagauuugcucuuaagauuuccaagaaucauuguguucuccaccccucccucaccaccaagggcaucacauggcaucacacuuuuuuaauuuuccauuuuacuagcaaauaauaaaacuuuuuauucagauuuauaauuaugaugauguuuaauuucaucuaguaguuuuuacauacuaguugaauacucauuuauucaaaacacauguguaaaaguuauguaauagcgaccucuacugguuuuaguuaugguauccugcaaguggauuuuuuaaaguuuugagaggaugaaagcgccuuuuugaagugaauuauauuaguuuaauaaggaaggaaauucagcugugauaguaaccugaguucuuucacucucaguggaaauuuuaacuaaagaauuucuggaaauuaaauugaaguauuuuguuaaaaacgaaugacuaugggaggacuuuaaagaaacuacaauguauuaaaauugcugucaccaaugcaaaccauugcuuuccaugauuuguaaauaguuuugaagugccuuugcaugguggauaaagaauauucauagagguuucaauugaaaaaugcugcauguaauuaccacugaaaguaaggacaagugagugagaacuggauuuagauauuuacuucuugaucuuggguguuguuccuugaaauuuuauacaaguacuauuuaaaguagcuucuacucauucuuguaauuagcuuuaucacagugaaguugaaauucaggaugugauauucccccuagauaauagaaagaauguuuagucucuuauugucuaauuaaggaacuaauacauugacaauuacuguuuucucuuagcuucauauguuuguaauguaaauuauaccacaugugaaaagcucuacuuuugguauucuuugauuuuaaaaguaaauuuuaagugaagagcacuauuuaauauauuuuuugcuuaguuguuauuuuccuauuuuccaaggaacguguucaaaaaaguuucccucauccaauugauaaaugggcaauagcugaugcccaaucagcuauugaaaagaggaagcgaagaaacccuuuaucucucccaguagaaaaaauucauccuuuauuaaagguaaugcugaacuacugccuucuugccuuuuaagggaaaaauaaaacccaccauuuuuauacaauaagaauauauuuuauggauaauugagucaacuuaagaguaaaauucucucauucuaaguuuuccagagauuuauguggugagaagggaugcuaugauaauaagaaaauauaaacugggcaacaugauuuaaaguaauuucauaucaauaguaauaagcaaguugagaggacuaagaaaguuauuguggauuuuguuuaucucagauguaauuaggaccacaaagagaauuuauaaaacuccuccuuucuuguugguuagaccuaaguguuccuauaaauccuuuugauguuaguacuuuguguagagaccucugugaaaaggcuacaaggcuauguguaaucuuggaacaaaaagauaaccuaaacucuccaguccuacuuaucauguaaauaagucagucagucaguugaaucucuauagaacuaauagaauaacugccggaagcucgaauaaugcuauuucuauuuuaguuaauguaacgaacuacuauuaccuuucacaacaaaaauauagguauuauaauaauuaaaaacuuagaugccaguaauuuuguacauacuauaauacagacaaaaugcuaauacuuguauacauugucugaguuuuauuauucaacaaaguuauuauuauccacaguuuguaaaugaggugacagaggcagaaagugauuaaguaacuucuaugccaaguucacaagacucuuaagugauaguguuagaaaguucagguuugcuugauguuguccaaaauuuaaaguuaaacacuugaaugaguuuaagguuguauuuugcauucaguucuuugaauagaaauaccugccuuauggaaaaggcauucaucauucucuucaugauuuucauuggccauauguugaauuguauucuaagggaauuaacaaauugagguauauaaauauuauguuaauaauccuaaauuuugaguuuuaugugcuaauugugaauaucauuucaauuuauuuuaauacaccuuuaucaugauacccuuauuaguuuuuauauacccuaaaagguaaaugcagccugucuccaauuuguaacaaacuucuuauuucaaaguuguuuuuuucccuuaaauggguuguuuggaaaauagaauuuguuauucuguaugaacagaccagucccacaaaagcccauauucucuuugaaguuuaauauuagggcuauuuaacauuuucuuaacagcaaccauuauucaguaggacauaacaugaauuuuauuuucguagaaauugccaggaauaccaggaauaugcccgcugugguuuuggggagcucaucuucccuuggaaaaguuaaaaguauaagccugguagagauuccuagauaccaauaauauauuaacucucauuuuuuguaaaagaaaaaacuuguuuguuauaguuacuuccagguauucugaauuagguaacaaagagcauuugcucccuuccccaaacuugggccuuccuuuauagguuagggauuaucuauuuguaaucuccgcuuaaguauuuuacaucauuagagguaauuuugccuugccuuuucuuagcuuacauuuucaauaguaauacauauauuauucauuguugaaccacuuacaauuaaauguuguugguaagcacaggccucaggaaaaaaaguguaaguuaaggugcaaauauguuuuuuauuuuuaaucaguguguuaaauguacaguauaugauguuuaaacaugcuuuucuuuuaauuuugcaggagguccuagguuauaaaauugaccaccagguuucuguuuacauaguagcagucuuagaauacauuucugcagacauuuuaaagcugguugggaauuauguaagaaauauacggcauuaugaaauuacaaaacaagauauuaaaguggcaaugugugcugacaagguaggaaacugagcuuuucuauuuuuuucuuaaguuucuuuuuaugacuuauuagaugcuaacguacuauucauauagaauaaaauuguauuauguguuggggaauaucuccaguaaccuaauaguagggauucaagauaccacuuuauagaaauaagacauuagauauauaauauuaaaauguguuuaaauaugucaugcaguuuuuuucuucugugcuguugcaacuaggguuaauuagaguaaucucuuaauaguuaauuucuuuucuuuuuucuuuuuuuugagacggaaucucacucugucgcccaggcuggagugcaguggcacagucuuggcucacugcaaccuccgccuccuggauucaagugauuguccugccucagccuccugaguagcugggauuacaggcacacaccaccaugccuagcuaauuuuuuuguauuuuuaguagagacaggguuccaccauguuggucaggcuggucucgaacuccugaccgccuuggccucccaaagugcuggaauuacaggcaugagccaccacacccagcuaguaguuaauuucuuaaaauuuauuuggauugaaagauuuguaagguuacggauuuacuuaaaaacaauuuuucaaaauguaaaaccacaaaacgauaguuuuacuucagcaccuagcuuucuucagauacuacuuugugguuuuacaauaauaauaauaagagcaaacacuuauugaagguuaagcauauauguggcuuaucuccguugguccuuaugauauuccucuaagguaagugaucuuagcuacauuuuauaaaagggagacugaaauucacagggauaaagaaauugguccagaauuuucugagaaguuucaaagccuagacuugaacuccaggucucucugagucuaaagcuuuuagucauuaccuaaggauguucacuuuaugaaaacaacuuugcagaaaggaaaauguuuucugaugaagcauuucauuccauuuuccucauuauacucuuacugauuuggaauauuauuucugauugcugauuccacuaaauuauguuuuaguauuuauuuguucuuugagaauguggccauauagagugaaaaaacccaccugauuugaagaagaauuucaaauguuuggguauuuuuaacugaagacacgaauacgaaauacuugaugcuuuuuaaugaaucagauaaauaaaauauuuuugaguaccuacuacauguuuacacagagaggagaugcaagauaaguauauauaaaacaaggcuccagaguugaugaagguauacuuauauucaugaaacaaucagaaagcacacaagauaaaauaauauuuuauuguguuauagagauaugaugcuguagaaguucucaagaaggggaaagauguguuguagcaagaguaguaacaguagacuucuugcagaaaauaauagcuuauuuugaccuauucccaacaaauguaggaaaaucggccgaauagacagcuauaaacauuuaaauaugagauacugaggccauggaauaaagugaugauggcaggguauaaaacagagaaaaccaagucagggaaauuaaagacaggaucuggaaacaaauuggaaguaauagguuaacaagagagacagacagauaaauacuaguagugauagagaacuuggaggaguguaguaaguuauaucacauguugaauucuguuuuagagaagcuguggagggaugcuggcaauauauccaagaagagaaauuuguuugucugcuuuuuuaucauuuaagaacuuuauucagagaacuuagagcauuucacaucaaauucuacgaaagcuucauauuuuauuauacuuuuuuauaucucugacuguauagguauugauggauauguuucaucaagauguagaagauauuaauauauuaucuuuaacugacgaagagccuuccaccucaggagaacaaacuuacuaugauuugguaaaagcauuuauggcagaaauucgacaauauauaagggaacuaaaucuaauuauaaaaguuuuuagagagcccuuugucuccaauucaaaauuguuuucagcuaauguaaguaucauuguauauaugccucucauugaauguguugugaaauuugcaugaccacuucaaauuugaaguuguacaguucaucauuacuaauuuguuaauuuuuuuaaguugugggacuuaauucaugaucacaaaguuuuacaacaguuucaagagauuuaacauuagaaauuaagagacaaaauacaaaguagacugauuauguaagugaaaaugaauucacagaauucuccauguacuccaaaggauaaagcuucuuguuuagguggaagauauguuuguuugagucauuugaaucauucaaccuacacuucaucaaugccaacuguauugucagguaccaugcuuggcagcagggauucaaagaugaauaagaaacaguucugcugggcacgguggcucacgccuguaaucccagcacuuugggaggccgaggcgggcagaucacgaggucaggagauggagaccauccuggcuaacacggugaaaccccaucucuacuaaaaauacaaaaaauuagccgggcgugguggcgagcgucuguaaucccagcuacucgggaggcugaggcaggagaauggcgugaaccugggaggcggagcuugcagugagccgagaucgcgccacugcacuccagccugggcgacagagcgagacuccgucucagaagaaaaaaaaaaaaagaguuccuuuccuuaaguuuagucuagucaagacagagauauaaacuauaaauugcaauaaaauaugguaauuaccauauuagaaguaugacagcaguaguauugggagcacaaaggaaggggccaguaacauugaaacuuagacaaaggauuacugaucuuaagauagugaucaaacuaaccuaauuggguccugaagaaauguugaaugagaacaggugagacggucacaggaauuacacacugguaauuccuggaacuguagccacacagccauaaaugacugauaagagaaacagugcucacuacagaggcugggauugggcucaagcuauggcgaugagugaaaauuaaaaaauaaaggagauuauggugaugguuguacaaaucuguaaauauauuaaagaccauuaaauuacucacuuuaaauggacacacugcaugguuucuaaauaauguuucaauaagguugcuuuaaaaaaaguaaagaagaggcaaagguuucugaggacacaaaaaucaagaaccaaaauggccaaaaagcacaucaaaagguguucaacaucacuaaucauuagagaaaugcaaauuaaaaccaugacauacuacuacauacucauuugaaaggcuaaaauguaaaugacuuauaauaccaaaaguugaaauggguauggagcaacuacuugugggaauauaaaauucccacauuaccugagaaaguaaacuaguauauuuuggaaaacaguuuggugguucucucucuuuuuuuuuucuugagacguagucucggccuguugcccaggcuggagugcagggccgugaucuuggcucacuguaaccucugccucccagguucaagcgauucuccugccucagccucccguguagcugggauuacaggugugugccaccacgccuggcucauuuuuguauuuuuaguagaggcgggguuucaccauguugaccaggcuggucucgaacuccugaccucaagugaucugccagccuuggccucccaaaaugcuggaauuacaggcgugagccaccaugccuggccaguuuggcaguucuuuauaacaauaaacauaaacuaaccauauugcccagcaauucuacuccuagguuuuuacccagaagaaaugaaaacauguccaugcaaaaacugguucaugaauguucauagcggcuuuauuuguaauagccccaaacuggaaacaacccaaauguccaucagcaggugaauguauaaacaaacugugguaugaccauacaguggaaugcuacucaggaauaaaaagaaauaguuaugcgugcaacagcaugggugcaucucagaaauauaagcaaaaaacuaggcacaaaagacaauauaugauuccauuuauuuaauauucuagaaaagacaugucuauagagacaaaaaggagaucacagguuuccugggagugaggcauaguaaggguugauggaaaugggggacaaagaaacuucuuaagacgaugaaaagguacuguaucuugauugugccgaugguuagaagggugaauaacuacacaaaaucucaccaaaagaacauuuaaaauaggaguuucguauauaaacuaugccucaaagucaacuugauaaauauagucacugauaaaaaaaucaaauaauaguaaccaauuuuaauuuaaauacaaaauggauaugguugcagauucuacauugcaacuaacccuuaagaaacuaucauuuguugaauuuuaguauaguaucauaaaaggauagucacucuauuuauauggaaaguccagaauaggcaaauccauagagacaaaguagauuagugguugucaggcacuggggagaggaaaggaauggagagugacuuuacuggguauuuagguauccaccuuccaaaaaaaucauagguuuucuucuugugguaaugaaauguucuagaauuugauacuggugaugacugcacaaccaauauugaaaaccauugacuaguaacuacacuuuuaaugagugaauuuuaugguaugugaguuuuaucucaauaaaaaaauuacacagaaaagcuagauuuuucguauacuuugaaauaaugugucacaacagauuguaugcagaaauagauaugaaaauccugcugucuucuaguacgcuauguuagagauuugcaaauguaaaacauugccauucuucuacuaaauguuuuuuguuauggcuuaaaaaaaauuugguuacuuuuuauaaaagugcuauuuauguuaaacacauaauggguuuauuauuuuuaaugaauuaaauauuuuuugaaauuuuugguuuuaacuucuaauaugguaaacauugaaauacauaguuauaaacaaaagguuuuuagaaucuucaauaauuuuuaagagugugaaggaguccugagaccagaaaguuacaagaccacugaccuagagaaauguauuugcaaauuguacaccuuugcagaaggaauucuugaauuguccuuuauucauauuucuaagucauuaaaauuuuucacugugucugacauguuaaauuuugugauuauaaaaugacuuauuggcucaaaauuuguuuaauauuauaauaauacagccucacugaauuaauguguuuucccccaaacaggauguagaaaauauauuuagucgcauaguagauauacaugaacuuaguguaaaguuacugggccauauagaagauacaguagaaaugacagaugaaggcaguccccauccacuaguaggaagcugcuuugaagacuuagcagagguaaguacuucaauuauauacccgaaaagucugcauaaaagccuacauuuacauuaaaauugagagucuuacuucuuuccagcuaaagucauagauacuaauuguugacuauuuaucuguuauugcuccuuuuucauagggucauugucaacauauguuucuguuaucuuagcaaacagaaaaaguggucucuuguuaauuauagaaagacagauaccgccaaggggggagguauuacagcugucacccaauggccuacuguaaaacguuaagaaaugucaaugaaugacuauuaaguaagagaccacagaacuugcaccugaggucagauuacuuguguuccagucuaagcucugcugcuuauuaguugugugaccaguggcaaguuauuucauuucuuuaaaccuccguaucuuuauuuguaaaauaagaaugauaauacagguugaguauuccuaauccaaaaaucccaaauaugaaaugcuccaaaaucugaaacuauuccaacaugaugcucaaaggaaaugcucauuggagcauuucagauuugggauuuucagacuuggggugcugaagcaguagguauaauacaaauaauccaaaaucugaaaucuuaaacacuucauuuuggguaagagauacucaaucuguaaucucaggauuuuugugaaaaauuaaauaaccuaucugaaauauuuaccuaucuaccuucacauaguaagcuuacucaguaugugauaagugcauuauuauuuagaauaggaaugagguaaauaggacaauaagguccaggaccugggugauucagauaccacgagauagaaagaaagguaacuaacuccucagauauuucaaaugcuaaaauaacaugagucaguccuaauaaguuagcauuaagagucauucugagguuucuagcauuugcuguguucucacucuaaaauccacucauuaugauacagcauugagcuuguaaaauauuuuuuuaauuaagacuuucaggcaaaauagaaugguaaguucaagcaucaccacagcccuuccauuccugcuccaaacacacauaaguaauaaaguauaaaaagaaaaauguggaauauauauauaacuagacuugaaaacaagaucaggaauggaauagacauucaagguagugaacucugguaucuggguguucaggcuguuaaggacaaugaauuguuucaaauguguuccaugaaagccagagcaagauuucuugcucaagucccuccuuauaacaggaugcugggaaaaucugccaaccugguaucuacaguaaaguuuucuaaaaaguuguggacuugauguggggagacaaaaacguugccuuacaauaauaacuuaacaaaguuucccacaauauuaagucaauaugaagccugaacccgcaaagucauuuuaagagcagguucugguuuggaagagugaucauaaugggagaaaaaaaggaaacaaaacauuaagucucccacuaagaagcauauaauacagaauuccaaaaaacaaggcaaauucuaauucucagaaugguaauuaauaaaaucaacaauuacaacaugaauuuauuccagaugaaauugauuuuguauaauagacauacaaaaaguuuaaaagaaguuuaggaugcugaaagagauaagugaaggaauaugauccauuuauaaagaagauauugugaaacaaaaauagguggaaaggaaaugagcagauuucuagauaucaaaagacagagauuucgagaauuaaauauacaagcauugaaauaacucauguaguauaacauuugcuggacccaguucaaggauaaaauuaguaaauuggaagauggaauugaggacuucacugagaaugugacacacagaccaagauaagaaauaugaaaggccaauugaaaguaauaaggauagccaggcaugguggcucacgccuguaaucccagcacuuugggaggccgaagcgggcagaucaccugaggucaggaguucaagaccagccuggccaauauggugaaaccccaucuccacuaaaaauacaaaaauuagccgggcguggugguacaugucuguaaucccagcuacucgggacgcugaggcaggagaaucacuugaacccaggagguggagacugcagugagccgagaucgcaccacugccguccagugacagagcaagacuccaucucaaaaaagaguaauaaggauacacugagagguuuaauauacaucuaauaggaguuccagacaaagagugauggagaaacaauauuugaaaagauaaaaauggaaaauuuucaagaaaugaggacauuaguucccaaaucaaaaaugaauuccaaauaucguucaggacaaauaaaaauaaacacacagcuaaaaacauggcagugaaacuauagaacaucaaagauaaagagaaaaucuuggguuggguccaguggcugaugccuguaaucccagcacuuugggagacugaggcagguggauugcuugaagucaggaguucgagaccagccuggccaacauggugaaaccccaucucuacuaaaaaauacaaaaauuagcgaggcaugguggugggagccuguaaucccagcuacucaggagacugagacacgagaauugcuugaaccugggaggcagagguugcagggagcugaguucaugccacuguacuccagacugggugacagagcaagacucugucuuaaagaaaaaaaaaaagaaaaucuuaaaagcuguuaagacaaaauauuuugcgaaggaacuauaauuagaauggcagcacguuucucuuuaacaacagagguuaacagucaguugaguaauauauuuaaaguacuaagguagaauaggauuuucuacccaacuacaguauuauucaagaaugaggacaaauuuuaaaauaaucaaguuuguagaagaaagcauaaguguucuucaugaccugugaaauacacaaagauuucuuaaacaggacacaaaagcacuaaccaugaaagaaaaaaauugauaaacuggacuucauuagauguaagaauauccauucaucaaaagacaaaauuaauagaaugaaaaggcaagcuauagacuggaagauaauauuuguaauaugcauagccaaugaaagacucauaucugggguauauuaagaacuccuggcugggcacgguagcucaugccuguaaucccagcacuuugggagacugaggucaguggaucacuugaggucaggaguuugagacgagccuggccaacauggugaaacccugucucuauuaaaaauacaaaauuagggugggcauaguggugcaugccugcaaucccgguuacucgagaaucugaggcagaauugcuugaacuugggagauagagguugcagugagccaagagcacaccacuguacuccagccugggcgacagagcgagacugucuggaaaagaaaacaacccaaaaacaaaauaacuccuacaugccuacaaaucaauaacuaaaacuucaggguuuuuuuguuuuguuuuguuuuucagaaaauaggcaaaagacuuaaguagguacuucacacacaaaaaagaugcucagcauuguuacucaucaaggaaauguauuuugaaaccauggagcaguuggaagucuacuugcuggugggggcuaggguguaauuugguacagccacuuuggaaaaccguuugguguaucuacuagagcuaaguauacaauguacccugugacccagcauuuuaacucuugggcauauaccaaacaaaaaugagugcuuauguugacugaaagacauauugaagaauguucacaguagguuuauucauaagggauaaauuagugguauauucacacaauaaaaugcuaucuggcaauaaaaaagaauaacugcugauaaaagcagcaacauaauacugaguauaauaagacucaaaguacauauauauugauauaugggaaguucagaaacauguaucuuuggaaacagauuauuagaguagugguugacugggaaacaugaagauuucugaggugcuagaaauguucuauuucuuuaucuggguggugguuacagaaaugcauuguauacauauguuaaaagucaucaaauugcagacuuuauguaaaguuauuccugaauuuaucaaaaaugaggaagaagugaggaauaaaaaccauuucaaacauacaaugaccaagagcguuuacuacuuguagacacucauuauaagaugcauuggaugguguucuuuagcaagaaggaaaguuuuacucaaagggaagucaagaaauauaagaacuaauggugaaaaagaaauugguagauguaggccgguggcuugcaccuguaaucccagcacuuugggaggccaaggugggcaggucacuugagcucaggaguucaagaccagccugggcaauauggugaaaccccaucucuacaaaacaccaaaauuacccaggugugguggugcgcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaagacacugucucaaaauaaauaaauaaauaaaaaauuagaaaguguguugauaaauuuaaugaauugcugaauaguuuuaaaaauaaguuuaaaguuuuucgucuuggaaagacuaaacuauauuucuauguauuaguaacaaaauauacaguauguaaaguggacuuguauuugugauagaagaauaacuugaaaaauuuauagauaaccguauuuauuuuuaaaaacauguacgaaaaucaccaaaagaacagaaauacuaccuguagcuuauaauguacagauagggaaaaaggaacuauaguaauuuuuuaaaucauuuucacugauaauaggaaagaaugaagcaaacaaaaacaaugauaagauaaaaugauaugauauaaaaaaauccaacuacauuaguaacucaguauauauaaacugaugaaacucagccuauuuaaagagaguaauuauauuugauuuuuaaaaauucacuuuaggccuggcgcaauggcucaugccuguaauuccagcacuuugggaggcugagguggguggaucacaaggucaggaguuugagaccagccuggccaacauggugaaacccggucucuacuaaaaaaaaaauacaaaaauuagcugggcaugguggugugcaccuguaaucccagauacacaggagucuaaggcaggagaauuucuugaagccaggaggcggaguugcggugagccuagaucaugccacugcacuccagccugggcgacagagcaagacuccgucucaaaaaaaugaauaauaaauaaaaauaaaauccacuuuaugcagcuuauaaaagauuuucuuaaaacagaaccacagaaauauuuuaagauaaagggaugaaauaucauaacauaaaaacuaaucaaaccuguauaacaauauuaauucaaauuaacugauaaaauuacacaaaguaagcacugaggaggaaaaaagagaaacacuuccuaauaguaaaagggauacuaucaugaagauacaacagccauuaauguguaugcaccugauuauaaagccucaaaauauaagaaguagaaacugacagaauuauaagaaaugaaaaaaauugcuaucauaggaaauuuuaacaggucuccaucagaaauuaaaagaucaaacaaaaaagauuaggccacagaagauuagacuaacacauuugauuuuacacacacacacacacacacacacacacacucucucucucucucucucucucucucucucccucucucucucauucccucacacucaauuagcccuccauauccauggcuuccaccucuguggauucaaccgacuguggauugaaaauauuuuuggggaaaaauaagcauaauuguaucuguacuaacauaauguugagcacauuacaauacauuacaucaggguacauuacaauacccuaaacaauaaaguauaacaacucuuuacauaacguacauuauauuagauagaaguaauauagggaauccucugaagguuauaugcaaauauaccauuuuauaucagggacuugaacaucccuagauuuugguaucugcaugggauccuguaaucaaucccucaccgauaaaagggacaacagagugugugugugugugugcgcgcgcgcgcgcauguguguguacacagucaucccucaguauauguggggaauugguucuaggacucccugcagauacccaaauccacacacgcuuaagugccacaucagcccugcaaaacuugcauaggcccuguggaacccauauauacgaaaagccagcccugaguacgcaaggguuucacaucccacaaauacuguauuuuugauccucauuugguugaaaaaaaucugcauauaaguggaucuaugcaggucuaacccacggguuguucaaaggucagcuguauacaucuuaauacuguugccuugaggauuaaguuucaacuauaaauuuugcagagagaaguuuacaguuuuacacauuuuuugaaaaaauaggaauaauuaaaaaugaaugaguuaagcuuucaaaccaagaaagaagaaagauaacgugauacaccuaagagaauaauauguaaggaaguaacggaacagaauuaaugaauuagaaauugauauaacaaaaguucucauggcugaucaacgggaaaaggaaacacacauacuaggugugaucuuggcucacugcaaccuccgccucccagguucaagcaauucucaugccucagccaccccaguaguugagauuacugugccaccacuuuuggcuaaucuucauauuuuuaguagagacaggguuuugccaugauggcuaggcuggucuccaacucuuggccucaagugaucuaccugccucggccucccaaacugcugguauuacauacgugagccaccguaccaggccuguuuuuuaaaucaugaaagaacacuaagauccacuucaaaauguuuuagaacuguaaugaaauaaccuuuaaaauauguaaaagaguagcaucaauguccuaaguuaaaaaacauuaaaaaaugaauagucaaaaguguauuucaacaaaugacuugcggcauagaccagguguugugaaugcugugguuucaauguguccccauauuuuauguauuggaaguuuaaucuguauauauugauuggagguggggccuguggagguaauuaggauuagauaaggucaucagggugggguggggcccccaugaugucaggccuguuuuuauaaaaagagaaagagaccugagcugacaugcuguaguucccuugccaugugaugcccugcaccgcgucaggacucugcagagucccuaccagcaagaaagcccucaccagaugcaccugccugucuugaccuucuagccuccaaagcugugguaaauaaauuucuuuaugaauuacccagucucagguauuuaguuauagcaacagaaaacagcaugugacaaugaguuuugccaaucuucaggaaacaguuacucuuuugcaaauuguuacaaugaauagagacaugaaggguaacaaguuuaucaggauuguaugaauacauuaucaaaacuacauaacgacaguaaagaaaaaacuaugagacauucucagauaucaaugaaauggcaaugaaaaaucaguuuaugauacaauaaaacauaugucuauauaucuuaugauguuuacucuuaugugguuugacauuuuaaaguuuuaauguaguauucuacuuuaguagguuaaaaucucaagaaaaaggcuuucuuaaaauuaaacauucacucaugaauuucuuuaaaauguugggcaaacaagcaauagaagggaacuuucuuaaccuaauaaaggacauuuacuaaaagucuguaagagauauaauaauaguuaaacuauagcaaaacuaagaaacuagaaaagaauaccacuaucaccacuucuauucacucuaauagcgaguacuacccaauacaaaaagacagaaaaggaauagacaagacaaaguuguccuauuuguagucaauauaauuaucuauauagcaaacccaagaaaauuuguauaauauuaaacuaguuggcaaguucauuauagcuauuggauaaaagaucagccuguaaaaauugguagcauuacugugcucaguuacaguccauugaauauauaauauuuuuaaagacugcauucacuauagaaauaagaccauaaaguaccuggaaauaaaccugacuaaagauacacaggaccuuuguuuuuaaaaaaaaaaaaaaaaaaaaucauaaaauuagcugggcacaguggcuuacuccuguaaucccagcacuuuuggaggcugaggcgggcggaucacaaggucaggaguuugagaccagucuggccaacaugaugaaaccccaucucuacuaaaaguacaaaaaauuagcugggcguaguggcgggcaucugugaucucagcuauucaggagguugaggcaggagaaucacuugaacccaggaggcggagguugcagugagccgagauugugccacugcacuccagcccgggugacagagugagacuccaucucaaaaaauaaauaaauaaauaaauacauaaaauuagauucacaaggaagaucugaauaaauggaaauauauacuauguucagggauggaaagacucaguacuguaaugauaccaguugucccccagauaaucuacaaauuuaaugcauagcaagcugauccuaaaauucacaugguaagaaugaggagcaaaaauaacaauuuugaggaagaacaaguugaggggacuuguucuuguccccuuaaguacuuguuagguaaaguaccuguuagauaaagucuugccacauauuaagacuuacuaugaagccagaguaaacaagaguguaguacuggugcagguaacaauuagguagcagaacagaauaaagagcccugaaaaaaauauauacauagauacuucuccugaaaugugacagauauuacauuaaucaguagagaaagagugaacucauuaauaaaugacacugggucauaccugguuaaauggaaaaaaauucauuccauaacacauaauucacagaaaguacucaacagauuaaaaaucuaaaaaugaagaguagaacuucaaaagaaaauauaggagaacauauuuaugacuuugacauaggaagguuuguuaacacauagaguaaaccagaaaggaagagauuaaguuuuaaaacuucuguucaagaaaagacaccauaguuauaagggaagcacaaaugaaugaaguuggaaccauguaccauauccgaaaauuaacucaaaauggaucaaagacaauguaagaucuaaagcuauaaaacucuuggaagaaaacaggucugaaucuucaauuuggcaaaggaugcuuagauaaugccaaaagcacaagcuauaaaagaaaaaguagauaauuuggacuucuucaaaauuaaaaacuguguuucaaaggacaccaucaagaaagcaaaagacagccuacagaaagggaaaaaauauuugcaaaugauauuucugauaagaguaguauucaguguauauaacaaaaagauaacccaauuuaaaaaugggcaaaggauuugaauagauauuucuccaaugaagauauauaaauggccaacaugguacauuaaaaaaugcucaacaucauuagaaauuagagaaaugcaaaucaaaaccucuaugaagccugagcaacauagugagacccugucuuuacaaaaauuagaaaauuugcccaggaugguggugugcaccuguggucucagcuacucgggggcugaggugggaggauugcuugagcccaggagguugaggcugcagugagccauaaucacaugauugcacuccagccugggugacaagguuagacuccaucucuaaaagaaaaaacauuaugcaguaccacuucacaucuacuaagauggcuaaaauuuaaauaaagggaaaguaacaaguguucaugaagauguggagaauuugagacccucguauuuugcugauagaaauauaaaacagagcaacugcuuggcagacaguuugcugguuucucaaaaaguuaaacagaauuaccauaugauccagaaauuucacuccuagguauauacccaaaagaacaaaaagcagagauucaauccuauacuuguaugccaacauuuauagcagcauuauucacaauagccaaaagcugggaacaacucacauguccaucaacagaugaaugguuaaauuaaauguauaugguaaauacauuacaguagaauauacaguggaauauaauucagcuuaaaaauggauaaaauuccaauacaugcuacaacauggaugaaccuuggaaacguuaugcuaauaaaauaagccaaacacaaaaggacaauauuguauguuuccacuaauaugagguaacuggaguagucaaauucauagagacagaaaauagaaguuaccaaggguuacggggaagaggcaaugaucaguuacuguuuaauggauacagaguuucaguuugggaugauagaauaguucagaucuggaaauggaccguugcacauugucuauuaaugccacuuaauuguacacguaaaaauggcuaaaauggaaauuuucauguguauauuuuaccacaauauaaaaaaaauuaggccgggcacaguggcucaugccuguaaucccagcacuuugagaggccaaggcgggcggaucacaaggucaggagaucgagaccauccuggcuaacacggugaaacgccaucucuacuaaaaaauacaaaaaaaaaaauuagccggguguaguggcgggcgcuuguagucccagcuacucgggaggcugaggcaggagaauggugugaaccugggaggcggagcuugcagugagccgaggucacgccacugcacuccagccugggcgacagagcaagacuccaucucaaaaaaauaaaaaauaaaaaaauaaaaggggguguugaaacaugcuacaacauggaugaacuuugaaaauguuaugcugaacacaagaagccagucacaaaagacuacauauuguaugauuccauuuacauguaauauccagaauaggcaaauccauggagacaaaaaguagauuuaugguugccuagggcugagggguuuaggggauugggagguaauagcugaagagugugugauuucuuugagggggugauaaaaauauuccaaaauagauuaugaugguaguugcacaauucuguuaaacuaaaaauaaucucauuuugcccauuaaaugggugaagugaauguauuagaauuuuaucucaauaaagcuuuucuaaaaacuauaaauuaaaauguaaagucaagcuaauaaaaauggucaaaagcuauuaauaaacaauucucagaagagaagauacaaauaaauggcgcacaaccauauaaguagauucucaaccuuacuaguaaucagggaaauacauauaaaaauaacacuggcauagucucacaacaucaggcuaacaaauuuuaagucugauaguaucaaauguugacaaggaaguggacaacugggaaaaaucacugcugcuaaguauauaaaucgauauaaucacuuuggaaagcaacuuccccuucuaguuuacaugcucuaaaaaauauucaugcauaugugcacacuaaguuauacaggcauaccucagagauaucguggcuuagguuucagacuacugcaauaaagugaaugucacaauaaagcaagucacuauuuuuuuggcuuacagugcauauaaaaguuauguuuacacuauccuguggucuaguaagcaugcaguagcauuaugucuaaaacaacauauauaccuagauuuagaaauacagcuaagaaaaugcuaauaauccucucagccuucagugagucauaaucuuuuugcuggugaagggucuugccuugauguugauggcugcugaagguuggggugacuggcaguuuaaauaauaagcaacaaugggguuugacacaacuguucgcucuuucuuuuaugaaagauuucuguguagcuggugauguuguuugauagcacuuuacccacaguagaaauucuuucaguauuggagucaauccucucaaacucugccaccguuuuaucaacuaaguugauguaauauucuaaguccuuuguugucauaaaaauguucauaguauuuucaccaggaguagguuccaucucaagaaacgacuuuuuuuuuuuuuuuugagacggagucucauuuuguugccaggcuggagugcaguggugugaucucggcucacugcaaccucugccucccagguucuagcgauucuccugccucagccucccgaguagcuaggacuacaggugugugccaccaugcccagcuaauuuuuguauuuuuaguagagagaggguuucaccauguuggccaggauggucucgaucucuugaucucgugaucugccugccuuggccucccaaagugcugggauuacaggcgugagccaccgcgcccagccaagaaaccacuuucuuugcucauccauaagaagcaaauucuccauucaaguuuuaucauaaacuugcagcaauucaagucacaucaucaggcuccacuucuaauccuauuucucuuucuauuuccaccacaucugcaguuacuuccuccaacuaaagucuugaacuuuucaaagccaucccugagaguuggaaucaacuucuuccaaacuccuguuaauguggauauuuugaccuuucccauaaauaacaaauguucuuacuggcaucuagaauggugaauccuuuccagaggguuuucaguugauuuuauccagcugcagcagaggaaucacuaucuaugucaguuacagccuuacagaacauauuugugaaauaauaaaacuugaaggucaaaauuauuccuugauccaugggcugcagaauggauguuguguuaagagacuugaaaacaacauuaaucuccuuguauaucuccaucagagcucuuaggugucuaggugcaaugucaauauuuugaaagaaauuuuuuuuuuucugagcuguuggucucaauagugggcuuaaaguauucaguaaaccauguuguaaacaguuguacuaucauccaggcuuugcuguugcauuuauagggcacacccagaguagauuuagcacaauccuuaagggcccuaggauuuucagaaugguaagugaacacuggcucaauaguaauggugaagaaguuugaaauauuucgacacagagacaaaauuagcacaugcuguuggaaaaauggggccaaaagacuugcuucacacaggguugccacaaaucuucaacuuguuaaaaaaaaaaaaggcaauauaugcaaagcacaauaaagugaagcaccauaaagugaaguguaccugcauaccaagugcaaauuacagaauuuuuuuuuauaauugugaaaaacaagaaacaguuaucuaucaguggagaauggauuagagaaaacugauauauucauacaguagaauauuauaguuuuaaaauaaacugaaaggaacuguaugaaucaaaauagaugaaucuugaaaaauuuuugaguauaaaaggcaacuuauagaugaauguauacauuaugauauuuggcauaugaucauuucugaauuggaagagaccuaagcuauaagcaucucuucacauuuuuagucuucucuuccguccacuguauucaugccugacuccauccucuuguuguuuuugaaacuuuacuaucaauuucuguaaaacguaauagacuccaauuucugguguuauauuaugauagcaauuuuuaguugagaagaaaguugaaggaguuaaaaauugggaagucaacuaagagccagcucaaggaauccaguaugacuuggaaguuuacaugccauauugcaaaaugcaacaaccagaacucacgucuucugauuucugaucuggugguauuacuguucaaucauuucuuaaaaagcaaucugaggccaggcgcaguggcucacaccuguaaucccagcacuuugggaggcugaggcaggaggaucacuugaguccagcagaucaagaccagccuggucaggccgggcgcgguggcucacaccuguaauccuagcacuuugggaggccgaggcgggcggaucacgaggucaggagauagagaccauccuggcuuacacggugaaacccugucucuacuaaaaauacaaaaaaaaauagccgggcgugguggcggaugccuguaaucccagcuacucgggaggcugaggcaggagaauggcgugaacuugggaggcggagcuugcagugagccgagaucgcgccacugcacuccagccuggccgacagagggagacuccgucccaaaaagaaaaaacaaaaaacgaccaggguggucaacauggcagaaacccugucccuacaaaauacacaaaaaauguaaccaggcgcgguggugugcgccuguggucccagauacucaggagacugaggugggaggauuguuugagcccagggggcagagguuguagugagccaagauugcacuacggcacucuagccugggugacagaguaagaccaagauccuguuucaaaaaaaaagcaaucugaaaaauaacauuaagggugauuuaauucauaacaaccuuucguuguuucauucccuucugccuuuuucuacuaugcuccuccacuagauguccuauuccucuugcuagaauuacccuuuauggaaaugagcucaugcuagaaucuagagcaccauuuucauaauaguuuuauacaagauagaagaguagcgacucuauuucuccugcuaaaaucaagauaccuacucucuuuuuccccagaaaucuucaaaaccaguagauucuggucuuuuuaacugagccauuagaauuuaguuuauugauuggugauauuaaugauggcaaaauuuugggcaguucggauuuuguuuaauuguuuugugaaauuaucacaaugaauuuuagaugacaugaacuguuacuucugguuuauagaauacgaaaguacauguccaccacugagaacuauaaaaacaugucuggcuucaguauucuaaauguuuauaccuuaccuaguuguacauaucuauauucuuuguuguugucaaguuaagauuuguuuucuagaaccaaaagucugcccacucuuauggccauguuuguugauaauacucuacuggaaaccuuuaaugagagcuguuauaacauauaaggauuuuauuauucaucagaaagaacugauuuacucucuuacuugagaauauugggaucucuucuauuaaaauuauaauuaguagucauauaauuuuugcuuagagacuuucaaagacauacauaauugugcucgcauagucgugccccauaauuaaaucuuucuguguuuguaaugguaaauuauuuauguuuuaccuucuuuauuuucuaaggaacuggcauuugauccauaugaaucguaugcucgagauauuuugcgaccugguuuucaugaucguuuccuuagucaguuaucaaagccuggggcagcacuuuauuugcagguauaguaauuuuuaaaugaagauguacaaugucugaaaaguaaacuuaaaaaaaaaauuaaaucacuuuuuuuuccagucaauaggcgaagguuucaaagaagcuguucaauauguuuuacccaggcugcuucuggccccuguuuaccacugucuccauuacuuugaacuuuugaagguaagaaaacucuuuauuguuauuuguaacauauucaagugugaauuuuuuuuuuugcuacuucauuuguaaauuauugugugaguacccugcacauuaguguguuucuguuuucuuuuuccagucaagaagcaaauggaaaucagucugcaaaagaguagcauauuuucucgucuuaguagugaauuuuauuuuuguuguuuuuuaauuuuuuuguuuuuuguuuuuucuuuuuuuuauuuuugguuuuuuagugaauguuaaagcaauugucagauauuuuugucuuguaccuuuacuuuuuguuuacauggcugauucuuugaaaacaaccuuggauuuaugcaucgcaguuuccauuuggggaccucagcagacucagggacucagugugaggauaagggagccagugugaggauaaggccaaaguaauggggaagguuaguuuaccugacuuucauagcucaaguuugcaacuaucuguauuaaacuguuuaucauuacuuuagaaacaauaaauuucuguaaucucaguaaaaauugcccauuugaucacaguucaaaauacuaagcacugacugaaaggaaagggguugucucuuuuuucuuuuccuguuauauacugaaauuaaauaaaagucuguauaaauuauaauucaauaguguagcucaaagugauauucucucuaccuuuaauggacuagccuuguaaagacaaaagaagacaugcauuaauagcguuauuauuucuuuagcuuucaaaugaguauuuguuucaucaaagaaaacuucuguuuaguaucaugauucuuucacagagaauauauuacuggaaaucauauuuauaguuugcagaugauaaaaugggcucucuguaaugaaucaaugaaugaauagaaggucugugaauuuauuaacaguaaacuggaggaacucucauccuuacauuuucucaggucucugcacugcauaguagucauuuggaauucaguuugauuucucaauuaggaauguuuacauugagaaaggacuaagggaguuaaaagguauuuuuaaucacuaggcagaaaugacaaagcucuuagcaauagcauaccauuuaaggucuuuggaaauacaggaugaguaucuuaagaggauaaucaagagaggaagcauuuaguauguaaaaucuuuagaaagaauucauuauuacuaacuauaguuauaaugggacauuuacacacuguuuuguuauauagaauuuuucuuuguaaugguuucucuaauaacgggauuuuuuuuuuuuuaaccugagccuguaaugaaauucagaaagauucaaaggccauauaaaaucuuaaggccguuaucaguuuauaaauaaaaacaagaaugccagguguguuggcacacgccuguaguuccagcacuuugggaggcuaagacaggaggauugcuugagcccagguguucaagaccagcuugggcaacauggcaagacccugucucuacaaaaauagaaauaaaauuagccaggaaugguggugcacaccugugguuccagcuacucaaaaggcugggcaggaggaacacuugagcucaggaggucgaggcugcagugagccaugaccacgccucuguacuccagccugagaaacagagcaagccccugucucaaaaauacaaaacaaaacaaccuuccccuccaaaugaacccaagaagcuuugaugaaaguucagaaggcuauaaaacccaaucaucuuaauaauauaaaagaaauuuuuacuccuucaaguguaggcaauuaaaauuucuaaaauuauaacuuacauuaauagaauuuuaauaagugcaucauuuagcaauuuaagauuucuacugauuuaagcauguguaucccuuguucguauuacugccuaaguuauauugcaaaguuagcaguauauugggcaggaaauuuugucuaauuaguccacaagacucucaucacuuuuuuuuuuuuuuuuucugcacaccuauaaucccagauacucaggaagcugaggcaggagaaucaccugaaccugggaggcgaagguugcagugagccaagaucacgccauugcacuucagccugggcaaaaagagcaaaacuccaucucgaaaaaaaaaaaaagaagaaaaagaauuuccuagcagcccuggauaugccaaauguguucaggguuccauggguaucccgguucauauuacugccucuucgcuuguucuuuuuucccauuuaucuggaauuccucuucuacccucuccaggcuggagugcaguggcaugaucucagcucacugcaaccucugccucccagcuucgagcgauucuccugccucagcuucccaagcagcugggauuaauuaaaggugugugccaccacagccgacuaauuuuguauuuuuaguagagacaggguuucaccauguaggccaggcuggucucgaacucuugaccucaggugauccgcccaccucagccucccaaaagugcuaggauuucaggugugagucaucaugcccagagugaguuccuuccuuucuuuacauacaucucuuuagagaacuuguuccauuuuuauugucugccuuaucauucaacuguuugcucugugaagaauggagcccuauuaucuuugaauucucauaccuauuacagugucuggcauuuaggcuuucaauaaaugcuuguuaaaaaaugaguggcaaaaaauauauauacauuuuccuuuaaauucuuaugucuuauauuuuaaagaaaguuuaacuguaaauuuuauauaauuaccuuuauuuuggaaacuuagguagaaugccuuaaacuuuacaaagucaaaagauaaguuuagcuauuaauaguauaagacuguugaacacaaagaaacaauaaaauggugguuaccagaggcuggaggguaggggaguagggagauacuggucaaaugacacaaaauuucaguuaggagguguaaauucaagagaucuaucguacaucaugguaacuacaguuaauaacaauacauugcauauuugaaaacugcuaagaaaguagauauuguguucucaccacgaaaaaaaguauguguuaaugcacauguuuuaaguagcuugauguagccauuccagauuauauacaucuaucaaaagauccuauuauauaccauaaacauaugauuuuuacuuguugauuaaaaaauaaauuaaaaauagugugacuuuaaugcugcugacacugaaaaaauacucuuuccuucagcaguuaaagauagcagucaagucuucacucuuuaacuugaaaaguuaaaguuaauuuuuuuaugaaguaaaaaaacuuccuuugugcccuuuugaaaaccauauugcuucaauaaugugauuuuuguaugugaaguuuaauuuacuucauuaaacaaauuuagauuucuuucuuggggcuaaguaaauauauugaccaguauuuuauuuuauuuuuauuuuauuuugagacagagucucacucugucgcccaggcuugagugcaguggcaagaucuuggcucacugcaaacucugccuugcggucugaagugauucuccugcuucccaaguagcuggaauuacagacgcccgccacuacgccuggcuaauuuuuguauuuuuaguagacaaaggguuuugccauguuggccaggcuggucacgaacuccugaccucaagugaucugcccaccucggccucccaaagugcugggauuauaggugcgagcccccacaccuggccugaccaauauuuuaaagguuagcaaaucaguacauguuugguuccacaaagguauuaacuuuuucuuuguuccuuauacaugggauuuuaucucccucuccccaagaugcacccaaacaaaccuuagaaaaaaccauccaggaugacuuugaauucccuagagaauugccuauucuuuuucuuguaugcuggguccuuguaaccuaggggaaaguaaguuucccucuauuuuaaaauucagguugaagucuauguuguuguguguacaugaguguauuugguuuccuaaggcugccacagcaaaguaccacgaagucagaggcuuauaaacaacagaaauuuauucuuucacaguucuggaggugaggaaucugaaaucagggugugggcagggccacacuuucucuaaaggcucuaaggaagaaucccugcugccucugccuagcuucugguggaccccagcgauucuuggugguccuuggcuuauagaugccaucacucccgucuuugccuccaucugcacaucagcuucuucacagcuucacguucuucucuaugugucugcauccaaaucucgcuuuccuuucucuuacaaagacaccaagucaguggauuuagggcucacccuaauccaagaugaucucaucucaacuugauuacaucugccaagauccuauuuccaaagaagaucacauucauagguaccagggguuaggacuugaauacaucuuucaugggggacacaauucaacccuuaacaauaaguuuuugguacacuauaaaaauuaaauuuuuguuguucugauucuccagcauauacacuggcuacauuggcuuuauacgcuggcuucccccuaacacccccaucccucuuuuuuagagauaggucucgcucugucacccaggcuggagcgcagugguaugaucauagcuugcuacagucuggaacucaugggcucaaacaaucuucucaucucagccucccaaguaacugagacuacaggcaugcacuaccaugcccaacuaauuuuuuuaaauuauuuuuuuguagagacaaggucccauuuuguugcccaggcugaucucaaacuccugggcucaagggaucuucccacauuggccuccgaaagugcugggguuaauggcaugagccaaugcacccagccuuuucuuucccccucuuucgcuuuuuuuuuuuuuuuucuguuuucuuuuuuuguguuaggccaauuaaucauuucauccugaucuuauauuuuuuauuuuuauuuauuuauuuauugagauggagucuuguucugucacccaggcuggauugcaguggugcuaucacagcucacuguaaccucgaccaccugggcucaagugauuccucagccucacaaguagcuaggaccguaggcacaugccaccacgccuggcuaauuuuuuaaaauuuuuauuuguagagaugagacgucgcucuguugcccaggguggucucaaacuucugggcucaagggcuucucccaccuagaccucccaaaguacagggauuauaggcguaagccaccgagucugguggagaaucaauggagguucucucuaguguacauucccuugaaccagcuuucuaaauucagaaauucuuaucuagaaaccaucggcucaaagcuacaugguauuggagcugaccacaaauguugaaugucuaaaguuaaacauaggauagcguaccacaggagccauuguaaacaaacagcuaacuauuguauuacuccaauuuuuaauuuaauuuuuugguuuugguguuugggguuuuguuuuuuguuuuguuuuguuuuugagacagggucucacucugucacccaggcuggagugcagugguacagucacugcucacugcauccucaaccucccaggcucaauuaauccaccuaccucagccuccugaguagcugggacucugguugugcgccaccaugccuggcuaauuuuauuuucugguagagacggcaucuggcuauguuguccaggcuagucuugaacuccuggacucaagugaucugcccaccucagccucccaaaaugcugggauuacaggugugagccacuauaccuggccaauuuuuaauuuuaaauaaacuugacugcugugagguacauuuguaguuagugauguuuucucugauuagaacagagaggugguuuuaaaagauauguuuucauaaaugacauaucguaacauuuuuuaggguugauugccuguuuaauguuuggaauugaaauuucguuuuaauuaagaauuucaucuucuccacccauaccuuuuaggugugcugguaccauaaaauaauaauuuauuugaaugucaugaccuuucuuucccucagcuuuuaguggaauguuuaaaaugaugucauggcaaacaggagcaaaagccuugaauuacacagcaguuaguuaauuaguucuggaauaauuuggauaauauuucauacauuugcuaagagggcuaguaaaucaaguguuacucuuugcauuuucuauguuguaauccacuguggugucucaucaaacgguaugcaaauaacauuccaaaaucgaaaugugaaccuaaucuuugcuuguguucuguuacguugugaugagcucuauguauauaauauuuaaaauaaauggagaucuuuauuuuuauaucccaaauguuagacaauuacaauguauauuucuuggguguauacuuugucauucuugugcauugcaauuuaccuguucuauggaauagguuuuauuuagugaauauugagguuuuucaaagucauuucaguuauuuggguaccuauuauagugaaaagucacgggacugaaagucaagaauuguggaucuaguaccugccuguuagugccuucaaguaaaugguaguuccuucguuguauacaaugccauguuggaggaaauuaauuccaaggaauaaaaacgaauucaagcauuccuuuuuuuaaucaaagggaagccauuauaugauugugagugaauugagcauauaaaaugcacuggguacaacaauuuauuuuuuauguaucaaacacucuugaguuuuagucuccugaauacugcuauauucuuuauauucauuguagcuuuuucuuuugacagcuccuuacauuuaaucccauuuaucucccaggguuuccuuugcauauggaacacaccauauugacuauugccucuuuacuuauuucuaagggaccaaaaaaauucgucacugguaaaagugguuucuuucuugugaaaaguuaaauuuuaucaucucaauagagcauaugaguuuucauucugcuuuaaaauaugauuccuggcugggcacaguggcucaugccuguaaucccaguacuuugggaggccaaggaguucgagaccagccuggccaacauggcaaaacccugucucuacuaaaaauacaaaaauuuucugggugugguaacacgcagcuguaaucccagcuacucuggaggcugagguaggagaaucgcuugaaccugggagguguggagguugcagugagcuaagauugugccacugcacuccagccugggagacagaacaagacuccaucucaaaaaaaaaaaaaaaauaauaauaugauucccuagaugaguuuaaguacaaucucauaugguaauauaaucucaggauuuaguacuuuuuuuaaaacuauucaaauaaacugccuuuguacaaauguaauuguuacuauugcacauuauuauuaaauaggcacucaugaaaagcaugguauugaauaucacugguaacaagaggaugcugcuuuguugagucucauuuacauacuaauugccacugcuuugucucuguagccacaauaagccacccuuuugaugguaguuagcuugaauuauauugcaccagugccaaguuuaaauuagcuauguuaaguaaaagaagcaaaaagugguagaagaaaggucauuuauuacacugaaauuuauuuuagaggcuugccuaaugcuauaaagguaaaaaugacauuuuaaaaguauuucaucaggaaaguuuuauggguuugaaauguacuuuggguuuguggcuuuuaaaauauuaacauuuuugagauaccagaauauucuguauguaaaaugcuacaguuaaauaguagauaaaugauuccaaaacuugaaacauuuuuaggauagaaaaucaaaggauguccaaguggauuuuuucuuuuauaaauauuuuuauguguaugagaauuauauauuuugucuaccauuagguauguuuuccugaauuaaaaauauaaaaaauguauccaggacaaaauaucaaaugcucaauauucugcuaccuguuaguuauuuaagaccgaaaaauugccuuguaucuuacugacuugaauuucucugggcuuugcuuuugagugauuaaauucucaaucaacucagugaacuaauucaucguucaguggugcuuucauuaaauuugccuuaagguauacagcaagcuugucuaacccccggcccaacacaaauuuguaaacuuucuuaaaacauuaugagauuuuuuugcaauuuuuaaaaagcucaucagcucucguuaguguuaguauauuuuauguguggcccaagauaauaauucuuccaguuuggcccagggaagccaaaauauuggauaccccugguauauagcuuucaauguuagauuaucugcugcuuuaaagacuaaacuugauaauguuuaaugguaacauuuuauuugucucccagaauucugccaugugagaggcaaauaguuucaaaugauagggauggaagguacuuugagagauuaccuggauuccagccuucagccuacuaguaauaucuguuaaguaaaaaccuaguaucuuucuuuaugaacccuggccauuggcuuucuuuaaucuagcuggccauauugaagaacaauauuaugaauaaaagauauuugauuuuuguauuaauauguacacuuuuaaagucucuuauccuuuggaaaauaucuuucguuacccuuuuuauguugagaauuguuaggaauaaauuuuucuguuuuuuuuuuuuuuuuuuuugagacggagucucacucuguugcccaggcuggagugcaguggcacgaucacggcucacugcaaccucugaccccugaguucaggcgauucuucugccucagccucccgaguagcugggacuacaggcgugugccaccacacccagcuaauuuuuguauuuuuaguagagacgggguuuuaccauauuggccaggcuggucucaaacuccugaccucgugauccccccgccucagccucccaaagugcugggauuacaggcaugaaccaccgugcccagccuaaauuuuucuuuuacuuaacacaguuaagacugaaaauuuuccuaaaaauguagauuaugccucuaguagaaaguauggugaguuuuuaauaaugaauauaagaaaucuggauaauaaaagcuaaguauuaaacauuacaauaugguauucauuacuucuagaauauuugaccauuaaaguauuuuaaguaaauuuuaauaaaaaugguuuagaauauaaguaagaaaucuguuuacuuuucacaggucaucagugcaugugguaugugcaugcgcaugcauguaacugauuuuuaucaauugaagcagaaaggaauguguuguugaccuuuaaggaauaccugugaaaaacacaaaauccuuaaaguacuaauguacuaaugaauacuuaagcuaauugaaaaguaaacuucuagccaggcaugguggcuuacgccuguaaucccagcacuuugggaggccgaagcaggcagaucacuugaggucaggaguuugagaccagccuggcuaacauggugaaaacuugucucuacuagaaguaaaaaaaaaaaaaaaaaucagucagguguggugacagacacccguaaucgcagcuacucgggaggcugaggcaggagaacuacuugaagcugggaggcagagguugcagugagcugagauugcaccgcugcacccuagccugggguacagagcaagacuccaucuaaaaaaaaaaaagaaaaauaaacuucuuuauaaaucacuuugaauauuucaugauuguguaucucaagucuuuucauucaugguagagaguagguauuccuaaauuguuggaugaaaacucuauugauaaaauguuauuuuauuuuauuuuaauagacgguaucucaaacucguaggcuuaagcgauccucccaccugggccucccaaagugcugagauuauaggcauaggccauugcagccagccaauaugugauuucuuaacuuuuccuuuugguaaccaggaacagguuuaagauguaugagugaauuauugugacucauacaucuguuaagugcuugcuugaaucauagccaccuuacuguauugacaauuaguuacugaugacuuaguucuuguuaaguagagacguucugucugacacagauauuugccaguaauagaaaauaugcuugaguuucaguuucauaaauauguauauuauagcuucacucaaaaucuuaauguggauauggacaaaguucuuuauuauacuaauguuaauucuguaguauaauuacaaagaaaaccauuuacacuuacauuguguguuaccauuuacaaagugcuuugguuuuuaauaacaaccccuaaaaguaggcaggguaggcuuuuuauaagccuuauuuggcaaaugggaaaaguaagacucagagaucaagugacuugccccaaggucacacagaaguagagucaaaauuugauccuagauuuuguaauugagauuccuucuacuauauugcaucguucucuguauauuuaucuuccuuaucaucucaauauuauauaacaauaauauaggggucagaaaccuaagaccaaauuccacacuuaaaaaaaaaaaaaccucgucuacaugcuuagugguaugcuaacucuaugauaauucaguagaucgauuaugcuccccauuucuuuucagugguaugcaccuugaaaaacuacauauuacugccugucacaagauauaacccaucuuaacacugcuaaucuuggucuuuuaauguagaaaacuugguuguguauuaauaguaacacacaagaaaaacacuuuuaaaaagaauauuugaugacacauuuaaaauuuuuauugugacaguugaauaaauguuauuuuuauccuuaaaugaguuuauuauuauuuuauccaaaaauguacuacugguucagauuugucauuuuggcuuuacagcaguuagaagaaaaaagugaagaucaagaagacaaggaauguuuaaaacaagcaauaacagcuuugcuuaauguucagagugguauggaaaaaauauguucuaaaagucuugcaaaacgaagacugaggugaauauuuuuacuuuuuaaaauauccuuuuuucccugaauauugugguguaaauucagggaucccaguucccuccucaaguaaacaaugaagaaaauaguuuuagugacaagccuggucuuuuagaggaagugacaucaaagccaagagaauuguuauuguuugaaaaaccuuucauauuugugcauuuuccuugcauacucccagacaagaccuccugagagucaacugguaagcugaaggagagacagaguaaaauguaucggguagauuuauguuggcaucguuauucugucaaaguaaaauuauuaguguccuuuauuuuagggauuauauaacuugaggcauuaauucagauaacauugcuuccacuuuccugauuauaauaugugcuacauguuuuuagcuuugggucuuguccauuuaaacucuucuaaauaauuuauuuuaaucuuucagauuacuuuuuuuuacuguauugggcuacuuuuuauuaguugucauucuaaauauuuaguagccaagauagaaauaaucauuuuguaguuacauuuaaggagaauuuugucagcaaucauugugcuuuuuagaacacugaaaaaaauuucuagguugcuuuaauuuucaaaauuguguaauuuuguaauucuaaucuauuuggggaauuagugaauaccuucucagugagacuuguaaaaaucuacuuuuacacuuucccuuacuuacaugagcucuagguuuucugucaucuauguacuaauaaugucuuuuucuuuauuccagugaaucugcaugucgguuuuauagucagcaaaugaaggggaaacaacuagcaaucaagaagaugaacgagauucagaagaauauugaugguugggagggaaaagacauuggacaguguuguaaugaauuuauaauggaaggaacucuuacacguguaggagccaaacaugagagacacauauuucucuuugauggcuuaaugauuugcuguaaaucaaaucaugggcagccaagacuuccuggugcuagcaaugcagaauaucgucuuaaagaaaaguuuuuuaugcgaaagguacaaauuaaugauaaagaugacaccaaugaauacaagcaugcuuuugaaauaauuuuaaaagaugaaaauaguguuauauuuucugccaagucagcugaagagaaaaacaauuggauggcagcauugauaucuuuacaguaccggaguacacuggaaaggaugcuugauguaacaaugcuacaggaagagaaagaggagcagaugaggcugccuagugcugauguuuauagauuugcagagccugacucugaagagaauauuauauuugaagagaacaugcagcccaaggcuggaauuccaauuaucaaagcaggaacuguuauuaaacuuauagagaggcuuacguaccauauguacgcagguaagaauuaugcaguugccugucacuuuuguuuuccugcuucaaacugauuuucuuuccugcauggguuuauugugccuaaaauagaaaagaaacuaacaaccaaagaccucuuuucuuugacuaaaaauaccccacuuuauauuucuuuggaauguuuuacuuuuucuacuacacuuaaauacuuuuuuuuaaccuuaccaucaguuauagaugagaaaaugaggucacuuggcuaaauuuauccaguuagaaagugacagaaacaagacuaaaguuaguaguaaaucaucauuauugggaucuaaaaaguuuuuuacuccuuuaucuuuuuuuucuuucuucuuuuuccauuucugagauuauaaauaaaaauuuuaauauaacaaaauugugcugguaguacaaauauacacggcauugcuuucucucaguuuccacuccuaaaccugauuauuuaauaauaaauguugcaauccuggaagccaaggauuccaguuuuauuauaauuuuucaccuagaaaugucuauagucaguguauuuauuuuacugacccaaaaauuuaaaaaaucauaggaaauguaaauaggcugccuagauuuuacaugaaaaacaaauagguuauugucauuuuuuuccauauaaagcuguuuuuugagagguacaauuuuucgguaguaugaccugccgauuuaguugugcuucaccaaccuuuucuauguucuuuaugaucuagacuacaacuauaaaaauguuuuuuauucaguuacccaaaauuugugauugcaaaauacuucuuuucugcuuaagagauuuuuaaggcuauaaaaguucaaauugcccuucuugccacauuuuccugguuuuuaaguccccuuagaggacucauagaauuuuuauaacaugagcauucuaaacuuuaucauuucauccuaaguacuuuuguuugggguuccuagacucauuuggaguaaaauuaaucuuuagauuuuucucuguguuuguaagaaagaaguuuuaauuuuuuuuuuuuuuuuuuuuuuccuguagagcauuguaagaagacuuacuacuaguguuuacugucacaagucagugauacuugggcaggaaaacauuuucaaauuacaaaauuuuuaauuguuucuguaagacuugauugagugauagaaguuuucucuaaauugcuauauuucacaaaguuaauuuaugauuauuaauaagcagcugaagaaugguuacaacuauugucuggggaacugucccuuuuauuuauuuuuuuaaaugaggacacuuuaaagcaaaauuaacuggaacaagcugauacuuguuuuguaguccugaaagucuucuuuccuuaauguguacaauguuagguaaaguccguggacaugguacuuuuguaaugauguuuuauuaguuauuucugucugauacuucuuuucuauaucaauuuuuagcuuugguauagaguaauauuuugagugcuuuuacuuauaaugaauauaaaacacuuaaauuucaagauuuauagaacuuugccaaaguuaaguguauugaaaauuuaaguugaugagauuauuuuacuuaaaaaaaauguuuuuaaaaaauuccuuccaauaauuuuuugagaaauaaaaggccaguguuguggcuaaguuuuuugauauuuuucuuuucugucuucuuuugaagcuuaacugaauauuuuaauuuaugucauaaauauauuacuggugaaacuggagucuacaagcagcuuucgugaguugugguuuacaguacacacacauuaguguuaacuguuagcuuauuugggcuauucuguaaggucuguuacugaaguuauuacuggcaacauagaaugguuuuuaauagaccaucugugaacuuguaaaacugaaauggacuuuuaaggccucacuacaaugguaacagaucaaguuaccauuuguuuuuaagaacuacuggucugcucuucuccucucaucuuucuucagccuccccaaagagaaaagggauuugugauuugguuaguagguauguuuauuggagaacaugcaguacagguuguggcuuacacugaaacaaagcuaacauuuaacuuacacauuuuuauuuuauuauauagaauuguaauaaaagacauuggauauaauacaugagaaaauuuaaugaauacuauaagacacgacuuacagacaucuuuuagauuauuauaguuugguuagacauugucauaaaaacagaagagaaacugguuuaaccuuacuuuauucagacuucacuguggugucagccaacuuuaucccucaaauauuuuaacaguaauguacaaaauggagcuauagaucucuaaugcuagaagagaugcccaagccuucacuuuguagacaaaucccaaggccccugaagauuauaugauuucccagaaguucuauuacgaguuaauuccagaacaagucaagaauuagguuucuugacucuaaauagaguauauuuucuaccauguuacauugacucauauaaggugauuguuuucaugaauagaauauguuguaauuuuuuaauuauauguguuaauaauuaaguaaaaggaucugguacagaugugagcucaaaaaaaauaaauaaauuacuuccuugguuugaacugccaauaauauaaauggcuuguucauuucugggcaaacgugcguacuaugaagauauugucaguaauuuuuuuuucuugaaauaggauauagguaagcucugacuauagauacacuuccauuggaaugcauagauuuuuuauguauagauacuggucauuauuauuauuuuuauuuuuuuacaaaacccaauuauuagucuauugauguaguuugcucacuaaagggaaagcuuuguggaaagaaaaauuuaaauuuaggugaauuagaaagugguuaacuugcuuaaaagauugcaacagggucuuagguggaaucuaauuuauagcuugucucucagauucgguguuucuggauguaucauaauuugcugacuauaucagaacuuugggguuugucccaaaaacuaggggaaaaauuauccaauuggauggaucauucuaaaucuggcaaugguaugaagagacuauuuccuuauccuaaguaagaaagcacaaagcaauaugcacaaauaaaaaguugagaguaggaauuucacgucuguuacagaguuguuguaggcaacaaaguacaaguuaaugagaccuaaaacaacacgaguagauaaaugguagguggugcuguguccaguuugguagucuauuuuagaaaaaugagaugacccugaaguaaggauaauaauucagaauugacauuuuaugggaaauaaaagcuuugcauauugaagugagggaaaagguguuucccuugccugggaauuucucuuuuccagaagaugguauugaaaaaacuuaagccagaagaucguuuucuuuaaaguauuuacugcuauuuuauaccuucauagggaaaagccucaaaaaccugaauuagauuuauuuugaguuuguguccuauauaagcucaguuucgguguuuuaacuuauuuaaaucuuuugaacaauuuuucaucuauagggcagcgcuguucuauuuuuauacucucugauuuuuuaaaaaaguguuugugcgucagcauagcgucuguuuccuuuuuuaaggaauucaagacugauuguuuauaaauccuuguugaggagcuuauuguuucuuguagcuuuuuaaauggcugcauuaaagggagaauuaucacaugaacagacauccugauuauaacaguguuuuacuguggugguugggggugggguggucuuuacauaaauaacuuuuuuauguaauaaauacaaauuucauugaccuugucaaauaaaaugucaugucaaucaaaauaggcacauaaggaaaaaggauuggauuaucacuuccaaucuauauucugaacacuaauguagguauacucugaguuccuaaaauuuugaaguauugugcaguaaaauaucaaauaaugguuuuauagugaggaaaacagagacagaaggucagcagaaaaaaauaacuacagcuucuguuugaaauaaccugguuauuucuguuugaaaauaaccuagcuguuuugauugggggaagcagagcaacuagugaacaugguggaaaccuuagcguagggauuugagagucaaguagcaaaguaauguuaucucuaaugaugagggggaaaaacuguagaaaaaguuuugguuguugaccauauugaaauucaucaggagaucauguuugagaaagaauuuuguggaauuaucuccacaaguaagugauaaacagaaaggagaauauaaaaaugggcuauuuuuaauuuuuuucuaggauuauauguuuuugcuuauguuauaaagccaaacccagacuggcuuuuguauuuuuauguguuuaccuuucaucucucucugcaacaugguuuuagaauauggguagauaacugcugcuccacaacuaacaacggcaguauaaaacuuagcuuuuaccauugccuaaucaauggaacuagguauucuguuuucuuacagaauuauauaaccuguccuuauugaugggcauuuguuuauauuaucuuagcucuuuacaucaucaguaagauaaacgucuccagugguuagcgacaugguguguguuacagucauugaaauggagaaaccaauccaauagaaauaaaaauaaugucuggaauuuuuaugcuuuucuguguaaaauuucaaauauaaguacuuugucgucuuaguauguuuuucauucauuagcaauuuuucauugcuuuagacuaaaaacagaauauaaauuaauacaagccugggacuauaugcagccuuuaagauauuuuuugaaaguacuuaaauuuuugccagauuuucuugguuuguuuuuaguuucugcugcuuuugucuuuuuggcaagacuacucuuaauuccagucaagcuaaaaacaacucuagaaccuaauacaacagucaugauuaugggaguguuuauuucacugccagcugcagaaacccuguacagcauacaggaagguacagcuguuaauuccuaaaaucuagaauaaggcugaucaagaguuacagaaucacaauuagacugcuaauuuuucagugacuuucuggugccuuuaaccaagauuagcaguacagguacauucugaguuaaucauucauguaaauuucuauagugguuauauaacucaagguuuaauucuuuauauuuagaucucacagcuguggaaacuuuaaggguuucuuuaauccagggagguuauacgauaugauagaaaagagcacuaaaucaggaaucacaugaucuagguucuggguccaucucugccacucuacaguaugaccuuagauaagucuaguuacaucucuuccagcccugcucaccucacauaaaucauaugaaauaaguuaugucaaaguucuuugagaauguuacauaauagaccaagaauuggugugaucccauuugacuguggcacugagacacaucauggcuuucccagcauuauaaucaauuacuaaagaacugaaauggccagaaguuuuggcuuaagaagaugaaaagucuguuuagaaauagcuugccuuuaaacauagccacaguuuucuuaaaacauacuuuaagucacuuagaacuuggcuuuuauucuguuuuucaacuuaaaauuccucuugaugucccucaacuuuuuagccugauuuucauggcauuugagaaaauauggaggugaguguugauuuuagauuuuuagacugaaauaaacuuuuccuuuaaaaagggagagggcacccuaaauuuggaacacaggucaaggaugcuuggaguacucuguacugcggguaugggcucucuccagcagugacaacucagcaucucucuaguggccacugcuuuugcuuccuaaacaugcuguuuugaguagccucaccuuacaaauagauuugcagaacaggaagaagauucuugaaagggaagauugugaugaaaccgauaaaaaucucuguauuaaaaucuuguacagccuucuguuuuaauaucuuuucuucuggaugagacauuagucuuuaacuuuugaggaacucuguaacugaagacaaacaauaaaauaccaacagagaggaaauuauuaaaggauuauauguauuuaaauuacuuuuaucaguaacccacucuagccucagaagguauaaagcuaacggagaaggggacauuuaaaaccaauguauuuuuauucuguaaaucuuuaacuuaaaauaguauuuugaauucaagguugucugauauuuaaaucaguuauuaucucgaugaccacauaucaauagauuggaaguauauuucuguuuugugauaaauccaugaauuugcuuuuuggggaaaaagcuauuauaaacauguuauuuuaaggcuaaaccuaggaugggucuuagugagaaucagccuaaaugaaaauuuuccaaacaaauacauucugcuuuugcuaaauccuaugcuaauaaaagacauugugcuucuuauaaaacuuugacccacauuauguagccuaacagaaauaaaggcaucugcuacccucuaugaauuuacuauuggagucuaccagucccuaauacaaauaggaaaagaaugcucccaauaaaagacucaaguuacugaacuuuccccuccuuaaaaaaaaaaaaaaaaaaaaaaaagauuuacaauuaaaugugggccuugauaaaauuugaguuauagaagugagugauuucuccccccuauuaugggagaugucuuucccccucuuuaugcagaagacaacagcccaagucucuugugcuggugagagcagccuuucuccacaacuuaggauaauacuguuaaggagagacgggaguaggucaggccuaggggagugaucacacucagccucuuguuuuacuucauggagaugugaaugaaaaguagguccuuucauggaagggauuggagacuccuauauuuaugauugaccucucauugugacuacuugaaauaaaggcaauuaaagguuggaauaggaccaaaccaacauauucuaucacauuuaauaguuuuaauagcuuauaaguauuuguaagcaucuuuaaguaguugugagauuuuuagcaaauaauuuaaaaacuguauuuaacuuuagcuacuacuuuauaaguuccaauuuccaguugcaugcucuguuaacaugauuuaaagaaagcuagauaagucauccuagauaaacucaucuugauguaaggaaaaguaauggguuauugcuguggccuuucucuuuauaagggggauaaaccaacuggugauacuuugagauccugguagcaggugggaggggagccugguucccugcuuuaccuuugcuuuucuuucuugcucauuccuguggccgaugaguuuaagaucaucuugucagugugcagagggcaagaaauaaguugauguaaaguuuuaauaucaccacuaauuuaggaggcacuaagcuagcagugcauuaccaaguccaaagccuucuacuuggcaaaacauuuuggaacuuuuaaacuugacuauuugaucuauuuugaaaauguacauaacaguuuuaaucauuuugaaucauagaguuuaauaagauauuuuuccuuuuucuucuuagaucccaauuuuguucggacauuucuuacaacauacagauccuuuugcaaaccucaagaacuacugagucuuauaauagaaaggucuguccauuuaaaaaauauuuaaauucauuauuuuuuguuaaaaaagagauugagcuaagauccuuuucagaaauguuagaugagcuuuaaaauauacuucacaagcacuuuuucaauaaauaaaaucucuuagaugaacauuuauuuuauaauaauguuagcuuuuauuauuucaauacaaaaauauucuuuuuuguaugugaaaacucaguauuugaaauuucaaauuuacagaacuaaagaccuauauaaaauuuauagagucaagaaauucaaauucugaugaguuagauguucuaaguaaguuuucaaacauacuucauguugaguaaaauggaacuugucagugaacaaauacugugauggaaggaaaauauuucauguacccaaacaaagagcagucaguuuuucuggaauuacccuuaacagugauuaugucaccugauuuagaguaauuccacagaccaaaaaugaauaucagucccguaacuuuauagucacauuuauuuuuagaauuugcauguauucuuuauuuuguuuguaguuaguuuuaucuauauuggcaaguacuaauuucuuuuaaaaauuuuaaaauaauuuuauuagccuuuaauacuauaggagucucacuuguuuacacugauaugcauaucuucaguaauuuuuuacaguauucucuugauuuugcugacuggugaaaacguuugugguuuucuauuuguauaacucgauauaauuagucuuuucauuaauuuguucuauuuuauguuagguuugaaauuccagagccugagccaacagaagcugaucgcauagcuauagagaauggagaucaacccuugagugcagaacugaaaagauuuagaaaagaauauauacagccugugcaacugcgguaagcauuaaauaaaugaaguaaauaagucuuuaucaaacuuucguuucaauguugaaguauauaaggaccuuucccaaacaaggagaggggugacaauaaaauuaguaaauuaaauuuacuaauuagagcaguuaucagaaauuauaguauaagccuuaacauagaauuuuggaaguguuaagcacacugauaagauuaauuugguaagaguuacugcauuuucauuuguauuguacugugcauugugauaaacauuuauguuugauucccauguaauucaauucuguguuaaugccauagaguauuaaauguaugucggcacuggguagagcaccacuucuaugauuuugaaagagaugcauaucuuuugcaacgaauggaagaauuuauuggaacaguaagagguauguuuuuuuuuuuaggugccuaguuuuauauguaauaaaaguaccaacacggugacuaucaauugaugucauuggggcucaguaauguaagauguuuauaauaguaccagcauaaccauuucaaaaaguuaaaaauuuucaucaaauagcauuuagaccugcaaauggcucaagucacccuguugauccaauguauuuucauuuagugacucaacuuacugauuauuuuagaguugauuaagccaagucuucauauauaucccaaaguaugagggcauuugggaauuacguugugccauuauaacaccacugauggaggucgagugggccacaggcaaauagaaucagagaggaagcagaguggauuaaauugagacucuaugucuaacacugccacuaaucagauacgugacuuugggcaaaaucacuuagauucuuuagacuucaguuuucuuaucaauaacauaaggagcuagguuugucgaucucuaagguuuuccuucuaguuuuaaagauuacgugaguguauggcucuaaggauaucuuagacaaacuuauuuuuauuuccuuuguaugcucuaaaugauaaucagaaaauaguuaaauaauaguacuuucauguacaauauaaaacagagccacaucaaaacucacacuaaggaaucaguccucuggcacugauauuuauugguuuauaaaaugcaguguuaauuagaugaauauuguguauaaucuauccuuauaaaucuugugauuuacauaagauauaccuuuucuuggaggauuauaaaauaauacauuaaacugaagaucagaacaaugggauggacagucucuacaaauuaaguacuuucuaauuuuauuuggaaaggaucuggaagaauacauaccaggcuauuaacagugguuacccaaaugaagaagaauaagauuaggauuggggaccgggaaauggaaaaggagaacuugcauuuuucauuuugaucauuugaacuuuuuauagcaaagauacauucaggugucauccgugugacuuuaaaccauuuuuaaaauauaaaauauuaaauaaagaauauuuaaauguuauuuaaaauauaauguauugcagguaaagcaaugaaaaaauggguugaauccaucacuaaaauaauccaaaggaaaaaaauugcaagagacaauggaccaggucauaauauuacauuucagaguucaccucccacaguugaguggcauauaagcagaccugggcacauagagacuuuugaccugcucaccuuacacccaauagaaauugcucgacaacucacuuuacuugaaucagaucuauaccgguauguaauuuaacauucaaguugaaaagucauuucaaaagaguuaacuuuuaaaaugaaauacugauuucugccuuauaggguuuucauaagacuuaacugaaauauuacaugaagugucuaguaauaaggccaggcaggcaguuccuguucuuuuacuccccuggucccucuagcugaauuuacaccuucugucuuucuguguucaccccuaguugguaaggcuagguucaaauccuggcuuuaccaauugcuggcccugggcaacuuuaaccuccuugugugacuuuauccuucugccccuuauuuuccucaagaguaaaauggggcuacugauaguaccuacuccuggggcuguuuugagguuugcaagucaauauauguacauuaccuagcacaaaguaagggcucaauaaauguuagcuacugcuuuauugugaacuuacagccauuauagucuuuuuuaaucauacuacauugauguaauuaucucaaaaauguccuucugauuuuaaauggagacuacuuagaaucuuaaauuauucacuuuuuaauaacuaaaugagaaaaugagauaaauuuauagaucucccacugaaaaucguauuucugaaaauuacaguguuagaaucuauuuuauuuccuaggacccuuuugugguagguuuuuuuccucuccuccuuuagaccaaaagaaaaaaaaaagaugugugaaugcauugauuacuguacccucuuugaacugauuauaacagauaucauuacuuaaaugucuacuuugucacccuaauuuauuaauaauguuuauaagugcugggaaagauauuauggaggagucucaaccuugcccaaagcaaaaugcuacuauaaaggaacgcuaaaaguacacagguauuuccauaaaaauaguuuuuaaaaacaguuuuuaaaggcugggcauuguggcucacuccuguaaucccagcauuuugggaggccaaggcggguggaucauccgaggucaggaguucgagaccagccuggccaacauggugaaaccuugucucuacuaaaaacacaaaaaauuagccaggcaugaugacgggcgccuguaaucccagcuacccaagaggcucaggcaggagaaucacuugaaccugggaggcggagguugcagugagccaagaucaugccauuguacuccagccugcacaacaagaguggaacuccaucucaaaaaaaaaaaaaaaaguuuaaaaaaaauccauaaggaaauaugcauaauuacacuuuuuuguuauaccuuguuuucacagaccuuucuguugguauaagaggaaaguucauaugagaguuuaguuuuuauuugucuccuuuacuuaauaaaacaaugucuauauuagagaaaaaagugucauguagaauuauguauugaugauuuuagagcuguacagccaucagaauuaguuggaaguguguggacaaaagaagacaaagaaauuaacucuccuaaucuucugaaaaugauucgacauaccaccaaccucacucugugguuugagaaguaaguauuccuagcauucuuauauuuuauagcugucagcuauguuaugaauuucaaugcaauuuuuuuguuuguuuuuuuugagacggaguuuugcucugucacauaggcuggagugcaguggcacaucggcccacugaaaccuccaccucccaggcucaagcgauccucccaccucagccuccagaguaaccaggauuacaagugugugauaucacacucaccuaauuuuaauuuucuuucuuucuuuuucuuuuuuuuuuuuuuugagacagagucuggcucuguugcccaggcuggagugcaguggugugaucucagcucacugcaaccuccaccuuccggguucaagcaauucucaggccucagccuccugaguagcugcaacuacagacgcacaccaccacacccagcuaauuuuaguauuuuuaguagagaugggguuucaucacauuggccaggcuggucuugaacuccugaccucaagugauccaccccucuuggccucccaaagugcugggauuacaggcgugagccaucgcuccugaccaaugcaauuuuauuucuauaugucucaugucuuuuuccucuauuccuccuuucuuuugcauugaguguugaugaaaaugauaauauuugucauuagaaaauauugaauguuuuucuaauguagcauuaauuuuuuucauuaacuuuuuuugagguccuuuuagugguugccugguugccuuacaguuuacccuacacaucuuaucagaaucagcuucagacuuauaguagcuuaauaccagugacauaugaaauauuacuccuauguagcucuauucccuuucucccuuuuuuuugugguacuguaauacauauuacaucuuauuaaugaugcaaaucaaacaauacauuguuaacaguuauuacuuuaccauuugucaucauccucuuagcccauuaaagcuuugcucucacccaccuucuuuguguauuauuggcaacauauuacaaauauauuacauuucuaugucaauaaauucaacaauguuuauauuauuuuauacaguuguuuaagucaguuaugagaagaaaugagaaaaaaauacgcauuuacaaaaugucuuuaauaauuacacaauuaccuuuacugauggucuuuguguggauucgaauuaccaucugggaucacuugcuuuucagccugaagaacuuccuuuaguauuucuucuggagggugggcuagcaacaaauucucucaguuuuuguuuaucugggaaaaucuuuauuuuaccuucguuuuugaacaauggcucuaucuucaaguuaauauuuuuuuuuucaguucaaauauacuauugagcuuauccaguaaguuuuuuauuucaguuauuguacuuuuuaauuccagaauuucccuuugguuccuuuuuauaguuucuaucucuuuaaugauauccucucuucgaugcacauugucaucaauaccuuccuuuccuucuuuuucaugcuuuccuuuaauuccgugaccguauucauaauggcuacuuagaaaucuuuuuuguuacuguuguuaaaucugacauuugguugcucucacaggcaguuucuguuccuuccacccccuccgccccacccccaccccuuguaagagucauacuuuccuauugguuugcauaccucaucuguuuuugcuggaaaccugacauuucagauaauauaguguagcaacucugaguacugcuccuccuuccccagcccccuuuccagggcuucuuauugcauggcagugguacuggaaagacucauccacuccuuaccugaccacacacacccagcuaugaaacuccacaauuugccagcugauugcucugauguuuucaacaauuuucugguggcauaaaugcuauacaaaauaaugcaaucaaauuguggcuccuuugaaggaaugguuucugagauuucuguuugauacuuguucugaccccaggagggcuccucucagccgucuuauuuccuaguugucuccugcaaacuacucugccuacagucuaggguguaucuucauuagauccacaaaucucuuccccauugccuuucaccacaauuuccacuguuccuaagggcaccauuaaauuuaaacuacuuuauacuuuguugcaaaugacaagaaauuaggagcuaucuguuugaaacagggcucuggggcugggcaacaauggcaagcuuuucucugagugacacuucugcccuaggagcuaagugcuugguugagcagguagaguggcagacggaugcuacugcagccugaggucuucuuacccgccucuucuggcauggaaccacgcccucaggaaccagaggaagggcucuuuucucaguaugcucaaaacaucacacccaagguagcgucuccauuccauaaguggaaguugggcaaaaaaggguauuccuacuucucagcugcacucaacugggacuuggccucagcaacaggcagcagggacaggaugagaaaacugaaguccugcuccugcaccucaccgggagcuagguguucuugacugcaggaaucuggaguagaugcucaguucacccucacugagcugggagaaagaagggagggaccagucuugguucaaauaccacagacucucuccccucucuuaccaaauuuuuguagauuuuccugaauagauguuucuuuugccauuugcucucagggccauuacuagagacuuuaaaugugugugugugcgugugcauguguguguuuguguguauguguguuuuaauaauuuuuaccaguuucacucagugaagcuccucauacuaucauaccacaaguccagaaucucaaugcaauuauauauuagguuggugcaaaaguaauugcaguuuuugccauuacauuuaaugcuguucguagaaauguaggaaacauaggaacagagcuguuccuagaaauguauguagccaauaauauaugaaagaaagaaauugagcauuaaucacuaaaaucuugcaauuagaugaagaauagaacacaacagaauucuugaauucuacuagaauacacccacaucacaaagaccucacaaagaccuccauacauuccacaagauaguggccucaccaguuaauucugaugcuaauagaggaugcaccaaauauaguaggaaaaugauuguuugacuguaccagucuagaagacgggaaagagcaguaugccugacuggaggcacugccuuccuucuaucagucacccugaaugugucuucucuauaguaguuauacuaucgccaccccccuacucucuacauuauuuuauuuacuaaauucuuuaagcuauaacuuuauuggaaaaacucuaaaaccuuuaguucacuuuuuuuuuauucccagauguauuguagaaacugaaaauuuagaagaaagaguagcuguggugagucgaauuauugagauucuacaagucuuucaagaguugaacaacuuuaaugguguccuugagguugucagugcuaugaauucaucaccuguuuacagacuagaccacacauuugagguagguuucuacauguguuuuuaaaaugaacuuucauucccuauuagaaaaauuagauuuuuaacaauuauuaucuuuaauuuuuaaaugucucauuugucuuuucaguaguagauuaaaagacugaauuaucuaaguuuuguaaugaauugguugcuuuuuaaaauuuaagcauuccuauuaaaauguauucacaggucccagccuaagcuagaagaaaaaacuuucggcacuuaauuuguaagauaauguacaguuaaauguucacauaauuguguaaggaaugacaugauaaacuagaucucucucacacacacacauacuuuaaguuuauacugaggucuaugaagauaauuuauuugaagcaauauuugaagcaauguuacagucauaaaaucaaauugauacuguuguauuugggcguuucuguuagccuaguauuuuuuuugacaagaccuuugauuccuuuuguaaacuuacgccuauuuuuuuuccuuauagcaaauaccaagucgccagaagaaaauuuuagaagaagcucaugaauugagugaagaucacuauaagaaauauuuggcaaaacucaggucuauuaauccaccaugugugccuuucuuugguaaguauuucuuucugaauuuuuauugcauuucuggauaaaacaaaacacucauuucauuaaaugacugaauaauuacauguguaauaugccagcagaaaauacuuguuugaucaauauuuagcaccugaagcccuuuagaauuuuucucauuaagacuuaaggugaagucuaauauacauuucauuuucuauuuucaucuuaggcagccauuagauauuauuuaauacuuguguuuuuauauuuauaaaagccuuuuuaauugcauuuuaauaaacuaaauacagcagaggcauagccaaacucaacuauauuuauaaucauuuuuguaaacaguuucacauggcuaaaaaucauagugugccugcugugccuuugggcccacaccucuggcacaucaaaauuuuauucucuucauccucuccuauuuuuccccuucugcaucagaggaaggaaguaccuuuuccuuccuuuuuaggacugaaucuaccaccugaaucucccuuucuguagguuccucuaucuuuuuccguucuuuauuuccuuuauuuucauguauucaauaucucuuuccuacucucaucuuuucucugccugaguauaugcucugaugauccuucuuuugaaugcuuauagaaauuaugaucucucuauagucucuuuaguaugugcuauaguuucuucuagccuuuuccucaucuauauuuuuuauauaguuuuaaaucccacugcauauaacaauguuauguccugauacuuuuaauauauuuucccacauuuuauuguuugggcuuuauagcaaccauuuuuguauuuacuucuaaucuuuuugcugugcacauuguauauaauuguaauuguaugaugugcauauuaagguuauucacuuaucauaucuuauauuuuuguauuuuauuaaauaaucuuaauuauuuauaauggcugcauaauauuccauaaaguuggacaauuuguuuuaaccauuacccugugauuggacacauuguuuccagcuuuuuugcuuuccacaugauuuucugauucacauuuucauuuauacuauuuuucuguauuugaaaauaucuucuugagacaaauaaccagaggaggaauuacaguagugcucccaucuccacgguuucacuuuccacgguuucaguuauccauggucagcuuugguccaaaaacaugagauauuuugggagagaaagaccacauucauguaacuuuuagcuauuuuuaaucuuacugugccuaauuuauaaauuaagcucauacguauguauguauguguauauguauguauaggguuuaguacuaccuauaguuucagguauccacuggggauccuggaacauaucaccuuuggauaagggagggacuacuauacauagguuaaaagguguccauuuuuaaacuguugauaugugauuuuaaguugcuuucugaaaggcugccaugagaaguguaugacaauuaugcugccaucaaguguaugacaaagcaaauuucaucccaugguuuccaauuuuggauacuuuuuuuuuucauuucuauuauuacaacuacuaagcuauuuguugcaauaauuuccauucuuugauuacuguggagauuuuuuucauacauucuuuaauauuuguauuuccucuuguccaugucauuuuucguaucuccugcaaacaaucugccuuguacuuuuuauucauugacauguauuaguuuuaaauucuaccaucuguccuuucucauucugguuucuauuguuucuaaccuuagaaaguucauauaaucuaguaauaaucauauuuucuucuagcuuuuuuuaugacuuucaaaauuauauuuaacucuaauaucaaacugaaguaucuuuaauaucuuaugaaauacucaaauuuauuuccccacccaaauuauuuauuuguuaaucuagguuuacugaaugauucuacuuuuucccuguuuacauaugggacuuccuuuuuuuuuuuuuuuuuuuuuugacacagagucuugcucugucacccaggcuggaaugcaguagcugccaucucggcucacugcaagguucacgccauucuccugccucagccucccaaguagcugggacuacaggcgcccaccaccacacccagcuaauuucuuuuuuguauuuuuaguagagacaggguuucaccguguuagccaagauggucuugaucuccugacuucaugauccgcccaccuuggccucccaaagugcugggauuacaggcuugagccaccgcacccggccagggaccuccuucuuuaauauguauuguaucucacugacuuccuauaccccugccacaguuuuaaggauugucacuuuauaaucagugauucucagcagggggcaguuuuugccccccuagggagcauuuagcaaugccuggagacaauuuuuuuuuaauuguccuaauugggauggugcuacaggcaucuaguggguagaggauagagauauuguuaacauccugcaaugcauaggacacuuccccacagccaauaaguaaguauccaguccaaaaagucagcagugcugagacagagaaacccugcuuuauauaguguuuucacagaugauaaaguugguucuucaggguuucuucaguccuuuuuuuuuggccaauuuugccuguuuauuuuuccaaaugaacuuuauaaguuugaguggggggggaugcccccaaauguaacuggaacaaucugucaauuaauuuguaaagaacauuuauuauauuuagcauuuccccuuauuauuuuuccuggguauuuuugguuugaaugguauucauuaaguuaccuuuaauuccaagaauuuuuaauuuccuuggguuuucuaaauauuuaaucauguuuacaaaauaugauacagugucucuuccuuugaccuuauuucuauguuacgccuuacauaauuggucauuaacuucccaaacaaagcuuuaaaaauaauggcagaaauaagcagcuuguuugaaacucaguuuuagcggggauaaaguauaauuuuacuacuugcuugauuagaugguuuuuauccuuuuaagaaagcauccuucuugcuacagaauugcuucauuucauuauuuuaaaaauacuagccuucaauuuauaucuacaaacuuuuuuuaauuaccgcuauuuguaauauaucuuucucauuucuguuuucacuuacuugcuuuaauuuacuuuuucuccaaaaagauaaggucucuaauuaucugcugaucuuaugagguuuaaaaaaaaucauuauuaauuccuaguuuuccugaggacuuuuccccuaccccuacguucuuuuuuuuuuuugauacaaggucucacuuuaucacccaggcuagagaguacaguggcaccaucuuggcucacugcauccuccaccucaugggcucaagcagucaucccgccucaaucccccaaguaggaggaacuacaggcacaaaccacuaugccuggcuaauuuuuuuauuuuuuguagauacaggguuucaccagguugcccaggcuggucucgaacuccugagcucaagagauccaccugccuuggccucccaaaguucuaggauuacaggugugagccaccguacccagccugacccucuacauucuugauaaaaauauugaguucauugauuuucucuuccuggaaaaauauuaaagccuauauguuuuugcuuaaagauauuaccaguucguuuaagaggaacuggaaaggcucuggauauaucugacgguaugucauucaaucugucaacguauauuucuugaauaccuacuaaguaccaggacuacgucaggugcuuagaaaagugaaaaauacacagucagucugcucaccuagcuuauagucaugcuacucaugauaucccauggucuccgguacacagacaugaaaagaaaccucaggacccauucacugacucacuauuuggccccugcuccuguaacauccuaaugguugguauuuauuuauacaaacugaaacuguccaaaguccucucucagaucuuuauaaacuuaacugaucuucauaacauguucucuuuuuuuuuaagacaguuucacuuuuguugcccaggcuggaguguaauggcacgaucucggcucacugcaaccucugccucccggguucagcaguucuccugccucagccucccaaguagcugguauuacaggcacccaccaccacacccggcuaauuuuuguauuuuuacuagagacaagguuucaccauguuggccaggcuggccaggcuggucucaaacuccugaccucaggugauccaccugccucagccucccaaagugcugggauuacaggcgugagccacugcgccuggccauaacauguucuuaagugaaaggaggaaguuucagacccacuuuagaguaugauuucauaagguguuuuaaggugagcugugugauuuauugagugaauacaaacauguagguaguuugauaggcacacaaaguuuaauaggugcagcccaucugccaaccuucguaccccuuucuucuugcccaucuuccuaguuacugagccucugcuccuuuaagguaguuuaucuacaacugacccuggucaguuuuggugcccuaucugugcuauucuuaagcuaaaaguuaccagucucuggaguuagacagccuuucauacaguucugauccgguggguaaagccagauguuauugcugcuucugaauuccauccugucuauaugguaguuuauagaaacuccuuccagauucuuuuccuaaauucuggauacugguuuucaaaccccuucuuugggggagggucagggauaguagcugauacuuccucuauuauuuuaccagcguuagucccaucuuuugcuggcacaaccaccauuuaaagaauaaaaguagggcagucacuccuuccaaagcucugccagauguuucaggucuauaacacaguuuuucuccauaaacuaaaauauucuacugauaggagaauggauaggugggcuaagaaaugaauuuuuucagcugggcgcaguggcucaagccuguaaucccagcacuuugagagguugaggugagcgaauugcuuagggccaggaguucaagaccagccuggccaacauggcaaaaccccaucccuacuaaaaauacaaaaguuagccaggcaugguggugcauuccuguagucccagcuuacucgggaggcagaggcacaagaauugcuugaaccugccaggaggcagagguuguaguaagccaagaucgcaccacuauacucccgccugggugacaaggcgagacucuguuucaaaaauagaauuuuuucuaagguaaaaggaggauguaccuuaaucagguuugucaucaaacauccaagccuuuagcauuggcuuugcccuuugcuuuuacacagcucugaucuuguguccuccuucuguuauguguaaauuugccuugucuccauucuugcuuuccagcuauuuuagaauugauucucauauccuggccugucuuuuaaaugucucucuucuauuuugaaacaauauacuucuuucauucaaucgaaaaccuuugcugaaugccucuauguguuaugcccagggcuacaugcuaagaauagacagauaagauacaguuccguaguuucuguucccuugaaagagcagagaaauaagucacagcacuguguaguaagcauaacacuguauuguagaaaaguguagacugaaguguggacaaaugccagagaagccuagaauccuaagcagcuacuuuauccugggaaggaugggaaagacaucagcaaaaaaggugaaaccucagcccucuucuuugucauaaugcucuguuuucucuuucccuagaagagcugccuccagagguaggguauguuaaaugauauauugaaguacaggaguaacuagacuuucuauuuauauauuuuuuaaaacaugaaaaaaaaaccuaagcuuuacuaauauauaauucucagguuuauguuauacauacacacauauacgcuauguuuuuauuaaacuauauauguguauauagggagaaagcgaggauaugugcuuaaauauuuuuuacugaugcaguguaagaucaaaguuuggacaccacugcugugaucauuuguucuuuuagcuagccaucaguuaggcacaaaauaauuuccaaauuucaucccaaacuguaccaaagugcuacuuauaagcauuuucacaacuucauucaagugugcuuucaagaacaaagcugugagucuucauucccacugcccccauuuccuccccaaaccaguuaaucaguucuuggggagucuaccucuuaaauauuuauccacuccccauuauccccacagacacuagggcagcccucaucaucucaccaggacuauuguuagccuacuaacugcucuucauguuacuggucuuaacuccuuccaacccaccuggcuucauaguacaccuagaguaauccuuccagaaugcaaacaaaauccuucuaauucccuaauuaucuccuagauaaaaguuaagcuauuugacaaaaggcacacuucaugacccaguccaagugcuaauacccacaaacucuucacagaugggccaucaguuugugaccacuauggaagguugauuugggcugccauugagcaugcauacucuuauggacguguuugucagacugaacacugagcugaguggaucaugcaacuuguguagaggacaguauaaauggcugaaaauaaaagccaaaugacaggcagaugugaaaauaaaaaagccugugcuuacuagaacacacagucacuuugucuuaugaauguaucaucaggcauagcccaggugcugagaaauaaccaaguaacuaaugcacuuaauaacuggauccuuuuaaaaaccaaacaggcauugaugucagauuucauuauugcugaucuguucaauauugauuuggauccuuuuaucuuuccaaggauguggccaaagauuucugugguguaugccucuaccacaaaagcauuuagaaguacaaacccagcccuugccuaugucuauccucauauccugccacucuuccucuaccccacacaccaaaccccuauggucuagccauacuaaagagcaaauuaucucuaaguaugccuuucaagcaagcuucaucaucaugaaucaaugccuuuauacacacugcugcuuugcuuagacugcucuucuacuuuauucuacucauuacacuucucauuuuuugggacuuauucuaagcauuaucucaucugugaugcuuuuucuaguccucccagcucaagacagaguuuggaauaccuccuuuuugcucucauagcauguuaugcauuccuacuaauauagcaccuccuaguauguagcgcuuagcaaauuauacuguaguagccaacaguucaaagcucuggaucccugaggucaggaacgccuuaagcacuggacugcuggaggucuuucucaucuuuguaccugcaguaccuaaugcaggacuuggcuuacagcagagaauccguacacauguggggagugaacgaacucaggaucuuuuuucuccucaaagcauuguaaucaguacuuuagggaaaaagguagaagcauaagaauauuagggcaagaugcaacaacagcaucaacaaucacaaccacggcuaauuaauacuuaacguucgucaggcucuauucuaagcucauacauauauucacucauuuguuucucacagcaacccuccuguccucauuuuacagaugagaaaaacugaggcacagagagacuaauuaagcaauuugcacaagaucacacacacaggcugcucgcggugacucacgcuuguaaucccagcacuuugggaggccaagguggguggaucaccugaggucaggaguuugagaccagccuggccaacauggugaaaccccgucucuacuaaaaaauacaaaaauuagcugggugugguggcauaugccuguaaucccagcuacucaggaggcugagacaggagaaucgcuugaacccaggaagaggagguugcagugagccaagaucgugccauugcacucuagccugggagacagagugagacuccaucucaaaaaauauaaaauauaaaauauaaaaaaaaaaauaagaucacacacagagaaggcagcagaacugguuccagagccuuuaugcuagaauagaaagugccuguuauuuuguucauucuccuccucguccaguguacagcuguagugauggggaaacaggaaaucaauuacuagguugccacuaagucuacaaacuauugaagaccagaauuuacauaaaucguaugcagucccacauuugacaggcuugcaaaaccuuccacauuuccaugaguaagccuauccaaauaguacuacuucucaauugcaaaucauaacaaccucuuguguggccgucagagcugacuaagcagaaacuaugauccucugaauuuaguauuuuuccuguuugccaaaaaugaugugucauuagugacgaaguuauucuuaaaguuccuuuaacaaaacugugauuuauaucaaauaacaauggcuuggaggggguauggaaaauugauuauucuuccuaacaaaucuauuaauuuuauuaaacuuggucucccucccuuuuucuuggauguuuauaaaauuuaagucuuucuaaaaaaaauaaaaaaauaaaaaauauguaucccacugccuucuggccuccauggauucugaugaggaaaaaaaaaaaaaaauuuaagucuuucacagauacuuucucuuaagcugcuguuuucauaucauggaaaucugagccuugguucuuuuguuuuggcaacugagaugguacaguguaauauacccacaauuaaugaaacagaaaaaaacuugcauuuuccuucuuuauccuugaaaucauuccauuauaucuucuaggaauuuaucucacuaauaucuugaaaacagaagaaggcaacccugagguccuaaaaagacauggaaaagagcuuauaaacuuuagcaaaaggaggaaaguagcagaaauaacaggagagauccagcaguaccaaaaucagccuuacuguuuacgaguagaaucagauaucaaaguaaguugaauuauuuaaagauucauacuucugauuaaguuucuaaacuacuuaauaaaaggcagguuuauuuuauaggggagaaaaaguaaaauaaaccuuaaaagaaauaauucaaauuuacuuguauuaaauguuuucuuaacuuuccaugaauuucaaacugaauuuauaauuuugaauauuaauaauuuuuucuuugcauuuauuuuagagguucuuugaaaacuugaauccgaugggaaauagcauggagaaggaauuuacagauuaucuuuucaacaaaucccuagaaauagaaccacgaaacccuaagccucucccaagauuuguaagcauuuguauauuugucuggugaugucauuacuaccauauguguuauauaguuuuccauaaagguauucagggaugaaguauacaugugauaguuaaaaguaaugaaaaaguacuuaauaauuauguccaggaauaucccacuuccuuccaaauaaaugaauguuaguauuaauuugaguaaauccugauaucaaagaugaugaaauugagcaaauauuauguaaguuuuuaauuuuuuuuaccccaaaaaauguuaagauuuuaaagacaggaauuuuaaugaauuuauacuaauucacuuguaauaaaauaucuacuuaugacauuuuaaaaguaaugacuuauuagaacuuucaaccaugaaucaugagccauaaaauaccaaguuuugcuaacaauacuuucuugggaaaauaaaguuuccauuguuuuuuguuacuugucagugcccagccaaauuuaugaauagaaucaccaacucacugauuugacuauguacucucuuguucauaaaaaagucaaaagucugccaggugcgguggcucgugccuguaaucccaacacuuugggaagcugaggcggguggaucaucugaggucaggaguuugagaccagccuggccaacauggugaaaacccugucucuaaugaaauacaaaacuuagccagacaugguggcgggagccuguagucccagccacuugggaggcugaggcagaagaaucacuugaacccgggaggcggagguuacagugagccaagaucgugccauggcuauccagcuccagccugggagacagagcaagacucgucucaaaaaaaaaaagucaagaauccugaauuaaacauagauggcuucuaagugaccaagauaaaucacauaaugucuuuuaauuaaaguguaugcaauugccugacagcaaaauuucucaagcccuuguucaguuuuuaauaagauggauuaaaaauagaaaauuauaaauagguauauaaucugauccaaugaagcacucacugagaaaugaucauuuugcaaggaaaaugcaauaaaaccaacauacauacacaaaugaaaauugggcaauuuaauguauucguaaauaucucaaaugguccugauggcaucacuguauuacagaauagaaagguauuguaauucacagugaugauccuggcuuuucaacaagguuaaauuugcucaaaauagucuguuuuaaaaaccagggaaauauacaauacauuuuagaaaaacuucuacccaaauguauuaaaauaacaaauacucuaguauuuauaggacuaaaacuuaguuauuuaaagaaaugcauucuuuaacaauuuagauaccagggcuuuagcaaaauagaauguuaaugcuuuaaauguucuacuuuuauuugaauaauuauguccuuauuagugauuuaugauuuuccuguauauuagcugaauuuuaccaggcacauauagaaaaacuuuccuuucuacuacaguguuuaaaguauuguguuucuuuugauaugucuacagccaaaaaaauauagcuauccccuaaaaucuccugguguucguccaucaaacccaagaccagguaccaugaggcaucccacaccucugcagcaggagccaaggaaaauuaguuauaguaggaucccugaaagugaaacagaaaguacagcaucugcaccaaauucuccaagaacaccguuaacaccuccgccugcuucuggugcuuccaguaccacagauguuugcaguguauuugauuccgaucauucgagcccuuuucacucaaguaggugcaaaaauucuaagugcauuaagguauuuguuaguacuauacaugcuagagguaaaaaagaaucucuguuauuuuuuuguaugugugaacuuguaguuaagucaaaugccauuucaaaagauaauauuauaaaaauauaagacaaauucuaaacuccaccaacuugaaauuucuaaaaaaucugcuggaacagcccucuuuaaauuuauuauacguuaaugaaaggccuagugguaaaauuggcagcuuaaauuucauuugagcuuuucaaaugcauuccucuuauccagaggagacaaagaucagucuuaaaaucugcaaguaauuuuagucccauguuucaaaugcugccuggcuccaaaauuauuauacaggcugaauaucccucauccaaaaacccaaaauccaaaauguucuaaaacccaaaacuuuuugagugucaacauaaugcucaaaggaaaugcucauuggaaguuuugagauuuuucaguuagggaugcuaaaccaguaaguaugauguaauauucugaaguccagaacacuuuuggucccaagcauuucagauaaaggauacuuaacauguauuugaauacuagucaggguacaccaucuacucuccaccaaauucuuuaguagcuuuuaauuuugcaauguaucagauuuaagcccuuuucgucuacccagugguccccugaugguauauaauggcugcuaauacacuaucugugcuuuucagugcagcgaaacaaaucucacagacugcacacuacugcuuauccaucucuuauuucuagaccagcacuguccuauagaaauaugugagccacauguauaacuucaauugucuaguuagccucauuaggaaaagcaaaaauaacuuuaauacauuuuauuuaacccaguauaucagaaauauugucauuucaacaugaaaucaauauaaaaauuuaugauugagauauuuuacauuccuuuuguucuaaaucuuuaaaauccagcgugcauuuuacacuuacagcacaucucaguucagacaagccacagucagaugcucaauaaucacauguggcuagugguugccggacuguacagcucaccuuuugaaaggcuaccuuuucaaucuagaucaccaauaauuuuuuaaauuaauuucaugugaaacuuuaaagcucuucuaagaacccuuuuucauuuguucguuauuaaaucaaaacuucaauccagucaccuuuaacucuuucaugaccauuuccacaugcccuuaccguuggcuaucuuagcucgaugugcuaaucaaguucccccuaauuugacauacuagaaucuaauacuagaggcagcaugacauuauuaugggggaggagguugagaagcacuaaccucgaaguuagaauuucugguuugucaucccagucugcuaauuagcuuucugauuuaagacaaaauacuuuuucugugccuucugggggucaaauucgauuuuuaagauucucucaguuggaagaaaucuaacuaaaaauauacuuaaaauaauucuuugguaguauauuauuuugaaauuugguccagaauccuauuuguuuauuccuguaguauacauacgucuguaguuacccaguagucuuuguugucuuugggccaucuaaaguauauuugggcugggcauggugucucacaccuguaauuucaacacuuuggaaggccaaggugggaaaaucacuugaggccaggacuuugagaccagccugggcaacacagcgagaccccaucucuccuaaaaaauaaaaaaauuagcugagaggagaggugugcaccuguagucccagcuacuugggaggcugaagugggaggauugcuugagcucaggagugugaggcugcaaugagcugugaucaugccacugcacuccagccugggcaacagagugagacccugucucaaaauaaauaaaguguauuugucuugagaauacuaugacuuggcauuauuuggugacugaaggucauggagucuuuuuuuuuuuuuuaauuuuauaaaauuuuugguagagauagggucucgcuguguugccaaggcugaucucaaacuucuggccucaaacaaaccuccugccuuaaccuuccaaagugcugggguuauagaugagccacugugccccgccauggagucaugugauacacauaguaagcugucagauauuuuugauaaguucaaauagacaccaaguaaaaaaagauucccauuuauucuccccagcuugccaacccccuaaauuaaguaaugaaaugaaaccagcaccuuuucaguauaucugacuuaaaaucauuauuuauucugacccauuuaacuguuugcaggauuuuuucccuagagcagacagcuauaggccuguaucauuaaggauucucaaauaagugaacuauugaaaccacauaaaagccaucaguugcaaauucuacuucucuuuguuuaaguagcuaaaaaugaaagugguggaaaaaacaggagauaagcauauuaaguucucuacuagugcugaaucuuuaaaugacuagcuaagcagcgaagaagaaaucauucuagaaugcagugcucuggauccugcuuuguuauaaacaguuauaauagcauuaaguuaacaguauuucacuuaaacagcuggacagguggagaaaacauuguuucaggaguuaggcuuuguaaucuuagacuugaggguuuucucaauuucucuuuguuuaugauaaagaaaaacccuauuacuacucccuuuguuuuugguuaaaaacugaaaauaacugauuuugaaaucaaauaaaccaguguaauauaaagccauccauguguucugcuaaucccuuaaaaccuaucaguugcuuuuguguauuaaaggucuucuccacaugcuuuugucuucacuuuugccuaacuaacagaugugcgagugccagaggaucacccagagccuccaacuugcuacccacuguuuugccaccagagugaauaccuauuuccuuguuucccucagggccuggcagaaaagaacugccuugacugcagucauaugucaucccaacauauuccacucaaagcaguacaaaguuccauuguuuaaguuuuucaaaaggcagaguuugacuagaauuuuuuuuuaucaguuauaauacuauacuauucuuuuuuuacucuuacgguuuuuucccaaaauaaucuacuuuuaaaaaccuauaauuaauuauuucagccaguaucugcugcauaucuuauuccuugcuaaacacuuacacgucuucacugggaaagcuugcagucuuacugagagauuaaaaauaaucauagugcaaagagauucacaguuaaacgcuaaaaauagugguaaagacauaaauacuggagaagcuuauagaaagaugaccucagaaugagcaagaguggucauggaaagcguuguggcaaagacagggcagagaaguggccacguacuuagugcugccacacauacauucaaagcccugcuccacaccuugcccuggccagguccaccuuugaggugaugacgacaguugcugagaaaagagaaaagaccacuggcucacuacuuguuucugcugcuauaauagagaggagaaaaugaugaaaugcucuuuuuaccuuccuguuugaagauugccuggucauaaaagggagucagaggucugacuucuccauuuccaucccuuaggggacucuuuaacaacaaaaagaauguauuacaaguaugucaagcugauaacgcaaggcuuuuccuccuggaagauugcuguaggugaugaguuucuaaucccaaauauauuugcauuuaccaggcuuuugugaguuuaagaaguuaucuaucauaucuuuuuuuuuuuuucuauagaaaaaugcuuguuucuaucaagaaugacuccuuuauaaacuggggaguaucuuuaagagugguuucaacccugacuguauaguaucaucuguugaggagcuuaaaaaaaauauguaggcccagcccacacuagacuggcauugguaccugguaucaguauuuuuuaaaaacuucccauaggauucuaauguacagccaagauugaggaccauuugucugucaucugggauuaugcuuaauaaauuaauacuguuuuuuaaauuaauuagauuucacuucuaagucauuaucaguaaauuuacucaguaucuaacugacaagaauuucuagcauauauuucuugauuagugcauguaaaauucuaaaagaauuucuauaguauuuuccaggcaauaagacaacuagugccccaaauuuaccaaaugcaugagucuaagccugugcuauauauaaauauacucaaagccaaguuuacaucuguguacacaagugugcaugcauauguacaauuaaagacuauaguuguaacagucaugagcuuguguuuugauuuuacuccuauuccuguauuguauuaaguguacuaucauguucuugaggcauaucuccaggagauauguuuauuucuuuuccaggaaaagugggacauauauaaguaggguaaacgcuagagcuagauacuccuuuaaucucuauuacgucagaucucuggcucccuuuuacaaccaggcaaucuucaauuauagguggcuaauagggaagaaaaucaucggcagagcaacagcuucauguaauuucagaguagaaaaaugaauuuuaaucuucugaaagguaauauuagaauuagcuggauugcuacacuuaggaaucauagguuccaaauaaauaucaguacauacggaaaucagauaaugggacagauuauuugaaauuagggcugccuagaaaucuggaaugugagaucacccuccuucugaccaaauaugcuugaauaaacuuaauauuccaaauuaugugagggauugccuauugugcaaaaaaaaaaaaacgaaaucugaauuuaaaaaaaauuaccacagucuaguauuauuuuagucucuuggauguuauaacguuaucuguuccaucuguuguuaauaugagacacuguacaaacaaacaacuauauugauuuagaaucaguauagaucaccuagcuuuuugucucaauuuuccuacuuuaaugcucuuggggcuuucgcuuuugauuuucaguuuuuuccuuaaaauaauuaauauuguugaaauuagacuuucuaaauuuaaauuuaucagaauuuccuauguaaaaugagucuaggcaccaaauguuuaaugacuuuaaaaaaaauguuuaugacuauaaaaggaaaaacccuguaucaauuucaagcuuguuuuauauccaaagugcuaguuauuuugugaugagaauauaugccccaagaacauuuuugaaagacauauaauuaguaacuuuuuuauuuuucaacuuacauaaaauaaacuuauuacuuguuucacaaguuugaguuuucaaaauaauauuuacuaaauggcauauuuauauacauccagcugaacuuuuugcuugaauuggguuucuacauuuuaaaaagucuuucaguaauauacgauuuuuuuaugaauguuuuucauuuaauaauuaugaaaucaaguaaagcuaaaaggaaucuuaaauucccaauaugauaucauuuuuuucuucucaaaaguaaguaguaaugagguuuuacuauaaacuguuacagcauucuuuaaaacgacaaugacaauaacauuuucaucauaauacaaauuuuugcagaugaguugaauauaucaaugaaagaaaaaaaucuacuuuuucuuguuuccuuucacaggcaaugauaccgucuuuauccaaguuacucugccccauggcccaaguuaguauauuugguuuaagacucauaauucuugcuuuggcuuuaaaaaucaaaccaaguguaaccuuuccugcuaaaacucuucuugggucuggcagcauugguaccuugcuugcaacauccuagaagugaggccuucacuugugcuaucuuuagaucauaagugauuugcuuaaauuuauauauuucucaugcuuuuuauaaaaccuuguuucucucuuaaaagaacauauuaaauaaguggcuuccacauuuaaccauuucuuuuuuccaacuauagaguucuaaguauauuuuaaugcucaacuuugaaaaaaaaaaaaaggcaagagcaugcaugcgcauaugggaaugcuggcagcuacaugcaguuucuaaaucacaaaauauacuuagccugauggcaggauagauuauagacaacugcuuuugacuuuagaagaacuuucuuauaauuguaauuauucaaaguauagccuaaauacugauaaacaaaauaaaguuccauuuuaauuguaagguaaacuaacaagucacuaaauuccauuauuuuaauuauuuaagcuaauauuuuuuugcuguccuuucauacaauuucaaaauauguacaauggaaaauacuaguuacaagcugaauuaacuauauucuuaagaaaaaagguaggugaucaaaauguugaucauuuaaauaauaucaguacacaaaguacucuuuuuaaguucuauauuuuauaacaugugacaaaauaaaaagcuuaaugcuuaaagggaaaaaaaacugccaacuauaauuuugaaugaugguuuaaguauuuuuuucacaucuuuuuuuauaguagguauaaacaacuaacuuaaguguuguuuuccaaaguguauuuauaugccuaccuuauguucuuguuaccauaaaugucuguaagagagguucuaauuaguagcuuuacuuacuuuuuuugugccaguccaccaacuuauucuuaaaucagauucacuagauuuuaguguaauuucuguuuucauggucagggcugccuccguugucuugaauagugccaucaccguuaaaauuuuuggauuuagaguauaaugagccucuuuuugcuuacaggcaaaggggagccuauaacuaaacaaaaugaggagaggccccucaccuagacacuaugauucuuucccuugcauccuuugagagaaaugcuagggagagacauuggagagagugguuaagagcacacacucuacucccagggacuauccaguaagguggggaaguucuauaaauucuaauaaagucaaagaaaaaaaugaacccauuauagaaucuaaaaauuaccauuccaaagauuuucaguagcucacugucucccagacaucugagaaucagacucaauuaaaaauuucaauaauagaguaaccaugggaauguuauuuuguucaggcaaaauaacagaauaccuuaggcagcuuuuuucuaaauauucugcuaaaaaaugucugcaugcuuuuauggcaguuugcuuuaaugaaauacuauucgguauugguuuauugaacagcuuuugguauuucuacacauuacuuuuaauuauaagcaauuuccagcuaagacuuuucaagguaaauaaaugaaauaaaauuccuguggacuuuuucuuaaaaauuuaacaucccacaggaucugcuucuguaucaucuauaaguuuaaccaaaggcacugaugaagugccugucccuccuccuguuccuccacgaagacgaccagaaucugccccagcagaaucuucaccaucuaagguaaaguaagaaaucuuguuguguagaaauuggaaucauuacaguucauuauaauaaacggcugucuaguuuaguucucacuaggauaaguuaacauuucagaguauacaggcuuaauaguuuaaacaaggauuacauauagauuuagcaugcaguaauguuucuuucuucugaagguaguuuuuugguaugcauucaagacccuuguaaaccuaaggcuaugguuauuuucagaaaaaaacaaaaguuuuaaucuguaaaguaagaggaauuugguuucaagcaguucuuuaaaagcauacagagaaaguccugaagcuuuguaugaaggcacauuauaagucaaacuguauuuugacauaugcuaaaauuuacuuaucugagcccuuaauaguaaaucugacauacuuuuaaauggaguuuucaugaaaauucuggguuuggaagagaccccaaaggcucaaaauagcuauuauuucuacuuauuuaauuuuguuuuuuucuuuuuggccagcuguuaaacuuaauucauuaguucuuaagcuguccagagugcagagcaccaggauaagucaagacaagacacucuuuguagaacuucaugaauguuaacauaguuaacuuaaaauuauaaaauagguacuuuaugcuaaauuagaaaugaucuuagauugagugauaagcuaagcaagcaguagcaaacaaaauuuugaggaaaaaaauuuaaguaaaaacuacggcaaacuuuuuuuuucuaugaauugacagaaccucccauuuaaaacauaugccagccuuggcaacagagcaagaccuugacucuacaaaaaaugaaaaaaauuagccaggcauggugguacaugccagugguccuugcugcuugggaugcugaggucgggggaucacuugagcccaggaaguugaggcuacagugagccaugauugcaccacugcacuccagucugggcaauagagcaaggcauugucucaaaaaaaaaaauuuuuuuuuaauuaaaaagaaaacauauggcaaaacucccuguuccacacuuagcauccugccaauagcauguuugaaaaccccaacuuaauucuuauagucaugauacuucauaaauuuauuaauaaauguguauuuuauucuuuucauuuguuagauuaugucuaagcauuuggacagucccccagccauuccuccuaggcaacccacaucaaaagccuauucaccacgauauucaauaucagaccggaccucuaucucagacccuccugaaagcccucccuuauuaccaccacgagaaccugugaggacaccugauguuuucucaagcucaccacuacaucuccaaccucccccuuugggcaaaaaaagugaccauggcaaugccuucuucccaaacagcccuucccccuuuacaccaccuccuccucaaacaccuucuccucacggcacaagaaggcaucugccaucaccaccauugacacaagaaguggaccuucauuccauugcugggccgccuguuccuccacgacaaagcacuucucaacauaucccuaaacucccuccaaaaacuuacaaaagggagcacacacacccauccaugcacagagauggaccaccacuguuggagaaugcccauucuuccugaguuccucuguacugggauguauauuuuccuagccccaaauccauugcuggcaauggaugcacugaaugugccagcacugaggaguuaaaaugagaacuccaaacacuaacgacucuucuucaagaugcaguauaagacaaugaauuuuaaccuagauguaauuauacaauggaaaugguauuccaguuuagaauauggaaagaccgaccuagaggaauuggacaacugauugcaccugaaaaucauaaagggacuuuuucuggccaauaggcaggaguccucuuuuugugaagugaucuuuugugaagugaucauuaaagggauggaaaacacagucuaguguccagcaggcccacaugacaguuuuuguaauucaaauuaugcacuuuuaaaaaaaaaaacuuaaacagggaucuuaauaucuuccuuuguuuuccuuugcuuuacucuucuacuuuagaauauuuucuuaaaaaucacucaaaggacugugaggaaaggcugugguaccugaccuuguugaaaucaaggcccggcacuguacuacaggccuguuuacagauuauuacggugaacugaauggguaccgaggcuucaccaaagagguacuuuuuuguuguuguuguuguuuuaggaauaauuguaccaauuuuaagagcauuccccccaccuguccccacacacccaaacaaaauguggugguguugccuucaaaaaagagaaguuuugugucauuaacaugacagaagaacuuuuuaaaaaaaaauaacugucaacuauucuauuugcauuuaggagacuguucaucuaugcuagauugucauuuucccuccuucucccacagaaguuuacugguaguccaugucauggcucguagcuaucccucuaaccauaccauggaaaugcaggcacccaaugugaaaaggagcacuugcugggcaucacugacaccgcucauguuuuacacauaguugaguaaucagcauaucuagaauuaucuugcauugccuaaaucauauguauauagugaauguuauauaauauaccuggcaggucuguuuuaauuuaauugaauaaagauacaaauacuuuguuuggcuggcauauauuaaauuauuauaugaagaaaaugguugauucuuauuucuuuuaguugaaaaacacacaaaaacacuaaacauaaaagcacguuuugugguacgccuugguuucuaguucuggauauauguauuaaucuuaaagaaugaucuaaagucacagcuuggcauauaggaagauacuugguuagaauaggauggguaucuuuuaagcagaacuuuguaaguaaguuuuaaguuccuaagcaacaaguauacaguuuguuaagguuuauauugaacauucuaccuugcuugagguuuucugcuuuaucaaaacuauucauaauagaacaucuaccugcaucauuacuaucauaauauggauuauucauaaagcguauguacuguucuucugagucuaacaaauacugugacugaaaugcaugcaccuuguugaagagaaaacauuuuauuaaucuccacuauaaugucugugaaaugugcaguauuccauccuuagagaguuuaucugguucaucagcaucugcauguauccucugaauaaugaagcaacauuucagcaauucuguuaaccacaccauuagagacauuuuuagaagugcugcaacauggugggaaccuaguacuuuaauaauuuccuaugauauuuauuagagcauaaaauguacaucacgauaguacaguauguaguccuuuaagaccagaagguauguuaacugcaccaucauuaagcagucuauccuauuuucuuauuuauuuguuagaauugaauccuuucucaauaucuguaccauuccuaugaugguagccauucuucucuuuauaaaauauuuccucuuugaaaagcguccuaaaacauuaauuucaaauccccucuuggaugcaaagugucccuaagaccauccauucaacaguauuuaugugagccaacuuacuagagccgcuacaacuaaucaugauagacaguccagaaucucccuggacuuuauacugggccagccucauugucccuaagauuucucuuuuuaugucucauggauuacuucucuuuuuaauugccccaggcacauuccaaaugagaaccugguaaaagucacauuggacccccuucaguaugucuucggcuaauguguuagccuucaauaaggugauaaccccuuuucaaccuaucuagucuauaaagaggaaaaauucagauuuggaguucuaauccuauuucucccaaagggaacuauucuucuaccccaugguucuaggagaccacuucacugugcaacaguuuuacaugcauuguggauggaggauauuuuuauucugaacuguuacauuuagguaaaaauauuuucugcagugguaacugauuagaaaaaugccaauuggaugcccuuagguggaggugagaaaauggcauccuugccuucuucucaauaugaaacauuaacuaguugacaaauuuauccuuguaguaaugaaaaucuauuuaaucagggaccagaaauggcugaggagauaaaugcaucauuacaaaauucugcuuuugaauccuggacauuacaaggggguaaaugcagcaugacuuuuuguuaaccacauuccaaaauguggaacauuucuuuuagaaaugaaaauauuucaaggcugauguauuuuaagacuacacauuaucaggaaacauacauugagaguucgcuuaauuaaagguuguugggcaucaaauuauguuuaguagguuacuauucucuaacaacucaaggaugcuuuaauggaucugaauuugacaaagagcaugccacacuaauacuacagucaacaacagcccagagaacaauuacuaugucagcuggaggcuauauuaugauucuaaauucuuaaagguuuuuuucccuccauaaaucaaaaauuaccuuauguaaaccaaaaauuaguugguauuuauggucaugaucuuaauucucaaguuuagcuuaaucuuguauuucauuguuugucuucuaauaugacagcuuaaauucagauuuuuaagugacucagcaaaauaggaggagugucccaauuuauuaguguuguacauauugaagaaaaccuuuuuguuccuucagauuuagaaagaaacaguuuaaccauuuauuucuugguauucugcugcugugaauagguuuacuuauucuuuuaacauauauugugugacuacgcaaguauagguccuguuguauugcauuaaucuuuaccaguaacuaaacaucacaagguuaauauugguuuggcugaaagaauuaugcaguaaaguuauuuauaagggaacaugaugacuuuauucaauauuuuucuucuuugaaacaucucauuacuaacuuuuaagauuauuucauaaucccuuauacaugagccaaugaaauauuuugagcucuacuuaagaagcaugaagucuauauuauaaaucuaaacaacaaaagcacuuguaacuuguuuaguaaauuccaugccuuauuuuccauuuuugacaccguaaagugcauuuucugucgacugugagcaaauuucccuuuugccuuuaaugaaaauagugcauuaaguagccaauugcugcagaauuauaaagcaaauuagcuaacagugggucacauuggacuaccacucaaagaaacaagaugcauaacagaugauggaagguacaugugguguggcuuagggagagcgcaccugugccagaugcaugccacuuucaguagcugccaaaugugccuuuaauuaagaacaucucuaauuuuuuucuucagaucaagucagcauuuggggucgggauuugggcagggaacuuuggggugcaaauaucuggugaaaccaccagagaauuuguuugucaaagugacauguauaauuuuaguugagacguguuuguguauauauguguauuugccuuuguuuaguagcacgguuauuugcuaaaauaauugucaaaaaauugcucugucggucggucuuugauguaagaacaaaguguggucuauacaucuaauauggccuuuguaccuaaccauguucauagguaaucuuuguacucugugugcagcaguauuugguuugcauuuaaagugaaaauaacggcuguuauuuuucuggcauuacuaagauaaacugaaaaauaauaaagaaaaaugccuuacauagcccacaaguguauuauuuuugcauguauuuauuuuagagggcaguauuuuugaaaucauuagugauucucauuuagcucauauaugccauauagaaauauuuugcauuuuuauuguggucuuucuuuggaggcacuuuuuuccuguaucaaguuauaaaaggauaaaagaaguuccacauuuccucugugucaaaucugcugauugauuguagugagugggaggccucugggaugaaaacuaguaauuuaaagugaccuugagugucaccuggaugaaguuucagagugcuaaggcauuuguauuccauaaaagaaguuuugagauaucacguucccugacaggcagcuuuugcugagaucugcuggaaugagguagccugaccuuuagcaauucuuuuucuaggcuuggcaugaaaaugugaguuuaggguuguaacuaaagaaugaugcaaauguaccgucauucagugugaacuauaggauguaaaaauugaugaauccuuagagagccaauccccugauuuaaaaauuaagguagaugaggccuagagaaaugagaugacuuagccaauaucauguggcaguccaagcaugaauuaucgaguauauucuagguaauaaauuuaauaguuauaggacaauaauguuuuuguuaaacuugauucugaauuuucucuugaauuaucacuuauucugagcuuuaacccagugauuuacuuuuuaacuuauuuuaauccucuuaggucaucgcagauuagucuguuugguacaguccauaguuaagccugccuuuuugcugauagcugcacaugguguccagagggaaggauggcuucaauacagaguacaauuccaaaaaagcaguuuauggccauucuaacauuuuaggacucuugauucuuacuggaggcaagaaaaacuguagcccacuuaacagcuaauuucucuaccucaguaacucaucaagaaaaggaagaaucaaugugauaggaacaagcaggugcuuuggaaucaugucuuugcagaaguuaguuauuuaaucuguuucucaucaauacaaggagguuaacagauguacuguuugaggcuauuaugagguuuaaagguaauauguguaaagcacaugccuuucacagaguaggugcuuaguaaaugcuaacuaaaguuacgagggaugcauugucaaaguuuacuggcuuuuagguaucuucuaagagguugguugcuuauucugaagcccucauaauuugauucuuuaugauuuccuuugcuguuuaucaucacuuaaauuaguucugagugaccuuagguuauaagcauuugauaagggcccaucugacuauucagcauucaacaaauauuuauucuucagguacaauucugauauuaggaauauggcaauaaacaaaacaggcaaaaguacaugucaucaugggguuuuauaaucuagugaggagaugcagacaauaaaaaguaguaagcauaauaaauaaauauauuauacauucgaauguuuucacuuaugaacaaaaaaggauauggugacuaggaauguggaaguccaggggaggugaaauuuaaaugggauggucagaagccugccucauagagaugacauuaauagacuuggaagaggugagggaacaagacaugcauauaucugggagaagacuaugucaagucacaggaaacagccagugaaaagcccagaggcaggagcguacuugguacaugugaggcagagugacgcugcuuguaucuggagaagaauaaaugugggcagaagagaaggagaugccaucagagguuugacaaagcucacuuaaggcuuuaaaagcccuuguaaugacuuuugacuucuuaguggcagaguaaccagggacaagaucugauugacauuuuaacaggaucacucuggcugcccuguugagaauaaaacagugggaauagggaggcuaacccaauagaaaauagcuuggaccagggugauagcaguggagcugccuuauaagaagaggucagggccuagauauauuuuaaagacagccaauaugcugauagacugaaugugagguguaagaaaaacagaauuguuaaagaugacuucaagguuuuggccagaguaacuggaaggauaaauuuaccauuaacugggguggggaagauaugguugaagcaggcuuggacauacuaaguucaauaaauauauuagacaucuucagagaugucaaggaggcaguugaagauguuagucuggaguuugggagaauaggcuaaagauagugaauugggagucacuuucauaaagacauuaaagcuagcagacuggauaaaaucacaaaggaacugaguauagacuagaaaaagaagagcucuaagcaaaggagagcccuggagcauucuaauguuaaaagagaggggacaagccaggccugguaacaccaccuacucuggaggcuguggcgaaaggaucacuugagcccaggaguucgagguuacagugagcuaugauugugccugugaguagccacugcacuccagccugggcaacacggagauccugucucuaaaauuaaaaaauuaagaaaaaaagaaaaaaaaaaggcaggaagagauggggaaucagcaaggagaccaagaagaaacucccagugaagaaaaacgaaaaccaggaguauguugugucuuugaggccuaguuaagauagaaggaggacgugaucagccugucaaaugcugcuugauagaguaagaugacugagaaggaaccauuuguuugacaauguggaagucauuggugaucuugacacaagcaguucaggggaguggugugggcaaaagccugggcccuaguaugauaaagaauggcaagagaggaacuggagcaguuuccucuuugagguuuuaugaaagggaagcagaaaacuggggcauggcuagaaccgucaagagaggauuucuuuugcuuuaaagaugggagaaauaagagcauguuuguaugcugaacgguuugucccaguugaaagaaaaaugugauaaugagaagagacagaagcacagaugguaucuaccaacaguccuuuacaguagauccuauuaacaucuucagauagauaggcuuacauacaugagacgaaacccaacacauucaguuuucuugauaagaauuaagagcauuuacagcuacuauauaucugaagggaaugaggcaagaaggcauaaaaaucucuauuuuguagauaaggaacaaguuuagaugacuuauuaaagauuauguacuaagcucuuggaaaacaacagauuuuaaaguuacuugguuugggaauaaaaauuuugauuauuuugaacaucugacaaucucccacaaacauauuuuuaguauugccuaaauucaucccuuuauguucuauauuuaaaacucagcuguaguguuacacaucaauuucuauuuuuuucccuuaaaauauauacgucuccaucaguuuucucaaccuucuuuuuauccauaccccuauuugaaaaacuguaccucucccuuccuuuccucccaacccauccccaccaggugagacucaccagcccauauacuauaaauaucaggcugcucagaugcugagaaugcugcucucacaccuccaaaugaacuuucaggauaagagaaucccaacuguaccaaaagcauuauuuuucuaggcucaggcagaaaguuauuaauggugauguuucaagaaaaaguuuaaucugaaaacuagaccuaauuuuaugauacaacuuaaugcagaaaaauuugucauuuuucuaagugcaugcaauugguuaucuggaauauacagucaauuuuaccaaguuauagaguaaugaugaugugcauauguauauucuuaaaucagaaucuuacugugugugauagcaaagguuacagacaauuacgaauacaaaaauacucacuggguuucaaugaacaguuuguuuucuguaucucaagaaucaguucuuuauucuguuuuaaaaugcagucuacgaauagaaucugagugcugaaacuuacauacuagaucauacuauuuauuggucuaauaggugguaucucuaaaauuucagugggaaaaugacucgcaggacugcauuaaaaugcagauuccuuugggaaacuaccuaucggguccuaugcuuauuaccuaggugacaaaauaaucuguaaaccaaacccccaugacauacaauuuaccuguauaacaacccugcacauguaccccgaaccuaaagguuuaaaaaugcagauuccaggcccccaccuccagauauucuaauacagugggacugcaauggugcccaggaaucugcauuuucuacaagugcccucauggaggugauguauuaguuaagacuuaaaggcagugaggaaaugagacaugaguugcuauagaaaacacacucaaaggguuucccugauguucuaguuucaggucccagacuaaacuauuucuuaugggaugaaauagcccacuggggagaacccuagaguacugguccacaaauccuugguucucaaaggcuccaauucuguagucagagaaggagggcaguccuugcuugggccuauauauacugaucucgcaagccuguagaaagggccuauugcgacuccuagccugugcaaaauaucuacuucaucuuuugguagagugcuucuuucugauuaucaacccaaauacuucucaaagacaucuguggucuccuauguaaagugcacuucuccagagggcuggaggucacagauguagucauugucaaguucuuuuccacacugcuccauccaugcauuauuuaauguaaugcaacaguacauuacuaggccauaaugcaacauuacauuacaggccugguggcccacacccauaaucccagccuuuugggaggcugaggcaggaggauagcuagagcccaggaguuugagaccagccugggcaacacagugagaccuugucucuacaaaauguuuaaaucagccaggugugguggugcacacccauaguccuagcuacucaggaggcugaggcaggaggacugcuugaggaguuugaagcugcagugagcuacgaccuuuuuuaaacuggagagauguuuucuaaugcuagauguugugaaaguggcagugguggcuuuaacugcuucugaaggcaacuauauuuccuucaugacugauauuuuuucuuuaaaaaaaaggcagggagguagagugauaacugaauucucugucaaauuaagaguaaaaauuauuuucuguagcuuucugcuuauuaaagcaccaccauuaauguuggcaucagcuacuuauugagcaccuacuaugcagucuucuagagguggaaaggaauuuaaaaauauaugccauaguuccugcccuugaggggacuugcauucuuacugggaagacacaacaaacacauaaagagauaaacaaguuacaccacaagaagucacaaaaagaugaagacacuuaaacugggucuuaagaucggcagagaggaaggaacuagagaaagggcaugaagcaagagugagccuggggaaggugcacagcugacugggaaacgguaaaaacccaguuuacuugagguaagucaguccaccuaggacucugaaaaauaugagaugguagccagaaagaaagaaagccuuacuggagagagcaagccuuggaugucacaucaagaaguuuggaauuucacuguagacaaguaaaaacagaagaguuucacauaaagcaauauuugggaauaccguauuagagacaugcaggauagaugggagcaaagaguacuuggagacaguuagaaaccucaggaaaacuucagguaucaagugaugggaacucaccuggagaguaggcaaguacguagcagcguuaauuauuacuaguuucauaagcuaguuucauaaaauacaacucaauuauuuuggaguuaugcuacagauguagcaucaagauuuuucagaggaugcugccaaaauaaaauuggugaagugugugauaguuuuuaaaccuuucuacuaacugaucaauuuuagugauaaacagaagaugaaagggaaaagaauuuuauuauguuaacauuuuauuuaauagauugugacuucuguaguauuucacuuuccacguccagucgauuuggcguugugcuugcaagcacugccggccacauaauaagagaaaaaucuaauuucaaaugaauucauaaacuucugggaaacaaaaaucuuggcuuaaacuuagauccuggaaacucaaaaaacuuggcagugauccuuuauguguuccagacaacuacuauucaaaacgcaguaggugaguuccuaauuugucaucagacaaggagaagaaaacuugcaacacuuacaugugaaccuuugccuauuuuaucaacaaacgcuucaauagaggaacagcuucugaagacaccaguuugaguaccaagauuuugaaugaacagaaaccaaauaccccuaauuuacuauaccgaacugccugggaauaaagacaaauuguuuaaacccaauuuuuuuucuauuauaaaucugauguuuggggcauaucaaggaugcugaccaucuugcacauauccauguggaaacagagcacauuuuaucaccccagagccaggcaggccucguugcaaucugauuccucuaagcuuuaagagcuugguuucuuuacaaaauaggaaaacagucaagugcugcaauccugaauuuucacuuugaccugcuguuuguagcaacugcugugugugagccauugaaguuuuggugcuauugccaccuucuuuucaggcugcagaaagucuuuuuaacaagauguggcuaaaucacugcuuuuuuccuaguccaucugguugugagugugugugacacucaagaucacgagugggucuugaauacugaguacucaauaaaacacagacuggacuguuuccauccucagcucaacccacacaagggaaaauguuucuuugccuuccucucuccccaguuucuacagaaauccuuguucccuuuacugauuuccauaaccacagaacaaguuuggagaucaauguguuuuuaagcuuugaaccuucugaaucaugguuuaagcacaaauucuccauaacucagauaugcaacauauaaaauacaguucuguuaauuaauccuuugccuuaagggauguuagauauugccuuaggguuuuuggaagacaugaagcaagacagaacuggccccuaacauaguguauauuaguuuaagaacacuggaugaguuaauaaguuaaaugccuaggaagcauaaaauucaaauccauguuaaauaugaacaugcucaguauuauacucggggaaugacuucaaguuggaaguuuucauucuuacaaacauuuauuuuccuccaaauuuauuguguuuuucuguaaugaugugaaaagucuucauuucccuuuuccccaguguugagguucaaaaagccagaucuuaaccagaaacuaaucuucaucucuucaaugucuuguauguuuaguuucauauguaaguauuuauauuaguuuuccucagggauuuauacaucgauauauauauauauauagauauagauauauauauauauuccuacacagauauauacaagcuuuuuauccucaucuuaccacuugacaauacaacuuuaaguauguuuuacacagcuguuccuuggucaaggucauuugcaagagcaagucgguuucugaagaaaucuuguuuggugggugaaggauccauugagggauucucauuaguuuuuucccuguauucugauccacuggaccuaaaaucucagcacacagauaaaguacagguugauuu

SEQ ID NO: 18440 - RNA, 188520 nt, Homo sapiens
cuggggguuuuccucacgguguguuuagugaccccuccccgcaaucccagaaaggcugcagcacuccaugguauccuacauguagcugcuucuaaaauaauaaaggcugggacauuggcugucuuggauauuaccacuaugcuaccugcuuggaacugggaccagauagaccaagguccaacuuugucguuaggggaaucagaaacgaaaagaagccacuuucugcuaguccuaaccccggucccugggccaggcaaaccuuuucaagcguccggcggcagcggccgggcgcggguccgcagaaaagccgaggcguuucgggucccaagcuguuccgccgccggccccggccuggcaggcgcgcggagccggaacgcgcaaggggucgggugcgcgccaggccuggcgcgcucccuccgggaucgcggcugcgcagucgggcgggagucgggaaaaggggaggagguuggaggagccggaguaaggggagggggaggagcggcgaaagcggaagccauguuggaguuucaccccgagcgaggggcugcgaggguucuccucuccuugugggugugaccagguucggcgcggcggcgggccgcggggggcggggacgauuggccgcuugucgucguccgcagcggcgugaggggagcggcggcggcggcggcggccgcagcguggagccgggugauugugaccgccgggggagccgggagccggccgcggcgcccucucuccguguggcccccugagcggccccccuccccugcccgggagggaggcggggggcaccuggggcccgccaugaaccccggcuucgauuugucccgccggaacccgcaggaggacuucgagcugauucagcgcaucggcagcggcaccuacggcgacgucuacaagguaaaggcaggggccgcgcgccgccgaggccgugggaucccgacccgcagccaagccugggcguccgagcccuugccgccuguccucgggagacgcuggcgccagggagcagucggggaggaggagcugcggacgccaagggcucugcugccuuggugaacaaagggccgaauguuuaaccccgagaccuccccagcccuuaccugagcccccccgguggacaugauuuuugccaccucccuucuugcgcgcauuuccagggaagggcagaacgagagcaggccacacugcucauccauagugcagagaaggucugggcguuuguugcguuggcagggucagcgcgacgaaccggacagcaggggucugguguugucaaaccugccugcuucacgccaaccuggggucguccgcucuagguugggagcugcugcccaccaggccucggugguaguuauuauacuaugcugagcgaccuccaucuuccaucgacagcucucagccuuuagcgccuuauucaucccccugucaguuucuuuuaauuuuccagaguaaugacuuuuuuuuuuuuuuggaaagagcaacuuuguuuucucuaagucgaauuggacugcgaugccauuuaaacuuguuuuuuaaaaagugacuugaauacuuagggaagguacugguuugacaagguuagaauucaaaguccaguagcgguacagcauuccuguuguagagggaccacuucuaaaugugggaagauaaaucacucuucccuggccaacucaacucuuggccucacaguuacugccaagaagagaggagguuguugccaaauguggcagcagucuugauuuaguuguguaucuucuuacugguaacugaaguugaacuccuccaguuucacauaacaccugaggaugcacaaagaaacuuaauuuugcauuggaaaguucagucuuaacuuuauuuugcccauguuuaagcagguuuuuacucuucaguguaaugccugugguaacuuacauauuuaauacagugcagccaguguucugcuuuagucugauuuucuggaugaucuacuuuucaccaucguggaucucaucacuuuuccuacuaugcaauauagauauauugagcccaccuacaauguaugagauacuuggcaaguaagcacuuuggguuguagcaguaaacgauagacuugguuccaaaucuuccuaaguguuucuauuuuuuuggacaaggacaguauuaaauagccauuuaaauaauuauugccguuuaauuuugugaugcagaaaagaguauuaggaucaggguuaugagagcauguaauaggaggaccugauccuguuuaggguaucagacgcucaucgccuuucagcugagaucucagagaugauuaggcguugcuuaggguacuggggagaggggauuacgccagauaggggagcaugauaugugaaggcucugaggcccgaugugaaagaaggccuguauagccugagcagccagagcgggaggguggcccuagaucuugcaggccucuuaguucucauuaggagaucggacuuguuuaggacaauggggaacuauugcaggcuuuuaagcagaggagugacauuagauuuagguuuuuaaaagagcucccuacuacagcaugaagaguggaauggagcaguugggaggccacugugauagucuagguaagaauaaugguguuaaggaauauggugaugacugugaaaguagaaguggauggaugcaagucacuuaugacugguugggggaguucgcuuauauugcgaugaaaaguuaacuaaaacucgaugaauguauacguuuuagguggcaggguauacagugaauuuuuuuacaggacuaauuggcuguguacuugcuauauuaaaaagaacaguuaguaguuaagccacaugauuaaaaagcaaaaaaaaauuagggccuguaauuuccuaaguguaauagagguauacuaaguugguuaaucuugucauucguuuaaaauaaugauaauacuagcugauguuuauggaaugcuuguuacuugccaggcacuauaagauuuuucuaauuaauccuaacagcaacccugugagauaggugcuauuguuaacuccauuuugcaguugaauaaacugaggcacaaggagauuaacuugccaaaguugguagguggcaaagccaaaauuugaaccaauuagggacuguauucuuaaccaauuggcagugcugccucucuaaagauaggagaugggcagauaauguauuacauuuccaguggagaaacugaggcacacauuuaguuuagcauuugaguuguagccacacucugagucaguguagaucuuuaaguaguaguuggaauaccuaauuccugcugugccacaaggucucacuguuuauguagucugccaaguggauaucagauaauagaugcuuggucccugccugccagacucuuccaauaccagugaccaaagcagagaaacuucaugugguucuugacaucauguaccccugccugccaaacucuuguuuauguuuuugucuauaaucaaguuuauucuauaaaguuacauuuuuuuguuauuuguuuugcuguuuuaguuuuuucuuauuuauacaaauuaauugugcuagagagaaguacauuuuguuuucaaaagccaauauauauaauuuguuccuuaauuugucagcauuuacgugcuaaaaauggaaugauuggauuaaauaaauaagagauccgauuauagucauucuuggaagguugguggagauuuuuauuuugaaaauguuuuccuacucaauguaauaacauauuuauuguacuuaagguggcgugguuuaguuccaaagcacugaacaaggauguggacaaucugggauuuauuagcuaugugaccuugugaaaucaaccucucagagcuguuuuguuguggagauauuauuaccaucauaugcccuucuucuuuugguauugacuaaaugacucaaauuuuacuuaguaaguaaguuaucuuuauuuuuuucaggccaaugcauauauacauuuuaucugcacugucuaaagucguaucuuguaagugucguguaacucugcaggcuuuaucugucaugaagugccugcagcuuggguuaccuagggaccuaggagcuggcaacugaagcucuuuaguugggccucaggaggcccauggagugcucugaaauuaauaggcuuaauguuguauguauuuguguuuuucuguggagauggguuauagcauucauugcauucuuaaagagcuucaugauccaaaaaaaugaaaaaaugauccauagguuugccauucaaaaaaguuuucuuggagaaauuagguaguuauaauagaucauaauaugauuuucacaugcauugugccaucuuuugucaggcaguuuuccaguuuaauuuuuauuauuccuacccuuuaagucuugauguccuuauguuuuucuagauuuuuugcuagaaagaagcaggagauaguaaagcuggagaugggauaaggcaaaagaaguuuugaaagaauagucucaauaugguuucugaggaaguaucuuaccuagucuuaugguuuuagucuggucccugugaaugauuccuagccuguguauccaagacuggauacacaaagacuccaggcuguaagccuuagagucaucuuuagugacuucuggacugggcuucuuaggcauuagcuaaauucuguacacaggcauuuuccaaagugugguuggggugcuucaggaaaagccauaccaugaguagguuaaagacugagaaguccuaugguaaagaaaccugguaaacuuugcuuaaccuagcaaacuccaaacuuacuugacuauuagauucuuuuucucuguaauacauauugcuuguccuuaguacuaguguuuuguagaacaugcuuuggaaacguugauauugauuuuuuuucaccuuuguguguuuggaagccauucccucugaagcacgggcugccguguuguuaagcuuccagguaggauucacaucguagucuguguaaauagauuuaaagugucugugaaagcuggcaggaaaaaaggugaggauugggcaguaaaauaaggaaaccaauuuauaugcauuuagauaauuacguguuaguuuauuuguaauuaugcaucuuucaagguguucuauuuaauaucaucauagacuaauucuuccauuauaaucagcauuugugagaaccuuucuggaaaacucaauucuuaaaccuaacggauaaggaauaugaagaccuuaagcauuuagaaaagaacauuugaaggaagcucaaacauuguuauuuggaguuaugcucacuucuauuuacuuccauuuaggauagacucuaauagacucuagagagaccagaagaaauggcccuaaacuucagaaagaucauuugaaguugaauaagguagaauuucccaucaucaguugcuauuugagaugaaaagugacaaugaaacagguagcgagguaauuuuucuagaguguuugaaaaacaaacagguuuucugacuuugaugcagaucugauuaccuaaaggaaguacuuaccuccagccuuugaucuguauauguauuuauuggugaaacguaucuaaugcaucauuuuguauuaagaaugaauaguaaguucucucaugagaguacauugaacagccaucauacauugaacagcuguaauaugagaggaaauguguuaugaacugugaguagaguagcagaaaugacaaggcuugguacuugguauuuacaggaacauaaaauguguaccugcuauuagcugucauaguuugagaucagaaccuuuugguuuccucauuuauaucauauuaaaucucuugcuggcugagagacucucuagauacuccauaauugcacaaccgaccucuguagcacagcauagugauuugagaacaggguucuggagccaggcugccuaguuucaccacccacuagcuuuguccuuaggccaauuacuuaaucccucucugugugucucaguuuccucagcuguaaaauggagaugcuuagaaaagugcuugggacaguaccugacacaaaaaaguguggucauuguuaauugcuguuagugucuagaaguauuuauuauuauguauuucuccuccuacuguccuucuaaccaacugcauuccucaugcuuugccucaggguuuuuagcuugcugucucugccuaaaauccaccccuccccaccaauaucuguuuggcuugcuucuucguuuaaagucucagcucaaaugucaucuuuuaaugagccugcuccuuuccacccuacaaaaaacagcacuucucccaccacuuucagggauacaguucagggauggauccagguuuuacgggaccugaaguugaugcaguuuuggggacccucauuaagaaaacaaaacuagaauuaaaaaagguaugaaagugaaucuuuagaaugagaaaagauaucccaacaaaauacuguaaccuuaggucccuuucuucugagacuuccuuaggcauuuaaucacaaaugcucacaaaaaaaugcuuucugaugacucccuggcucccugucuccaccuggaauacucuacaugucccagcaacucucagcacucauagaggaccaugcaagugaaggggccugaacuuuaaguuuuguuagcuucacaaaaaauucaguuggacucuuuacuuaauuuuuaauuauggcauguaucaccacauguuuauuuguuuauagccugucucuucccacuagaguauaaauccaggaaacuggugauuuugcuuuguucauugcuguauccccagagccuagaagaguagcugacccauauuagguucuuaauaaauauuuauggaaugaauaaaugaaccaacacgagaggaacaaaccauggcuacaugaguuuagaggaaggagaucauuauuucugacugggagaaaucacagcaggccuugcagaggagguggcauugggcuugacuuagaguucuggcaauaguggguacagaaugaguuaaauguaauggguuauuauuaggucuuaaaucuaaucaguaggguuaauguaucuuuggcauauuaagcaauguucauaauuguuauaugcauaugaagauacuccgucauuuugaacuaaauaccccuagugacugacuagugaauacagcaguaggcuaucacauaugacuuuuauuuuguuuuuuuuaaaauacgauuaaauugggcuuuuaggaagaggacuuuguucaccaauacaaaaaaaaccuucgauucaagagaugaaaucauguuucuuuuuuaauuuuuauuuauuuuuucauaccaccuuuauauguacaaaaaucauauuucuuuucugcuuuagguuuuuuuuagucuuuuuuuguucuggaagaugccacauuucugaguucuaacugccuugaccugauuauagguuugguuuccuaauguaauaauguacugccuaccuuagcccuuaaacucuauagaauaauuuuagauuugaccauaaauuuacauauguugaaauaagacacuuauuuuguuuguuuaagcucuuagaaauuugagauuguaaaaauucuuucuguauaaaggaucaucuaccuuaccuugcucaaagaaucuccucuucaucgccuguaugcuaaccuacauacaccaugauaguaaggccuccccagccauguggaacugugagucaauuaaaccucuuuccuuuauaaauuacccagucuuguguaugucuuuauuagcagcaugagaacagauuaauacaugccccuucccagccagucauaaauaccacccacccacaauuauuguucuccuuucggucaccaugaaagcucuuuuagaacuuuguauaaaugaaucaugagugaauugccucagcacuuuugaugaaaaucaguugacaguacacaugugaguauaucuggacucuuguucuuuugagcuguaugucuauacuuucaccaauaccucagugucuuguuuacuguagcuuuaucaaaagucuugaaauuaggcagaguggguccuccaauucuguucuaccuuuucaaaaugguuuuaucuauucuagguccuuugcuuuuccauacaaauuuuugaaucagcuuuucaaguuaaauauaaaagccuacuggaauuuugucuuaacuuuaaauuuugagauacauaauucuaaauucauugcaaaaagaggaaaagaggucucauguacccaacacccaccuucccccaguggugauaucuuuacauaccuauagugcauuaucaaaacgaggaaauuaguuggcacaauacaguuaacuaagcuuuagucagauuucaccaguuuuuguaugcauucauuuuuuauaucuuuguauauaauuuugugauauuuuauauacacagccugcugggauugugugggaucugucacucaguuaguggagaauugagaucuuaaaaacauugagucuucugaucuaugaauaugauauaccuuuacauuuauuuagaugaucuuuaucucaucaauauguugcuuuauuuuaauuaauuaauguuaucccuggcuuuuccuacuaauauugcagugaaacauaauuguggaaaacuucuccaggauugcguaguaauuauaaugugagccauauuuucaguuuucauuaaaauucucauuguacuaguaguuucugacuuccuuuggcuuagucuuguucauuuuuaacccugagcauauggacuccuuuuuuuuuuuuuuuuuuuuuuuuugagacggagucucgcucugucgcccaggcuggagugcaguggcgcuauuucgggucgcugcaaccuccgccuccuggguucaagcaauucugccucagccucccgaguagcugggauuauaggcaugugccaccaugcugggcuaauuuuuguauucuuaguagagacgggauuucaccauguuggccaggcuggucucgaacucuugaccucgugauccacccgccucagccucccaaggugcugggauuacaggugugagccacugcacccggcccauggacuccuuuuaauaaaaauugacaaaaaugaaagggaaacaggcaaaaugacuauuuaaaaagauauccauuuuuucuauguauccaaagauuuuuuuuuugaggcagaguuuugcucuuucucuuguugcccagguuggagugcgauggcaugaucucagcucacugcaaccucugccuuccggguucaagcacuucuccugccucagccucccgaguagcugggauuacaggcacccgucaccacgcccagcuaauuuuuuguauuauuuuaguagagauggaguuucgccauguuggccaggcuggucucgaacuccugaccucaggugaucaccugccucagccucccaaagugcugggauuacaggcgugagccacugugccggccccaaagauuauaacaaauaccuuauaaaacuugguuuacuuuuauauaugagauguguguguuucuguguauuuugcaaaacucacagcuuuugagcuuauuaaaggaaaauacacuuaaaguuuacuucauccuuaagugaaaaauaacacugcuagguuguuuaggagauccuaaagaaaauucuuacccugaggaacuuaaacccugauauaaggaaacaaaaucugcauguauggaacaucuaaggaacaugccuaaggcacuauuuuaacaauuagaagaaaacaauaaaacuauauaaauacuguaggaauuuuaauuuaagggaaaaauaaguugacuuccugaaagagugaaucuugaccugggacuugaagaaaaauuguauuugcgauuguggagaacugugaagucauaccaaaagaguaaauauggguuaaaaauacugcuguagaaccuaagugggcaaagaaguaauaagacaacuauucuaaggagacauauugggaaaugugguagauaauguuucacauauauaagauacagauaaaugaaugccaguugaagaauuuagaacucacuugaccuacaauguaguauuuuucaaauucauuagggccacucuuuucucuaacgugcuuggguagcuauuuagaugguauucaauaaguuuuauuucuucccuuucaucucuauugauuuagaaguuaaaagauuuuacuuuuaugcuuuuggugguuaccguuaaauuugcaacuuguguaauuagucugaaguuaacugaucuuucucuguucucuuucuggucaguauguggauuuuagaaggcuuaauuucauucacuaccuuacuguuuuguguugucucuuacuuugguucuacuguucuuaaaugucccaguuuaguuuuuauuauuguuuuauacagacagugcuucuuuacauuuacguguaggaguuuucaauuucuuugcucacuguuucuucuuggccuuauauuccuucauucuggguucagauuucuuuaaucuugaagcuguauuugguaggauuuuuuuucuuucuuuuaacuuuucuuuuuaagugaggaacuguauaagguaaacucagucuuccuccucccccuccucauugucuuuauuuugucuuuacuuuuaaaucauaguuuagugggguauagaacucuaaauuaacgguuguuuuuuucucagcacuuugaagaucuuuuguugucuucugguuaccuguugugcuguggagaagucuguugucaauauaauuauuguugcuuuuagcuaaucuuacuuuuucuuuccucccuguuugacuuuuaagauuuuuuucuuugauucugguguguacaguuucacaguguuauguguggauuuuaauaaaaauauuuacuguuuuucuuuaaucugaagaguagcguauuuccucaguccuggaaaauuguaaacugcaauaucuuugauaccuuucuuccccuaucucuuucuuguuucucuuuagagcucguguuguauucuuuaacuuuguuauaguucuccaugacuucucaugauuuuucucuuuauucugugucauguauuaugguucuuaucuuuauuaucuuuaauuaugucugucuaaucugcuguuugaaacuuucauuuuuuaaaaaaaguuugcuuuuuaaaaaauaauuucaauucacaggauaauugcaaagaaugagagaauaauaaaaauaaaauaacucucauacauccuuuccaagauucaccgauggcuaauacuuuaccacauuuauucucuguauauauacauauuuuuuuuuucugaaccauuugagaguaaguugcagacaucaaacuccuuuacccauaaauacuuugauguguauucucaaaaugaaagacauuuacuuaaacugcaauaaauuaucaaaaucaggaaauuuaaauauuaagacaauacuauuauuugaucuacagaccuuauugaaauuucaggagucccaguaaugucuauuauagcauuuuccccccaacuccagaaauccaggagaaucauaugcuauuuuuaguuucuaagacucuucagucucuuaaccuagaagaguuuuucagccuuugucuuuuagacaccaacauuuuugaguaguacgcaucauuuauuuuguagaaugccccucauuuguuuaaauucauguuacacauuuuuugacggaaauuuauagugauguguauccucagugaaucguaucaggaagaacaugauguugauuaguccccuuauuaauguugauuuugauuauuugguuaaggugggugugccaaguuucuucacuaucagauuaucucuuccuuuucuaauuaauaaguaaauuauggggagauacuuugagacuauauaauauuuuguuccucaucaaaccuguacccacuaauuuuaauauccaaguugauuucuacuugaauuauuacuauaaugguucccaaauaaugauuuucuaacuccguuaauuucuucuacauguauugguugacauucuacugugaagaacuauuuuuguuuauuuauuuuuuggcucauggauucuucuuuuauucauuggguuuugauucaucacuuuuauuuugaugcucaaacaauuucagauuuggccaguuggauuuuaucuuagcuaggacugccguaacaacauaccacagaccagguggcuuaaaugacagaaauuaauuuucucacaguucuggaggcuagacauucaagaucaagaugccagguuucuagugaugcucucuuucuggcuuguagauggccuucuuacagagagagagggcauacuuucuggugucucuucucauaagggcacuuaucccauccugaggccuucccuaccucaggaacucaucuaaacccaguuaucuccaaaaagccccaucuccagaugcugccacauugaggguuaggucuucaacauguggauuuuagagggacacaguucaguccguagcagauugcauugcuuuuuacauuuuauuaauuauauuccuagauauguguuauucuuuuucaagucuuuguauucuuguugcauacuuaauuguucuuagugcuuucggauuagucuauaauuucaaauuuugggggauuucaucuugcaguuuguugcuuuguuuuaugcugacucaugccugugaauuucuauguuaauuuugaauucaucuacuuuuuuucuguaagaaucuuugugguuuaaauugacagcugaguggaggggcugggggggugguggggagugggugggagacuguggcuguccuuccaaaacaguuuugcuuuuguuucuuccaguaaccucaugagucuuuuuggucuuggauuuuuauuuuaauuucucaguuugggauuccccacaucuuauagauaauacaaacuugaaccccaaaucaaaagagcaaugacucuuggauuugaauucuuggaggacuguuuuucuucuacccaaacacagacuuuguuguuauccucuugugcuuguagguaacuuuuuuuuuuuuuuuuuuuuuuuugagucagguuauaacucugucacccaggcuggugugcacuggcacaaucaaggcucacugcagccucaaccuccugggcucaagugauucucucaccucagcuucccaagguagcugggacuacagguguccaccaccuugcccaccuaauauuuguauuuuuuguauagacaaggucucacuauguugccuuggcugguaucaaacuccugggcucaggcaauccucccaccucaaccuccuaaagugcugggauuacaggcuugagccacugcgccuggccuaacccuuuuuuaaaaaaacuguuuuugcuuuacugaaggcacagucccuuccagaguccuagcauuauucgggggucuccguuccaaugugcuguuuugagugggcccacgacuguucaccuguacucagaugguuuuaaaauccccaagcaccuagauugcagagauccacuagacuuccuuccuccauccccucccaccuugauucuaauuccccuccccccuguugguggaaaucucaauucugguuuuccacuuuccaucuuaauucagugugauacauuuguuaaaauugaugaaccaggccgggcgcgauggcucacgccuguaaucccagcacuuugggaggccgaggcggguggaucaccugaggucaggaguucgagaccagccuggccaacauggugaaacccugucucuacgaaaaauauaaaaauuagcugggugugguggcacacaucuguaaucccagcuacucaggaggcugaggcaggagaaucgcuugaaccugggaggcggagguugcagugagcugagaucgugccacugcacuccagccugggcagcagagcgagacuccgucucaaaaaaaaaaauugaugaaccaauacugauacauuauuauuauguuaauuaaaguucauaguuuacauacauuaggcaucacucuguguugcacauuuucugugcuuuugacaaauguuuccaucaguauaguaucauacagaauaguuucacugccuuaaaaauuccauuuucuaucuauucaucuuccauucuccucugcccaacuccaggcagccacugaucuuuuuacugucucuauaguuuugucuuuuccagaaugucauauaauuggaaucauacaauauguagccuuuucagacugucuucuuucccuuagcaauaugcauuuaaguuucuuccauaacuuuuuguggcucaauaccucauuuuuuaaaaauuacugaauaauaucucauuguauguuuauaccacaguuuauucauucaccuauugaagaacaucuugguuguuugcagguuuuggcaauuaugaauaaagcagcuauaaauauccauguguagguuuuuauauggacauaaauuuucagcucauuugggcaaauaccaaagagugugauugcuggauugugugguaagacugcuuuuagcucuauaagaaacugccaaaaugccucccaaagugacuguagcacuuugcauuucuaacagcaaugaaugagaguuccuguugcuccacauccccaccagcauuuggugguguaguguuuugaauuuuggcuauucuaauagguguguagugcuaccgcauuguuuuaauuugcugucccuaaugguauaugauguuggucaucuuuuccuaugcauauuugcuaucuguauauauuuuuugguaaggugucuguuaagauuuuuucccuuuuuaaaauaggauuuuuuuuuauuguugaauuuaaagaguucuuuguauauuuuggauacauguccucuaucagauauauguuaugcaguauuuuuucccaguguguggcuugucuuuucauucucuuaacaaugucuuuugcagagcagaaguuuuuaauuuuaaugauguccagcuuaucaguuuuuucuuucaugagucaugccuuugguguuguaucuaaaaacucaaugcuagaccauggucacuuagauuuucuuguauguuaucuucuagaaguuuuauguuuugcauuuuacauuuaugucugugauccauuuugagguaauuuuuguaaaagaugugagguccaugucuagauuuuuauauuuuauuuuauuuuguuuugcacgucaauguacaguuguuccaguacuauuuguugaaaagaccguccuuuucccauuggaucaccuuugcuucuuugugaaagauuaguugaauauauuugugugggucuguuucuggacucuuguguuaauuugcuauagcuucuauuagaaaguaccacagacuagguggcuuauacaguggaaauuuauuuucucaguucuggaggcuagaagucugagaucaaggucucaauagauuugguucuucugaggccucacucuuuggcuuauaguuggcuguuuucuccuggugucuauacauggucuuuccucuguuuccaaacaugaggaguuugggauuguaauuuggagucagauauauagcagagaacuaggggagauaaggacugggagaagacuauugagucuaguuaggaggguauaauugcuguucagaaagaguaguugguaaagcauccuaauuagaaaugauugagaaggcaggaggaaauggugacauugucuguggucucuuuucaaggaguuugaucaugcugcuuucuucuaguaccauagcauuucuaucuuaguguuuuucucaggaguauuuauugagcacccaugcugagcuguguaccauggcugacagaggaugaacagaauguaaucccucuucucaaguugguggcagacuagauacgggaauaguauggaguaauuauagcguuaaguaauaugggguauuuugugauuaaguauuauguaauucccaauaaaaguucagaagaucagaaaaauugcagcccauggccaaauaaaggcuuuuuagaagagauagaaugaaaguuuggcuuuaauguguuguuuagauuuaaauggauaaaguggaagggcacuguaguugaggugaaaaucgaagaaugaaguccugguagggggaggaauaagcaagaagagaucaugcaggaaacgggccaaacuacaucaaaugauuuguauuggagaauaauagagaacauuagauauuaauaacaauaguuauaaucauagcagaugccauuuauagaguauauacuauguacuaggccuuauuuuauuuaagugcuuuauagguauucucauuuuaauucucuucacaaccuuacgagguagguauuguuauuuccauuuuacagauacagaaacugagacacaaaaagaaaggucaagaauaggcccaggucaggugcaguggcucaccucuggaauaccagcacuuugggaggcccauguggguggaucgcuugaaaccaggaauucaagaccagggugggcaacauggcaaaacccugucucuacaaaaaaaaaaaaaaaaaaaaaaaugcccaagucaauaaaucuaguaaguaguaaguggugaaaccaggauugaauucaggcagucuuacuuccagaacccaugccuuguagucacuguguuguucuguagagagguaggugagaccagaauaugucuugagaaacugucuccagguuauaaauuaaaugugauagaaauaagggaagcaauuugagguguuugaugaaccgaagaguagauagugagcuacuugauggcagggaccacuucuuaguccugugagagauggaugugguggagaguggacaguuaauccucagucugauauuucagauuauguggaagaugguguaccaguuaggagugaauggaaaugauaugaauuagauuaaugacaggggaaacugggggcauagaugaccuggagagaugggaaaguugagugaagcaagauguggaguuagauuuuggacagauugauugagguguaaugucuauagacuagcagauuugaaggaacccguagggaaauaucgucaagagggauaguggacaccugagaauaagaauucuucaaugaugggagugucaaggaaagagacaucuuuugcuugaguuuucaaaggaauaauagcucuuaacuucuuccucacuuuuaauauuugagaaauucauggcggccgggcaugaugucucaugcuuguaauuccaacacuucaggaugcugaggugggaggauugcuugaggccaggaguucgagaccagccuggacaacauagcuagaccucaucucuuaaaaaaaaaaaaaagccaggcaugguggcacaugccuguaguccuagcuacuugggaggcugaagcaggaacaucacuugagcccaggaguucaaggcugcuguaagcuaugauugcaguacugcacuccagccuaggcaacacagugagacugucucuaaacaaaaaacaaaauuaaaaaaaauauggaauucaugauucaugacuucaguuuuaccuuugaauagugacauuugagcaaauaaaugaaauaaaauauaaaacaccuauucuguaagugcacguguauauggaaguuauggucuuuaguuuuaaguauuauaaguuacuaaauauuucccaguugaaauaaguuaagaauaauggaguaaauaagaguagugaaagauugauuacccaugauuguuuagcguuugcuuucaacaccuguguguccuuaaaagcccuuuuuggauucuuguauuccuuucagugccucagaggaauaggugacuuagaaucucucucugacccuaggccaggggguucauacuccucuuccuccauuucauucucaggaggugacacaguggaaagaagagaccauugaaagugcugagugauaggaaagucagaugggauaugucauuacuaaaccuuuuucaucuuuccguuuccauaccuugcuuuugccuguccccauccugugcuccaccaucuucuaucccgucaguaaaaccacaaacuccaaaucuucaaaaagcauugagcagagaauauaaagccuuuugcagaaacaguccacacacaguuauguuuaguuuuugaaugccauucagcuugaagaaguuagucauuuuuauuucauaaucauuguguugauauuuuucuucuggggucucuuauuucugguuagugcugugauguuaauucaccaauacuacuaggaucugcuaaucauagaagauguuuuuauuuggaauguugagauuuuauuuccuccaguaaacuguguucacaugagguuugacaaacuuuuuuucuuucaaaaaccaaaauuggagguuucuguuaauuacugggcggagcugcuauuuuuauaguaggucuguauuguuuguguugaguuucuuuagcuguuucuaucgcgcuaugaugcaauauuugaauuaaaauguagagaauauuucuauaagguaauacugcuuuuauagaaaauaauauaaaaaggugaaauuuaaauaaacugcuuuauaagauuuuagacaauguauuuuuaaaauauaauuuaacuuauuuuggugggcuuuagaagaaaaaucuguaaacuaaacuuauuuugucuggcaguaaagggaucuaguuuuuuuuuaacacuauuguuugcagaaaguauucacuuauuaauacaugauaaaauuaguuguuuuggaugagaaauaccuuuuuguuaaacuuaucuuuuuaaguucauacuauuuaaaacauuauuuaaaauauuucacuuacuauauaagauuuuuaaaaaauaaacuuuauuuuagaauauuuuuggauuuacaaaaagucacaaagacuccuaacccaguuucguuuuuuguuaacauguuaccaugguacauuuggcacaacugaggaccaguaucagaacaugacuguuaacuaagcuccaccgucuauuuggauuucacuaguuuuucucuaaugccucuuucugucucaggauuccauccaggauaccauauucuaguuacuauguccccuuaagcagaauuuucuggugugugacagcuucacagacguuuugauaacuuugauaguuuuaaggagugcuggucaauguuuuguagaguguuucuaaauuuaagguuuuuuguuuuuuuuuuucucaugguuagauugcgguuauagauucuagggagaaugaaguauguaugcuguugacauaauuuaucacuggcaauauuaacuuugaucaccggcaguguuaacuuugaucaccggcaauguuaacuuugaucaccuggcuuuuuaguuaaccagguuucugcacuguaaaacuacuuuuccccacuuuuccauuuuguucuguuuggaagcaagucacuaaacacagcgccacacucaagagguaagaaguuaaacuucaccucuuugaggaagggaguagcuucguaaauuacuugaaauucuucuguagggauuuaugucuuuguccucauuuauguauuuauucaguuauuuuauauuaguauggauguauggauauuuauuuuauacuuuggguuaugauccaguacuacaugauuuauuuuguugcccagauugcuccaacuuagccauugggagcucuuucaggcucuuuccugugucccauucauagguccccaucauuuguuuuuuuuuuuuuuuugagacggagucuuguucuguuaccaggcuggagugcaguggugcagucucugcucacugcaaccuucugccuccuggguucaagcaauucuccugccucagccuccugaguacgugggacuacaggcacgcgccaccacauccagcuaauuuuucuauuuuuuuaguggagauaggguuucaccauguuggccaggauggucuuugucucuugaccucauaaucugcccaccucggccucccaaagugcucagauuacaggugugagccacugcacccagccaucauuuuguuuuuaaugcuuacuuucuggcacugcaagaugcuuuaggcucaucuuguauuucucugcccuagccugauaagcagacauuuuuccaaggagcccugguuccuucuguuagagaaugguguuagauaccaagaucugggcucugaguauguuugcuguuggcgugucauugauucuaggauuucucuuaguagaugaagcuaggaaauacguguauauauugcuaaaccacguauacauacauaucuauaauuauuuuaguaucucucugucuguaucuguuuuaagcuaaacugauaucucuugaucuaaucuagcaucacaugguuuguucuggccuucccccauuguuuaucuguaguuuccuaauccaguaguaagaaaccuggcuuucgggcgggugcgguggcucacgccuguaaucccagcacuuugggagacggaggggguggaucacaaggucaggagaucaagaccauccuggcuaacacggugaaaccacgucucuacuaaaaauacaaaaaauuagccgggcguggugacaggcgccuguagucccagcuauucaggaggcugaggccggagaauggcgugaauccgggaggaggagcuugcagugagccgagauugugccacugcccuccagccugggcgacagggcaagacucugucucacacacaaaaaaaaaaaaaaaagaaaagaaaccuggcuuucacugccugguauccauuuaugaauuugcucaaucucaguauaucuguauagcuuuuuagaaauuuucacaacucuguuacaaguugacaagccaaacaguucucguauuuuuaaguuacucauuuacucuuugaaauaauaauaauuauacaccacuuacuaugugcuaagcauuauucugugaacuuuuacauguaagaaccgauuuuagucuuaauccaugcuauguuguaggaacuuuaauuaucucuauuuuacaaaugaaaauagaggggcccagagagcuuuuguaguuuuuuucccaaggcuccacagcuaguaaauggcagagccagcaguugaacccaguuugccuccagacuccauacauucggcuauacugccaaaaauagaugugugaaaacauuguaguguugauuaucauuuuuaaaaauauucuuuuuuaugcuaaggaagaagaggguucagugaucucagaaaaauccccaaaguacccuucuggauaugagaggggacagugguuagaaaagaguaaauuucuuuaaauagucaaacuugcagaaauggaacuguauacucacuaaaggaaaauaaugcuugcuuucuucugguugaagagauugugucugugaggaaaauaguucaugcuuuuaaaaaucuucuggaauaaaacauggccagcuuuuuuuucugcccuccuuaaaccaauccaugaugauugccagauuauuuuuuccuucugguagaagcaugugguucucacccucuucacauaugucucuugcacagaggggaaaggagugggucagaauugcaguuagcaaaggcguuuuauuggcugccgaucaagucaagaaccaaauuaguugaaggaauuucuuuauuaacaugccagaaacaucuuaucuauuugguuuuaccagagccuguuuagcauuugguuucauugguaagcucauguagaaggcuuaguuauucugaaguuuuguuuucaaacaggacagcccucccaacuccacccucccagcaucugacugaaaauuuuugacaguuuaauugagauauaauucauauaccauacaauuuaccauauaauugaaugaguuacccaguuaguaugacuuaaauuugaguccuaaaaucagaaacaagauagugauagagggaauuuauucuuccaaauguuauuuuuauauauauauauauauauauauauuuuuuuuuuuuuuuuuuuuuuuuuuuuugagacagagccuugcucucucgcccagacuggagugcaauggugcgaucucgacucacugcaaccuccaccuccuagguucaaacaauucuccuuccucagccucccaaguagcugggauuacaggcucccaccaccaugccuggcuaauauuuuguauuuuugguagagaugggguuucaccacguuggccaggcuggucucgaacuccugaccucaggugauccacccaccucggccuuccaaagugcugugauuauaggcgugagccaccgugccuggccuauaauuauuuuuauauuaaguaccauuaaugaacaccaaaagugacuauuaaugccugacauuaauuuauaaggauuggagagacauaaauaccacaggaacuugauaaaguggcacagugugauugauccucauugaaguaauacguacgguuaucuuuucaccauaauuucacuuuccuuucuuuuaauugacugucuccuuuuucccacucaaauuuaagggcauuuaauuccguaagucuguuucuaaguaauaauuaaauugaaacuagauuguacuuacuuacuugugcaccaauaagugcaaaaggauuuugcacugagaauucccauuauuuuagugcagaacuugucaaauuuuccuuuguugcuuaaacaaagucauaucaguaagcauaaaacaucugaaggaaauuuuaauacuucugaugcuuguucaguuguaguacauacuuuuaaaaugaagcccauucauuuggaacuguuuuugagagcuauaacauuuaaauaacaucuaggagaaguuuggacuuuuacaaguguaggcugucauuuugcagaaaagaaaaucugguugugaaccaaacccaacuuagggauuuggcucauggaauugcuuauaaccucuugaacuuuucaguucucuaaaaaauuguuggugauaauauuuaagauucucuaugaaguuggugguuuaauuuuggauaaaugaauucccauuuuuuacauaauacuuggcuuucauacaagguucaaaguauuagauugguacauacucuuuuuuuuuuuugaguuggagucucacuguguugcccaggcuggagugcaguggcgucaucucagcucacugcaaccucugacucccagguucaagugauucuccugccccagcaccccccgaguagcugggacuacaugcaugugccaccacgcccagcuaauuuuuuguauuuuuacuagagacgggguuucaccguguuagccaggauggucucgaucuccugaugucgugauccgcccaccugggccucccaaagugcugugauuacaggcgugagccaccgcacccggccuagguugguacauacucuuaagagaauugaggcauaguaggcagacagaguagaagaaagagaucugcaagcaggugguaguggggguggaaugugggggccauuucucaaaaacauuacugaaauguuuucugaagaaaauguauucuucuaaaaaauuugccuaacauuauuuugugagcuguuuuggaauugcuacuagccucuuaauucccccgcaauaguuugugaaaacuauuuaauagaagauuuuaauguaaacuccaaaauuccaccuacuaacuaggauuuaguaguaagauacaauuuuaagguuaagagcaggauuuuuguuccugcaucuggggugcagugaucuucagagaagauuggugccucucuuugcuucucauuuuggcuuuugauggagagguuggugaguguuucuguuuucuagauuuggcuauuucuauagagauuaggaacauguugcuuauuguaaaguaucaagacagagaggaacaaaaucaaguuuaacuaugagagugcuuuaaagcugaccaugagaaucauguucucuagcagauauuccuugaacuacucuucccuugcagucaccuugaaagauuguaauaggaauuagcgaguaaguguguaugcucuuacuuaaagauguagauauugauaugaggaggaaaggaauaauguacuuucggaauauaucugaaucguauauuuucuguuaagaagcaagaaauuaaaagccccucuugagugacaaaaugauccaaagcagagcuucacuuaagagguucuuagcaccuacaagguggagccugggcaucuuguaugccaagaacucuacagguaguucugagaagacaguuguuaacggacuccccugucuggugauacagggggcccaccucuacccuggucuugcuucucuuacaacuuuuucugauuguguucacuuucuauuuaguccguauuccuggacucugcaccucuaccuuuuuacuuugcauguacagucaauggauucucacaguuaauugcagucauuguagugacuggaugugacccauuuuuggcugucuuugguuucauauaucuugugauugugcuuguuuuucucagcaauaccaguaucugaccacugacuguacccagucuguccccugggcugcacuggcauuuccagacuucugccuuaauugcccccuuuccucauaaugguggagagacauuaaggggaauggugguucuguuccuagcucccucguuaauuagguaaaugugugugauucaguuccuuaaccacuuaggacuauaguuuucucaucucuugcuuaaauccucuucaguuucuguauuauuaauagaacuugguuacucauguauuuuucucuuucugauacaaggaauuuagccugacucucuaacuuuuacugcaugaaagcuuugaugaauuucuuuauacucuagguaaaauggaacaucgagauguacuuucugcucauuucuaagacaaaaagcuugacauuuuauaauccuuuguuggguuucuccucguuagucacuucagugagguagacaaguuaguugcauguaauagacaauuagaaaauacaagaaaucuuuaaaaauauugaaauggcagguuacuaucuaccagauagauacuauuuggucagaugaccaaguaguuaggaacuuagccucuugauugccagauuugaauuuuagcuguacuaguuuuuaagguuuuuuuuuuaaucuuggacauguaauuuaauuucuuuaugccucaauuuauucauuuguaagacgagaauaguuaaugauauuuaaauugugaaguuuaaauaacaaagcauuuaaaucuuaguacauaaccuguacauaguaaguacuucauaaacguuaacuacuauugcaguaguauuuguuccuguucuucauugucauguaaauuuagggcuauuuucaugaucgccguuuaggaaagcccuucugaguguuucuaggguuuuauuuuuuguuuguuuguuuuuauuuuaauagcuuaucucaagucauauucuaucauaucaucuagguauuuuugcuuuuccuccugccuaggacuaaucaaucuaauuuuuuuuguuuuuauuucccuuaacuggaauguaagcuucgugggaucaggggccuucuuugucuuauuccuuguuauaucuccagcuucuaguguaauagauggacuacaauagaaggucaguaaauauuuugggggacgacauuaauugcuacagugagcuguucagcguauagcugaaaggagaugguggugacugcagcuagguguggcgcgaucuccuguagauccaauuugguggucuuuuuccagggcccugacccgcgcuagcuguuacugauuuugccccugaaaguauguucucugacuuaauuauuuuggucuuauuuggcaaaucauugcaguuuaccaaaguguguuuucuggaacauuugaucuuuaaagugaucuuccuaaugacuguaauauuccaauuccacagaacacacuuugggaaaugcagaguuaguguacuacugaaagccugguuuacccucacucauuucuugccuuguaaaaugauauggucaggaaaguuaaaaugaaauaauauaugugacauacuuuguaaacucucuagagugccaugaagcguguugucaaguguuuaagcuuccuuuuauuagucaccauguagauuuagucaccauguagauauguagccauuacccuucgaaccucaagccauuacguuuagucacuuucccucucugcagaucgucacauuuuuuucauugcuaacagucacaguuccuuagaguuauuuuguucaauucugacaaacuucugugcucaugaaaguacuugacagauacuugaugcacuuagaacugaauggaugacgaagccuuugccagauaaaagcuuacugguuccauccacuuucucaccaguggucaucagagaaauggauuuccagaauuguaacauuguaguuuaaucgucuagcaaagacauuaagcauaagcauaaaccauaucuuugugucccuguacccggcaccauaccuggcaugugauuagcucucaguaaguauuuaauaacuaaacaagacacugaaaccauacaccauucuuuccucaugcucacaucaugaaauggagucacuguuuagagagggaauguaaauugguacacucaaucuggaauauguaccacaacuuucuaguaugauuuaaguaggaaaaauguagggaaaacaucugccuucgugucagaagugagggagucaaacuuacuggcuuucugucuguacucugcuuuaaaauuggauuuuaaauaacgguuuuaacuaaaaauagacgccaagaagaaaacauuucucugauguaaauauccauuucccaguccucacaggaaauucacuuaaacuuaaggcauacaauuauauggaguauacuuuguuuuuaaaaauuacuguugaauuacuguccuguauuuaaaaagacauagauucuguucauuuaucuccagcuuaaguaaaaaaaauggcauaaugauaucaaaauauuuuguucuuuuaaacaguuucucaaagguguauuuaaugcuaauguagauuauauggugaagauauguuucuuugaaaagaugacauacaaaaacaauucuaggauaucaguagcaaaaacuaugacauaugugccuuugaugucauuguaccguauauccuuuuguauagcuaaaauggcuauucugugcauuuugguuuaauugcuauagugaaaauuacauuuuugaagagcuagaaaagcuuuucaaaacuuggaaauguuguuauccuucauauuaugaaaaguacuaguuuuagucuuccaccaugcaaagaccuuuuuaaaaaugaucuuuuaaauauuauuuucaugauaaauaauuuaccauuugucuguggaagagaaauacugcuuucugcacacacuuguguauguguuccaaaaucauguaauaagauuuuuggcuguuagagugacaugugacuguaaugguuuucaguagaguuuguuauuauaauguauuagcaaagaaccaacauuuauaaagauagaaagcuuuacaagaaaugcuaagaucuucauaauauuaccaguugcuuuguuaugauuuuauugcucuaauuuucuaggauuguaaaauuaugucuaauuauugacauggguacaggauguugcgugaauacagggaacuccaaauucuugauuguggcuauuugugguauguccugccaaucuauaaaggguucagcugccucuuauguguagaugaugcaguggccuguugcugaacuagaaaucagcuguugcuuuaaaugacagauuagcagcucccuccuccacaaucccaaacuaccauacccagaccuagguguaaguagaaacuaaaaagagauuaaccaaaguuacuucuucgcuguagucagaaaaacguaaaggauauugaaaaagcaaauguugggcauaaucauauguagcauuuuauguuucaguuugugguaagaaguuuuucaaaguaccuuaacaauggaaauaccuuucugcuauuuucauuccaucauuggaauuagcacuuagaaacuaucccuuuaagugcuauugagucuucaguuauugcuuaaccacauuguccuuuaucucagugccugugaauuagagaucugucuuuacauuuauuauaguacuagguaaauaggcauuuauaccaacuguaacauaaacagagauuccauguagaauauggauaauuauuuuuagucuauuucuguucacacuguuaaauuaaccuuguuuuuguuuauuuucaacucugaguauaucucaauaucuacuaugcuuuauuuuucucuuccgauuucuguucucugcauacucaauauuuucuggagaaauuuacaaacuggcugaaacaucuaguuuagcuuuaagugauuuguuguugucguuuuguuuuuaaauguugcccaggcuggacucaaacuucuggguucaaaugauucuccugccucagccucuagaguagcugggacuauaagcuggugccacugcagccagcuuccaaguggaucauuuauugaaguucagcaauauuagaguggauccuugaacaacagagagguuaggggagccagccccccauguaguggaaaauccauguauaacuuuuugacuuccccaaagcuuaaccacuaauagucuacuguugaccagaggucuuacugauaauauaaauaguuaauuaacguguauuucuuauauguauuguguauuauauucuuacaauauaguaagcuacagaaaaggaaaggcgaagaaaucauaaggaagagaaaauauauuuacuauuccuuaaguggaaguagaucaucauaagugucuauccuugucuucauguugaguaggcugaggaggaagaggaaggguugguuuugcugucaggguggcagaagugaaaggaaagacagaagaggcaggcacaguauaacuuuacagaaauacauuguaauuucugucuggcuuuuuugcuuuuucauuucucuaaaaauguuucuauaugguaccaauccucccacuguuaguuucagugccuguaucaugggaggaucccugucauaaaagaagucaaagcagucuuggagaaucaaacccauuugccagauugccugauguuacuuugcuuucuggcacugcuucuucuuugucuucuuccucaucgucuggcacugcuuuagaagcacucaucuccaucaaguugcuucuguuaauuccucugguuugguaucuguuagcucuuaaauuucucuaagauccauaucucgaaacccuucacccacccaaccccccaccaccuuuuuuuuuuuuuugccauaucugcaaucucuuucaugauuuccuugacugacucucauaaauccugugaagucaugugcaacaucugggcauaguuuucuccagcaggaauuuuuuguuucaggcuugauggcuuuaaagguuuuuucuguaacagcaauauaucuucaaugaugaaauucuuccagacauucaugacauucucucuguugguguucucuuccauugaauugacagucccuucccuagaguaucgugucuaaugacccuuaaagguccuuaugacccccugaucuagaugcugaauuagagauauugugcuugggucaaguagacuauuuugacaucuucaguguugaacuccugggaucuggguggccaggggcauugucuaauaucaaaggaacuuuaaaaggcaguuccuuacugagaagguacuuccugacuuuacagacaaagcauggaaggaaccaauccagaaaaaggguuuuguuaucuagaugguuuuuuuuauuuuuugcuuuuuguuuuuguuuuguacaaccaaaagacuggcagcugguguuuauuuuuucccuuuaaggcucaaggguuaaaagcuuuguagauaagagcaguccugaucauaaacuugacugcaucugcacaaaacaguggauggaguuagccuauccuuuccugccauaaauccugugcuugcuucucuucuuuacuaauaucuuguggcauuuuuuucccaaaauagggcacuuucaucugcauuaaaaaaccuguucagugcuagacacaguggccuacaccugcacucccagcacuuugggaggccgagaugggagggucacgugagcccaggaauuugagaccagccugggcaacauagugagaccccaugucuauaaaaaauaagagcauuagcuguaugugguggcaugcaccuguggucucaguuuccaucucaggaggcugagaugagaggaucacuuuagcccaggagguugaggcugcagugauccaaggucaugccacagcacuucagccugggcaauagagugagauccugucucucgcucuauaaaaaacaaaacaaaaauaacaaaaacaaacaaacaaaccuguuuaggcagauaaccuuucuccugaaugauuuucuuaauggugucugggagcuccucugcugccucuugguuggcaguagcuguuucuucuguuuucuugacguuuuuaagccaaaccacuucuucagauuaucaaaccauucuccaacuggcauucuucaacuuuaaauccuuuuuuuuuuuuuuccuuuaaguuguuaauagaaguggugagagcagacauucuucccuuguuccugcucuuaggaagauacuauuuaggcuuucaccauuuccuuugauguuagcuuuaggucuuuuucauaugcuauuugcuauauuggcacaguucucuuuauuuccuguuugcugaguuuguaucaggaacagauuuuagauuuuauuuacuuuuuuauucuguggagaugaccaauuuuuguucauuuuuggucuguuaauacagugaauuauacugauugauuuuucuaauacuaaaccuuguauucuuaggauaaauaccacuugaucaugauguauuaucccuucuaacauuguauuugauuugcuaaaauuuuaagaauuuuuuauguucaugagguauauuugucuguaguuuucuuguaacaucugugucuuguuaucagaauaaugcuagccucaauugagaaguauucuuuucuuuuaguuuuucuacuuaagaguaguuuacauaccgcaauuacaguguuguaauauucuguuuuucuguguacuguuaccagugaguuuuauaccuucagaugauuucuuguugcugauuagcauccuuuuuuuuucugauugaaguacucccuuuagcauuucuuguaggacaggucugguguuaaugaaaucugucaguuuuuguuugucugggaaagucuugauuucuacuucaugucugagggauauuuuugcugaauauacuauucuagggcaaaaguucuuuuuccuuccucacuuuaugccuuuccccucuauccuggccuguaaggcucccacugaaaagucugcugucagauguauuagaucuccaguguauauuuuccuuucucuugcugcuuaaagagucuuuucuuuauccuugaccuuugggaguuuggaguauucaaugucuugagguagucuucuuuggguuaaaucugcugguguuuuauaaccuucuuguacuuggauauuaauaucuuucucuagguuuaggaaguucucugcuuaucccuuugaauacacuuucuaccccugucucuuucucuaccuccuuuuuaaggccaauaagucuuggauuuguccuuuggaggcuuuuuucuagaucuugcagaugugcuuguuuuuuuaauucuuuuuuugucuccucuguuuucaaauagcgugucuucaagcuaacucauucuuucuucugcuugaucaguuuugcuauuaagagacuccaaugugcucuucaguaugucuguugcauuuuucaacugcagaauuucugcuugauucuauuuaauuauuucagugucuuuguuaaauuuaucugauaggauucugaauuccuucucugaguuaucuugaauuuuuuuuaguuuccucaacacagcuauuuugaauucucuuucuaaaagaucacauaucuugguuucuccaggauuggccccuggugucuuuuuuauuuuguuuuauuuuuugagauagggucucacucugucacccaggcuggagugcaguggcaugaucucggcucacuguaaccucuaccuccuaggcuuagguaggugauccucccaccucagccucccacguagaugggaccacaggugcacaccacugcagcuggcuaauguuuguauuuuuuguagacacggcauuucaacacguugcccaagcuggucuugaauuccugggcucaaguagucuuccugucucagccucucaaaguguugggauuacuggugugagcaucgugcccagccuuggugucuuauuuaguuuguuugaugaggucauguuuccuuggauggucuugaugcuuauggauguuuguucaugucugggcauugaagaguuagguauuucuuguagucuuucuagucugggcuuguuuguauuugucuuucuugggaaggccuugcagauauucaaaaggacuuggauuuuguaaucuaagccauaccugcaguaaaggacaacccaaucccaguaacacuguaguucuaguagacuuguagagguacguccuugguggucuucaauaagauccaaaagaauucccuguaucauaggcagucucuuauucucuuccuuuacuuuuuccuaaagaaacaucauuucucucucuguucugagcugccuggagcugggggaggggugacacaagguccucuguugccacccguaccaggacugugcugggucagaccagaagccagcacagcacugggucuugcccaaggcccgcugugaccccuaccugguuacugccuauguuugcucaagacccuagguaucuguaaucagcagauggugaagccaaccaggcuuguguccuucccuucagguugaggaguuccucuagaccccagguggguccagagaugccaucugggagccagggacuggaguuagaaaccucagaaaucggcugggugugguggcucaagccuguaaucccagcacuuugggaggccaaggcgggcggauccccugagguugggaguucgagaccagccugaccaacauggagaaaccccgucucugcuaaaaguauaaaauuagccagguguggucgugcaagccuauaaucccagcuacucaggaagcugaggcaggagaaucgcuugaacccagaaggcagagguuguggucagccgagaucgugccguugcacuccagccugggcaauaagagcaaaacuccaccucaaaaaaaaaaaaaaaaaaaaagaaagaaagaagaaaaaaaaaagaaaccucagaaaucuuccugguguuuuauuuuacuguggcugagcugguacucaaaccaugaagcguggucuuucccaguccuuccuccccuuuccacaggcagaggagccucacgcauuggccaccaccacuacaggcccauggggaguacugucaggcuaccgcugauguucacuuaagaccugaggguucuucagucagcuuguggugagugcugccagaccuaggacucaccauucagggcagugggcuccuuucugccccagugcagguccagaaaugcuguccaagagccaaggccuagaaucagggacuccaagaguccacuuggugcucuaccccacuguggcugagcugguaccuaaggugaaagaccaaguccccuuuacucuucucucugcuuuucucaagcaggagucuuucacuguagcuaccacaacugggcaugcgcugguuuucacuugaagccagcacaugucagaguuucacccaggacucacagcauacuaccuggguuuugcugcugguuauucagggcccaagggcucuuuagucagcagauacuggauccugccugaacuggguucuucccuucaaggcagcugguuccuuucuggcccagggugugucuagaauauuaucugggagcuagggccuggaaugggugcuucacgauccuaacuggucuuauauccuaguguggcugagcugguauccaagaugcagguuagaguccucuucacucuuccuucucuccucaagcagaagacagggaucuuuuuuagagucacuagcugggguuaggggagggguggcacaagcacucccuuagcugcccuggcuggugucauaauagcuugcaugccccccaaguccacuggcuccaagccccacucagcccuacgacuuugccuaagaguugcaguccuuguggccuagacugccuuucagguuuauugagggcugcagaguacuucaucccaugguggggaggcuugccagaacucaaguucugacuguugggacaggcacuucccuucuggcuagggcugaucuaaauacucccuccauggucgggugucagcugaguucaaugcaaagucucacaaucacugugcuuuccaucccucaagcacacacauucucugcgccacacugccacuguggguggaugggggacguuggcaauucaagauugccuuuccuucagugccucuuucagugauaucuucagugccucuuucagacaucuucagugccucuuucagugauaugaaguuaaaaccagguacuuugagugcacaccugaguuuugguucuuauaaaggugcuuuuuuguguguagauaguugcuaaauuugguguuccugcugggugucaguggguggaguccuguucggcccucuugcucugccccuaucuugagaaguauucuuuucauuuuucugaaagaguuucuguaaaauauuuucuuccuucuguguuugguggaauuuaucagcaaagccaucuggguuuggaggcuuuauuauugggcauuuuaaacuauagauugaguuucuuuuagaaauauagggcuauuuaguuuauuucuuuaaugagauuugguaguuugugucuuucaaagaauguauucauuucauccaaguugaaauuuaauggcauaaaauuauuuauaauauuuucucauuauccuuuuaauauguguacaaucuguagugaugucaugucucuacuucccaacauugguaaauuugugucuucucccuuuuuuuuuucuuucuuuuuucuuuuuggccugucuuuuuuucugauugguuuggcuagaaguuuaucuucuuagagguaacagagccuuaauuuuauugauuuuucucaaagacccaauuuuugguuuaauggauuuuucuguauuguuuuuauuuucuauuuaauugagguacacucugaucuuauuuucuuucuucugcuuacuugagguucauuggccauuugcuuuacuuuaguuucuuaaggaggaagcugaagucacugauuuccuguuuccuuucuuuuuuuccuuuuacgagcauuuguugcuguguuucuuuuagcuguguaucacaaauuuugauauauuucucuuuauaagcaauuugauuaugauaugucuuaauguagcuuucugcucauuucucuugcugggaguucaugaagguucuuggagguguagguuuaugguuuucuucaaaacuggaaaaaauuuggcaauuaaucaaaaaaauuuugcucuuuaccuguuucuuagucuacuugaaguuaucccacaacuaacugaugcucucuguucauuuuuuccagacagagaaaagacuguaguuucuauuaccguuuucuucaaguucacuaaucuuuucuggugucugaucugcucuuauucuauccauuguaguuuaaucucaguuauuuuaguuuucauguauuaauaugauuuggguuuuuuucguaguccguguuucuauuuaacuggcuuagucuucacuucuugcacauauguaauguaguuaucauagcuaguuuaauguuucuacuaauucuguuuuugaaucuguuuuauugauuuuucuucuuaccuuauagguuguauuuucuuacuuuuuuacaugauuauuaauuucuauuguauuucagacauugugaauucuacuuugugcccuggauauuuuuguauuccuguuaguauucuagggcuuuuuucuguggugcagugaaauuacuucagaaacagauucuuguauuuauuuguuuuuucugagacagggucacacuccugucauccaggccggagugcaguauugccaucuuggcucacuguagccucaaccucuccugcucaagcgaaaugcccaccuaagcuccccaagcagcugagacuacaggcacgggccaccaugccuggcuuuuuuuuuguauuuucuuguagagauggguuucgccgugucacccaggcuggucucaaacuccucagcucaagcgcuccacuugccugggccucccaaagugcuaggauuacaggcaugaaccacagcgccuggccuugcagguauuauuucgaagcucaguuaggugggaacagagcagcugguagccuacagcuaauuuuccccaauacuaagacaguauucuucugaguauucuaccuggugucucuuaaauuaugaaguuuuccagucuggccgaugagagcaugaacuauucccaacccuuagaaaucuuugguaauuguucucucucuuccuuucuggugacucugcucuaggccuuguguguuuccucacaaggauauggggauugguauugagcugaaauuuugagaugaagaugggacaccccccuccccuuccugucuguauaguugucucuguuuugguacucuguccuacgaauucuagcuuucuucauuuuccuguauucuuagcuucaucaucucaacuuagggugaccaucaggcuccaucuggguucccuugcccugcacugaggccuggaaacugucucuagaauauaagccgggacaauuguaaaacucuguaggauuuuauuuuucuuuuuuaaggaaucacuguagcacacuacagugauucuuguauuuauuuguuuuuucugagacagggucacacuccugucucagaacuaaccgauauuucaugucuaaagacuaaguguuauauguuuuguucauuuuuaaagcuuuucuuuuaggugaaaggguauagcugcuuucugcuacuguauuuuggccauauaccuuucuuuuggaagcugaaaauuacuguauuacucauuaguuaaagaggaaauuacagugaaaauuauacaauaucuauuuugaugaaaaacaauuaaagcuauagauauaaauaaagcaggacuuccagucauaauuuauaauaauaaauucacuuauuaaaaaauaaaaaauaaaaugauuagauaugaacaccaaggaauuaaaaaaagagcagaguaaacucauaggcacuggaaauguaaauaauaaggaggaacaggaacuaaaugaaggggaagaaagagaggggggaacaauaaaaccuaagcucaacauuugacaagauauguaaaaaagaaaaaccugguaagaacacccaagaaauaaaagagaaggcauaaauauuauuuguuaauuauuguugcaaauauaaagagcauaccuacuaauuuagcaguacuuuaaaauauuaugagcaacuuaugcuaauaaaugugaaagcuucgaugcaaggaugguagagucaagacuggagacuguaguauuccagagaagagauuaugguggccugaacucuagggcacuaguaauagaaacagagaaguuaaaaacauacaacagacauuuauaauucugugaauggagggauggggaggguuaagguguuggguuauagcguucucccuugggcaguugcgagauguugggugguaucacuacaccuaaaguauagcaggguuuuuggggggauuaauuugagguacauggaugucgguagcauugucuaguugguuauaugggucugagcuuugagcuuacugaagucuggggaaauugucuuauaaacuuaccaacuuguuuuucuuuuugugagcaugccuuuaaauguuuccagaaauauaaaauauccucuuuuuaaaccacauuaaacccucccccauauaaauauuauguaccuggcuagaucuuaguuagauaugagaacaaagauccuacuuacagcagucucuuguaauaaacacuaaaauguaugcuuguaacaggagcccuuaacuuuuuggcauaguuucuguguaagaacucagauuucucugagugauauggcugugacuuagauucugauucucuaaaagucauugccaggcuugucugacccugcugcuagguagcuaggcagucuucacuaaaauaucgccucaaauccuugcauuuaacuacuuaaguuccuaaaauacuugaaaaucagcuguacucauuuaugugacugaggugcuacauguagacuuuugucuuccucuuggcuugaacaaaacuccaggucaccucaaagauggaaaugagaugguucccauguguuuuuauuuuguuaaagagaugugauguauauuggaaauggccuuuccucugaggcuuucauucuuugacuggauugaaggcugcugcgcacuaccuuaagccuaccaguuuuagcauaauccuagccugaccugcacugaacuggcuguuauuaaaaaccuugucugugucaucugaaguauucacugccugucacaagugguacucuucuugcaggcuucuuagugacauauaaauuacaacuauagcuugaacaagguaaacaauguggcuuuuuguuacauaguacaacauacguuuucaaagcauaguacguucuuuaguuuuaauugauagauugggaauuucgugugagcagguugauaagugugauugcauuucugauguuuauguuucacagaauucuuuuuuuuuuuuuuuuuuuuaacgagacagagucuugcuuugucucaggcuggagugcaauggcaugaucucagcucacugcagcuuccaccuccuggguucaagcgauucuccugccucagccucccgaguagcuggagcuauaggugugcaccaccacaccuggcuaauuuucauauuuuuugguagugacaggguuucgccauguuggccaggcuggucuugaacucuugaccucaagugauccacccaccucagccucccaaagugcugggauuauaggcaugagccaaugccuggccaauuauuaucaucaucauuauuauuauuauuauuauuauuauuauuauuuuaauuauuccugaaaccaucaaaggaaaggcuuacaccauggcuuaguaaauuuuuggggccaaauauuaaccaugccaccaauuucuuaucuuuuuauuucaaauuuaauuuauaauuuuaauaaagaaugcguuuauuuacguuucaaaaugcaaagugcuauuuuaaaaaguauccccugagaagucuuguuucccacccauccccaucugucccuucuccuuaguucauuuuauguauuacuaacuguauuuuuauuaauuuuuguuaauuucuguuuauuccuuuagacuuuaugcaaaaggcuaauucacacuaauacuuugcacccugguuucuuuauuuuuauuccauggagcucucucguuauaucagucaguauauaaagaccuuccuuaucuuuuuuuuucuuuuuuuacuauauaguauucguuuguugguauaugcuguaguuaauucagccaguccuuuugcacuugaauuuguucagucuuuugcuauuaacaggcaauuucauacugauuaagcuuguacauguguauuucuuauguauguagguuucgugaugguuucguuuccuagaaggguguuugcuaggugaaaggguacaugcgucuguaauuuugauugauauuauuggauucccuguauauauaucuugcauuuugcauuucagcagcaauauaugaggguccuuggaaugcccccccuuucccuacagcuugacaagugguuggacuuaaaucagauuuugccaaucugauaagaaacacuaucucacuguauauuuuuuguuugcauuucuguuuucagcuuaucauauauucaagggccauuuguauuucuuuucuuuuucacauacuuguccauuuuuucauuggauuaucuccucuguuucuaagaauucuuuauauggguguauuuccggacuuuguauuuugucccacuggucugucuauucauuugccacucguauacuuuuaguucuugaggccauauaaaguuauauuguuagagcuguuuucucauugcucuucauuuucagaguuuuccuggcaauuacugcuuguuuauuuuucaauaagaucuuuagaaucagccuuucuaguuccuggaggaaaaaaauugauacuuuuauuggguuuguaugaauuuuaauaucuuaagaagaguugauaccuuuaugauguuuagccucucuaagaauaugauuauaacuuucucuucauucaauucuacuuucauuucuuuaaagguuuuugaaguuuucuuuaaguuugcacauuugugauuaagugaaaauauacaaauauuuaguugcuauuggaaaugaagucuuuauuuuugcuguuguuuguauuauaauauguuguauauaugaagauuauugaucuuuguauauucuuuucauagguuacuaucuuacugaauucucuuauguuuguagucacuaauucuuaauauuguuuuaaagcacauuuuauggaguuggugaguacuauauaggauuuuuuuuuaguaccaaagucuugguugagagacauuacacuauccauuuuuacugguuuagauauguagcaugaugaaccucagcaaguuuaaaaagaaucauuucuuuauuuugacuugaaauuucaaguuuuuaaauugaugaaaaguugucauuuauuguggcaggggugaugugaaauccagccacuuauugguauguguuacaacuuagcuaaguccaguaauagucaguacauacuacuaaaugauucaaaagcaaauggucuuuuagaucaaguaauagaucucuuaaauugagauguauuuaccuuagauaguaagaaugacucuuuggucucuuauaagaggugaagagagaugcuguuucugggcuaguauuuuugcuaaaaugguuuuaugaaaaacuuucauaaguuaaaaauuuggggcugggcgcgguggcucacgucuguaaucccagcacuuugggaggccgaggcgggcggaucacaaggucaggagaucgagaccauccugauuaacagggugaaaccccgucuguacuaaaaauacgaaaaauuagccgggcguaguggcgggcgccuguagucccagcuacuugggaggcugaggcaggagaauggcgugaacccaggaggcggagcuugcaaugagccaagccauugcacuccagccugggcgacaaagugagacucugcuuaaaaaaaaaaaaaaaaaaaauugggggcuugaaguuaaagcacauugucuugaguaaaagauauugguagaaguucagaaauguaaacugaauugucuuuuaucuuauuuuaccuaaguggacuauggaauauuaagcuauugguauacaaauacuuguaggccgggugcaguggcucaccuauaaucccaacacuucaugaggucgaggugggaggaucacuugaggucaggaguuugagaccagccugagcaacaucgugagaccccauuucuacauuaaaaaauuuaaaaauuagccaggugugguggugcaugccuguaguuccaacugcuccggaguccgaggcaggaagauuguuugagcccaggaguuaagaggcugcagugagcuaugaugaugccacuacauuccagcuggugcaacagagugagaucuugucucaaaacaaacagacaaacaaaaaaccccaaaaaccaaaccuguauuucccuuccccuuuuccugauauuuuaauauuuaaguauacauauauucuacauaaugaauacuguaucuaucauccugaacuuuuuaacagcucuagucuuuuguauacugaagcuuucaggcuucaaauaaagcauacauaucaaaauauuuugaagaguaauugaaaucucaguuucucccccuccuuuuaacuaaacagauggaaagaauuauuugauaguguuuuccagagcccuuuauaauguagcauauuugagugucugauucuuugaauaaugagugugagaaaauugaaaauugaaauguagagcgcuauaguagguuuuaguaaacaaaguuuuguuaugucacaguaaaugguaauggauaaauaggauaacaggagugucuuauauuugggaaauuacauucaucccaaaagaacaaaagcaguaagcaggaagacaaauuagcuuacccuaauagugagaaagggagcugauaguuuagccucaugaggucaaauuauguaauuucucuauuguauaacagaagaguuucagaagcauuccauuuucuuuuucagauuaaaaagccagcauuaucagauaguggaaaagcuuauuaauacuugcuguguagccugaauaaaaccauuauuuuaaaaauguguguguguguguguguguguguguguguauguguacgugcauguagguuguuugguaaaauccacuuuuuauguacuugcuuagauuugucagcagcaagcuauguugcuaaauuucuuugguaauuuuuauacaacagagcccuuugcagguggguuuauugcacauugcaauauuaguacuucauuauguguugguguuauuucuugagugggaacaauggcauucaucucuuuuuuuuaauuaaacuggauauuagaaugcuggaagguuguuuaauuucaucaguguauaucugaacuaguauuuuaucuggucuuaaaaauaauugcugucauaguggaaucauucucuuguuccauuuuuguuucagauguuaagaguuacauugugauuuuccuauuucuggaagaauaauuagagucugauggauucaaauuccuucugaugcacaggaaagccccuuuccaggccagucucaagaaacuuugggaggaggauauagcacugacaaagggugauagaaacuaguuauuaucaaagaucuaguugcugccaggcguuuuucuguuuagucguauccuuggcaucauaaccacauucugccuaucuuauucccugaaguugcccucuucguuucuccauaaucugguguuacauuucuuucuccuguccgucuggccaagcucuuuuauaacuuauuugugaauaugcuguuuugauacuuggcugacugagugagcucagguccgucucuguggagaggaauggcccuccuccacuaucaccccuuccuuugaggacuguucuagacaccucuggauuaaaagcacaacagaaaacauagcuauuuauucuuggaaauaauuaccuaagcaaaaaauaauguggcucuugugaguuuuuguucuggagaaccacaaucuagaaaaccugggauaaaguagaauuuuuaaccauuucucuccauucccauuaaaugaccuuaguucaagcuguccucauuucaggcuugcuguagugcaacguguccuuagaaguuguucugccuuucccuggcuccuccuuuauguuucucccaagauuacuauaaugcaauugaaguaaauauccagcaguaacagaagcaaaugagauguuguugaaggguauugggaacaggagaaaagugaaaacagugguauucauauuggccauucucucguaguaggcagauuuuuagcaagaggaguaaugguagaaaaauuuuuauaaagcauaacaaaaguuucuaauauugcuaggugugcuuuguaagaguaauguucaaagccuugauggagcuuaguuauaaauuaauuuaauuuacuuugaaauuuuaugucaugagaaagcauauguaugucguucucauuucacugauuuuaaugaaagauauacaacugacccuugaacaacacaggcuugaacuugaacuacacauguccacauaugcagauuuuuuuuaaccaaacucaguauuuguguaaugugaaacccauauauauauggcugacuuuucauauacacagguucugcaggggcugcuaugggacuugagcaaguguggauuuugguacacucaaggguccuggaaccagucuccugcauauaccaaaggucaagugcagauccagcccucaaauaauaggcacaaauucuagaaauugguucauucaccccagauuuaaacauaagugaucuuaaaaaaugaaguuuguugcucgcuuugggagcacauauacuaaaauuggaaugauacagagaagauuagcaugggcccugcgcaaaaaauauuuuaaaaaauuaaaauuuuaaaaaaugaaguuugcuauacauagcuuuuuuuaaaaaauggauggauuguaaugacuucagguaaaaacgggauucugaaauggauagguucuaaguuuuaugacugauacguuugaaaaguauauucucuuguaaaauggaaauuaucuuaaguaaaaggcuucuaaggagauagauuuuauuggguagaauauguuguguuuuuauaauguacuuaaucuggacuaccaucagcuguguaaacauucuguuuauuuuacacauuugccaccaguuuguacauuuuuguguuucauucucuacauucacaggugaaguccucaguaauuuaaugaaaacauuuucuaaugagcucacuuaaucaguuucuccaacucaaaacaaauuggagguagggaugcuguacacacagucaguaagaaauaaccacuaacagccugaugagagagaaggagaaaaccaaaaugccucaaauuaaguaagcagaacaguccagauuuacuuagagaagugguucuuaaccuuauggacaccuggcuuaguccccuuuauucuguuauaauggaauaccugagacuggguaauuuauaaagaucaaagauuuauuuggcucacaguuuuggaggcuggaaaguccaagagcauggcgauggcauccaguuagggucuuuguacugugucaucccauggcagaaaguggaagaguaagggcgaaagaucaagagagcagaagggagccaaacucacuuuuauaaccaacucagucucaagauaaacaaccuacuuccucagaaaugacauuaauucauuuucuggccuuaugacccaaucaccccaccugccaauacuauuacauuggggauucaguuuccaacacauaagcuuugagggacccauucagaccauagugacagcuaauggagucuguaaacauuuuucucagcaagaaguauaaaacauauaucaguuuguauucagugucaggaauucuugggcucacugaagcccagccuugggccccaggcuaaaaauaugauuuaguauaggggcaaauagcuuuaugugucuaauuuaagagcgucacuuugggaugcuuuauagauaauuuauauaauaggcaauauugaguuagcagaaaauguuaaauuuuguaucacacgcuuaauaaacauacaauguuucuuuuuugaauuaaaaaauaugcauuuuucacuuaacauuuaucccauuaucuggaaaacuuagucuucauuccccagggauacggguuagagaagugauauucugcauuugcauuaaauaagcuucacuguaauuuuuuuuuuuuuuuuuuuuuugaguaggagugucguucuguugccaggcuggaguggaguggugcaaucucagcucacugcaaccuccaccucccggguucaagcgauucuccuaccacagccucccgaguagcugggacuacaggcgcgcgcuaccuaccaugcccagcuaauuuuuguauuuuuaguagagauggaguuucaccguguuggccaggauggucuccaucucuugaccucgugaucugccugccucggccucccaaagugcuaggauuacagaugugagccaccgcgccuggcccauuuucacauuuuaaucagugauguccaggagacuuuuuguaccagcgagauuacgagcaucuccucccaacuccaugugcagaaaugccagguugguagguugugaucugccuuggugggaguguuuacaccacgaaaauguuagaaaucaaugcucauucugccuucauucccccaagcuguuuuuuuaaacauuuaccagcacacaacugauuuuaauuacucauucagcaaacauauuuugagcaccuguugucuuccaggcacuguucaaggugccaaggauauaguagugaauagacaguguuuacuuaagugaauguauuuuucuaaauccuaaauuuucuauuaaauuggggagcuuuuagggguccuuagucaaauaauggugggagaugaagaaucaaacaaaaguaaaugguuuucuuugccacagaacuuucagaaucuuuuaaugugcuggugugcacaguugaucucuaggaggagaguauaguauauauucuuucuuucuuucuuuuuuuuuuuuuuuuuuuuuuugagauggagucuugcucugucgcucaggccagagugcaguggcacaaucucggcucacugcaagcucugccgccuggguucacgccauucuccugccucagccucccgaguagcugagacuacaggcacccgccaccacgcccggcuaauuuuuguguguuuuuuuuaguagagacgggguuucacuguguuagccaggauggucuugaucuccugaccucgugauccgccugccuuggccucccaaagugcugggauuacaggcuugagccaccgcgcccggccuauaguauguauuauuucuaauacuuaaccaauaacucuuuuuuuuccagaauauauuuaacauguuucagaaguacuauucugcugcuccaggcagucauauugcagauguuagaaauuggugaauaaggucauuacucaagagauguaugucggucagaauaugggcaggauuucugaagacagacuuucccaucguguuuauagggcgauugauuuuuagguuguggauugaguuacuuuauugauguuuuccugaacuauccuguuguauuuucauuuccaguauuuuuuuuuuuuuaauuuuuauguaaagcacugcucuacuuauauguuguuaaucuuagaaaagugcuuuuucuucugaucuccaguuucugauuuggggacacuuaaugauauacguacaugaauuucugccaccacuuacucccuguugcuagacuuuuucucagcccugggcaucccuuccuccagugccucuugcugaaaugggagucucuuaaaccccauucaucugccauuucacgcuuauuagacuaugguguuucucaagugugagugauaggcuauugauugaaucagucacuugaguaguauuaaaaccauagguuccuggggcucaccucagaucugcugauucagagucugcgugguguggaagccaagacucugugauuuaaagcagaucuacaagugguuuguauugaguuguuuaauuuccaugcugaguuguuuaaauuucauuuuuugguagguguauaccguauuucucaguguaggugcuacuggcauuuuggccaggauuaucguguggcaaucugaaggcacaacaggacuuuaaaaaucauuggguccuaccuaccaaauacuauuaucauccccaguuauugagacaacccaaaauguaaaugucccuccacauuuccaaacaccuccuuuccauuuuuaugggguuaguauccucaauuaagaaucacuguuauauacuacuuucauuauuuuagauguugaucguaauaauuuaauauacauaccuaaccuaagaccccaaauuauucacuaacucuguccacuucgcaaacuguauaaagucuucagagcaauuuaauuguacuuccaccuuccuauuuccaugguauuuugcuccauauuugaguucuaguuuuuuaaaaauugcauagacauuauuguuuuuuuacagucaucaauguuuaucucuacccaagauugguaguuuauuugauacuccuugcaucuuaaacuuucuuucugagccuuuuuugauccugaaauacauccuuuagaagaauauguuauugcacaucuuuuggcagugagcccuugguguuuguuagaaagugucuuuauuuugcccuauuuuauugaauaauguuuuaccugagaauauaauucuagacugacuuaacuuuuuuucagcacugcauuuucuacagucuuucuggcuuucuuuuuucucugaaaagucuaauuguuguucuuuuguggauaaucugacuccuuuucucugagugcuuuuaaagaucacuucuuuuucuuuaguuuuuuugcaguuucauguagugugucuagauguggauuucuuguuuauuugcucuccuugagacugugucuucugaaucugagguuuugucuuuuacccauucuggaaaaauuucagccauggugucuugaaauauugguucucucuuccuuccuuguuuaauuagauguauauuuucuuauucuauucuuugugucucuuaaucucucauuuucuaucucuugcucucuuugcugcuucagaucugccauuuugucuaauuuuaugucuguguacaccaguuagguuuuuaauuucguuuuuuauuucuagaaauucuauuuuguucuuuuuguccugucugccaagucauuuuuguuagccucuugcuucugacccauguauuuauuuauuucuaguguuaacuuuuaaaaaaucuguccuauguauuuaauaccuucuuuuauuucuuuaaacuuuuaaagcguacuugauuguaauguuauauaucuuuuaauuccuaaaauuuaacuucuauggauuugauuugguuuuucauaguuuuuacugcucuggugguuuguuuccuuuuaugcuugauaauuuuguuuuaagcucauaucugccuaauaauauuaugugguaauuuccuggaguauggguugaagauguguuuaucuacagauaauuuguuucucccucugccaggugccuuguguuaccaccaacccagaaacaacuuaaauuuauuucuugacuugaggcuccuggcccucaaaaucaguguaaauuuuaacccuaugcucuacuggggacagacuugugauuauggauuuccagggaagauauuuugauucuagugaaggccugauuugaacaaauugccuguuguggauagagcccuuuuccccaaccuaccugugcggugugacucuucaagggcauugcugguuuuaugcaguggucccaauuucagcuuucaccacaucuaauaaaaaucaaaacugaagucccuagauuccaaguuuaaucuaaggccauggcuugagcuuuuguuuacagcucugauuuuauucaguaaauacauuuaacagauuuuuuaaagcuguuuauacuacaucucuuugugccaccugugaauuuauuugcuugugaguucagugcacguaaaagaguguuuguuguaucuugucugcuauuucuagauauuuguaauggaaggauauuuuauaucuagucuaacuuauuuccaaaagugaaaucuuggaagguguuuacgcacauuggggucugagcaccuuugggcuagaaaugcugcugcuauugcuucuauagugcaaaguuggaauugguuaccugaucucuuaugcuuucccaaacucagugcuacuguuaaguuuuauccauauuauuaguguggucugccaguuaccauuuagaaguguuauugauauggaacagguccauuuuugaauuccaaaauucagaauuaaacuuugaaauacaaauuacugauauguuggaacugucuguacucuuuuaucacucacagauuauuuuccaugucuauauccaauuauuaucugcuaagugcauuuuuugaaaguuaaugauagccucaaucuguuuuuaaaauuuuuuuuuauuaggaccagguaguccuagaaauguagaucuuuaauuaucugguuuuaagaaacaaagagccauucaaguuaacuuaagaaaagagaggcuauuguaaagauacaugauacacggaacuggaagcuugucaggaacucaaggcagcuuggagaucugcucuuuucuuauggucuuguaauuuuuucuguccaucuguuggguuauuugcucuuuauugauugucucuucauugcgucuuuucuauuucuucaaaacuucacuuuaugcccaaaguccugcaugcugugacacuggcacauagcaugguuucacagugaguuacauugcaugguggugcuauuucucaguauuuccaguuucaaacauuuuagaguugugcugucuaaugcaguuaucacuagccacgugugacuuuuaaaaucaaaauugaaauuacguauaggaucuguaugcugauaacugcaaagcacugaugaaagauaucaauaucuaaauaaacagagacaccugccaguaguguucauggauuggaagacuccacauaguaaauaugucaguucuuuccaaauugaucuauagauuuaauguacuuccaaauaaaagucccaacagcagauuuuuuuuuuuaaacagacaagcuggcucaaauuuauauggaaaggcaaaggaccuuuguugccaaagcaacuuugaaaaaguaaaaguuggaggaaucacaaaauuauugugauuguaaauuuaaaauuuacuauaaaacuacaauaaucggccgggcguggugguggcucauaccugucaucccagcacuuugggaggccaagguggguagaucacuugaggucaggaguuggcgaugagccuggccaacauggcaaaacuccaucuguacugaaaauacaaaaauuagcuaggcgugguggcacaccugcagucccaccuacucaagaggcugaggcaggagaaucauuugaacccagaaggcagagguugcagcgagcugagauuguaucacugcacuccagccugggcaacagagugagacuccgucucaaaaaaaaaaaaagaacaacaaaaaaaauuacacuaaucaagacuguauaguguagguaagagauaaacacacaaucacuagaucaauauagaucaacaugggguccagaaauagauccacacaaauauagccaauucauuuuugacaaagguggaagucaguucaaugaaaggaaaauugacuuuuccacaaaugauaagaaagaguuggacauauacaugcaaaaaaauguaccuaaacuuaaacuguacaccuuacacaaaaaugaucucaaaauguaucaugaaacuaaauguaaaaacauaaaacuuuuagaagaaaacacaggagaaaauauuugugaccuggaguuaagcaaaaagaucuuggaugugauaccaaaagcacaauucauaaaagaaacuauugauaaauuggacuuuaucaaaaauaaaaacuuuugcucuguauauuuguuuggcaaggcugccauaacaaaaugccacagacuggguggcuucaacaguagaaauuuauuuucucauaguucuggaggcuggaaguccaaaguuaaggugccagcaggguugguuucuccugaagcuucucuccuuggcuugcagauggccuccuucuuggugcaucuucacauggccuuuucacugugcauguauaucucugguaucucuuccuuuucuuaaagggacaucagucuuguuggauuagggccaacccauauaacuuauuuaaccuuaauuaccucuucaaaugcccuuccucugaauauagucauguucuaaagugcuggggguugggacuucaacauaugaauuugguagggagcacaauucaauucauaaauucugcaaaaaacacuguuaacaagaaugaagaauaaguuacagacuggaagaaaacauuuggcugggugcaguggcucaugccuguaaucccagcacuuugggaggccaagacggguggaucaccugacgucaggaguuugagaccagccugaccaacauggugaaaccucaucucuacuaaaaauacaaaaaaauuagccgggugugguggcaguugcuuguaaucuuagcuacuugggaggcugaggcuggagaaucgcuugaacccgggaggcggagguugcaaugagccaagauugcgccauugcacccuagccugggcgauaagagugaaacuucgucucaaaaaaaaaaaaaaauugcaaaucauauaucugacaaaggacucauauauagaauauauauauauauauauauauauauauauauauauauauaugaagaacgcucauaacucaguaagaaaauaaauauuccaguuaaaaacauggaugaaagacuggaaaacaguucaucaaaggauggcagguaagcacaugaauagacuaagagcaucauuagucaucaaggaaaugcaaacuaaaaccaccaugaaauagcauuuaccuaccuauuaggauggcugaaauaaaaaauacaaugccagcucuuggcaaggaugugaagcaaguggaaccccaccaugcguugcuucugggaaugaaaaaugguacagucacucuggaaaguugggcaauuucuuauaagguuaaacauauaccuaccauaugauaugaccuagucacacuccuggguauuuaucuacccuguauacaaauguuuauagcagcucuuuccguauuugccaaaaacugaaaacaacccagauacccuucaacugguaaauggaugaacugugguaaauccauacaguggaacccuacucagcaauaaaaaggaauaaacuaaugauauaugcaacaacuuggugaaagaagagucuaaagauguuauauaaugaaugaauuuauauggcauucucaaaaagaaaaacuguagucauagagaacacguuaguguuuccaggguuuagggaggauuaugacuuccauuggaguuuuugcagugauggaacuuucuuauuuccugauggugguggugguggugguuacauaaucuaauauauguguuaaaauuacuagaacuguaucuuuaaaaauccauuuuauugucugguaguuaaaaaaauuaaaaacuccaaauuuuaaauauuucauuuuguacacacguacaauuaaacaaaauucaguuuuucacuugcacuggccacauuuuaagugaucaauaggcacaugugguauggggcuaauguauuggauauugcagauacagaucauuuccaucaaugcagaaaguucuuuuggacaaugcuggguuuucuuuguuuuguugcuguuguuguuuugagauggaguuuugcucuuguuacccaggcuggagcgcaguggcgcaaucucagcucacugcaacuuccgccucccggguucaagcgauucuccugucccagccucucgaguagcugggauuacaggcacaugccacugcgcccagcuaauuuuuguauuuuuaguagagaugguguuucaucauauuggucaggcuggucuugaacuccugaccucaggugauccgccuaccucggccucccaaagugcugagguuacaggcaugagccacgacgcccggcuugagccaccaugcccggccgacagugcuguuuuaaagcaaggaucagcaaguugucgauaaagggucagauaguaauacuucaggcuuugugagccauauggccucugucuuagcuacucaacucugccauugaauuuuuuuuuuuuuuuuaauacuggucuuacucuguugcccaggcuugaggacaauggugugaucauagcucacugcagccuugaucucuugggcucaauugauccuccucccaccucagccucuuggguaacugggacuauaggcacaugcuaccaagaccaagcccagcuaauuuuuguauuuuuuguagagacaggguuucaccauguuucccaggcuggucuugaacuccugggcucaagcgaucugcccacuuuugccucgcaaagugcuggaauuacagacaugagccauguacauguggcuauguaccaguaaaacuuuuauuuacaaaaauagacauguuugcugaucccuauuuuagagaauuugcccuguuuccuauuuucaugucagcucaggguuuauugguauauuaaccuuauaauuuaucauccaaauuuaauaaauguucaguuguuuaagagugaacacaggcacucuuauuguacugguagaauuauuaauaauucuaccgguacaauaggcauaaccaggaguacucuggguaaaccagggauguaugucacucuguuaguuuuccuaugaauugguugcccuuguaguggacacauaccuagugacaugauuuggcuguuuccccacccaaauuucaucuuuaauuguaguucucauaauccccacauguuguagaggaaccugguggagguaauugaaucauggcggugauuaccgucuugcucuucucaugauagugaguucucaugagaucugaugguuuuauaaggggcuuccccucuuuugcuuggcacuuuucauuccuguugccacgugaaggaggacauguuugcuuccccuuuugccuugcuuguaaguuuccugaggcuucccaacccugcggaauugugagucaauuaaaccuuuuuccuuuauaaauuaccgagucgcaggcaauuccuuaaagcagcaugagaacaaacuaauacaccuagucuaaucaacuuugggaaagcgaacaugaagccaucccuucagcagugagcauggguuauccauuuucuucugaaagggaguaguuguaugggaaguacucugagguuuggcuggccugguacacucaaaauagucuguguuuucuguccccaagccuuugcucaugcuuuucguucugugcccuuuuccccaucccuuuuguauguuuuuccuaauucaggccaucuuuucaaaccucugcauaaaugguaacaucuucaugccaucauuccuguaauaccuuuucaggcuuauaaguuggugguuacauuuucuaaaagucaguaacauagugcuuuaaacuggguccccaaaccugacuguguaucagcaguaccucaguagcuuaagauacagaauccugggucccauucuuaaucgcuugaccuagaauucaaaauuuguagcaguauuuuguuauuguuuuguuuuguauuuaaacucuuuauaugauuuuuauauaaccaacuagcugguucaguauuuggaaucuguugauuuagaaugaaauuauuugauauaaacauugacuuuuagaauuagaaggaaccuuagaaauagccugucuucaccuucauguuauuaaauugugggcagaggggucaggaagaagacacaagggaaauuacuugcucagaucccauugcugguuacuggcagagccaggacuaaacguuguuaacucucacucagaacuuguauucauauucacaucggacaugcccuucuacauaguaagguuugaguacuccaaggggcucaauacauaguagaugauggucagauguuuuacugauaaugacuguuucuaacccacuuuauauuguaccuagcacauuuuuuggcucuuaaugauugcugcuugaauauguuguuaacccucaguucacucucaaggaaugccuuucugauaguuggagauaauuccacaaucugcgugaaaucaucucagaaaaauucuuuccaaaacuaguucaaaucugaauggccucugaaaggcucacugaaucaaacuaaauucugguacagcuuugaaaguuaguacuuucccagagccccucuaagccgagaucggucuagaccugcaggauuuuccucaccaguccacuuccauuuuagaaagguuacccagaaccuaugggaguauguggugggggacguguauacugaaauaaggugugagaccagggccaggaaaaggcuugugggaaguggugguagccuaagcugagcuucgaaggaugucuguuaggccaggggagggagcuggaacaaagcguggauggcucuggggaauagcagguuguuuaguuuggccagaggauaaaguacagguuagggagugacuagaaauauagaugggggccagauuaaaaugugguauuucacaauuucauauccauaggcaaaagaaugaaacugaagcccuaucugacacaguauaaaaauucacucagauuauagacguaaauuuaagaaaacuauaaaacuuagaaaucuuagaaaaaaaaaucauaggaaaaaaguauuugugaccuuggguuaggcaaaugguuucuuagcugcaacacuaaaaacacaagaaacaaaaauuaguuaaguuggacaucaucaaaaugaaaagguuuuguguuucaaaggauacccauaagaaaaugaaagcauguagaaugggagaaaauacuugcaaaucaugugacugauaagggauuuauauccagaauauaugugaagaacucuuacaauuaacaauuuaaaaagaauuuaaaauggacaaagaauugaauagacaguucuccaaagaagauauucaaauggaaaauugaaaacagguccacacaaaaauguguacacugauguuuauagcaccauuauucauaacagcuaaaaaguagaaacagcccaaauaugguauuuccauacaauggaauacuauuuggcaguaacacauaaaugaguuugagacauggaugagucugaaagcauuacaccaagugcaagaaaccagagucacaaaggaccauguguuauuugaucccauuuacaugaaauauuuauaauagucaaauccauagagauggaaaguagauuagugguugccagggauugagagucagaggaauauggagugacugcgaaugggucugggguuucuuuuugaggugaugaaaguguucuaaaauuaguuaguauaguuacauaacucugaauauacuaaacacaacugaaucauacaccaugaaaggguguacuucaugguauguggauucuaucccaauaaagcuguuauaaaaagugcuguauuuagugaaagcuuuaaauacucugacagggaauuuggauuuuugucuuuaaagcaaugauguguuguacccuugcagaguuauaagucaagaacagcaugaugagaacaucauugugggagcauuugaagaaugguggucagaucaguguugcagcagacuagaucuagcugcuuagaauauuuuauccuguuuucugcccuucacaaguaugaacauuuuauguuacauauucugaauucaaaauuuuuaacuuuauacgugcuaauauuuuauaauuucuaucuugcucuccuuuuuaaaaaauaaacugcucaaggugauugaaaaaaagaauagcaguugcagaauguuagagauaauauugacuuuuaaauuuaccuuuguguguaaccuugacuacagucaauuuagagauagcaaaauaugacuuauuuuaggcagaagaccaagauuccuggugaaucauaaagcuuuaaagacccuuuauuaauaaacauggauuuuacuaaggaaaggcuuagaagugaaguuucuuaaggacuuucaauugucuguuuuccccuuuuugugaaauaucuuaauacugccaaauaaauuacauauuggaagauauuucuaacaucauagaaagcaaaagaacaguaaucauuuuagcucuauguuuuuuucaguuaacccuaaaaaacuguaauuuaaaaacuguuagccuuuaggaaauucuagacugauuuaccacuugaaauaauuguauucauaagucaacccuauaggaaauauugaccuugguaaaccacucaucaguaguuagugucauaauuuuucuguuaaauauaugcugguguuaguaaaucuauuuuuagaagaguacauuguguacagcaaccauuuuggacaaacacuguguaacuuguaaauagagagugugcccuccuguggucauugguaacaaaaaucucaguuauaaucauccuagcuuucugaguucacauuugucugcucuuccauaguagaaucacccauacucugaauuucuucucaguaaguaaaaaaccauagcaugauuuuuaaaugguggcaguugucuuauuuggaggagaugcuaaaggagaauccuaccagagaaaagauaucaaagugugaggagaggcaaguaguugugauggugcuugaaaagcuuuaugacuauuacaccugaauguuuuucagauacacucugccuccuuuacagaaugcucccagaaugauauucugguuuuauuucuauuucaucauuuauauauguuuucuuccuagagaaaggaacuaguauccagcacugucuauuugaaacaucuaucccauuuuauggaaauuaaguuuaauuugaaauaagucuucaaaucucuuuuguacugccuugaguguuuauuaguuauggggauuuuguuugaaggaacaauuuuuaaaugaauuuucccugcaaauuuuauuaauuucuaugagaucucuuaauaucuuuguucuucuuagaguuaaaugguuaaauuuuauauuuucagcaaugacggugccucauaucuuagaucuuuggcugguauuuuuagugcccuaguauucuuagaagaauuccacuguuaaugguguuaccaucucuugccaggugauucacugauuuucaccaauccauuaauaagagaguguugcaacuaggaauaaaucuggucacaugaauggaucuuucugugaucagggaauggcauguauuguucuucauuggugguaugaauauuauuuguaguuaacaguuuaaaauaucaaauugaaaguucugauccaauuauaaaauaucuuaaauugacaaagacuuacugccauuuuaauauaguuucugcuuauuuauauguguauuauauauaauauauauuguuauauguacacauaaauacacauaauauaauuauguguacuuauauacauaauuauacaguuguaaaugccaggaaucuauaauuugauuuuuuaaagugauuuuuaauauguggcuuacaaaaauagguuuugcauugaacuacauguauuugacuguaccaucagguguguuuaaaaggaugcagggggccuguuuucauaauuauauacacaauuguguuagccuuucauauccuaaagcuuuuaaaugaaaaaauauaaggcuaguuaauuaguucaacuagccuuugaaugaauagcaauacaguguaauacuuaaaggcucagacuguggaguuagacugccuagguuugaaucccagcacugucgacucacuggcuguaugaccuuguuaaguucuuuugaguucuauguccuuuaguuuccucacuugcaaaaugagaauaauaucaguaccuauuuuauaagguuguugugaggauuaaaugaauuaauauuaaaacauuuagaauagugccuggcacauccguacuaacaucuaaguguauauuagcuauuaguuuugccaauauuaaauuuauacauaaauguugaaauuuauugugaaggaaaaacuauuuguuuuguaaauauaaauuacauuugcauuucuuuuaaaauauuuuuauauaacugaaaacaguaagcuaaagugaaauuuuauacacuuuuuaugaaagcuuucuucacaauaauccuuuuuuccucuuucuuuuaggcacggaauguuaacacuggugaauuagcagcaauuaaaguaauaaaauuggaaccagguaaauuguuugaaauucauuuuuucuuacugcuagaaagccaugggauaucuuaaggcuuauuuuaaugauguuugguuaacauucucuuguuuuccccaacaucugggauaaauagagcugcuuguaugcccuuuccuccacuucuucaaguucugcauacaacacaccuugcucaguucuucccugaaaaguaacugauaauugggggaggaaggggaacuccuccugaaaagacuuuguucuuucugaacucaguugagcuaacuugugacaagcugauagugguuuauuuccaggcugacgucuuguggugucagugugauguaguggaaaaaacagaacugaaauuuagguaguuguaguucaguuugucucccacucccuugcucugugaacuugggcaaauagcuucaugucucugagucucaguuuuucucaggagaucuagcuuccacauucuguauuucauugcuaucccagcaguugucuaccaaauugagcagcuuauuguaaagccccuuaaggcuacuccuuauuuuuugucugcuucaacuauguucuuugaauuccuccuacuucccucaaaacccacauuuuucuuagcuaauuacucacucuuuguuuauucucucuuagaaaccccuucccacucuuucuccuucccaccauaagcaagucuauaauugugcuagugucuagaccgaguaccacagcaguuagugccuuucugaugacuucuuccuuuacaagcugauaauaagaguuuauuggugaaacaaguuuuagcuccaguaugaacagaaauccauucagagacuuugcaagaguggaaaaacuuuuucuguuuaaaaaaaaaaaaaaggccaaauagccaauacuuuagacuuuguaggucauguauggucucuauauucaguucucccucuuucccuauaguuugcucaccccuuauuuagagcaucaauaaacuuuuuagaagugauauuaaaaugaaaauuuaaggaugugcugauugacugugaucaaaccacacauaaauaaaaugaauuaaaaaaauuuuccaguuauacauauuuacagauuuuauguagucguuauauucuaaacaucgcaagacaagauguuuaucuuuuuucugaaucuccuacucuucaauucauaagaaauuuaagaaggauauuugaaguuguugaaauauuagcuacaaaaagaaauuuggcauuuaaagcagggccuucauuuuuaaucauuaagcagugacuguguuacuuaaugaaaugguucuaaugagaaguauuuuguguauacaucauucccucaagaaaccuucucuuucaggaagccuugcuugacccugggucuaauuaagaugacuccugagugauuagcucugcuguagcacugaccauagcuauauugucauucuagacuugccuuucuuuguuucuaaguuuuaaucaaauuugugcccccagcacugagcuuagggccuggcacauaguacucauucuguacaucuuaaaauuuccuuaaaaaauuaaaaacuugaaaaagcuuacuguucaagucaauuauuuucuguucaugaaauguucaaguuguugcacugucagucuuggacacugccauguguauauugaucaauguaauaaaaguagaauauacaacuauacaaaaggaaaaaaauaaaaaucauucauauucugccacccagagaaaacaaagguuaaucaccauaaauauguuuccucuauuacagcuacccauuuccccccgccaccaguuauuuugaucccucaaucauaaaauuccagcccauaguauuucuguguauaugccuaaaguauaaauacucaaaaaguguaaucacaaacaggaacccucauacacagcugguggaaauguaaaauggugcaaccacuuuggaaaacaguuugucacuuccuuaaaguguuaaacauaaauuugccauaaugacccagcaauucuacucuugcauaucugccgacacaaugauugucaugcacaaauguuuauaguagcauuauucacaguaugucucaaaauuggaaacagucuaacugcccaucaacuggugaaugaauauguuguguucauacaauugaauacuauucaacaauaaaaacaaguugcugauagcaugcuguaacauaggugaccaaaacgugcuaagugaaaggagcuagacacacaaaacugcauacuguaugauuccaugugaaagguucagaaaaggcaaaucuguggugucagaaaguuaaucuggugagcuggggacgagguggacuaacaauuauuguacgugaagggucuuaugggaauaaucuagugaugguuguacaacuugguaaauuuacuaaaagcaccauugaauuauacacuugaaauugcugaacuauccaauuuaaacguaugccuuaauaaaauuauuaaagauacguaacuacaaccauuaacaacauuacaguucuuuauuaauaagaccuacgcuuagcaaauaguugcuacguuauaucuauagguucccacuuaauuucuuuuuaucuuuuuuccuuguaauuuucuguggaaguaacucgaucauuuauccuguaaaguucccccccaguccagauuuugcugauugccuuguuguagcaucauguaauauauucuuuggugacuugauagauaucucuagagaacugaguagacuccgguuuuauuugggguauggaggagggaacuacuucacgagugguguuacgcucacauuuuucuaagguagagggguguguguguguuuaagagacagugucacuguagcccaggcuggagugcagugguaggaucguggcucacugcagucuugaucuccugggcucaugguauacuucuaccucagucucccaaguagcuaggacugcaggcguaugacaugacacccagcuaauuuuuauuuuuuguagagacagggucucacuauauugcccaguuugcucuugaauaccuggucucaagagaccucucaccucggccuuccaaacugcuaggauuacaagcaugagccacuaugucuggccuaaauuagaguuuuugauggcuagucuuccauuuuuuggaaacaaaaauuaagucugaaauagucuagugcaacauguuggauuuuaagaauuucugucuagaguuuguuccuuuuuccuuuuuuuacagcugauaagcaauuugaaccugaagcaaaauaaaaacuuacgcagaccuuuugaccaaauuguuuaaaugugaaguuacuccaaggugucugacuguugcuucucaucuuaauuaugcagcuuuaaauuuaaaaaauuuaaaaaauuuuguuuaauuuuuuuuuaauuugugauggagucuugcucuguugcccaggcuggagugcaguggcccgaucucagcuuacugcaaccucugccucccagguucaagugauucuccugccucagcugcccgaguagcugggauuacaggggugcaccaccacgcccggcuaauuuuuguauuuuuaguagagacgggguuucacuguguugggcaggcugguauugaauuccugaccucaggugauccacccgccucugccucccaaagugcuggguuaacaagcgugaaccaccgaaccuggccuaauuuauuuuuaauuuuaauuuuuauuuuuuauuguuuugagauagagucucgcucugucacccaggcaguggugugaucuuggcucacugcaaccuccgccuccggguucaagcaaucuucaugaauagcuggaauuacaggcaugcaccaccaugccuggcuaauuuuuguauuuuuaguagagacaagguuucauccuguuggccaugauggccucaaacuccuggcaucaagugauccgccugccugggccucccaaaguacugggauuacagaugugagccauuuuuaauuuucguggguacauaguaggcauauauauuucuggguuacaugagcuauuuugauacagacacgcaaugcauaauaaucacaccaggguagauggauaucugucaucucaaguauuuauccuuuguguuucaaacagaccaguuauacucuuccaguuauuuuaaaauguaugauuggauuuuuuguuguuguuguuacuaaagucacccuguugugcuugcaaauacuagggcuuauucauucuuucuaauuuuuuguaccaauuaaccaucuccaaaucccuucuacccccccaccaagcccuguaagcuucccagccuaugguaaccaugcuucuacucucuaucuccuuaaguucaauuguuuugaguuuuagcucccacagauaaaugagaacaugugauguuugucuuucugugccugguuuauaucacuuaacauaaugacuuccaguuccacccauguuguugcaaauggcaggaucucauuccuuuuaauggcugaauaguacuccauuguacguauguaucacauuucuuucuucauucaucuguugauggacacuuagguugcuuccaaaucuugguuauugugaauagugcugcaguaaacaugggagugcagaucucucuuugauauacucauuuccuuucuuuugaguauguaucuaggaguggaauugcaugauuguaugguaguucuauuuuuaguuuuucgaggaaccuccaaacuguucuccauaguaguuguguuaauuuacauuccuacugacaguguaggaggguucccuuuucuccacauucucaccagcauuuauugccuaucuuuuugauaaaaggcauuuugaauaaggggagauaauaucucaugguauaguuuugauuugcauuucucugaugaucagugauguugagcaccuuuucauauaccuguuugccauuuuuaugucuuugaagaaaugucuguucagaucuuuugcccauuuuuaaauugaauuaggguuuuuuuccccaguggaguuguuugagcuccuuauauaaucugguuguuaaucccuugucagaugaguaguuugcagauauuuucugccauucaugggguugucucuucucuuuguugauuauuuguuuugcuaugcagaagcuuuuuaauuugaugugaucccauuuguccauuuuugcuugguugcuagugccuguaggauauugcucaagaaaucuuugcccacaccagugucauggagauuuuccccaauguuuucuuguaguauuuccauaguuugaggucuuagauuuaugucuuuaauccauuuuaauuugauuuuuguauaugguaagaggaagggggucuaguuucagucuucugcuuauggauauccaguuuucucagcaccacuuauugaagagacuguccuuuccccaguguauguucuugguaucuuuguugaaaaugcauucacuguacaugucuggauuuauuucuggguucuccauucuguucacugaucuauguaucuguuuuuccagcagcaugcuguuuugguuaccauagcucuguaguauaauuugaagucagguaaugugauuccuacaguuucuuuuuuuuuuuuuccuuaggauagcuuuggcuauuuuaggucuucugugggucccuaaaaauuuuaggauaauuuuuucuauuuuugugaagaaugucauucauauuuugauaggaauugcauuaaauccuuagauucuuuuggguaguauggacauuuuaacaauauugauucuuccaguccaugaacauggaauaucuuuccauuuuuuuuuggugacuucuucaauuucuuacaucaauguuuuauguuuucauuguagagaucuuucauuuuuuugguuaauuccuagguguuuuauuuuauuuuauuuguagcuauuguaaauggaauuucuuucuugauuucuuuuucagauuguucacuuuuggcauacaaaaaugauacuacuuuuugaauauuuauuuuguguccugcagcuuuacugaauuuaucaguuuaauaguuuuuugguggagucuuuagauuuuuccaaauauaagaucauauaaucugcaaacaaggauaauuugacugcuuccuuugcaauuuggaugcucguuuauuucuugcucuugucugaaugcucuacaaaaauuuaauauauaaauauauguaauauauauuauauguauaaagggaucaauucagcaagaggauguauauagauagauguguguguauguauacguauauauauacauauauauauauagagagagaggauauauauguagugaccuucuuagcucuucuuaacaguuucuauuuugaaaucuuuuuuuucugauauagcuacuccuguucuuuucuuguuuccauuggcguggaauaucuuuuuccaucccuuuauuuuagucuguguaucuucauaggugaaauguguuucuuguaggcaacagaucauugggccuuauuuucuuauccauucagccacucuguuuuuugauugcagaauuuaguucauuugcaucacaucagugcucaaaaaguuguggauuuuggagcauuguguauaucagauuuuugaauuagggaaauucaacguguauuggcaagaguuaaacauuccacucuuuccuggagaaccuaagucacuuugacauagagaagcagucuugauuuacaucccagauggcagagcuucagguaagagacaguguucacauccaucguaacuuuguugcuuauaaggacaaagaaccuuggguucauuuuauaauccaauccugaagucugccccuuuacauacagcucuccuuugcucuaagccuaucaaaacaccacuucauuuaaauuucaccucacuuccauuuuauucaaaauauuacaaaaacucuuaucuuuucuuuuggugagaugcccuaagauuucucuggcguguaguuuuccucauugcaaugggucaguaaaccugaauuugucagaugacggguuuguuccuguggucuguggcugauccggcuagaacacugccaauucuugagacuuauuugggaaaaaaaaauuaaaaauggaucaagaugagagcuauggcagagcuugcuaguagaauagaauuuauauauauauucuuuggggcuuuauuuucaaguucugauaagguguuauuauauaaauaaguuauagaucuggaaucuuuuugugauuuaaagucagaauuuaaaaguuacuuauacucauuugugguauuguuugcagcacuaguuauuauaauaugauacaaaugcagauagauaacagugauucauuagguagcaacucauaggaaaaacucuucuaaauggggaaacucauuccuuuuccaacacaaugaaaacuacugagguugauaaacagagaaacuuguagugagaaaauaggguauuaugcuuuguuuccgugagagcaacaugcguuaaauuguaaagcuaaauuuuaaaagugcaaaaaaguaccaauaagaccuuauuccacuauuuuuucauggaccuccaaaguuaaauguuauggaauauucucuccugccagccuuugacauuaguuuuuucuuuccugagagguaguagaggugcuuucugccuccuuaucuuucaucauagaguggcgaaacauuggggauaugauuuaucuggugccuuuucccaucucccuugaguguuuuuguggaucccuugccaccaugugcuuauucagugcugccuuguguuuaucgccaucaugaauagaguaguuguuacaucauucaugauaauuauucuucaaagguuaaucauggauagcuuagucacucuuaaauuuauuagaaucauacuaugacuugaggcugacugagcuggagagauugaauauuuacacauugaaagguaauaaugcuccaaaauaaaaaagcaacugacaaaggacuuuuuguuuuguuuaucugcaguguauuucuuauucucaguccucuguuuaugaccagugauuuggcuucaaggauguuuauuuaguacuuaauuuaguuagaaggaagauacggagauaugguuccugccuuccaguaacuuguuauccaaugugaaaacuagaauguuuauguaaguagcagccuaacuacggagaacccauugagcagagugugugugcauauguaggugguggugcuggcaguaaggaacggugauggcugugacuagaaagacuuaauucaugggucacugaagauccgccuuugacuauuuacuccgaaauacucuggguugggaauaucuagguaggaugcugugugaaagaauacacauagugcagaguggcugauguagccuaacuuauauuugguggguuccauagaagcugugaguuccacuucccuugggauaaggaaguaaaacuucagaugagccuucaagacuggcuaggauuuugcuaguagaauaagagaauggaggguauuccacaugaggauaguauaaaagcaaagguaguaugaaaguacuaggccuguuuggaaguaguaguuugauuugucuagaguaguaugcucuaugugagcauggugggaaauaagaaguggaaaacugaugauaguuuauggaaagccuuaaauacuagcccaaagcagccaggcccaguagcucacgccuguaaucccagcacuuugggaggccgaggcgggcagaucagcugaggucaggaguucacgaucagccuggcuugguggcucgcaccuguauucccagcuacuugagaggcugaggcaggagaaucacuugaaccugggagacggagguugcagugagccaagaucacaccacugcacucuagccugggugacagagcaaaacugcaucucaaaaaaaacaaaaaaaaaaacuagcccaaagguuuagauuuuacccuguaaaacagugggauuucguuuguuuuuacagguuaguaacauggucagaguauaacuguaggcagauucaguguacacaggcagaugggagagaagcccugcuggugagaagacauguuacuguugugacagccaugcuugaguuaugugcagagggaaggaaggggugacugcaugagauuuuaggguggauagaacuuaaaacgugauugauagguuacaagggauaagggagagguacgauauauguaaaaauugaguuuaugggaagaauagguuuguuguuuugauuuuagaaacucauuuucaugaguuuuauacagcugugguuuaugccuauguaaccucaagaacagaucaggagcugcuaaaaaaaauuaucuuuaaaucagaucuggugagagaacagaaaguugagaaauuaaaaacguccaaaauuagaacuauuuuauuuaacuuuuuuucuuuuuugggauuuuuuuuuucuuuuucuuuuagagacaggaucucacccugucacccaggcuggaguauagugaugugaucauagcucacugcagccccaacuccugggcucaagcgauccuccugccucagccucacuacugguugguauuaacaggugugcaucaccacacccagcuaauuuuuuaguuuuuuuuguagagacugggucucguuguguugcccaagcuggucucaaacuccuggccucaagugauuguccugccuuggccucccaauguucugagauuacaaacaugagccacuguguccagcuaaaacuauuuuaaacaauaugucauuguucuuguuggugggcaugauaaaaacagaaaauuuuuugcccauuguauucuucacuucccuuaaaaucuacaccgugcucuauuuuuccuuuuucuguccuuacuccagaaacauuuuuugagucuacuauaauacuuacuuuacauauagaaacuguaggguugcugccauaauuuuuaguaggcagggggcgcgauauacuccagaggauuuucacuagaaauucaguccugaguuacggguaccuuccuuauuuugggccuuccaucagaaccacucggguaaaccuggcucucaaaagagcuggauccagguaagaaaaggagaccaaacagguuuauaggucaggaagcucaaguuaagcccuccuucccugacuaccuggacacaauccauuugcacuagagaauguuuucucaaauauuccuuuaaaauaagaaaggaguggaacugguucuuugggaugaaaaaaaucuuaauucuuuuuauguacaaagcacagauauauguauguauauaugcauaauacauaaacaugcagaauaucugugguauuaaaauuucuuggggagaggcauuaggaaaacagaguugggaaacacagcauuaggguagacauuuuuucuuuuuaucuuaaaguugaggucucacuauguugcccagguuggaucaaacucucaccucagucccccaaauaucugggacuacaggcuuccaacaccaugcccagcucuagaguaagacuuuuuuuuuagggagccagggccaugguuucuuucuuuucuuuuuccuuuuccuuuucuuuuuuuguuuuuuuagauagagucucauacugucacccaggcuggagugcaguggcacagugacagcucacugcagccucaaccacccaggcucagucaguccucccauuuaagccucccaaguagcugcgacuacaggcucacaccaccauacccagcuuauuuuuaauuuuucuacagaugaggucucaccauguugcccaggcuagucugaaacuccugggcugaagcaguccaccugccucagcuuccuaaaguucugggacuacaggugugagccacugugccuggcuucuuuuuuuguuuagauaguuugagcaagggaauuucuacuuggcuuuguggaacccaaguucaaaggccauucaguaacaauguauguaaauguaagugauacuuaucuuaaacauuaaucaagaacacuuacuaaaauacagccaaacaaauaaauagacucuaaguuauuuuuaucaggugaaguauuugaaggguuguuuucuucauucucauuucugaaaaaaauacaaauauugcuguuuuaaucauuuuuucauuuguuuugaaauaaguaggaaucaauaggauuauuagauacuuccuuuguauuucuguguuauugaucagggcuuuaauauuucuucaaaaauucaaaguugggugcugcuucugugguuuuagaaaaguuuuuucuaauuuuauguuguaauuacuuaagccaauuucuuaucuuuuuaaagauuagccaguggguuucaagauacccugauaauuuaauauaguguuucagaguauuuccugguacuccaguaguuugacacaguaauugacaacuuaagagaaguuggaauguuagccauagauuacuguguaaaccaaaaaauaaaguuccaaggccucccaaccaucuaaacgaaccccuccacugggccaaaggcauuccgaaguuacccugaaaaauucaggccaugauggaagcagagguggaacuacgcccucuucccuuucugaauucagggaaagcugacugguauuaacaucaguacagaucuuacaucucaagagaaacauuucuucgucugaaauuucgucugaaacauuuacgucugaagagacgccuacuaccuggagguuucaucugcaugauaaaaccuuggucuccgcaaccccuuaucagaacccagacauuccuuucuauugaugauaacucuaaaccaauugccaaucagaaaauuuuuaaaaucucccucuaaccuggaagccaccaccuccacccccaccccaccacccugcuucaagcugucccacccuucuagaucaaaccaauguaaaucuuaaauguauuugauugaugccucaggucuuccuaaaauguauaaaacuaggcuguacccugaccaccuugggcauauguucucaggucuccugaggacucuuucaugggccauuggucacucauauuuggcucagaauaaaucucuucaaauauuuuacagaguuugacuccuuucacgaacaacugaaguacuguuaauuucauuuauuguuucuaccauaugaaauggaguuuagaaauuauguauuuugaaugacaccacacaugaaauuaaaaguuaauuugaaauugacuuuaaaacacuuuuacauguaacguagauguguguucucacuucucuguguuuaaaauagaauggaaaugggaagauuugagagugaaauacccauaacaauggcaugagaaaccuuguugauuuuucguagucuaagcuuacauuuuucucuuggcuauaggacauuuuaaaaauuacuaugggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaauuacuauggcguaacccaaaaauaaaauucuaagccccccaaccgacugauggaggcucuccucagccaagggcauuccaaaguuaaccugaaaaacuaguucaggccaugauguuaccaucauaaugagacuccgacauccucauuauacccuccucccuuuggaauucaagcucagcugaccaacauuaacauuuaaauagagaucuuaagacuagugaacagacuuuuuauagcaauaagacacagaauuccagccugacucuaguauagcaucacaugacagauagcaggcccugaaagaaauagaaguauuuuaucccaaguauauuucuuugauauauuuugaaaugguccugcaaagccgucucuugugggggaaaucuguauucuauagaggauucauuuuuccuuuccaggucuuuuuccugauccaggagagaauuaacugagucuggcacuucauaggucugacaaaagcucugaagucugcuaccuggaggcuucaucugcaugauaaaaccuuggucucugcuacccauuaucuuuuuuuuuuuuuuuuuuugagacagaguuucucucuguugcccaggcuggugcaggggcaccauccuggcucacugcaagcucugccuccuggguuuaugcaauucuccugcuucagccucccaaguagcugggauuauaggcauaugccaucacgccuggcuaauuuuuguauuuuuaguaaagaugggguuucaccauguuggccaggcuggucucguacuccuggccucaggugauccacccaccuuggacuuccaaagugcuggcauuacaggcguaagccaccgcaccuggcccaccuuacacguuuugauugaugucuuaugucuccuuaaaauguguaaaaccaaccacuuugggcacauguucucaggaucucuuggagcuguauuacagaccacuggucauucauauuuggcucaaaauaaaucucuucaaauauuuuagaguuugucucuuuuuaucaauggugguaaaaacacgucacaugauaccuauucucuuaacaaauuuaaauauuuaguacaguauuguuaacuauaaccauuauguuauacauuaugcucuagaauauuuucaucuugugugacugaaauucuuuacacauugaacagcaacuccuaauucuuacuucccccagucucuggccaugaccauucugcuuccuggagugcaaaugucucuuugagauucuaauuucaguucuuugggguauauacccacaagugagauugcuggaucauauugcauuucuauuuuuaauauuuagaggaacuucuguacuguuuuccauaguggcuacaccauuuuacauucccaucaacaguggacggggguauucauauccuggacaacacuugcuauugucuucuuuuuuuuuuuuuuuuuuauaauggcuaucugaacaggugagaagugacauuauguuuuugauuugcauuucccugaagacaguaauguugggcaucuuuugauauagaucuguuggccauuuguauaucuuuuuuugagaaauuucuguucaaguccuuugcucuuaaaaaaaaaauccccaguaugauuacuguauaaaugacaaaaauuguauacuguuuguuuacaguuuacaacaugguauucugaugcauauguauguugugaaaugaucaaaucaagcuauuucauauauccaucacccauucaaccauagcucuuuuuuuuuuuuuuuuuuuuugagacagagucucacucuauugcccaagcuagagugcaguggcacagucuuggcucacugcaaccuccaccuccuggguucaagcaauucucccaccucagucuccaaaguaccugggauuacagacaccugccacuaugcccagcuaauuuuuuguauuuuuaguggagucugggcuuugccauguuggccaggcuggucucaaacuccugaccucaggugauccacccaccucggccuccaaaagugcugggauaacaggcaugagccacugcgccgagcccuuugcucguuuuugaauccaguuauuugguggguuuuguuuugcuguugcauuguaggagugccuaguaaccccucaucagauauaugguuugcaaauauuuucuuacauuccauagguagucuuuuaauucuguuucuugugcugugcggaagcuuuuuagugguggaauuucaguugucuguuuuugcuuuuguugccugugcuuuuaaugucauauccaaguaauaauugccaagacuaauauuaugaauguuuuggccuguguuuuucuauaagaguuuuaugguuucaggccuugcauuuaaguauuuaauuaauauucaaguauuuaauaaauuaaagcugaauuuuuuguguauguaggauaacguccaaugucauucuuuugcaugcugccauccaguuuuucccagcaccuuuguugaauacuguuuuaucccauugcauagucuuggcauccuugugaaagaggauuugaccuuauaugcauguguuuauuuuggguuuucuuuucucuauuccguuggucuauaugucugucuuuaugccagugccauauuguuugauugcuguagcuuuguaauauguuuugaaaccaggagugugagaccuccagcuuuuauucuuuuuucucaagauuguuuuggcuauuuggcguucuuugugguucuaucuaaauuuuaggauuguuuuuucuauuucugaaagaaaaaaguugcuguuuguucuccagauuacauugaauuuguagaucgcauuggguaguacgaacauuuuaacaaugcucuuucaguccauaaacauggcaugucuuuacauuuauuuuucuaauuaaacguuuuguaauuuucagaguacaggucuuccuccuccuugguuaagucuauuacuagguauucuuuuugaugcuguugcaauugggauuauuuucuuaauuuccuuuucagauuguuguuaguguauauaaaugcauuugacuuuguauccugcaacuuugcugaauuuguuuauuagugcuaacaguuuuuuuguggaaucuuuagagcuuucuauaugcaaugucaugucaucuuccagcaaauauaauguuacuuuuuccuuuucacuuuggaugucuuuuauuucuuuuucuuguuucuggccaaaggacauuuaacaugauccaggauaaagaaucagaaggaugagaauuauuccagauguaucaauucuaaauaagagcuacuuauuucaaaauaauaucuaguagaaaacuguuccuucauguuuauuuuuuucaggugaauuuaaguauaauuuuuucaggauucaacuggcauuuuuauuggaauuacauuaauacaguuauuaauucauaagguacuugcugucuuuaccauaguaaguucuucuauucagaagggaagugucuuuuguuuuuuucaggucuuuuaucucacagaauacuuuguuuucuuauuuuccuuuugucaucuuuauuucugucuucuacauguuuaacaucuucaugacucucauaagcuaacaugguuuuccagaagcaucuugacagaugucauuauaaugaaauaauuacuugcaguaucaaacagcuauuuaacaugaaaacuaacaacagagcagauucuguuuuaaaugauaauuuaauaauauuaaauuaaauauuuaauauuuaaauaaaauguaguuuaaauaauguuuaaauaaucauuuuaaagauuuuaaaagcaaguuuaaacuuuguauggagccuauggguuuuaaagcuuauucuuagguacacaauuuaauuugacauauucuaauauguuauugaaggauuuuaaaaaauuguuucugccuuuuuuucaaguguuuguuguccaagagcacagucauauauaguaaauaaugaaaauuuuguauuucuacuguuuauaccgccuuauuuuuuuuucuuuuggguuucaauugguuauuaccuuuagaauaauucauuaauucauuuauauugaaagagucuaaugugcuagggaaacacacauauaaguaaacauauaauauguuaagugugguacauggggaaaaauagaguaagggggcauagaauugugacuauggguaguugcuauaauguauauuauuauaauaucauauuauuacauaaaacgugauauaauugcuauaauguagagacaaaagggugugggagagagagggaaacagagagaaagaaagaaacagaagagaaacgggaggcagagacagacagauuugccugagaugauacaacuaguaaguugugaaaccaaguuuuauaauuagauauucugauuucaaagugcauauccuuaauagugacacugugcuagauauguagacaaggccagcagcaaaguauggacuuaaugugacagaaauaagggaccuuuucaggguucaucuuuaagcuguuauuguuuugauuguugauauaguuuagcuguguucccacccaaaucucauuuugagucauucccauaauccccacauguuaugggagggacuuugugggagguaauugcaucauggggggcaguuacccccugcugcuguucucgugauagugaguucucaugagaucugaugguuuuauaaguggcuuuucccccuuuugcccauacuucuuccaccugccaccaugugaagaaggauguguuugcuucccccucugccaugauuguaaguuuacugagcccuccccagccaugccacacugugagucaguuaaacccuuuuccuuuauaaauuacccagucuuugguaggucuuuauuagcagcacgagaauggacuaguacaguaaauugguaccaggaguggggugcugcuguaaagauaccugaaaaucuggaagcaacuuuggaauuggguaacaggcagagguuggaacaguuuggagggcucagaagaagaaaagaaaauguggaaaaguuuggaaguuccgagagacuuguagggcucagaagacagaaagaugugggaacauuuggaacuuucuagaaacauguugaauggcuuugaucaaaaugcugauagugauauggacaauaaaguccagacugaggugcugucagauggagaugaggaaccuguugggaacuagagcagaagugacucuuguuaggcuuuagcaaagagaguggcggcauuuugccccugcccuagagaucuauggagcuuugaacuugagagagaugauuaggguaucugguggaagaaauuucuaaggagccaagcguucaagaggaagcagagcauaaaaguuuggaaaauuugcagcccaacaaugcgauagaaaagaaaaccucauuuuccucaggagaaauucaaaccugcugcagaaauuuacauaaguaacaaggagccaaauguuaaucacuaagacaaggggaacaugucuccagggcauuucagagacuuuugcagcaaccccucccaucacagcccuggaggcuuaggaggaaaaaaugguacugugggccaggcccagggcucccccugcugugugcagccuagggacuuggugcucugcauccuagccgcuccagccguggcuaaaaggggccaacguauagcucaggccauugccucagagggugcaagccccaagccuggcagcuuccacgugguauugagcucacaggugcacagaaaccaagaacugagguuugagaaccucuggcuagauuuccaaggauauauggaaauaccuggauguccagacagaaguuugcugcaaggguggagcccucgugguucugcuagggcagugcagaagggaaacaugggguuggagcccccacacagaguucccacugcagcacugccuaguggaacugugagaagguggucacuguccucuggaucucagaaugguagauccacugacagcuugcacugugugccuggaaaagcuggagacacuuaauaccagccugugaaagcagccaggaggggagcuguacccugcaaagcuacaggguuggagcugcccaaggccaugggaguccaccucuuguuaucagcaugaccuggaugugagacauggagucaaaagaggucauuuuggaacuuuaagauuuaaugacuacccuguugguagucauuaaacuuuaagauuuaaugacuauccuguuggauuucagacuugcaaggggccuguagucccuuuguuuuggccaguuucucccauuggaacagcuguauuuacccaaugccuguaccaccacuguaucuagagaguaacucacuugcuuuugauuuuacaggcucauagguagaagggacuugccuugucucagaugagacuuuggacuuggacuuuuggguugaugcuggagugaacuaagacuuugggggacuguuggaaagacaugauugugacuugaaaugugaggacaugagauuugggaggggccaggaguggaaugauguaguuugguugugucaccacgcaugucucaucuugaauuguaguucccauaauccccauggguugugggaggacccagugggagguaauugaaucaugggggcaguuacccucugcugcucuacucgugauaggaggccuaucuuuauaauguauuucucaugagccuugaacaaaguucuuuaaauccuuuggauuauuaauguauuaaacucuacuuuuuucuuacccaaaucuacauuuuuuauuuaccuuuaaaaaucgaguauguggaauuuuucuuugaauuuuuuucccacaaaaauguugaauuuaauuugaccauucucacaaucacauagaguugacuuaauaguacaaaaugauacacuuuggaucaguaguauuucaugggaaggcugcaguugaaaaccuaaagccacuaauacauucuauuagaaauaaaaggaauaauauguaggcaauuaauuauauaaaacaugcuaacaauuggaugaaauuaaaccaaaagcugauauucuggauuuacagucaucauagaaaggaauuauguggugcuguagauugauucagucaacaguucuuuauugaucacaucuuugguacuagggguacaaagaugaugaagacauaaugcuauccuagaggacuuuguauucuagugaaggcaaagacaugcagacaucaguguaauauaauaaaagugcucaauacaaagaucacuguagaaguuaugaugcuuauaguuaucuguaacagaaaccccagcugaaguggcuuaaacaauacacagaguuuauuggucauguacagguauaucugaaaauuacagagacaggugaggcuugcuguaauagcucaguaugcuuccuuuuaccuguuucuccucaaugcuuuccacauguuaacuuuauccuaaggcugacucccuuugagguuguaucaugacuacuaauaacucucagggcuacccccagaaagagagcuuuugucuuccaaccaucagacuaaagucuuggguucacucugacuagaucaacuuuuacuguaugcaacucuuucacuagauugacuaaaaguauaauuuuggguugagugagaaacuaaaaguccagaacuuccaaaguaccuaguauaccuauaaaaauugguguuagucuuauuuuggcuuuauuauuccuaauuuuguuuucuucuaauauacagaaaaucaggaauccucaauggugggaaguaaauugauaagaucauaguucaauaaucuuccaaauuuuugaaagccuaaaaauuaugucuuuggagauuugugauuuugugcucauaucaacgcagaaauuaagaacccaacauaacaacugucucuucuccauuauuucuuuccuuguaacugggacaguaagguggauuuugauauuggguucacaugguucaugguugggcuguuucaagucucaauuacauuugcaguagcaaaaugccaaggccagaaaugucagggcuuaccacaaugaccuuauacuuaugauuugagcaguaauuggggaagccuucuguuuuuuacuuugcuacuaauuuacauuuaaucaggcuauucauaguauauaauacuuuaaaagcugaauuaguaauacaaagcuacuuuucuuucagaguaagcacuuccauuuguucucuuucugcauagucucugguucaccacauuugcauucacugcaguucuguuucucuccaugacaaguguucauucaggagccacagcaugugacacugcuauaggauugccagaucuuauuuuagagaauuuggacaaggaggcaguaggagagagauuauuugcuaauagucugaccaggcuaaaauacagucccauucugcauuauaacacaguuggaacaaggcacucaaauacaggauaagccugugaaugugggccaucugguaauccaguacugcuugaguguaggccucucagcucuacaaacagccuguggagauaaauuugacacacuugguguauaaggguuccugcccuaacuuagaaaagaauuacuucuuugugcuaaaauuauauuaaauguuacuuggaaauaaaggaaaaaguaauuuacauuuccuauugauggauuauaccgaugauuauguccaaggcauaauaauaauagcaaauacuuguauaaagcauacuccaugccaggcacuguucuaagcauuuuacauguauugguucauuuaacccuuacaacauuccuaugagauaggcuauuauuauuuuacugaggauggaauuggcacagagaagucaaauaauuuacccaaacucacaccgcuuaguguggaacagaguuaggauuuuaauccagaaagucugggaccagaguucaugcuuuuaagcacuaugcuauauuuucucucaagucaggacugaaauugucauuaaaaguaauaccauuaacuuauuggcuauguuuuauuuauaacucauuaauuauguuauacuuauuaauacguauaauuauuuuauuguguuuugaaauaaaugagcauuuugaaacuuaccucuaaauauucaacaugcuuguuuuuuauuccaggagaagacuuugcaguugugcagcaagaaauuauuaugaugaaagacuguaaacacccaaauauuguugcuuauuuuggaagcuaucucagguauacuguuuguuucccuuuugaaaagcaauaaugauuucaucaccuaaugcauuaaacaaaauaaaguuaguuuuaauaccauguuuuguaguuuuucuucaugcuuugaagauaggauauuuucauaccaauggaauuuuuacuuaggaccuauguuaauucuguaaccaauauugcagucguaugacuugggaauucuagaugugcuuuuagugaaaaugcuggcaaguaaaaaccuuacgguuagucuuccagugguggacuagcgaucuaaauaugccauucucuugccccuuucuucuggacuuaggucaguguagagucaggagcaucucuuccagcuauguguuuaucaaaaacuuuuuuuuaauuuugugcuucuggucuaagaguacuauauuacuuuaucccuuuccuucauuguauccaaagaacuaggaacuauaaucaucucaguaacuuauuuuuccagguccuaaagugaacuuaggacugugaauuuccuuucucuuacuuuguuuugguagccagacccaagccagguucuuagguuauauugcauaggcgaucaccuuagggucaaaucuuguuuuccauucacuucuacaugcagcugugaguugaucacuggugaccuaguuguuuuuaagcuuccuccaagggaagauuagagaauauuuuacuauuuuuuuccuuucuuucuuuugugggggcgggacagagucucacucugucacccgggcuggagugcuguggugugaucauggcucacugcagccuugaccucccuaggcucaggugauccucccaccucagccucaugaauagcugggaccacagguacguaccaccaugcccagccuuuuuuuuuuuuuuuuuuuuuuuugagguggagucuugcucugucacuaggcuggagugcaguggugugaucucggcucaccgcaccuuccaccucccggguucaagugauuccccugccucagccuccugaguaccugggacugcagccacguggcaccacgcccagcuaauuuuuuguguuuuaguagaugggguuucaucauguuggccacgauggucuugaucuccugaccucgugaucugccugccucagccucccauagugccgggauuacaggcgugagccuccgcaccuggccuaauuuuuguauuuuuuauagagacggggaucucacuauguugcccaggcuggucucaaauuccugagcucaaaugauccaaaaugcugaaauuacaggugugagucauccugccuggccuucccuauguauuaaaaaaacucuucaguuuuucuucagcauacuuuagcaacauccaacauacuguaacuuauugcagguucccauuuucauaugauccagguacaaaacacuuuuucucuucucuuuugggcacaacagaaaagacuaggguauucugcccugucaucuuucuagcuuuugaaaaaccaacuggaccugcuguucaugguuguaaccacucuuguacagcuuugauugccccaccuugguuaagguagaggugugggaguuuuuuuguuuuuuuuuuguuuguuuguuugagacagagucucacucuguugcccaggcuggagugcaguggcaugaucucagcucagugcaaccucccggacuggagugcaguggcgugauaucggcucacugcaaccuccacuucccggguucaagagauucuccugccucagcuucccaaguagcuaggacgauaggcacacgccaccacacacagcuaaauuauuuauuuauuuauuuauuuuuugagauggaaucucagucugucacccaggcuggagugcaguggcgcgaucucagcucacugcaagcuccaccucccggguucaagccauucuccugccucaccuuccgaguagcugggacuacaggcuccugccaccacacccggcuaauuuuuuuguauuuuuaguagagacgggguuucacaguguuagccaggaugaucucgaucuccugaccucgugauccacccaccucagccucccaaagugcugggauuacacgcgugagccacugugccuggccuuuuuuuguauuuuuaguagagacgguguuucaccauguuagccaggaugguggcuaaccuguuauuccaggauaaccccacucauuuauguggcacccuugguaugguaaaaugagcaugaucuuuuugccagagacaaaucguaucuuugguaguuaagagguuaaguucuggagacagauugucuggucugagaccugguucuaucacuuauuaaucaauuauuuaaccaguuugugccucuguuuccucaucuauaaaacagaugauaauaauaucuacaugacaggauaggugugaguacuuccuggguaacuacgugugaaauacuaagaacagugcuuagaauguaauaaaugcucaauagguauuugccgcugcuacuacuacuauugcugcugcugcugcugcugcugcugcugcuacuacuacuacuucuuaacuuuuuaaaaguaucauuauuuuagugccucauuuggucuuucagcaaccuggauagcaguauagcugugguagaaauuauuuccauuuuacaaauaagauucuugagagaauuuaacaucuaaguuuuuuauuuuaugauuuugcuucauuccaaauacaaaaagcaaaauuacccagaaaccaaaguaaaacagacaaaaguaggaucauuuuuuucaguaaaacuauguucuuuuuaguguuguacaaucuaauauuaagaaacacugauuuaaauauauuauuuuauucuguaaauggguauagcugaucaaagugauuugaagguaaaugguaguauaauguaggauagcaauuaauuuuaucucucucuugcucuuuucuucuguagagauucuucccuuauucccuaauugaaguucaggcucagccaagguuggaguagggaauccuaaugauuagacuuguaggauguuagagcuguaaggggcuaagagauguugucauauagcccauucuugguuauagaugagaaaaugaagugggguauaaaugacuuacuuagucuauccaacgucucauuaguggcacugggauuuaauccuggcuuuacaaguagcuagucugaugucuuuuuuggcauacuguauugcuuagcccagaaaggccagauuuagucucagagggaacgugauuucuugaauucuuucucauuacugaaugacuuuacaaaggaggaucuuguuugaacuugauagaaaccccguaaaauauauacuguucauugcaacauucuuccuucuauguuguugcuauuacaaccuguauaacaaauuuagacaaaaaguuaagaaaacugagcaaauguaguuugaccauugauaaauuucccccucagagaaucagauuuacccuaugaauuuucuuaguagaugacuagcauauaauuaaguuucagaaguccauuuuauaucaggguagcugugcucgcuuaugaagaaauacugaaacugagcuucuauaaagcagaauaccuggcauucuucuuaacaagaccuuuccuacuccacuguucaauaucauuaauauaccuacaauaaaaguagauagacaaagcauuaacauuuaaaaauuuuaaauagucccgguuugguauguauuuguaucugaauauauauguuuguguauuuauaaaacaacagaauuaaaucauuauagacuuauucuuuacaauucuuuuggagcuuaacuauuacuucuuuuaaacuaaagaugaguuuaaauuaauuucagguuccuucuaagcauuccuuagcccagcauaucacuuaagaauaaguuaagaaaauggagacauuccucucaagcuugaacucaauaaagcuuagggggaaaaacaauaaaugcucauuuauuuauuuuuuuugauacagagucuggcucugucgcccaggcugcugugcaguggcaggaccuuggcucacugcaaccuccaccucccgaguucuagagauucuucugucucagccucccgaguagcugggauuacgggcgcacgcuaccacacccagcuaauuuuuguauuuuuaguagagauggggucucaccauauuggccaggcuggucuuuaacuccugaccuugugagccaccacgccuggccaacaaaugcuccuuaaacaauaagccaguagaagauuugauccauacaguaaaaacuauuuagaauagauauuuuaaacuuuugggcugggugcgguggcucaugccuguaaucccagcaauuugggaggcugaggcagguggaucaucugaggucaggaguuugagauuagccuggccaacguggcaaaacucccaucucuauuaaaaauacaaaaaauuagcugggcaugguggcacaugccuguagucccagcuacuagggaggcugaagcaggagaaucacuugaacccaagaggcagagguugcagugagccaagaucacuccacuacacuccagccugagugacagagcgagacucugucucaaaacuaaaguaaaauaaauaaaccuuugaaguacagaguacuaguuuagaugagcauacuuuaccucauaacaacuuaaauaaguaaaucaccaccauuuacaaaguguuuauacauuauuucuuagcauguagagugcaguguugauuuccacagaaagauaucuaaaaccuaauccuucccuuuaaggagcuuauaaucuaacaggagaaguaggcaugagcaaauaaucguaacauaauaugcuagaugcaguaauaauuuagaaguaaggcacagaagugcuaaggaugauagacucucugauuuuugucaauguaggggaaucagagaaagcucugugaaugauguaauucccaaauauuggguguuaaaagauugguagauauuuauguguauagaaaauuggaauuuuuggcaaagggaacacaugcaugaaaaacugugacauauucaggagacagcuacuggucucacauuagagccugagagggaaaaggggguacauaguuacuucucaguaugugcagagauugguuccggaaccccaguggauaccaaaacccaugaaugcucaagucccuuauauaaaguggcauagcuaugcacauccuccaguuuaaaauuaucucuaggugacauaugauaccuaacacaguguaaaugcuauguaaauaguguaauacuuuauuaauuuguguuauuuuuauuguuguauuauuuuuauuuuuuccccucugaaaauuuucagucuccgguuaggugaaccugcgauugguugaaccccacaggugcuggaccuguggccuccagagggccacguguaguuggaguagauaagguuguggagauaugggcaaaaaugaaucuuuuaucccuuaauuaggaccuaagggacugagcauacuugcugaaagauuuuaacagaguuaguauauucuguggaggauggaccuaggguggaggggauuaaaagaggcaauuuaguuaaacuaauuaugguguauuuauuacaguaauccaggaaagagauguuggucucuugaguuauauaaaacugggaaaaaauuuuuucuagagccagagacagugcuaagaagggaaacaacuggaucuuaacucgaaauacauuuaugaauaucuuuuugaauacuuagaauaugagaauaaagauuacaguuaagucacuuuauacccagcuacucuugcuuuuaaaaaagggaacuuucuaguuuaggaauauuuuacauuuacgaaaaguugcaaauaguacagaguucucuguauuuccuucacucagcuuucucugauguuuacaucuuaacgcagccauggcacacuuuucacaacuacgauauuaacauuggugcgauacuauuagcuaaacucaguauacuuauuuggauuuuaucaguuuucuguucaugucuuucucuuuucuguuuuugagaggaauuaggaauauaucugaaaguugauguuaauuuguuauuuguuuaagccaggguuucucaccuuuggcauuaucaacacuuaaggccagauacuuuuuuguugugggagauaguccugcgcauuguaagauaguuguuaauauuaguaccccuguccucuguuaguuaccaguagcacccuuuccccuaguugugacaaccaaaaauguauccaggcuuugccaaauguuccuugggggacacagucacucccaguuaagaacuacuacucuaagcaaaaaaacuuuggugaaguuacagauacguuccuuuaccaguauugcuaggauauuuucuauagaucauuaguucugagggauacaaauauguauuuuguaaaaaaauggguguauugaaaaaauaaucuggguaaauaguaaauuaaacagaauuagaaguuuuauuucuucuuuuucuuucuccuccaucuccucccccucucaacuuuucccaucccccuucuccucuuuuuucgcuuccuccaccucuucccacuuuaucuucuuucugguacccuucauccuuccauuuuguuaccucucccuucucuucccuucucccuccucugucucuccaaccgccuucucacuacaggauuucucagagccuuuaauauaccaguggccuugcuaauuuucaagaaaagacuaugugauauuuuuaaaaacugauuuaacuauacggugguuucuuucuggaagcauacuucauguaggauugauguucaguggcccacccuuuggaaauauuaugcugaacacugggggauuauuagguauaauuauagagaaauagaucagcuuguaucccccugaguacagcauccuuaccccuccuuauuaaagggaaagcagaugguauagguuaccuauaaauaaauuuggaaugcaauuauuuuuccuuauuaguaauuuuuaaaucaaccaaaaaaguuuaaaaauuuucuucacguuaaauaaguuauuuauauuaaaacaucuagcaguuacuaaacuuuguuuuucucauugaugauuaagguugaauuauuuugcugaauauaguggaauagccauugcuuuggucagcaagacaacaacucacaguacaguacaggaaucaggggacugcaguguacaggauagcuagccauccucucccagggaggaagacuccguaugccaacuucaggcagauauuagagaguugcugauccucaguagucuuggucacauuuuauuuugcuguuuaaauuaugcuauauuugagaaaaauauauaaauaauuauacuuaguuuggucaguuuuaagucugugauguguuacaaaaugugggaagauuaaaaaguguguuuuaggaauuauaagaauuucagaaccauaaaauagcuauuagaauuuuggucccuguaugcucugguagacaucaaaauaguuaacuuuucccccucuacuuaauuuucuguuucuuauaagauaaauaauuuuacaaaaugagaaaaaagaauucugaggauuuguugaaucaggauguuaauacugauacauugaauauuuacuucagugguuaauuuuauuucaauucagauaccuagggacaaagauuuuauaauugaccugcauaaaaugggcugauugacugaaguccuuuccuauuaggcauauggcuuagugaaugaccaaaagcaaauguagauuugucauuauaagaaagauauucaugggacagaugaaagucauuucucuaauagacuaugacuacucaagcuuuuggauaauacuagacuuuaacuaaauagaauauuauaaaaguaaaguauuuuaggcaucuuaaaaaguaaaguauuacuauauagucgugauuuuuuuuucugccuauaagcuggaaagucauuuuacauaggaugaauagaaaauuguauauuuaagcaaaggaagaaaagagaauagaccaacuucaaguagaagguagugucauauugaaauauauaaaaagcgagaacucauuuccugcauucauuuucucuagcaaggaaaauuguuuucaaacuggaagggguaggaaaaacacuauuaagauggaauugaaacacaagauggugaguagauaauuauagagcagcuagacaccuuaaauuuuuagaaacuuuuagauuuauguaaauuauaucucauauugaaaguucagcaaaugugaugguaguccauuaucaaugaguauugacaaacagaagagguaucagagauuagagaucaacaaugaacaguuuguaaaugaagggagaaguugguuuccagaaaauacagacuauuaaaguugauaucacucauugaucacuagcaaagcucuaggauaaauuucuaaucagauaauuaaugaccacuuauaagaaagaaguugugauuaacaugacuuuaguaagaauauaugccugaucaaucccaucucucuuuuuuccuuaaaaaagaaaaaaauuuauuuauuuauuuauaguuucaccgaguuccaggagcaauuuaagaugacuuaaacaucuuuaaguuaauuuacaaguuaauuuaaguuauacuacacuacacuacaaguuaauuuaaguuacacuacacuuaaauuaagaugacuuguacacuacaauauaaauuauaacaaaaggaguagaaaacaacuuacauuuauugugcuauauuccagguccuuuacuaagcaguuuacauguuauucuguuaauucuaagcagaccccagaacagucauucaaccuguuuuuuguaagcugugugaaguccuaguugcuugcaucuuaagaacucuaggcuggcauuuaacaugaaagauucacuuguggcagaugugaagauauuuuagagcuaugguucucaaaacauuuugguaauagaaccccuuuauuuuauacucuuaaaaauugcugaguaccgcaagagagcuuuuguuuuauaugaauuauaucuauugauauuuaccauauuagaaauuaaagcugagacauuuuuaaaacucaagaauacaacauaagcucguauuccaguagcugucagggaugacgucauuuucacacuucauguagucucuggaaaacuccauuguacucucaugagagaaagagaauguaaagagcagauaauuucuuaguguuauuaaaaugguuuugaccuugguggcccucugaaaaugucucagggacucucaugggaccuccagaucacacuuugagaaccacucacucuuuuagaggaaggauucaacuaaccuauagagaucagguuauggaauccugcauucuagauauauccaaauuggagccuaagcagcauuccaaauauuguugacuugccagagccuuuauaucucaggcagaggcagagaagugccaaaugguaauucuaaguaaucugcauagagugucuuucauguuuuaaaauauuuguaauauuacuuaagcucauuaguaaacccacuagugcagauuaaaauaguuuauaagccaaguucuuacaauugcugcuucuggaggguggacuccugauuuagguucguucagaugcuaaccaacugcuucuggauuguggggguugggagcaggaguggagagguguauuuccaauuaggauacuuuaaaaaguuagcucacugccccaaggguguggauuaaaccuaaugcaaugugugugaugcuuucuuugccgaagcauuuuaaagugauaugcugggagagcuaauaagacaccugucaaaaacaaagggaaaugaaucaaaacuacuauuuuuuuuuaaguauaagauuuaacaaauaagaaaaaaguccuaugcuuagugucauugaaccagguagacaaauaugaagcuggagagagaacuggucugccuuuuguuuuauaaagauccagagguuuugauuaacuacaaacaguaaacuagcaguuuaauguaguugcugagaaguuaacgauagcuuucagcuaacuuaauagaaauacagugaucaaauaaaggagauagugguuacauucucugggggauuagaaagaccacacaucugccagucucagacaucuauucugaaaguucuuaauaccaggccacugggcagcuggcacauauuuauauaauuuauagcuauugguauuuaccauauuagaaauuaaaacaaauuuuuauaucagcuguaugcuucaauuucauuguuaugugaaccaccuaugaauugcagauccuggauggcuucagauuuauuuugggcuucacucuuuuuuuuuuuuuuuuuuuuuuuuuuugagacagagucuagcucugucacucaggcuggagugcaguggaacgaucucugcucacugcaagcuccgccucccggguucaugccauucuccugccucagucucccgaguagcugggacuacaggcacccaccaccacgccuggcuaauuucuucuuguauuuuuaguagagacgugguuucaccguguuagccaggauggucucgaucuccugaccucgugauccgcccgccucggccucccaaagugcuggaauuacaggcgugagccacugcaucuggcccacucuuuuuagcauuauuuucuagaaucaugauaccuugcuacuucauacucuuaaguugguugaccuuugcgcucugauagcuugugcuuucuuuuuguaugcuaccuuguccacuacggucaagucagcucaccucuuagguccagcuaauucugcuacuacccaaccauaugugaccuauggcugauaaaagcaucucugcuuuuuuguuuucuuuaagauucagaucucggucugucacccaggccagagugugguagcacuaucauagaucacuauaacuucgaacuccugggcucaaauaauacgccccgccccgcccugcaccuuccccccgacccccugcacccugccucagccuccugaguaggugagacuacagguaugcaccacuucuccuggcuaacuuuuuuuguuuguuuuuuaagagaugagagucucacuguguugcccaggcuggucucaaacuguuggccucaagaaauccucuucccucagacuccuguguuacugagauuacaggugugagccacugggccuggcucagcaucuccacuuuuuaauguauuguucauguaacacucagaaucuuaguacuugauuuuuugggugccacauuuuaagagacacaaggacugacuagagauuaucuacaggaagguaacuaaacugagaagcuaguaaacauaggauuguuucacagugugacccagccuauucuggguuuauuuccugcuacugucucuucaggcagucuuucuucaacucccacuaaaucacccacagucucccacaugugcauuucuuucaaguuuucauucuuuugcacaggucccuuuccugucucucccugguaaauuucuacuuuaauuucaagacccaauuuaaauguuuucuccucccuaaaacuuuccauucauuuuccuagguauuuucaucucuggguucccacaguacuuuauacaugccuggauuaugcauucaucaaauuaugaucuaacccaagugagcagacuuuuucuauaaagggauacauaguaaauauuuuaggcuuugugggcuacauggucucugucaccacgacuaagcucuucuguucuagcgugaaagcagccauacaguauagaaauaaaugaguaugacuguguuccaaugaaacuauuuauuggcacuaaaauuugaauuucauacaaucaucauaugucaagaaauauuuuuguuauuuucucaaccauuuuauuuauuaauuguaguuacaaguaacaaccauucccagccauuuuaaaauaggaaaacgauucauaguugcagagguguacaaaaucaggcagcaggcuagauuugguccgcuggccauauuuuccugaccucaaucuaauucgauauguuuauucuuucagucacucaugcaaucauucauuuauggaacaaauauuauuugcuggauauucuucuagacacuaagaaggcaguggugagagagacagacauauauuaagguagaaucuuucuucugcauuagagcuugcugaguucagggauuuucugucccaucucuguaccaugaaugguacauuuccugguacauuuuuaagagauuaaauaaugaaugacugaacaaaggaaugaccuauauaaaucacagcugauuauuucuccuaugacuauaugauuacaacagcuuauaauuugaguaugagagagaagugcuaucuaaagagaagugagugauaaauuuuaagacuguuuugggaaaaucacuguugaaucuagauaugaagcuaacauuuauauuuugccuguuuuguugaugagagugcuaucaaaguaguauacuuugagauuuauugccauuugucugugaagaaucuggguagauguauaaacuuuuggggaggagaaguuuuuaacuaaagggaaguauuuucauuauuuggaugugccugauaacagcuuuauauccaacaaaugguguauuauaaguuuaaaaccucagguuggauuauaguaacacauuauauuaaguaauucauuacucauaaagauuaauuaguuauuuuaaagauaacacauugcauuuguuguuuuucaguguuacagcuuacaaccuuaaaauacuuguuaccucacacagacaguuuuaaucaugaaaauaugauacaugcuucuuuucucuuuauaggcgagauaagcuuuggauuugcauggaguuuuguggaggugguucuuuacaggauauuuaucacgguaagaccaaaguuguauuuuuauagggguuagguugaauuucuuaaaauacagcuauuuacuauauuaaaacaucaacauuaucuuaaggaaagcaagcuauguuuuauuguuauauuguuuggcuauauaaagguauuuuagauauagguggaagaaaggaggagucuuugcuuuuuaauuuggaaaauuaaaugcauuugaauuauuugcuaauucugcagaggcauauuguagucauuucaaaaauuuaaacucagacuuguaaaaauucaagggcuuugcuggcuaaugcuaagcugguaaaauauccaguguauacaugaguagugauaauacaaagauaauuuauuuugcucucauguauucaagaaauaucaauuaaauguuuauucucuuagauacugccagauuccgagggauucaaaaaugauuaaaacauuuuucacugggauuucaaggaguguauaagagauuuguaaaguaaaauagccuuuucuuuuucuuccuuuucucuuucuauuaguggauuauugucacaaacuguagaguaggcuuuugauuaauguaaaauaaaauaauaucuauuuaaugucuauuuucugagaaaauauuguggaccuuuuuucucauuuuuucauagaauuugggcuccuauuuucuaguguggggccacuuaaguaauuugaggggugaauuacacuaaagcagagauguaagacuauuugggucagaauuuuacuguuucuauuuuacuucauuucacuuuaucuucuuggcauagguuuuacuuaacauaaagauugacauaauaguauuuuacugggauuacaguugaaauagggaaaaggaaaugauggauuuucuggaaucauuuuagaaaacuuaauaaagaaaauaagcuacuuacauuggucuuuaaaagauagguaaacucgguagaaaaaggaugaugaagggccgggugcaguggcucaugccuguaaucccagcacuuugggaggcugaggcgggcagaucaccugaggucaggaguucaagacuggccuggccaacauggugaaaccccaucucuaccaaaauuagcugggcaugauggugggugcuuguaauccuagcuacuccaaaggcugcggcgggagaauugcuugaaccuaggaggcggagguugcagugagccaagauugcaccguuggacuacagccugggcaacagaacgagacucugucucaaaauaauaauaauaauaauaauaauaauaauaauaauaauaauaauacuagaaagacaaagaagugcauuuucagagaugaagccuuggcacaguaacaugaaggugugacucaugugugaucacucuuguugguguggguguggggucgaauagggagagccuugaagaccaggugaaagaguaugagaagguuucugcuuuaugaaaaguuacuuuuuaaggauacuuuuaauuaaguauaguuguucuuugauaaauauuugagaaacuuuucuuuauuauuuguggcauuuugauuucaaagauucagugaaaaugaagagauaucuggcauuauuuuacaugacaaaacaguauuucuagaagcuuguaauuucuauguuagaaauucaaauggcuauuccacuuuuuuuugguuggaauuugggugaauuucucuauuauugauuuccuuacuaauugguuuaauuucccuuuugcugaauuuuuuuuuuuuuuuaaacggagucuugcucugucgcgcaggcuggagugcaguggugcuaucucggcucacugcaaccuccaccucccggguucaagugauucuccugccucagccuccugaguagcugggacuacagguuccugccaccacaccggcuaauuuuuauauuuuuaguagagauggaguuucaccauauuggccaggcuggucuugaacuccugaccuugugauccgcccaccucagcuucccaaagugcuaggauuacaggcaugagcuaccacgcccggccuccugaaguuuuuucagugauauuuuagugguaaacuuccucaguguuugacccucaguauuaguugauuauuuaaguggguauagauagguauuuucuagguugacagguauuuucuuucagcauuuugaagaaggugggccauugucuuuuagcuucuaugguuauuagaaccuucugucagucuaauuauugauccuuugcagguaaucuguucuuaucucuaauugcuuuuugucuuuuucucuuaauuucuggugccuaagaauggguuuauuuuuacuuuuucugcuugggacuuaacaggcuuaccucugugaauuuugcucuuuuaucacaucuggacaauuaucaauuauuaugucuucaaauauuuucucccccaaucugcgaucucuccuuuagaaucuuaguuagauguacaguaggucuucaugucucuucaacucaauuuccuauuuaccaguuuuuuauccuucaggagagccuggagauacucauaucuaucuuccaguuuacugauuuuacagcuguauuagaacauccauuagauuuuauuuuugguuaccauauauuuucaugucuagaaauuauuugguucuauuuuauaucucccuccauuauuuuuuccuuugugucuuauucuuacaguuuucauuccuucuuuuacaucuuuaguuuuuaaggcguaccuuuuuuuagucauucucagauuguuuagugauuucaucauauauccauaugauuggucuuaggugucugauucugcuuucuucauuaagaagcaagaccaguuucguuacagaaauagguugucaugauucuuaccauuccauuucaaccuaacugguaaaaguaacaaaguaauaugaauucgucaauacugauuuauuuauacuggucagcaacuggcucaguggaaaaaaauggcaguuuucagguacccuggauguucucauauaugaauauuggggauucauaugcuuaugcagaaccccaaauccuaucuuucucuguguucacucuuuuggcuguacccauguuuucaccaaauaaccuuuucguggcaauguguaauaaucuuuggcuagucuaugguguuguauacuugcacggucauguaggacacguaccuccauuucuuucuaugugucucucucuucugccucuuuuuuaucacauugucauuauauagagagaguauuauauccuggaauaauuuauuuaaugaaggggaaguucuuuuaauaauccuagugcuugcaagguuuccccuuuaacuuuuauuuacuuuuacuuugaagaacuaacaguagaaccuuuuauuguuccaacauaauaggauuuuuuucuauuuuccauugagcuuuuuguguuuguuuauuuaauauuguucuuuaauaacuuuccacaacccguuauaucuuuaugguuaauuauuuucucacuuauuuuauaauuuuggauuuugagaucauuuuuagugagguuuuucagugggaauucuauguggcauuugaagauguguccuuccagaguuuuguuuuuguuuuuuggguuguuguuguuuuuuuucugggauccuggugaccucauuguuuccaauauauauuugaaugcucaaccugaguaaggaggccuauggugacaaauucuaagaggaggcauguuuccuccaucccuaugacagccaaaaucccuaguuaucgucgugcuugucuacaccuuuaaugaggauguagcccucugagacuucugguuuuauguggguguuuguuuuagcucuucugcauaccuagggccuugucuucuguacccauguagaggauaaugcuaaagcccuagcuuaccaggauuaaccuuccccuaagagacagcuagaauauucuuucacaguuuuaccuucuguuuuucauuugucuccugggaaaguaucuuacuguuuguaaaguuagcuaguaauugaaaagguuauuucugaaaaaaaaauugucuuucacuuccaaguguuauuuucaggguuuucagauuaucuuauuuaucauauuauagaaacagaaaucucaaggagguuuaucuuacugaaugugugugggcuuggaagccacagaaauaaguuacaugguuuauccauagacauuuaaacccaacccgguccuuaaaauaaucuaauuggaauagauuucucucuuucauaauuguaaaauaccacaaguacuccaaacuaaacauguuuacaaaucuguuaaguuuguguaaaugugaguuuacuaucuagccaagguuuuuauccuuggaauuuaauucaauuucuagaauagucucucccacuuuuuauucuaaagugauuuaauagugaaaaagaaaacuauuuuaguguacagaugcucuguuugugcugcuauaacaaaaugccugagacugaguaauuuauaaacaacagaaauuuauuucucacacuucuggaggcugggaagugcaagaucaaggugccaacagguuuggugucuggcaaggacccauuucucauagagugcacacacacuguguccucacauggcagaagagauggaagggcaaaaaagaguagacacugcuugaagucucuuuuauuaagagucuuaaucuccuucacaagggaggagcacucaugaccuaaucuccuccucaguguccugccucuuugagauuaaguuucaacgugaguucuggagggacuuagcagaugcauacacaggaaauauuacuuauaagauuaagaccuauauauugauguaaagguguucaucguaagugaaaagaguagguuucagaauuguaugauuccacuuauguaaaguuucugagauacaaauaguuuauaaaauguccguuuaaaauagucugguagguuauagaccaaacuauugguauugcuuacuguugaguaacauuuuggauaaagaagagaccuuuaauuuccaaacuuuucuauugauuggaacuuuagagugaacauguauuaauuuuauagcuaucuggcuaauauuuuuauaagaaguauugauuuaaaacuagucauaauacauguucuauaucaacuaaaaagcuuuaauaaaagccagcuaaaccuauuggacaucguuucuuuugauguuuaagagaugauauugaugaaugagauauaaaaaugagaauauaauuaauuucagugacuacuuuagacauucauucauuccauaaauauuuaucaggcugcuuuucugugccaggcacuguucugcacacuggagauacaacaaugagcaaaucagauuuuuaaaaagcaaaaaauuggcugggcacaguggcucacaccuguaauuccagcacuucaggaggcugaggcaggaagauugcuugagcccagaaauucaauaccagccugggcaagauaaugagaccccaucucugcaaaaaaugaaaaauaaacuagccaggugugguggcaugcaccuaugcccccagccacucaagaggcugaggugggaggaucacuugagcccaggaggucgaggcugcagugagcugugauugcacuacacuccagccugggugacauaaugagacccugucucaaaaaaaaaaaaaaaaaaaaaaaaaaaacuggagccaggcacaguaggacaguaguaauucaugccuguaguccuagcuuacauuucaguagaauuguuuagggauauuaagucuguugcuuaaacuuguaaaacuuuauuauauauugaaaaacaugcguugacuaauuuuaugaguauuaauugucuucuuuuacaguaacuggaccucugucagaacugcaaauugcauauguuagcagagaaacacugcagguaaaucaagugcuaauucaaaaauaacauuuuucauuaaacuaaggcuuuacuuacugugcauuaccuguucagcaaaguaagaacuaaauauuuuaguuugguaaacucuuaaaaugaguuuuaauacauuugaaaauuguguaaugaacucaaauuauauuuacaaauaaauacuuuaaagcauaaaugugaugauauaaccuaaaauuuaagcacuaugcaucuguuauuguauauuuuccucuuaauaccaaagaaaggcuugaaaauuaagcacuaucaugggaauucaaacacucugauacuaauuagguauauacuuuuuaaaaguuauuucaaacuauuuguagaauucacugaaaauuuucuuagaaaaauuagucauuuucuugaucuuuuuuuaggauaucucauuaaaauauguuaaugauuaguacuagaucuccuguaaagauuaaauaaaauacacagaauacuacccauuugauuacauaaaauccaaaagagugcucuuugauaaaaucuuguuuauuuuucuguuuuuugaaacuccagggauuauauuaucuucacaguaaaggaaaaaugcacagagauauaaagguauacauuauauuuuuaacauaauaacccucucuucauuuuuaaauacucugaucaaauuguuuugagcaaaauuguuuuauuugauaaaugcaucugaaauguuaccauaauaaaaaugagugauacuuuuaauaguuuaauuuuuuauagcagcuuuauugaggcacaauucacauaccauaaaauucacccuuuuaaaguauaucauucaguagauuaauguuuuaauaacucauuuuagcuucuuuguaguuauugauuaguaaaaugcagaguaagcuuauagcuuucaucaaguuauaguuuuuaguaaguuuuaugcuuugacuauuucagugagcuuucgcagucuuaagucuaagucuuaguaaugcaucaaaauggauaaauugaccuuugacacuuucucauagucuuuuuuuuuuuuuuuuuuuuuuuuuuuuuugagauggagucucgcucuguugcccaggcuagagugcaguggcacgaugucggcucacugcaaccuccccucccggguucaagugauuccccugccucagccucccgaguagcugggauuacagccaccugccaccaugcuuggcuaauuuucauauuuuuaguaaagacaggauuucaucauguuggccaggcuggucucgaucuccugaccucaggugaucaucccaccucggccuccuaaaagugccaggauuacagacgugagccacuguguccugccuucucauagucuuuuauuuauuuagcuggcaaaggagagcaggugcucugaaugugcugggguuagcccagugguacagcaugugcucugguaggaauccuuagcauauuucuaaagauacugccaucuccccaguuuagauuuuuuuucuuucacuuauuuuucuugugccuucuuuguucauccuuccucauauuucucucuuccccuuuuguuuucuaacauuuucucuaacauaaagauuuuuaaccuuuuuugaggauagaggcuggggcaaaucuuacuguccucuggguuucugaugauaaacuaugaacugucuucugagaaaaugcccuuaugcgcaugucuucaaauuuuccaagaaauuucaauggacucgcagauaaccugcugagaucccuuguuugaagguauuuuuuugugauccacuuaaaagacauaaagagcuuuuggaguucaaagguagaagagcucacaggaagaugagcagcucaagaaagguucugugucauuggcauguagaugaucugggaggauugacagauuuuugucagaaauggaaguuggaguacauuucaagcagagaaaacaaugugagcagauacagaaguuagaaagugugaggccauuuuagagaacauaaaaacuguaccauauuauugaagagaagagaauguaugagacuaauuagagaugggacugguuggguaguuugauguuccauuaugcaaggacuugugugcuagacuucagagucugggccuaauuggguugauuugauuugggucaucgccaccauuucuacuccugucuaagccaccauaauauuauaucauguggucuuuuguaauagccugaguggucucaaugcucccauucuuagugguuuuguagucacuuuucugcuuggcgaccaaagggaccuuuucaaccauaucuuaucacucuccugcuuauaaaccaccauugcuuucccauuguacucaguauaaaguccagaugccuuuaccaugaccugcaagguuauacguggucugacccaugcauuucuccgugaccucaucuuauacuccagguuucucuguuuuacucauucuuuuccagccacacuaaacuugccgaucuuagaauauguugagcucauucuagccccaggucuucaaauuuccuccuccuuuccugaaauagucuucucccagauuuugguguggcucuguacccuuacuucacccagaucucugcucauauauuacugccuuuggagaggccuucccugcugugucuucagaguaauuauuucuaccugacuuugaaucauuuguugauucauucauucauagaugauaaauauauuuauuuuaaguuuuuuccuccuacuuggauguaaacuccaugggaauuggaacuuacucauuauuguaaccccagagcuuaaaauagcaccugacuacuaguagccucucagggagggaaaggagggaggagagaaaggccauaauguacaagugaugugauuauaagcuauaacuuaggaaaguuagucugagcugaagaaaggccaaacugaagccucugacagaagucuuagauagcuagguacuagaucaaguuaaaaucccugcuccuagucucuuuccuuuuucuccuuccccuacuauuccacagagcuacaguaguaucagugggugggugcagcucagcuucacuggugacauuuggaguuuaggagccuuuuuuuuucuccccaacccccugucuccugugccagucuuuuacuguuuuuuccucauguugguugagaguaggaggguucccaguauuuuuuccaccaaacccauacuuacaugauugauggcaccuuggaccaaagagcccacaauaccuuugggauauaguauugcuaucucuuccaaaagcuuugagcuuauugaagaugaagucaucauuaucuacuuugagcuuagaucaagaagcaaaaguggcuaaaaugcaaccagaucaugcagaggggugacauuuuaauuuugugggccuguggcuaguuguuuauguacuggaugggccuaagcacuugguaaggcacauuaggauagacaaccucauguacuaagcagcaagguacagucucacauaccaacccugguucaauugauggugaguuccuagaaagggagguucuuuuaaaaacacacacacacacacacacacacacacacacacacacaaaaaugggaaacaauaaucaaguuuaaaguguaauguaaacaguugaaaaugcauuguacgguuacauuauaguguggugauaguguuugaucaaugaggaaauaacauuuugaugaaaacuaauauaucacuuuuauauuaacauucauacuauguuaguagcagcuuuuuugcaaggcagaacauuuuauaaagauagucaaguugccuaaaaaguggacaguagauuuaccuaugacucuaaugauacgacauuuuaauuaagcacacuuuaaguauuucuaggucuaaggcugugauuauuuuaaauauguauauuuauuauauaugugcugucugauaaaauaucuauuuccuacucuaacuaaaauauuguuacuuugaagggagcuaacauucuauuaacggauaauggucaugugaaauuggguaaguaaauuggaauuuugucacgugcacaaaucuauucuaagauauaguaaaguuuauguuuuccuuuguaggaccagguuuucccucuccuaagacggcaucuguguauuuuuagauggaaaucucguugccaugcugucaccucucugcauccacuucucuuaaacagggauaaagucuguccuucacauaagacauaucuguuguaaagauacugugaaagaauacccuuucugaauucuuucaccucuaaacccaggaaugugacuucuguaauaguaagaaaucuguacagaauuaccuuguaaccaaaaaauaagacaaauaucaaaaaaucaguaacuccaaaaacacuuuauucuucacauaaagcuuuuaaaauaaaauacagcauuacuuacuuaagaauguaauuuagaugcugaauguugcuuuauuucaaacaguaacauauuucauuuuguaacuguagguuguuaaauuuucaauuaaaauagaguucaaaaccuaaauaaugacuuaauuugcaaguuuaagaacaaguguucguuauaguuuuaugaacaaagucauauuuguuaguauuaaaugaaauaguuaauaacaaauagaaaacaguuauuuuaaacuauaucuauuagauaaacccaaauuaaaaauaagcauuuuauaaaaauauagauauaacuauuuugaacuauaaccugugagauuaaucagauuuaagaauauguaucuagaaauuaacauauaauaaaaauuuccuccgugacuucuaaauaugggaaaagcagaaaagauauguccuguucuuuuuaguuaucuauugauugcuuagugaacaguuuuuaucagcaguuuaauauuuugugccagugugaugugccucacucaaagacauacuauuuauaauauaucuuacuugagaagguuuuagaagucaucauuaguaaacuagaaaauauuagaucuccaaauacuuaucuaaaagaauaguaacaaaucauacauaaaaauaauuuccugauagugacugauacugguacuaaauguauuguuaaguuuggggauauucugauuggaugucuuuucaagcugcaaguagacuuacugguuuaucugaugucaaucauggguauggagaaagugaauggaauauaaugucucuuaaagaucccuuccagugauauuccuuggauuucugguccugagaauuagaaauuacaauauuaauaaguuuggcaauuuacauucucucagcuaucacuuucucuucaaaauuauuugaucuugaccuuuguuauuugauuuauguggggauauaugggaaucuuauuuggcugugauauguauucacuacuuugugauauuuuaaugcgaguccauuaagguuaaaauuuguaaugugauguuugagaauaucccguauugcuguaaaauuaacuuaauaaaaauaacuuuuaaaaguuucuuuuuauguugccuuaaacaauuuuauuuucucucaguuuccuaaauguuucucauuuuuuuuaauagcugauuuuggaguaucugcacagauaacagcuacaauugccaaacggaagucuuucauuggcacaccauauugguaauuguauuuuaauugauauuuaauacuuuguucuaucauuauuggauauagcauuucuaaaaaauagacuggucagaauuuuucagacuaagauuaagaaaaaagucaucaacaggcaaaguaauucaggcauguacacuuauggguggauuacauggccagaaaauauccuaccauguuauuuuucacuaaggagaaaaggcuuuaaugauugauauggcuuucagaaaccuuaauauuuguucuagccuugcuggaaaauccugacucuuuuuccuguacauuucucauguauuuucacagguguuuuuauaucuuucuucacccccauuuccaguccauauugugauuaaucuuucaacauuacauuauucaaguaccucuuugcuaaaaacuuuuuggcaugucuugguugccuauaggaucaaaugcagauuucuugacaguugagucuucugugaucuggccucugucugcuucauuagccuuagcucuuaccagucuucuccauggaccuuccuuucuagccauguuugucuguuagauacugaucauaguauaaaaacuauccuacucgcauauuuauuuacagaauaguuuuuggccgcuuacuaugcuagaugugauauuaagcaguaugaugauaaugguggauugguauagagcuuuuuuuguucauaucauuacuuugaaguaacagcacccuggaauuccuaccuugcuuucagcuuaugugcaaccacuccccugaugcccucuucaucugacucaucagcagucauauagcuuuaauugcuacuacuaauuuuuuugcauuuagaauaugauguauauaccauuuucaugucagccuaucuuuucaucaauauauauuuuaaaagucaaauaaugcuaaaaaggcauaugagaaaaacuuaguuguaacuucugccaucucuagcauuauucauuuacagauacugcguuaugacaguugaagaucuuagcucucuucauucaucuuucaaucaucuuaucuuuccaguguacuuugcugagucaauuaacaguacuuuccugaaaaaagcuuuuccugauuuuaauaauuucauuuuaaauuuacuuaguuucuuguuucuguuuuuaaaucccugauuaacacuuuccauaccuucccucauuuugcaguuuuguaagaugccucuguauaauuuucuauaccauaaagucugucacauuaucugucagugcugauuuuugucggguuguuguugcuuuauuuuuguuuuuguuuuuguuuuccuagaauaauccuuccuggagucauuuucccuccuguuccagccuggacuguugaauucucuagcucuuuugccuggcucugcucuggcagucuuucaucuucagcuuagcauuccuuucuuggauucuaggucuucuucuuucaugauguacuccuuccuuuuugugugugugaaacacauuuuaauaacuuucugagaaaccgugcaugggaguaacauuuuugagauuuugcauguguauccuuguacaugauugauaauuuugguggguaauucuaggauagaguuuuugaaguauugcacuagugucuucuguggugcccauggugugauaccauuaucuaugaucuauugaauguaacuccucccccuagaaucauuccugguguuuugauauuccauaauuauauaccucaaaaaauauuuuuuuauuguuuuuacuuuuauucauuguacuuggcauuugugcuuuauaauccaaagacucaugucuuuucaguuuugggaaguacucuugugucauuucuuugauaauuucuuugcuguacuuuuuccugcucucuauggaacucacugguuguaucuuggaccacuuaaauuaaucuauuaauuuucuuauauuuucucuaagaacaaaaaaaucuuuuuuguucuacuuauaagaguuccucaacucucuacauucauauuuucaugauggagccuucccucaaauguccacuaauccuuacauuuugguucacuuugaagagcauggcacuaaaaacugguucauaacucuuuuuguuugggaagucggguguaaaccugguuguuauguucuagaacuggucaagugaaggaagcagagauguucauuguucuauauacguacuucuacuuaaucauguccucucccuuuaaccucuucacuccuugguuccuggugucucuugagucugcagucucucuucuucgucuugguccuuauccagugggaauuggggggcaauaguugcuggggcuuaauggauaagaguaggaaugccagggacugacuguugacacuuucuaauacuccuguuuccagcccaaccucaacccuacuauugcuacuuuuuaaaccuagcuugucaacauuuccaggguauuugaggcucauuggcugcuaguuguuguucuuuuccuuggcaccugcuuagguuugcccugccuccuguuugcuacaucauuuacuauucuucuguuuuuagucuguguguuaugguuuuaguuaaaauaugucugcuggacuuuucaaagaugguauguguauauauuucucuuuguucuucucuuuauuguuuuggguugagcagagugagggcuugaauugcugucauuuuuaaguacacugucuucucaguuuuauuguaaacaucucauuaaaucuucaggaucugacuugauucuauacaauauucauucacugaauguuaaugaugaaauuuccaacuccaguuucacagguuaaaaauuuaugucauuacucuuggaauaaugugggaaauaucuugggaacaugugaaauugugaauuagguaaaguuaauuuugggaacacucucccuguaucugucuuucugguauuauaucuuuccuaccuaaaaucuaaaacuuuagaaccucucucuucccaagugauuagaucggcaguuauucaguuguucgaaaaagucugcuugaaaugacaguucucaaaauuaaacacauauguaccuuaaacauuuuauuucaauuuaagacauauauguacauuuauucaacagucuuuugauauagaaucaaggccuuuucuuagaguagaucacuuacuagaguuccauuuuaguaaugcaaaccacacacaccccaaugcaucaacuacauuucuuagucagguuuauugaggcauaaauuuacccuuauuagguguacaguugugcaaauucauacaguuguaugaauguugaaaaacuuguaugcuguggugguaagaaaccaccagaacacauugacacuauccaaaaaaucuuuuauuuugccccuuuuuaguaaaugcucuaccuccauccguagcaucugguaaccccugaucugauuucugucucuauauuugugccuuuuucuugaguggcauagaaauggaaucauauaaucuguagccuucccaguuuucugccauugucauguucuuaucuaacguaccagguuuuuuggcucaucuuuagaaauuugccuuucuaaaagcgaagucuuucuaaagcauucacuaauuuuuguuuguuuuuguuuuugguuuuugagauggggucucacucugucacccaggcugaagugcagucgugugaucucagcucacugcaaccucuacuucccaggcucaagcgaucgucccaccucagccucccaaguaacuagaaccacaggcaugcgccaccaugcccagcuaauuuuugcauuuuugguagagacgggguuuugccauguugcccaggcuggucucaaacuccugagcucaaaccauccaccugccucggccucccaaagugcuaggauuacaggcgugagccacugcucccggccagcauucgcuaacuuuuaaaccuucauuauaacuauguguuuacaauagcaaauguaacuggaauaaacaguuucagagaugaacccaguugacugugauaagcacacaacuuagcuggcuggaguagacauguacuaaguguaauguuucccuuguauuuacauagaagaagggagagcaucagcuaauguggugaacuaguaaggggaggcaaguuaggagcguaucacuugcaugcauuucccacuccacuagggcauuucuaccagcuacuuggaaucuagucaucauaaaaguaauaacugacacuuugaaauucgcuuuucuuauaguaauuuaaauuuucauaagaucuguuucagauuuaaaagauuuuaagaccagggguuuugaaaguuagaggguuuuuuguuuuugacuuuacugacuuacuugaccuuccugaaaucauaccaggaagauaaauguguauuuguaagauuaucuagacugcucuuuaguauggaagaguugagauguuuauuucaauuaguugcuuuuaaaaauauuguuuaggauuugaaaauuuuuguauuugauaauuaauaguuuaaaucagucaaauucaaauuuauggaaguauaauuagaauaagacuguagcaaaguaaagagaaacaaaaaaauuacugaauuuggguaacuuuccucugaauaaauacauuuuuuaaaaguagacacuuguuuuuauaacuuuuccauuauuauaauagaacuagaaaaaaugccaaauaaguuuuuaguaaauaugaauuaaauacuaaauaugaagauuauuggugcccgacggaauaguuuuggugaaguaaaaacagggauugccuggucgcaguuuuuugauaacaggaaguagagcuauagguugcuuauuacgaauauuauuuauugaauuuugcauguacagagagauugggagcaugaaugauuuuggacguguuggucuauuagaauuguauauuuuuauaaaccuuuuuaguaacuaguauaaggaaguaacaauggaaucagcaauaggggacugaagugcagagucuuuuuuaaaauuuauaaacaaagguuugauugacucacaguauuguauugcauggcuggggaggccucagaaaacuuacaaucauggaguaaggcaaaaaagcgggcaccuucuucacaagguggcaggagagagcacucgggaaacggccacuuuuaaaaccaucagaccuugugagaaccugcucacuaucaugagaaaagcauaggggaaacugacccaaugauccaaucaccuccuacgaggccccucccucaacacauggggauuacaguucgagaugagauuuggguggggacacagagccaaaccauaucauucugccccugcccaccccccaaauugcagguccuuuuuacauuucaaaaccagucaugccuucccaacagucccccaaagucuuaacucauuccagcauuaacccagaaguccaaauccaaagucucgucugaggcaaggcaaggcaagucccuuccaccuauaagccuguauaaucaaaagcaaguuacuaaugagggucuuaugagaugucaagaucuuggaaaagguggaccuuuuaaguacugcauauuuauuuuucaaaaaccaaggccuaaagaggccuuaauuuagauagugauaauuccuugugccucugggugggaguauaaaggaaaacauauaacagaaguuuuuuauuuucuggaauauuuauuucaggauggcuccagaaguugcagcuguugagaggaagggggguuacaaucaacucugugaucucugggcagugggaaucacugccauagaacuugcagagcuucagccuccuauguuugacuuacacccaaugaggucagugcaucaucauugaagaaucuuacgcuuaagguuuuuauccucuuaguaugcugucaugaacaaguaauuuucuuagucuuguuuuaccuuauuuggggaacaaauaguaauagaauuuguguaauagauaaaaaugugaaauauuaaaaugcuguguaaugauuuguugauuuuucagagcauuauuucuaaugacaaaaagcaauuuucagccuccuaaacuaaaggauaaaaugaaaugguaaguauuuuuauguuauuuacuuuuauggugagaugagcaaaaaaugaauuggaauguaaaagucuaauuuucuaaauuucuuaggucaaauaguuuucaucacuuugugaaaauggcacuuaccaaaaauccgaaaaaaagaccuacugcugaaaaauuauuacagguauuauuuuugcccugaaauauauauauauauuucaaaagauaaaauguuauucaaucagauuuauaguaaguguucugcauuguauuuaauuuuuauagcauccuuuuguaacacaacauuugacacggucuuuggcaaucgagcuguuggauaaaguaaauaauccagaucauuccacuuaccaugauuucgaugaugaugauccugagguaggaauugcuuuuaccagcgggcauauauaacauguauauguguauguauauaugugugucuguauguacgucucaaaauccauuuuuuuaauuuuggggccuaguuuaaauaaaaaagcucuugagggaacaauuaauucuuugucuuugccuuucauggaaagucaaaugcuagguuuuucuuacugacuacuuauaggugacuauagugugaaaauggcaaaggcauaucauuuaauccacuuguugaaaucacuguaguuauuucaaaauagccauuuuuggugaaguugccaaauaaucauucacuguaaaagggaaagcaaaugggaagugccuaaacaagacauuugaauauucaaaauuuccccucaguuugcuucucaaaaagaauccucaguuuggccugguggcucaugucuguaaucccaucacuuugggaggcugaagcaagaggauuacuugaggccaggaguuugaaaccugccuggucaacauagcaagaccccguuucuaucuuuaaaaaaaaauucuuauauaauacuucauaaauuauuagagguuaguaggaaguauaggcuugacuuugccagugacuaaaacucagcuauucacuauggaaauguuuuaaaaugagccaguauaguuguuaauaaaauaauucuaauaugacagaagcauugauauuaauggaagcuucacuucuguuugcauauguaacauuccuagcacugcuaauaguuguggcaaccaagauaaauucaguauaugugacauggcagaauucuguuauugggucuguaacagaaguggauaggcuuuaacucuacuggcuuuaugggaggcccuuaaaaauauuguaaauuucauuaaugacugaaggugaaguguuuagaaagacggccacagauugucuuaagucagagagaaccuuucuaucaauucagcauugucccagcuugccaucuuaugauagauaagcuauuuguccuuuuguuuaagggucuggaaaagaguuuggagcuuaaaaauguaaggaauguaaaguauaauuaaucuuauaauuauacucugaagaaguuuuuuuuguuuuguuuuuguuuuuuuuugagaugagucuuacucuauuacccaggcuggagugcaauggcaugcucucagcucacugcagccucugccuccuggguucaaacgauucuccugccucagccuccugaguagcugggauuacaggagcccaccaccaugcccagcuaauuuuuguauuuuuaguagagaugggguuuuaccacauuggccagguuggucucgaacuccugaccuugugaucugccugccucggccucccaaaugcugggauuacaggcaugagccaccgcaccuggccugaagaaguuuuuugguguugauuugcuuaauuuuauuuuuaagaaaguuaaguuuuacaaacucuucuagucuuauuuaguauacaggcaguccuugaugugcaugguaguaugggacuguaaaaaugacugcauaagcuaaaauucugcaaaguaaucuuaauaaucaggaaaaauuauaauuguuucaugacuuuuaaaauuuuuuguuaaagcauaaacucuguuacugucaguuguaauuguagaaaugugaaaaaauaguaaaacuauuauuuacaguguauuauaaauauuagaaucaucgagaguuaauguguuucauuucuuuguuaaugaacuuuucaugcacuuuuuuuacuuaucuaguagucugcuuauugaguaguuugccuuuucaucaugugucugugacacagagcaaguaucuuuucuaugccuuggcaaauugucauauugcuuucuaauuuucuuucuaaucaugaucaugaugugcaucuguuauuuacguaguaauuugugaacugaaaggcuaccaauaaaguuuauacuuuaugcaauuucaauuaauauacagugguaacuguuauuugaaccaugauguagggaacuaguguuauuuaacuaaauuaugguaacugaaauuggugcauaacaaagcuguaaaacaaggacugccuauauccuuuucagugcacuaaaugcuacaugauuguuucuuaccucacccuauguacuugucaugucuuuuuaaaaauguacucaaagaacagaaauaauaaaccaaauagagaagcaaucuguggaaugaagauucuucuaaaacuuucucauauagcagggaaagaaacucaucuuucuuauccagacauuguuuugguauuauaauuauaaauuguuacaaaucucuaugguaaguagguaaaauaaaggaauuuaauuauuccagggguaggaugaggggaagcuguuacauucccucucacaguagcuuagaauaauguuuuucuuaagagaaauucauaacuuuuuuauuugcaaaugauuuguaauuguaauugcuaagugcaguguugucacucaaaauacgaauguaucuaagaauuucagcacuuacugugauacuagaacuauuguaugcauacucuuaaaaauaagggugggcucaguggcuuaugccuguaaucccagcacucuggaagaccgaggcagguggaucaccugaggucaggaguuugggaccagcuuggcuaacauggugaaaccccgucucuacuaaaaauacaaaaauuagccgggcaugguggcucaugcguguaaucccagcuauucagggggcuguggcaagagaauugcuugaaccugggaggcagagguuauagugagccaagaucaugcgacugcacuccagccugggcaacagagcgagacuccaucucaaaaaaaaaaaacaaaaaauagaaaaagaaaaauauauauauauguguauuuaucuauauauacauauauacacacacacacacacacacacacauauaccacaucuaagucuaguuuaaguuuuuuauagguuaugcacuguggaagaaaguuugacuuuuuaauguugaguuccccuguaguuucuauuuuagaaguaauuacacacugguguaauucuaauucugauuuuuauucaguuuucgucuccuauauguaagcccacuuacuauguacagcauuauaagauuuaacaauuuuauuaaucuguuaugcuaauaaauuaauaauuuauugugcuguuuaagccgggaagguaaaacuguucucagaaauaaucaugaguuucauccauguucauuaauaacagucuguaugaguaaccugcauguuaccuguuuuuguuugguuuugcuacuguauauuagaucaaaagucuaggguuuuuccuagcucuauggcuagcuagcugaaugcccugccacuuaauuuuaagucucaguauccucaucuaugaaauugaagggguggguugccccuccacaccuguggguguuucucguuagguggaaggagagacuuggaaaagaaagacacagagacaaaguauagagaaagaaauaaggggacccaggggaccagcguucaacauauggaggaucccgccagccucugaguucccuuaguauuuauugaucauuuguggguguuuccccgagagggggaugugucagggucacaagacaauaguggggagagggucagcagacaaacacgugaacaguggucuuugcaucauagacaagguaaaagaaucaagugcugugcuuuuagauaugcauacacauaaacaucucaaugcuuuacaaaccaguauuguugcccgcaugucccaccuccagcccuaaggcgguuuuucccuaucucaguagauggaauguacaaucggguuuuauacugagacauuccauugcccagggacgggcaggagacagaugccuuccucuugucucaacugcaagaggcaugccuuccucuuauacuaauccuccucauuacagacccuuuaugggugucgggcugggggacggucaggucuuccccuucccacgaggccauauuucagacuaucacauggggagaaaccuuggacaauaccuggcuuuccuaggcggaggucccugcggccuuccguaguguuugugucccuggguacuugagauuagggaguggugaugacucuuaaggagcaugcugccuucaagcaucuguuuaacaaagcacaucuugcacaacccuuaauccauuuaacccugaguuugacacagcacauguuucagagagcacgggguugggggguaauaagaucauagauuaacagaaugucaaggcagaagaauuuuuuaguauagaacaaaauggagucuccuaugucuacuucuuucuacacagacacaguaacaaucugaucucucuuucuuuuccccacagaaaugaagaauaaugcuuguuucacgaguuuaaggauauaaugcuaaggugcaucaaaacacuuuguaaacuaaaaagcagguugcacauguaaaauuuaaauaccuaauuuucaaaauuacuuuugcuacuguuucaccaucacaaguauuuaauauuucagucuuuuaaauuuguauauuuuuucccugagauguaccuacacugugaguaguuaguuugagucuuguucuugauuugccuuauugaaucuaagacuuagagcauaauguuuaugaauuauguuuccacaaagauagaucuaagaguguaucuccuucaaagguaauacaauagcuucaaagguagcauuucacccacagaggaagcuauuggguauugcaauaauuacaugaaauagaugcugguugagagaccuuagugugaguauggagcugcaaaaguuuuuugaauaagaccucuuuuacuuccaaagguuauaguaauguucaugaauuaacauuaaauagaacucaucuccauucuacccaccuucagaauauuccuguaugaaguuggcagugcacauagaaugguuuuaauaaaguaaaaggaaagaaaauagaggacugcuccuccaagaaaaaaacauaaagggccaaaaaaaaaaaauuguguugaccaagaaaaaguaccauaaaucauuaacccauuuagccuaguguuccauuauuggaacuaggcuugugggaguuauuuauauccuacugcucaaggccaucgucaagguuugauuuuucacacaaaaaauuugcaaccucagguauaaauggguuaaugccuuuagcauuauuucauugcauuuaugucuuauccuuuugauauaaggaguugacgcagauuuuuuaaauugcagucuucucugcaauagggaaagcuacuugcaacguguaaacagcuauugaauuauugaaauacuuaauuuuugacuauuuauuuauauuuaacucgaugaacauucacuggggaccugcuguagcuaaaacauuauuuccuaaucuugagaaguucaccauuucaggagaagaaaaaacagccaacuuuuguuagggaagucagagaagaugucacaaaggaagugacauugcuagaaaggaguuugccaauaggaagaugccagaaagaccaaaguuuaaaaaauaaaaauaauggucaaagaauuggggacuuuuaaaaacucaucaagacucuuaaaaaaugauagccaucccccauaucuaaauguuugaauacacuagcuuucauaaauuuuagaaaugguaaaauauggucuuuagccuuaagauucauguaaaaaugaaugcaaucaagagaggguuacauauggauuaagagcacaucagguaugugaaucuuuguaauuucauuugucuagguucuuaucuacugcauagcagauuaguggauucuucuuacauuaaauaauagcucaccauaugacauuuauauaguagaaauauuuagacucuugauuuugaauuuuaagagauguuugacaaaauaaauauuacuugagauuuuacuaucauuaacaguuaccuuucuuuaaaaacacugaaaauauaguugucccuugacguacacaagggggauugguuccaggacucucaaguauaccaaacuccgugcauacccaaaucccacagucagcccugcaaaacccacauauaugaaauguugguccuccguauacauggguuuuguauccccaaguaaucugcauagaaguggacuucugcaguucaaacuuuuguucaaggauaaacuguacguggaaugaagaaacaauaagguuuuaguuuccguauuuccuaaaauuccuagcaauuuuuagggagaaaauugggguaaggagguucuuuguaguugugguuuaaaaaaaaaaaaaguauguaauugaguguauauacuugaaaaagaugagaagaccuaaaaguaaauuugacagcauucagaaaguauuggcauuugcuuguaggaguucucaaucugagcacuguugacauuuugggccagauaauccuuuguuuugggagggcugcccugugcauucuagaauguuuagcagcauugcuggacucuucccauuaguugccaguuaacacccuuuaaucccaaguugugacaacaaaaaaauguccccagauauugccaaaugucuccucagggacaaaauugccccggucaaaaaccacuggcuuaugucaacuaggauuuaucauacugucuaugucuuuccuucccguacaaacuugacauucucaucuagcucccauugcaaagggccuguuauuuguauuuauauuauuugaugauaacaauaaucauagaacuuuaagaugauaaaaguugaauaaacgugaaaugguuuguaagggcaggguuuuguuuuuuaucaagaaguaauaaaaauaauuguaaucacguugcauguaaagcauuguuuaaaaaaaauagacaccaugcaucauugugaauggcuuguuucuuuaaaugccauuuauuagaaagauuauuuucaucagugcuucucuaaauaucauauauuaguuacuauaagcccguuaucgcaggugucuaugguuaguguguauuacauuuauagaggaaaaaugagaguauuuauguuuagaaauuaaaggcuacauuuuaauuuuuaaaaaucuuaccauuuuuauuagugaucuugaaaaaauaauucauuacguuucuuuuucucuuaacuuuuauuuuaguuucaggguacaugugcagguugguucuguagauaaaugguaugucacgggggauucauguacauauucuuuugucacccaggucauaagccuaguacccaauagguaguuuuuuauccucacccuccucccaaccucaaguuggccccuaugucuauuguucccuucuuuguauccauguguacucaguguuuagcucccacuuaucagugagaacauguggaauuugguuuucugcuccugaguuaguuuacuuaggauaauggccuccagcuccauccuuguugcugcagaggacacuaucucguucuuuuuuauggcugcauauccguaccacauuuucuuuauucagucuacuguuguugggcauuuaguuugauucaguaucuuugcuauuguguuuugcuauugugaguaguacugcgaugaacauaacgugcauguuuuuaugguagaacaacuuauauuccuuuggguauauacucaguaauggcauugcuugguugaaugguuguucuaaguucuuugagaaauccccagacugcuuuccacaguagcugaacuaauuuacauucccaccagcaguguguaaccguucccuuuucccugcugccuugccauaaucuguuauuuuuugacuuuucaauaauaaccauucuggcugguaugagaugguaucucauuaugguuuugauuuguguuucuccaaugauuagugauguucaagcauuuuuucauauuuuugauggcuguguauaugucuucuuuugaaaaguaucugucauguccuuugcccacuuuuuaauagaguuguuuuuugcuuguuaauuuaagauucuuacagauucaggauauuagaucucggucaaaugcauaguuggcaaaaauuuucuccuauucuguggguugucuguuuacucuguugauaguuucuuuugcugugccgaaccuguuuaguuuaauuagaucccauuugucaauuuuugguuuuguggcaauugcuuuuggcaucuucaucaugaaaucuuugcuuaugucuaugucuggaaugguauuuccuagguuuucuucaagggucuuuauaguuuuagauuuuacauuuaagucuguaauccaucuugaguugauuuuuguauauuguguaaggaagggguccaguuucaaucuucuguauauggcuaaccaguuauccuagcaccauuuauugaauggggcguucucuccccauugcuucuuuuugucagguuugucgaagaucagaugguuguagauguauggcuuuauuucuaggcucucuguucuguuccauuggucuauaugucuauuuuuauaccaguaccauucucucuugguucuguagccuuguaguauaguuugaaaucagguaaugugaugccuguaguguuguucuuuuugcuucagauugcuuuggcuauuuggacucuuuuuugauuccacgugaauuuuauaauagaguuuucuauaaauuuuaauuuuugagaauguaucuacauggccuuugucuaauuaaaugauucuaaaggauauccuuuuucuuagaagggcaacuuuuuaaguucagaugagcuauuuuagaaucaauucugcuuauucgaaauucuaguaaauguaauaccguuuuagagauguuaaguguaaucuuucauuguuagaaacaaaacaaauuauuuagcauuucagaagaugaugccuaacauucuguugccuacuuuaauuucagguugggcaucuuucauucccuggccucauuuaacaaaaucuuguggcaaucccuuucuccuuuuuuacaugaaauauuucauuuucaaaagaaauuuuugaaaaaauaugaaaaaauaccguuuucauauccaaccaucugaauugguacaucugaagggaagauaaucagucaagucuccaguucaccucuguucuaaagggugaaauauggccucuguauaccuggauagccuuucuuguaaucauuugacuucuugaguuaguuaucaguuuuguuccugacaagcuagagguucaguuuucacaggguuucucuaaaucauauuuuuucagcuuuuucuuuuucuuauguuggagcccuugacaaaucuuauauuggacauucagaguauaaguuuuccaguauuccuuugugaucacauuuaauuaguuagacucuguaaauaauuucaaggugugaaucuucuuugcaaauuaaaggcaaauaauuaaauauugguauguuuccuacucauggaaauuauaauggcacaucuauaaccaagagaaacugagauggaguggagagcauuuuuuuaauuaaaaaaaauaaagcuucugaaaaacauaaaauacuguauguucacauaagcauaaguuauauaauuuuuccagucuuaguuaaaucgauuacaauucagauagugccaaaagugaaacacaaacuaauauccuacaucaucuauaaaugucuguguguaguuuuuaaaaauuauuucaaaaaaauucauaaauugaaaaauaaaccuuaaaaggcuucuaagcucaaccaucauuaaaugauagaugcaagugguaauguuuacacuguuguauuuccuuucccuucagaauuucucgaugucagaauagauccaggauacucaaguguacuugauucauccuuguagaauggaucuagacaagucugauguugcacauacaaauaagaauauguuacuaauuguguuuaauuucauauguauuuagccaaagaagugcccuuucuaguacaaauaauaauuuauguuguggauaauaaaaauauuuuuucaccuaauaguuugagcugcuauugugguuugcuuuuuuaaaaaaaaaaaauuugcaaagugcuguuuugcuuucauuuuuacuuaaaaugaaguauuuuuuccuauuuggguaauuuuguggaccaaacuaugacuugauuaucaaaugcugcauaucauugauuuuguucuuuucuagccucuuguugcuguaccacauagaauucacucaacaaguagaaacgugagagaagaaaaaacacgcucagagauaaccuguaaguauauacuauacacaguuuaugauuuaaugauagaaaauaaguuauaauuuaguuacaguuauuuuuguuuuauuuccuucugaauaguuuuucuuacuaaacacuguuaaagguaaaguuuaauuagggcaguaagaauuucauuuuccuuauucuuguggaauuuuugguggcaggaugggauguauuuauguuguuacuguuugggaggauaaguuaauuccuggaauaagcaggguagaaguaauuaaggcagugccguaaaugccugugugcauguaacucaccuagagagcuuguuaaaugcaguuucagauucaguagaccugggaugggaucugagguucuacuaacaagcucccacgucauucaugcacucaugauccaaggguaacagagaaauagaggucugcaaacugcccuagcaucugaguaaccuggaaacuuuuaaaaagggauucucaggcaccacuuuuccauagaguccaauucaguaggucuuggauuggcccagaaaccuuuuaaaauaggccuccaguuauuucuuaggggcagccaaguuaugggcccacuaagacaagccauucauucacaugggauccaauacugucaacucaucagugauaaacugccaacaagaaucccucgaacaauagugccuuaacuuuuuuauuccuuagaagcauuuauucucugaguuuuguucuagugauaccuggaaaguaugguggguuauauaaaaagcucaggagugggauuugguacuuugcuugccagcaguuaguugugugaucauauaaaauuaucuuuaaagcuccugcugaagucacguuuuaaauuugcuaauuucaccacaaaacuauuuuuccgaaaauggcauccuuagcaugugagagcauuucucauauuuuaauauacaaaaaauaauuaugaaauaucuuuaucauuucuuuaauauacaaaaaguaauuagaggccagguacaguggcucaugcuuguaaucccagcacuuugggaggccgaggcgggcggaucacuugaggccaggaguucaagacaagcauggccaacauggcgaaacuccgucucuacauaagcuaccaaaauuagccaggcauguugaugugcaccuguaaccccagcuacuuggguggcugagguaugagaauugcuugagccugggaggccgaguuugcagugaguugaaauccugccacugcacuccagccugggcaaagaacaagauucuguuuggaaaaaaaaaaguaauuagaggugacuugcaguuaauuuagaaaacuuuauauauucaguacuguugaaaauguaauuuaaaguacucucuuucuuguuaucucauuuuauuaaaaaauuacauugucagucccuuuauagcauaguauuucugaaucacucugugguaacauaucagugauucucaacuucuaagugcauaugcauguguaugcuauuucaaacuagaugucuaggcugggcacagugacucacaccuauaaucccaguacuuuugggaggccgaggcggguggaucacuugaggucaggagcuggagaccagccugaccaacauagugaaauccugugucugcuaaaaauacaaaaauuagccgggccuguuggugugugccuguagucccagcuacuggggaggcugaggcaggaaacucgcugaaaccugggaggcagagggcugcagugagcugagauccugcuacugcacugcagccuuggcgacagugucucaauugaaagaaagagagagagagaagagagagagaaagaagaaagaaaagaaaagaaaaagaaaggaaggaaggaaagaaagaaggaaagaaagaagaacaucauaugagaauucauggacacaaagggaaacaacagacacuggggccugcuugagggugaagaguuaggaggagggagaagaucagaaaaaguaacuauuggguacuaggcuuaguaccugggugacgaaauaaucuguacaauaaacccccgcgaugcaaguuuaccuauacaacaaaccugcauauguacccugaaccuaaaauaaaaguucaaaaaguaaaaauaaaaaagagcaucauaaacagugccgcagacugggaugauugaccaacaguuauuugaagaguaacuggaagauucuguggcagaggcuugucauaacuuuagggaauuugaagagagcagaagagugauaccaguguaagguuugaaucuccauagggacuuugcucccuuucuggaaaugcauucuccauccacagaguucagguacagugauacugaauaccugcuauagucacggcuuuuaguaagacagcauccuugcacucagggguuguacaaucuggugggagaaaugggcauguucacagguggcaauaacacaaggcagauagaugcacaagacuguccucauguaauuuuauuacagaccgcauuuuggaauuugaagacaaguauaggugaaagcuguucaauaggccuuuaucaagaugagguauauguuaguuuugauaccuuacuaaaaguuauuuuguaaucuuugaugugugaucaauugugaacaguuaggauggacucauucuuaaccuacuuaucagaucuaagggccauuugauaucugagccauuaacagcuuaaaagcauauacacacccagacauaacuggagauauuacagggcuguguuucucaacuguuuuuuuccuuaugccuccuauugcuaaauauucaaaucccauggucuucuuucauugguauuaacauucacaauaaauuuacauacaaaguugaaaucaaaccguuagaaaagugauuaugcuuugaaaucucacuguuuuccucagcuugguugagaaguuuugguuuuggcugaagcucuuacuaguugaaauguaauauauuguggcuguuuucuuuuuauuguuuuguauuuuuuccucugcuuguaucucaguggacuugaggguuuuacccagguuauaagaucagaaaaugauaaugagcuguggaaauaaaagguaaagauacugaaacauucaauacauuagaaagcaaagaaaaagaaaagaugaauguaguacaguuaaucugugucuacucuggcuaguuuauacuuuagcugcagugguuguuuuugguuguguagcaaacccaaaauuuagcagcuuaaaacaguaaacauuuuuuaaaucaacucccauauuuuuauuuuaaaucuuauaagacaauauuauugucauuaaccauggucaauauuaauuuguauuuguauauuuaccaauuuuuugcucuucauucaauacuguauuucuguaccacuacuuauggaucucuuuugauuaaauaauuccuuuuaguauuucuuuaagucugaagguauugaauucucucacuuucuguauaucugcucauauuaaacaauaaacauuuauugucucuaacagauuuugagagucaggaauccaggacagguuagcugagugauucuggcucaaggucucauaaaguugcacacaggauaucagcuagggcuggagucaucugaauguuugacuggacuggaagauuuacuuccaagcucauucacguaacuauuggccagaggcuucacuuccuugccaggaggccucucuuuagggcugcucacaaugugacuuccuccagagcaagugauccaacagagagagcccaagacagaagcuuuaucuuggaacucauauacaguuaacuucugcucuggucuuuuggucacaucagccaacgcugauccaauguggaagcauuuugaauaccaagaggcaggagucacugggggccaucuuacaggcuggcuuccacaaguacccuguaucagcagcugucuacccaccuaaauacugaauuaagauggucucagccaggcacaguggcucacgccuguaaucccagcacuuuaggaggccgaggcgggcggaucaccugaggucaggaguuccagaccagccuggccaacauggugaaagcccaucucuacuaaaaauacaaaaacuuagcuagguauaguggcgcgcaccuguaggcccagcuacucaggaggucgaggcacgagaaccgcuugaacccaggagguggagguugcagugagcugagaucgcgccauuacacuccagccugggcaacggaaagagacuccgucucaaaaaacaaaaccaaaaaaagauugucucuguuuuauucuuggucacaacaaaguagcaaguuagaacuugauuguacacacauauaauuuuguuaaucaucuucuuuucuuacuguggaaauggccuagaauuaacaaauuaagcuuuagcgguuaagacuuuauugggcuuuuuccagcugacauacaaauggccaucagauacaugaaaauaucacuaauuguaauauuacaauuaguucagcaucacuaauuguaaagaaaaugcaaaucaaaaaagaaaaaccccaaugagauaucauuucacccuaguuuaaauggcuguuguuaaaaagccaaaaaauaacacaugcuggugaaaaugcagagaaaagggaauucuuacauacuauugauggaaauguaaauuaguacagccacuaugguaaacaguauggagguuccucaagaacuaaaaauagaacuaccauaugauucagaacuacuggauuaugcauccaaaagaaaggauaccaguauaucuaagagauaucuacacucccaaguuuauugcagcauuaucacaauacccaggauaaagaaucaaccuauauguguaucaaugggugaauaaauaaaagaaauguaguauauauacacaacagaauauuauucagucauaaaaaaaaugaaauccugucauuugcaacaacauggauggaacuggaggacauuaauguuaagugacuaggcauggaaagacaaaugucucauguccucauucauaugugguagcuaaaaaaguugaucucauggagguagaguagaaugaugguuaccagaggcaggaaaggguaagagauagguggaugaaaugagguuguuucauagguacaaaaauaaaguuaaauagaaggaauacauucuaguguucaguagcagaguagggaaauuaacaaucauuuauuguauauuucaaaauagaagauuuggaauguucccaacacaaagaaaugguaaauguuugaugugauagauauccuaauuacccuguuuuguucauuacacauuguacacguguaucaaaauaucgcauauaccaccaugaauauuuacaauuauuagugucaguuuuaaaaauugaaaacaaagaucuuuggagaucagugugugguugaugguagcauuaaaugucuuucaccauggaauaacuuuuuaaauuauuauaucauuaagaauauaaaaacauccugguuuuggccgggcgcaguggcucacuccuguaaucucagcacuuugggaggccgaggcggguggaucacgaggucaggggaucgagaccauccuggcuaacauggugaaaccccgucucuacuaaaaauacaaaaaaaucagccgggcgugguggagggcgccuguagucccagcuacucgggaggcugaggcagggaaauggugggaacccaggggguggagauugcagugagcugagauugcgccacugcacuccagcgugggagacagagcaagacucugccucaaaaaaaaaaaaaaaaaaaaaaaaaaauccugguuuuacuuuuuuuucuuuuuuaguuggccaagugaaauuugauccacccuuaagaaaggagacagaaccacaucaugaacuuguaaguaguauagccuuagaauguuagcacugaaaauaaauguuuuaauuuguuuuugugugauguauuaguacugaccaaaaaagcuagucauuaauauuuucaaaaacauucgaggucccagccuggucaacauaguaagacccugucucuacaaaaaaauguuaaaacuuaguugacguggcaguguguacuuguaguccuagcuacugggguggcuacggcaggaggaucccuugagcccaggaauucaagguugcagugagcuaugauagcacuacuguacuguagccugggugaaagugugagaccuugucuuuaaaaacauaaaauaaaauuuuuuuuaaaaucgugggaaacaaaaagguaaguaauucucaaauucauaauaaauaaaucuguguugcugaauauuuucaaaauuauuuuaagagaaacuuaauuguuuuaccauucugugauuaaauguuuuuaaugcugacuuuuaaauuuuuuuuauuuuuuauuuuuucucuuuuugaggggcuuuuuaaaauguguuauuuuuaugauaaaugccaugguuuccaaacauuagaguagagucauaucuguauagaguauugaaaauuagggagaugaggcauacauaguaaaugaaguuugucauucauuuaaggcuugcuauaacuuuaugaauauacuuugcaugauucuuuuguuguuguuuuauauacuccuuuccagauaaaugauaauauauuagauucagucauaaaagcaaaauacuuugcaucuauuugagauguuaauauucuauagaacaauaaaaaaaugagacauuggaaaauacaaaauucuaaagaaauuauuuugccagaguuccauaugaugucuguuucauuuuuuuauuugcuauuuaauaaugagaagaaaauaacuguuaauaaguacuaaggauugaaguaggagcuuucuucuucaguuuaaugcuuauuuuaacucacuugacugaagcauacaaagggugucauuagccuuuaccuuauaguuacucuaauucaguguaccaguguggaggaauaggauguuaaagaaaaagucuuaaaaugaucauauuguaauaccaaagccugacauuuaugaagagggguggagaaaauuaagaaaaaguagucaugauauuuauaaaugcuaauuguguuuuguuaaggcaguuugaguuuauuuuuuguuucccuuuguaaguuggcauugccuguauuuaaauucuguacuaauuuaguaacugcauuuuagagcaaaguuguugcaauguugcuuuuuuagaagcugccuaauacaguuugacucuccauuugccuuaauaaaauuauauuagcaggacuuacuucauuugugaaaguuucccuuugugaauuuguggcuuuuagucuaagcguaaauaacuuggguuucuuggucucugcuaaacagcccgacagugaugguuuuuuggacaguucagaagaaauauacuacacugcaagaucuaaucugguauuucucaucuucugauuuucuuugucagcauuguuuuagucuuaauuguuuucuuuuaagaucaaacauuuuguccaauuaaagcauuguuuuauaaguugcuaucauuuagcaaacuucuauauauuaagaauuguagcaguuuuuucccauaacaaguuacauauauauaucuacucaaauauaaugcuguaguaauaaacaugcuuguauuuuuuaugaaaaauguuaauauuuaauuuucucauucauauauuaggguuuuuuuuuuaagaaauggcauuucccuguaaaaauguccaguuuaaugauguaacuuguuuuaaugaacuagaaaccacccauccacauguauauauauaaacaauucauauguuauaugguacauauauucauaugcauuacauauauaauauucauauaucaugguacauauauuauucagauaauauaugguacauauauaauuuuuaaagauaauuuauuccuacauuaacaaugaaaucauucucagaugaaguuuuaauuuuucagcauuacuaucaugucugguuuccuuaggacaaaauuuagauuauaaagcauuccugaaguuauaaauacugucuuaccauuacauaagaaaaaaugagaaauugaugcuauuaaauguuaaauaaauaauacuuuuaauaguuguuauuaaguaaauaguucuuucugcuacugugguuggcgagagccccaaguuacccccauauuuacucccagauucuacuuuucugacuuuuaaauggaauuuuccuuaucuuuccuuccucuuuaccuuaguaacauacaucuuucaauuuugauuggcuuaaaugauucuuuauauaaauuuuuuaaucuaggaccucugacauuuguaaaauauaaaagagauuuuagacauaauuucccuucuuuagggagguugcuguccuauuggacagaauauacuuacacauacaaacucuuacccaugcaacaaaauacauaauggcuugccaacauuuugccagguggcaaguguugaugagggaagcuaacauacaauagguacuguagagaugagagaaggagaagagcucuggggcccauguggcuuaucuggcuucugggagggacuaagacuaaugucaguauuguguaggaacauuguagauucuucaggaagaaaagggaccagaugcuggcucuguuucacagcaauuggaaacaguugccagcacagaccacagguuugagagaugucaggcagagagcugagauuuugaaauuaucauacuaaucucggauuccuuuaaaaaaaaguagauuuaaauuaucaaagaggaagugauagaugaagccaugaaauugcauguguuccccauuguuaaaucugaagaaacagugcaaaaaacugguuaccucaguggaugaugccuauguuuaacauucagguagaaccaacauuggaaguagggaagaagcaguugaaaagcuaggagagccaguaaaugcacugucucaaaauaaagagggaauguguucaauggcauaaagagacagaaugugugaggauugggaauuaacccauaggggccaagugagauagaaugucugaagaaaacacagucggugcuugcuggauugaaaauguuuucagaauuacacacguaggcuagaaugacaauuagugaaauuuauugcagaaauaaagacaacacaaucaaauuuuuaaauugacucuaguauuuauuaauauccuccauguagaaaagauaacaacaaaacuggaaacauaauacuuuaaaauuacaaauacucagccgggcacgguggcucaugccuguaaucccagcaguuugggaggccaaggcgggcagaucaugaggucaggagaucgagaccauccuggccaacauggugaaacccugucucuacuaaaaauacaaaaaauuagcuaggcaugguggcaugugccuguaguuccagcuacucaggaggcugaggcaggagaauccuugaaccugggaggcggagguugcagugagccaagauugugccauugcacuccagccuggcaacagagcgagacuccaucuuuaaaaaaaaaaaaaaaaauuacaaauacucuuuucugugccacauguggaacuagccuaguaacuugaauaaguuaccauauuguggcuuuguucccuguaacugcucccaccuucaucccugcucccugcccuauaaucaggaguuuccugugguacaggggagcauuugacaggggucuugugacaauggagggauuuagggacuauuagguuaguucgggcagaagagggaugaaugaaauauuugucagaguauacaacuuauaaaaucaaccuuaaagcucacucccaaugguaacaaaagcuaacauuuaucuagagguuuuuauauaccaggcauuauucuaagcacuuuaaauauauuaacuuauuauucuuguuuuacaaaugaggugauuuaaagugcaaagaagcugaaauucguuagucuuuagcuaagaauagcagagcugggauuccuaagcagccuagcucaggaauucaaaacuaaaccacuguacuguguugccucuacccaacaucaucaguauauauuuuuaaaguaauacugggccccccaccuuuuuaaaguaaauauauaugucccaugguuauguuuuguuuuuguuuuuuuuacugugguaaaauauacauuacgaaauuuacuguuuuaauguuuaugucuacaguccaguggcauuauguacauucacauuguuacgcagcugccaccacucuccaucuucagaaugauuucaucuucccaaacuaaaacucuauacucauuaaacaauaacuccccauuccuuuuucccuccagccccuggcagcgaacacucuguuuucugacuaugaauuugacuucucuaguuaucuuguauaaauggaaucauagcauauuuguucuuuuguggcuggcucacuacuuagcauaauuucguaauaccuucaggguuccuccguguugcagcgugugucagaauuuccuuuuuaaggcugaauaauacuccauugcauguaaauaccacauuuuguuuauacauucauccauugauggacagugaguugcuucuaccuuuuggcuauugugaauaaugcugcuauaaacauggauauacaaauaucuguuugagucccugcuuucgauucuuuugauauguaacuagaaauggacuuguaguucuaucuuuaauuuuuugagaaacugccauacuauuuuccacagcagcugcaacauuuuacauucccaccagcgaugcacaugacuucuacuuucuccacauccucaucagcauuuguuauuauccucuguuuuguuuuguuuuugacuuucgauaauagcuauccuaauggguauaaaguagccauaguuauuucuguguucuaauuuuaucaauucuaaaaucuuggcacugugaacaagauuucaucucuuacaaaugcuuguggcuggccacuaaaagccugaggaauccagaaugucuggcccucaucuuagcuggcaguuggcaccaagguaaaaacccuaaaucccuuugggaccagaagaaacauuuaccccuuuaaagaccuugcuacauaaacauuccauauuaccugugauuucugguuguuuuaaaugccaacuguuuuuauuuugugauuuuguaagugaauuuagaauguuguauuuaaacuuuugugcuauccaaaagugcucucucaaaaaaaaaaaaaaaaucagauaauuaauauaugaagccagaagaauagggcuugauuuuuuagaauugacaguaugagaauuuuugaaagaugccugaguuuaaaacaaaaacucacuguaaguuaauuaaaagaguuuugcccauaaccauaaaaaucaguuugucugaucugcaaaaugcuaucugcagauuaaaagauuauauuacacauccgucuuaacugaugcuauuuuuuucuaauuugcauaguuuuacuggcuauuuaagcccauguaccaauuaaaaacaaaaaauugaaaguuaauucuguauaaaagacuauguugacccggcgugguagcucacgccuauaaucccagcacuuucggaggccaaggcggguggaucacuugaggucaggaguucgagaccagccuggccaauguggcaaccgcaucucuauugaaaauacagaaauuagcugggcaugguggugcacgucuuuaaucccagcuacuuggaaggcugaggcaggagaaucucuugaacccagaaggcagagguugcagggagccgagaucgugccacugcacuccagcuugggugacagaucaagacugcaucucaaaaacaaacaaaaacccaaaaaacacuauguuaaugacuauguaggggcauaaauaaauaguaacauaaucauugcucugaagaaguauauaguaugccucaccugccaauauucauuuccgagccugcaguacaaaagucauauuauuccauuuucaggcuccuuaaucugcuuuuauuagucagaaaccuaacuugaucaguuaauauucugacucuacuugcuuuucugacuuuuuaagaaauaaaaaauauuugaauuauccuggauucaacaccucucuauuucuauaaaucaucuacugcguuaaaaagugucucacuaacaaccuuauuugugccauaauuuucucauuuuugaugggaaaauauuucuccuguucucuuucuuggucaagauauauugcucaaguauuuuuuucuuuuguguuuuuguagugaacuguaucaauucuauugacuuccugcugcuuucucaucagguauagacuuaaaucucccaaggggauuuuuuuuaaaacuacaauaagauguuuuuggucauaugcuuuuccuuuuccggugcuccauguuacauccuuuguucauuuucaguucuuucucacacuuuguguucuuagaaauuccaucugaaauuuagaaauagucucccauucgcuaaaaugaacugcugaaauuaggacuuugcaacccaaaaagauauuuuaauugggcuaggauaacgaucuugaacuuuuaaucuauacuagguuauugcauguuuucagcuccuguuacuuauuugacucuacuguguaaacacugucauucauuaacaaguugaugccugauuagugcuacuaacuuuuuuuaugcuggcauacucaaguguuucuuguuuagcuuguaaagaauggccauaagauaccaucaucuugggauaguuugagcgccuuuccaagcauuauuuugguagcauuuuucugauauggaauaacuuccaaauccuuuuugaaaagcauuuuauaucagucuuucuuagacugccccaacgacauauaaugaacuacuaacuuugcccugguuucacuuuuguuccuuuccuuuuuauuucuugucauuuucccuauccgauuuucuguaugaauuccugucagauaauaggugcuugguaaacaaugguuguauuaaaugagauuagaaacuuuuuagaaggauuuaaaguaauauuuuacuuaugguauuccuagcacauuguuuuguuccaugguugcuauaacauaauuuaaggagaagaaauuguuaaagaaugagccccuuugaauuucaccuuuccugguaagacuugggacaugacccauuuaaucgucggacuuggauguaucuacaacuucuuuccuggccugaauguuauucucuauaugagccuaugcucaauuuucuauuaauauauuacuuuaguuauuuuagauacuuuucuuaccuuucuaaauauacugcugaacucaguuuauuuucuuuauuuuuuuuuaauuuuuuuuauuauuauuuuuugagacagagucucucucugucgccaagcuggaguguaguggcgcaauguuggcucacugcaaccuccgccucccggguucaagcgauucuccugccucagccucccgaguagcugggacuacaggcgcgagccaccacgcccagcuaaucuuuuguauuuuuaguagagacaggguuucaucauguuggccaggaugaucucgaccuccugaccucaugauccgcccgccucggcccucccgaagugcugggauuacaggugugagccacugcgcccggccuauuuccuuuauuuuuaaucauuauuaccgcgcccggccuauauccuuuauuuuuaaucauuauuaccagccuuuuacuugucuuauaucagaugagcugaguauuuuuaugacacaucuguguuuguauaacagaagagccauggccauuccacacgaaugugugcuuuuggaagcugucauuugauuaaaggcuuaagagauuguauuggcuaaagauauagcuggucugauagagggcccaguuaucuauagcugaagaaaacaaauuuuguguuuauuuaauuuaguacuucucuuuacugaauacuacaguuuaaggauucagugguaaagucaugaccacuuaaacugugcaguuuuguaauaacaaugauuuuaucuuauuaagauauaucauuacaaauuaaagaguacagauguccuuuuucauuggaauuuugugugauaccagugugacagucaacuagucuuuuuuaugauguguuaucuuuucucacacugauaagaacacuuuauuaugcauggaauaacacaaauauugaagaagacaaaauuugagucuugucuaaaccaggauuuugauuuuaauuuucaucagauuuuuuugacaggucuuggaauauuuaaauuuuaaagugcuucucucuuaaauguaauguauugcuuaaaauccuuauauuuugaggcuuaguuuuuagugucauuuagaauuagcuuuguguaucuuaacgaggcugaaguuuuauuuaugggaaaauaaacaguuggcauuugaacaagcauuuauuuauggugcagucaguuugugccaggaacaaugcuagaccguaggcuguaaggaaagaagauagauuugauuauuucccauuguuuaaggagcucgcuuuuacaaacauguaaauagauuaaaaugcaguguaagugcuagagcagcucuguguguuaaaugcuauggaaacuuagagaaagcugcagauaauuuucccuggcaaucuuggaaggcggcugcuccaagguggcuuuuguguuaagcccugaucaugaaucugagaauaucuuguaaaaauaaaaagcacuuuaaauaugcuauauucuaauguaaauaagauucauuuuuuaaaugucaaauauucccccuuaaugguuaaaacagugccuagauuacaguggcucuuuaagaagaggacaaaaggcagcuuuacuucauucuuuucaugguuguuggaaagcacauuucuuuuucucaagaaggcauuugaguugagcauguguacuguucauccuuuuaaauguuaauucuuaacacucuauaacccacagcauuaagucggaagguguuuaaacaguugaggaacugccuuaauacucauuugaaguuuugcuuaaaaaauuauuaaaaguccuucaguacaauuuauaauauuguacaaguucauauacguaauuuacuuuuaaaauagcacccaauuucauaucuuuaaaaaauuguuaccugcgugaaacagcaguagaaauaugugaaaguguuuauauacguaauuauuuuagauacuauauacaaaguaaaccaagauuuuugucacauauucacuucucugaacguuuuugcuucauuauaacuggagaauaaacaccuuauuugagcuuuuuucuuucuaaaaacugauuuuuacaaaaguuaauuaaaguaacaguaaccaaaaaugaaacuuugcauauauuauucagaaaaauuccaagaaaaacacucaaauaauaaaauacuuaaaucaggacuaugaacucgugaaauccuucuuuuuaagaauguauagcaauacagauuuauuugggggucugggacuuaucuuuuaaaaauaauauguauuauauauauuaauguaucauggugugucauauacuacuauugugcuaaauauuuuauuuuguacuauuaggaucugcaacuggaauauggacaaggacaccaaggugguuacuuuuuaggugcaaacaaguaaguaaaguucuuuuaaaacuuaauuuaaauucaagaauuauuaaguugccuuuaauauuauauuuuaauauuuaagguagaaaauuguauuaggcugguagauauauuuuacaauaugcauuucaccuuuuuccauugcuuccuugcucauuauuuaguuaauaguuguccuaaugggaagcaucaacauaauuuuuuuauaucaagcuacauugcugaucuuguauguuagagaaaaccacauguauugccacugaaggcagauacauguuuuagcacuuuauuucuaaaacugaucuguuuauuucuuauaaaacuugcuuugguacaucucuaagauggguuggucacuaaaaacagcuggaauuauucauacaacuuagaaaucuuaacuuuuuagcuauaagguuuuuuuaaaguaagauagcaguuaaaaugugugucugaauucuuaaaaguuaccaaucuaugcaguaaauaaauucaacaguuauuuaaugccucuucuacaccaggcacugucuaauugauagaggcacagagguuuaaaaggcagcuuacaaacauuaacaauuuaaauuguucauuugccagguaugaugggagacagaauuuugcuauuccccuuagagucucauuuucuaaguuuguggauaaauuaugauaaaaacuaauuuauaagggaauauaauuuaaauuaccaaaaucuuccagcagugcauauauuauuuuaauagucagaacaaguuaaaauuccuuuuuuuuuuuuuuuuuugaggcagagugucacucuguugcccaggcugcagugcaguggcgugaacuuggcccacuucaaccuccgccucccggguucaagugauucucaugccccagccucccaguagcugggacuacaagggccugccaccaugccaagcuaauuuuuuguauuuuuguagagacuggguuucaccauguugaucaggcuggucucgaacuccuggccucaagugauccaccugccucagccucccagaaggugcuaagauuacaggugugagccaccgugccucgcaaaauuucaaaauauuauuucaguugcauuagagaguugagacauauauauucccauauuuuaaguuaagcaguugagaaauaguaacuaaagacaaauagcuuaguuuuaaggguaauaaugcaaaaucauguuucucucuuuuuuuaauaaacuaaauaccaaauguuuaauuuuuuuaguuaaauaugcuauccuuuccuaacagagagaaaaggcuuuaauaacaaucuggagaaauauauuaguuuuuauuuaagcugaacuucaguuaaauacuaucagaguuuuaaaaauauuauuagcuuugauacuauuauuaagucauuauuauuauuagcauuuauguuuuuuaaaauggaaaauaaguguaaaauuuucuuggcagagaaaaugaaauuuuaccuaaauaguugacuauuugugauuuauaaauugucuuaguuuguuggugaaaaacaaaggaaaguuugucucauaguggauucgcaaauaaaaaaaauuuuugaaguguuuuuauguuauuuucucuaaauaugaagucccuaauuuuaagguccuuguuaguaaauuuuaguguauuuuaagagacugaaauuuuugggaaaauauuuuuuaccuuuuuugauucauuuaaaauacauuuuaaaaaucuguacaugcaaaguacaaaaaaaaaauguagccccucacuaaaugcuuuuccagauuccuuaguuuccauugucugauuucugauuguuagacauuuucguaguguauaguuauuuuggcuagguaaaauguuaauaauuugcccaaccuucauuuuuugaugaauuggaucccugcuuaaggaacuguauucuauguaacgaacccuuggcaagguagguuggccaaaaguuugcucuuuggcuguguuucguguguagguauagacauacaugugacaugagcauggauguagcacuucucuugcuguauugauaugucugcuuuauucuugugauuaggcaguguuuuaaaaacgggauuuccugcuuucuccauaggugaucaggcagacagauuuccauugacggguuucuaccuauuccagaccgugcaggaacuaucuaauuauaauuguuaacauaggucuuuucuuuuucuaacaggaagcauauguacuuugacuuauacuugcuugucuccuuuucuuuggaauucuaaucucacuaaggucagcuuuucugauaauuuauuuaaaaccaacaaaauacuauuuuuaaaagaaaacacuaggccgggcauggugacucacgccuguaaucccagcacuuuuggaggccgaggcgaguagaucaccugaggucaggagaucgagaccagccuggccaacauggugaaaccccgucucuauuaaaaauacaaaaauuagcuggacaugguggcacacgccugaggucccagcuacucgggaggcugaggcaggggaaucgcuugaacccaggaggcggugguugcagugagccgagaucgugccauugcacuccagccugggcgacaagagugaaacucugucucaaaaaaaaaaaagaaaagaaaacauuaaauuauuuauguuuuguuuuaauuuagggcaaaaauguugaagguaaauucucuucuaauaaguaauaguuaaaagaguacauugaauuacacaauuccuggcacaguugaguauaguaguaguaaaugccagauggcuuuuccuauaagcuacaugacuuugagaaauuuaccucuauuauugcuaguaaaauggauaauauaauaguaccugccucauagggugcuaaggaugaaauggaauaauugcuauaaagcauuuagcacauuuaggacuuaguaaauacuuauuaguugccuuuauuuaugguaguuauucaguaaauaauuguugauuguaugaacaaguaguaaugugagugaauaaaacugcuguuuaauuuuagagaaauaggguuuuuguuuguuugcuuguugguuugaaauguaaucagagcaguacuuacagauugggggcaguuagacaauuuuuaaagauguuaauaaccgcagcacugauucuuuagcuaaugcaaauaugcugaguauuuugguggucauuuuagaccucugccauaucuguuuguacauuguuucauuuuuaaccuuuucgucaacauuucuuacucauuuuagauugucuuagaauucagcaucugaaagcauuguuuuuguuuuguuuuguuauuuacuuuauaaaacuuccauaagagaagaauucaaguggacuagugaauagugacauuguuuauuguguaacauucaaucuuggugaauaaaucaguaucacauuuucuccagugcucucaagaugcaauauuuacuguaaacagacuuuuuagcaaauuuagccauauuucauuuucucuuuuauaaagccuaaaaaguaaaucaugcauccuacuuuucauuaagaccguauuaauucuguaauuucauuaauaaaauauguuaacacacaauggggauuuauagguaaaugaauuaaaauauacauaugaaucccugagccaugggcuaucugcuuuuucauauucacuuauucaaccauucucuuauuguuagagaacucccagaaagauucuuuuuaaaaaaguggaaugcuggcugggugugauggcucacggcuuauaccuguaaucccaacacugggaagccaaggcggguggaucacuugaggccgggaguucaagaccagccugggcaauauagugagacucagucuuuacugaaaauacaaaaauuagccgggcaugguggugcacgccuguaauccuagcuacucgggaggcugaggcacgagaauugcuugaaccugggaaguggagguugcagugagccaagaucacgccacugcacuccagacuggaccaaaaaagcaagacuccaucucaaaaaaaaaaaaaaaaaaaacauggaaugcgaaugcaauauaaauccaauuaaauaugguacauuuuaaauuaucuuccuguauucaaauccuaauauuuucuauuguaaaaagaaauaucucaaaaaagauugucaugugcuuaacaaaaaaguauuuuuucacaucuaaaauuacauaaaagccaacuguacaguucagauacauuauguuuaauuugguaaaauaguuuaaagcagcacuucucaaauauuuggucucaugauuuuuuuacaguguuuaaaauuauugaggauuccaaagagcuuuuguuuauggggguuauaacuaucaauauuuauaguauucaaaauuaaacuuuagaacuuuucaaaauguuaauauauuuuuaaaauaauauuauuuguuauaaauaacauacuuuuguguguguguuuaaaaaaaaaucuccauucuuaaggaccaacucaaaugccagcucuucacagugguuucuuaaaacaccucugauuucucuccugagacucagaggcagugaauaauugccauaaaagguuuuauuauauaugucagugcacugcagaacacuuuuuguugagguccacuaauaacauuuuuuuaugaaaaaaauagcuauuuuuuaugagacaaaauaauauuaguaaaaaaaaguagcauuguuuuacuuuuuuuuuuuucaagucuuguuaacauugccuuaauagaagacagcuaaauucucaugucugcuacugcauucaaucuguugugguaucacacaucuuguagucucuggaaaacuccaguguauacucaugagaaaauaagagcaacaaagguauuacauauugugaaaauaguuuggaccuugcagaccccuacaggagacuaagagaccccaggauuuuuauaccacaauuugagaacugcuaguuuaaggaaauguuauuuagccaauaguaauaaagaaaauacuaaucaagucccaacucuguccuaaauuacccuucugggcacuuuaccuacauuaauucaguagaccuucugacagccacuuugaaauaaguacugagguaauuucuacuuuacauagcuggaaaucaaagcauagagaaaucagaguaacuuauccagugccauauccugugauggugaaggcaggauucagauucaggccgucuuggcuuuaaagccugucugcauuuugcucuagugccucuagacagaagcuccugcuuucuuagaguuggcccuuggagagcuuugugaauaagauaauauuugacugugguaccucacuuuuuguaucuccaaaauaggacuugcaauuaguuugugguuuuccuauagaauuuaccacucuggagucauaaguuuuucauuuuuuaaaauuuaaauuguuguuaaucuaggcuaauuaaaauauugaugccuaaaaccuauucuguuaauugcuuacaguagauaaccauaccuuucaguuucucuaguuuuauguuuuguaauuuuaagggcaguuuuuccugauauguauuaggagggaaaauaauuaaaaggugcuaccugauaacuuuuagggagaguaaaacuuuugcugacucucuuuuaucccaguaguauauuaguaacuauauuuaucuccccuauuagcuuugagaagucuaucgagucuuuaugcucgaagaguguaauuuaggagguaugcugcaugaacuugcgguaaaaagaaguaagggaacuucaggaaugccauaguucucucuuacauuccugaaaauuaaaguuuuguauacugcuccuaaugguaaaauccucgaccuggucugauacaggcuuagucucccaaaaguguaaauguguuugcccgugcaccacuggagaacaaauccuucagguaagugagugucuuccgugaaagcaaagugcuacuacauucauguauucacaucacaugcaugcaugcuucugcagagagauccaacauggugaguuucauuuuguaggauugccugagagcaugauguuauuuugaagugugucaccuuccuuauuuuaagaaaaagaaaguauauauaauuucaggugucagguauaaaauuccagguaaaauuugaauccuggagacuccuggcuaugacccugcaauuauuguuuugucaguacuguugugacauuccauggugaguugucuucuguuugaauugguauuuuucaauaaauauuaggauuuauuuuguucauuuaaaauacauauauaaagacauuggcaacaggaaaauagagguauuuuauuaaauauaacuugauguuuuaugguugcagaggugaucacuagcaaauuuucaguaaaugguaaaaaaguaaucauucaaaaaauguaugguuaagguuaaaaugauaaaaacacauucgauauuccuuugauaauuuauucacauuauuuuuuguuuuuguuuuuucuuuuaaggagucuucucaagucuguugaagaagaauugcaucagcgguaauuuuaauuuuuaaucuuaaaguacuuuaugucacagacaaguaaagucaguuugccuucuucucuguuauguagccuauuuguuugcguugucuuuuuuuucuuuaauagagauagggucucgcucuguugcccaggcuggauugcagugguaugaucauagcucacugcagccuugaacuccugggcucaagcgaucuuuccaccucauccucccuaguaacggacaucacgauccaccgcucccaguuccuuguuuuaauucugaaucuauccuauccuauaaagaugcagaaauaaaauuuuaucuuacaguagcuuuuccugcauuuucuaaaauuucuucuuacuguuuugguaaaauccauuuaauaacaaugacauuauccuuuuuauuuagaggacacgucgcacauuuagaagaugaugaaggagaugaugaugaaucuaaacaguaaguucugucucuguuuuugguaaaaagaaaaggugucauuugaccugauuucaucaaucuggcagcuuaauauugauggaaauuucaauaucaguaacacaauaucauggguuguaucucaguuuccuuccuuuuuucuauucuaguuacauuaacuugggcugacauaacaaaauaccauagacuuagacaacagaaauuuauuucucacaguucuggaggugggaaguucaagaucaagguaccaaccaacuuggugagggcugccuucuuggcuugcagacagccgucuucuggccaugucuucacguggccuuuccucaguguaugcacauggugggaucagggguaagagugaucucucucucucguaagaucaccaauccauaggauuaggaucccacuguuacaaccucauuuaagcuuaauuacuuccuaaaaacccaucucuaaauauaaucacauuguggguuaauacuucaacaugugaauuuuauagugacacauuucaguccauuuuuuccaaaggacaauaauuuuuuauuguagauuuaucagugauugauagcugcuguaauuuuacuacaacuacaaagaagcuuauuauaaauuugauuaaauuuuaaucuguuauauuucaagugaacaaauacuuuggauguaaauauauaguuuuaaaggaggaauauuuuuacuauuauguaugcauugauguuuacuuuuuuuuuuuuaauaaagaugcaguuucaugguaaaaugauaagagcacuugaguagcaguugagggcauagguugaucuuggguaaaguuacauaaacuuucuaggccuugaaauccucaucugagacauuugugcuucaucauauuacaauuuuuucuuucuuucuuuugagaaagggucuugcuugcucuguggcccaccugaagugcaguggugugaucuuggcucacugcagccucgaccuccuggcucaagcaguccucccaccucagccuccugaguagcugggacugcaccuccacacuuccuaauuuucuauuuuuugguagagauggguuuccaccauguuguccaggcugggcucgaacuccugagcucaagcaaucugcucaccucagccuccuagagugcugggauuacaggcaugagccacugugaccagccucuuucuguuucuaaaacugauccugaguuauaaugaauccuaacuucagucacauucugcauauaauuucauaaagcauauauauaguuuuugaugagcuucaucaaagauguuucauaucuaacaguagcaaaaaugaaguuuacaaugugauauauuuuauacuguaucauuuauuucauaagccagauguggcuuauguucuuaauuauuuaccuuucaguugauauaaacuggaauuauaauuaucuuucccaguuuuaauuacaauauaguacuuggaaccaagaaaguguauuacccaauuacuucuuuuuaaauugaauuuaauucuuuuaacugaaauaauuauaauacaaauuucugugguacauaguaacguuuugauacauauaauguagugaucugaucaggguaauuagcauauccaucaucucaaacauuuaucauuucuuuguguuggaacauucaauauccuccuucuaacuauuugcaacuaaauaacacauuauugguuuuuuguuuuguuuuguuuuuugagacagagucuugcccugucacccaggcuggagugcaguggugugaucucagcucucugcaugcaggcucuaccucccagguucaugccauucuccugcugggacuacaggcacccgccaccacaccuggcuaauuuuuuuguauuuuuaguagagaugguguuucaccauguuaaccacgaugguaggauggucuugauuuccugaccucgugaucugcccaccucggccucccaaagugcuggaauuacaggcgugagccaccacgcccggcccguuauuguuaacuauagucauccuacagugguauaagagaguaguaauacuuacauacuguaaguauuuacauaacuguaauuuuguauucuuuaacaaaucucucccuuucguccccuuuucccugcccuucccaguuccuaguauccuauguucugcuuuuuacuucuaugagaucaacuuuuuuuuuuagcuuccacaugaguaagaucaugcgguguuuaacuuucuguuuuggcuuauuucacuuaacauaauguccuccaguucccaguuacuucugaauaauaccucuagcaacauuucacaaaauacuuuagaaaaaacuuacaaucuuagaaaaugauauuugucuuugcagcuuuuuuaugugucuuugaaaaaauuauuauauuuuaggauugauucauuuguaaaaugaauaguucugauucuaaacuuuucuguuuuuagcucaacucugaaagcaaaaauuccaccuccuuugccaccaaagguagacagauuuauuuuucaauuugauauauguguguuauuguucugccaauuuaauacuuuguugagaguuuuucuagcuuuucauuugugauccacaaagaaaaaucaugaaguugauauaaguaaaugauuuuuuauuauguuugucucauuuuauaaugcccaacuuauauuuaguguucuuuuuuuuuuuuuuuuuuuuuuugagacagucucacucugucacccaggcuggaguacaguggcaugaucucgguucacugcagccuccuccucucggguucaagcaauucuccugccucagccuccccaguagcugggauuacaggcacccaccaccagguccagcuaaaguuuuguauuuuuuaguagagacuggguuuugccauguuggccaggcuuggcucaaacuccugaccucaggugaucugccugccuuggccucccaaaguugugggauuacaggcaugagucacugugccuggccuuauuuaauguucauucuaaguaacaaguccuaggaauuuacacugaaaaugauuguauuaauggauuaguguuauuugacuuggguuagaaaacucacauuucuuacaagauuguuuuucucaaaaucugcaaccuauuccugacuucuaagaaugaauaaaggauaguaauuuaucaucauagauauuuaauuuucaaaagauaauuuuaauuaaaaauacaaaauaguacaauuuuuaaaugcuuuuuaacaacaaaauuauuuuuccaaacaaaaucauucuaaaauaguaauuucaacugauggguuguuuuuuuuaaagguaaaaugagcuaauauauacuuuauaaguucauaugcauagcaaauuuuaauuauaauaugaguugcuuuaaaguuuaaaaucaaaguguuacaaaugagaguuggagucuuaucagucuugucauucgguuuauuacuauuuuuauuuauuuucauuuuauacaauugagaaaauccugauucaugcaaguaaauaaugcuguacuugcuuguuuaguuuuaucauagcagaaguaaagagaucugaauuucaaagaaauaagugcugagcaauaauaagagacacguuauaaauucuacaaaccgucagccaacuguagauuuuuccauuguuuguacagaaagugucucaggcaucccauauugcuauguuuguauucuccaacaugauaacguuuuuuguuuuuuuguuuuguuuuguuuugagauggagucucgcucuuucgcccaggcuggacugcaguggcgcuaucuuggcucacugcaagcuacgccucccggauucaugccauucuccugccucagccuccugaguagcugggacuacaggcacccgccaccacgcccagcuaauuuuuuguauuuuuaguagagacgggguuucaccaugauagccaggaugaucucgaucuccugaccucgugauccgcucgccucagccucccaaagugcugggauuagaggcgugagccaccgcacccggccacaugauaacauuuuaauugguauccucucaugccccuggucugaaagauuaagcauuaccauaaagacauugagucaucuaagagacagcuuagauuagccuugauacggagcugaacuuugacuagucugaauauuugaaauaaaaagagauugauuuaaauugaaggagauaagaaagacuaaaauauuuuuauuuggcuagucuaaguggggagacuugugaggaauuaauaaaaaagucgacuuagaggcccuuuuauuugcacagcagcaaaaccugagauguacacauuuuaguguacauuuuuagaauauauuuaaaacaauaagauagucugaauuggaugguugaguaaccuuuaaacucaucugguaaaccucuaauguauaguagaaauaauuugaaagcuuuuaauguauaauaguacuuacuucaggaaaauaauuugauguuucauuguuggucucuuuuucuauauuauuucagccuaagucuaucuucauaccacaggaaaugcauucuacugaggaugaaaaucaaggaacaaucaagagaugucccaugucagggagcccagcaaagccaucccaaguuccaccuagaccaccaccucccagauuacccccacacaaaccuguugccuuagguaaugguggagggugacagcaaauauguuaccagguuuucauacuauggggagaaaaaaaacuuucuuuuaagagauuauuugaaauucuuuugguggaggacagaaggaaagcaguggcuauggagauguuuucugcuuuuugccuacuagcuuaaaguguuuuuaugacaggauucccuaugacacagucugagauauuuuguccucauuucucauuucauauuuagccuucucucuucuagagacugguuccccauucauuuagcuacgguguggaaacaaugcaaauuaaacuaugaacaaacauggaaaauguguuuugcgucuagguuacuucuguuuuagaagagaguaccuuguccuaacuccuuauuucauuuaaucauuucuaaaaaaauaauugguauuauuugcuagguauuugccuccaaauuaauacuagaaggugcuauuuuaacacuguaaagacuccucuguguuuauccagaagaagcaauuuuaaaaaagagcaacuaggcugggcaugguggcucacaccuguaaucccagcacuuugggaggccgaggcagguggaucaccugaggucaagaguuugagaccagccugaccaacauggugaaacuccaucucuacuaaaaaaaaaaauacaaaauuagcugggcgugguagcgcaugccuguaaucccagcuacuugggagacuaaggcaggagaaucgcuugcuugaaccugggaggcggaguuugcacugagccaagaucacgccauugcacucuagccugggugauaagagcaaaacuccuucucaaaaaaaaaaaagagcaacuaaaguuucuuggaugacauaauaauaaaucaccccuuuucuaaaaguaguuaugaauucaguauuugguuuuuuaaugcuaacaaauacaugcacuuauacacaaccugaauuuaaauuugccuaauaugccagaaauagagguauaaauagaagaacauauauauaaaugacgucuuacuuucauaguaaauauucugauugggugaucccaaaugaauaaugacacuaugucagaguuaauauuuuuucuuuccuacuugauaacuuucugaauaaaaguuuucaugaagauuaaucauuuucaaugaauauaucuuauugaaggaaauggaaugagcuccuuccaguuaaauggugaacgagauggcucauuaugucaacaacagaaugaacauagaggcacaaaccuuucaagaaaagaaaagaaagauguaccaguagguauugauagucauaaguucuacuuguauuuguuuccuuuuuaacuguuaaguuaguuuuaugcuuacaauuagugacacuauagcacuaguauauuuuacaauuacuauauugauauuuuaguauauuaauuauaauggugaauagauuauuuaaaucuugaaaaaaguaacuuagcuaugguaaacuugaaugauggcuuuuuaucguuuacauuauuuagaccaauuuguuauguaguacguuauaaaacaucuucuuuauacagauaaaugcuuaguauucuugugauuauucacaaaauaacuauuauuauucucauugaggauaauugauucuugauaguuucucuuacagucucaugaaguuacggaaagaaggacauagauaaagaaagcuguagcuucuaccccaggacaaauuucuaacuauagaucaggggucccuaaccccugggccgcagaccaguaauggucaguggccuguuaggaaccaggccacacagcaggaggugagcagugggcaagugagcauuaccgccugagcuccaccuucugucaggucagcugcagcauuagauucucguagugcaaacccuguugugaagugugcaugcaagggaucuagguugcacgcugcuuacacgaauguaacuaaugccugauuaucugagguggaacaguuucauccccaaaacaucccuccccuucaacccccaucuguggaaaaauugucuuccacgaaaccagucccugaugccgaaaagguuggggaaccacuguuagagauuacauaaguagugacauugcugcucuuacuuaccacuucaagaaaggugaaauuagucuuagcagcuacuccuaucacaaauguuagcuaaaacaucagaacuauuaaaacauaaauguuauucaucagggaucauaagagaugaaacauuuuaaacauuuguaaagaauugacuuacaaucacuggaagacauucaacuaucaucauagaauuuaaaauaguagaaaauccuuaaaauccccaauaucucaacagaugucaacaagaugaauaggguuuuuuggaaguuuuuguauauacuaauauuuguuauuuuuauagaaauuucuaguauauucgguauguuugucuaguacauucaguaugcuaugguuucugcaguaagcacaucacuagagucuuuugugcuauaucuguuuaacuuuuuaaaaauauuucacuauacaauaugacauauuauucuuaaaauucacauaaaguauuugguguuauucauuguaauuucugaaauuuaggaauggguuuuaugaaguucuguccaacugagcagugccuuuuugcuuucaacaauuuaaauuuuaauagaccugcuaacauaauaguacaaaaaugcagcugagugacuguaacacaguauaaaauaaauagccuuugagagauguaaacuuuuuuuuuaaccuuuccaaugguacuaaguaaacauuuuuuauguaugcauuuuuaguucacuuuuucuguuaacuuacuucauuaagauaaggaacuguuucaguaauucugaaauaaauauguccauggcucuaucauaggauaaacaguaucagugauauauugaagcaugcuuacaguuuaugcuguaauucuugaaauuauuuacagccgucacaucuguaaucccagugcuuucaguggaaaaggcaaggggaucacuugagagcagaaguucaagaccagccugggcaacauagcaaaacccugucucuacaaaaaauaaaaauuuagccagacaugguggcaugcacccauaauccuagcugcucaggaggcugagacaggagaaucacaugagcccaggagguugagguuaaagugagcuaugcuugccugccacugcacuccagccugggugacagagcaagaccauaucucuaaaaaaaauuaaaugauaauaaauaauaaauuuauuuuauuuuauuuauuuauuuauucauuuugagauggagucucgcucugucgcccaggccagagugcaguggcgcaauuuuggcucacugcaaccuccaccuucuggguucaagugauucuccugccucagccuccugaguagcugggauuacaggugcacgccaccacgccuggcuacuuuuuguauuuuuaguacagacggaguuucaccauguuggucaggcuggucucgaauccuugaccucaugaucugccuaccucagccucccaaagugcugggauuacaggcgugagccacugcgcccagccuuauuuauuuuaaauaauauuuacaaccaguucuauuagugcuuagguuaaaucugagaguuauaacacucagagcucccuaauuuaaaaugauguuuugcuaggccgggcacaguggcucacaccuauaauccguacacuuugggaggccaagacagguggaucauuuaaggccaggaguucaaaaccaaccucgccaacaugguaaaaccccaucucuacuacaaauacagaaacagccgggugugguggcaggcgccuguaaucucagcuacucaggaggcugaggcacgagaaucacuugaaccugggaggcagagguugcagugacccgauaucgugccccugcacuccagccuggguaacagagcaagacugucucaaaaaaaauaaaaaaacaacaacaaaaaaagauguuuugcuaaaauagaugacaucagauaauuuaauaacaucaauauaagaaaaaauauauauuauuugcauaauggaauaaaaagguaucagaaauuauuggcaauaauaagaugugcgcauccucaaaaauauaucuacaaaguaugucauuuuaauuucagaaauguuauauuuuuauguuguauauaugaaaucaauuaacaguagcuuuuuuauuaguuuucaucucauuguuuaagugauucugauguauggcagcucuagggaaaaauuagaaugucauuccuuaaaaugauguuacugagauuaaccuugaaagaaauguagacugucacaaaguucauguuuaaaguauacccaggggguucccucucaggggacaguucguauacucaagaauguggccacuuggagaaauaucuggcauucuucagcauagugugggugagcaaauguguuacauuucuucuccuuauaauugccuguauacucuaaccaaugauuaauauauuugaauucaucaaaauuuggaacuucacuuagcaaaacucauuguaaacauggugaagauuaucuacacaaggagaaacuauuuguuguauauauauaacagauaaaauacucaaaccuagaauauauuuuuaaaagcuccaacaaauagauaugaaaaaagauaacucaguuaaaaaaaaugggaaaagaauucacaaaagaggaaauacagauagcaaauaaacacuggguuaaaaagauucuuaaucuuccuagcagucagaggcaugcaaauuaaugaggagcacaggagaaaagguuuuuuacuaaucagcuuggugauauugcugugagacuagaaagaaccaggagcucucauacauugcuggugggugugaugugauauguacacucugaaaagcaguuugacagucaauaugcacuaaaauguaaaagauagagacccuguguaucaguaguuucucaguauacccauacugcgguauacuucucacaguauaccaauaaaggcauccacucauacacuguguaaguagguauauacaggaaaguuuauuucagcaucuguguucuaguaaaauauugacaauaaucuaaauaccgaauaauguuuaaggauagcuaaauaaaguauauuuaugccaugcugcaguuaaaacaaaugaacuaagucuacaugaccgauauggauuacuguccaauuuuaaggcaaagauccugcagauaguguauaacuauuuguguuuuaaauuccuaacacacacacaaacacuauuuucuaugggaacauguauuuacauauauaccaaaaaugucuggaaagccauaugauuacauaaguauaucuaauucacuagagaaagauuuggaagguuuuacaccaaacuaguuuuucuggggcaaguacuagaaauagugcauugugaaagaauuauggggaacuucagccuuaacuguaauguuuuguuuuacaaagaauguauucauguauuuuauuugaauaaauguguuugaaauacaguauuauuauaucaaacagcagcaaaaaaaguguaaucauacauguguucuuuuucuagaagccuauuaguaauggucuuccuccaacaccuaaagugcauguaaguacuaaauauggaguaggcuaaguuucaagcuaagucacuuguguguguuaucuuugcuuagguuuuuuugucuguuugaaagaacuuucauuauuauugaaaaaaaaucuauaagauugcuaauuuaauuacaggcaugugucaccaugccccgcuaauuuuuguauuuuuaauagagacagaguuucaccauguuggccaggcuggucucgaauuccuggccucaagugaucugcccaccuuggcuucccaaagugcugugauuauaggcauaaacuaccaugccugcccuuuuucuuuuuuuuuuuuuuugagacggagucucacucuguugcccaggcuagagugcaguggcauaaucucagcucauugcaagcuccaccucccagguucaugccauucuccugccucagccucucgaguagcugggacuauaggugccugccaccaugccuggcuaauuuuuuguguguuuuuauagagacggguuuuaccauauuggccaggcuggucuugaacuucugaccucaggugaugugugcaccucggccucccaaagugcugggaucacaagugugagccaccacgccuugccguuuuuuaccuuuaaauucuacuuuuuaauuagcacagaguauacuuuauaaacuguauguuacaaaauauauauacuuuauauuuguaauuuauauaauacuuaaauuauaaauauuuuaaaauaauuuuaauauugauuuauacaguauacuuuauauuauauagcauauauauuacagcagagaaauacauaaaauagggcagauuuucccacuugacuguaagauaaaacacuuaccucaggcuugcaguuugacagggaaaagcuaucuguggaaugccagguagacuccagcuauacaaauuagcuuaagauugggaacuggcuugauuguuuuguucuucguuuugucauuuaaauuucuagggguuagcaguacccuaacacagaaauuuccguagcugucuuaaaaggucguuauuaggguuaguuaaaugauaguuucugcccuacauccuaaagacauguuucuauuggucugcuacuacuugaugguauugccaagcuaaauuguucuuuuuugguaccagagucuuuaaagauauauuguuugguagauuucugucauuaaaagggaaauuuuaagguccauguuuuaauuauguuaauauuuuuaauccauuauugucaacuagugauguuuucguucaguauguuaccuccguguuugugaggaagacauuccuucuauaaaaugaugcacaaaugcuguucuuuuaauuuaggccaacauggcaaauacugaaauuuucucugaccaaaaauauuuuuguacuguuuuucccucaaguugucaguaguaaaagugauuaccugagucaacauucuuguaccuugaguauuuaaccagaaggauaauuucagaguuaauauuuugcucuuugauaauauaaaguucaaaugggugauauauuucauuaugauauauuuauuaucugaaaaguuuguaaauggacuugauaaguaauauuaacaucaaagaguuaagcuuuuuaaugaaucuuuccagggaaauaaucagauugcuuaauugaaaaaaauaaaaauaaaagucuguguuuggagguugaagcacauauaugaauuucaaaucagccauaccuguuucaguuuguaaugugaaauucaauuuuuaauaccauuuuuaggcucauaaaaccaaacaagaaaaaugucuuccuuuguagagauuaugauuuccuuuuuaccagagacuauuguauugcucuugacauggagcauguaagauacauuauuaugcagaauugguuccuauuauugcuuuguuuaguugaaaagauagaaaaaauaagaccuuuuuuuuuucucuuuuuuccaaguaaaauuauuguggcaccuggaaacuugugguaccacuguuaggcaaaugacuaugaugauuucuuacacuuacuucuguaaauuugaagaugaucauaauuucaguauacuaucuauagacucucacauuaaaauagauaauaguuacauuuuauauauuaaagacuguuacuugucacuguuucauauugguuauucuuuguuucccuagaugggugcauguuuuucaaaaguuuuuaaugggugucccuugaaaauucacugugcaucaucauggauaaacccagauacaagagguaguauuguguguuuuuaucuguuaucuuccuaauuuuuuaaaacuggggccaugaaagcauuugugauuuuguuuauuuucugaguaucuuucuggggaaaaaaaguuuuguuauaauuuuuuuuuuauuuuaagguaaauauguuucuuugugcuguuaucaguguuugaggugacacauaacauuaaaauuucacuguauaguuaccauaucaguauagugaagccauguauucugagccacccuaguuuccuccagaaauguuucugcugcugcugcacaguagucugguaucuuuuuuuauuuuuuauuuauagggaaaauguuuugcucugccacccaggcuagaguacaguggcaugaucauggcucacuauaaccucaaacuucuggccuuaugcaaucccccugccucagccacccgaguagcuaggacuggaggcacaugccaccauuccuagcuguuuuuguuuuuuaauuuuuuguagagaugggagcugucuguguuccccaggcuggucucgaaguccugggcucaagcaguugucgccucagccucccaaagugcugagauuacagacaggagccacuggccaguagcuucauuuuuuucaaaacagccauuauggaaggaauuuagcuaccaaggauccgggguuuagugaccacuuuagaggaucucugaccuuaaaaggggccauaaucacaacaguuguccuuaggcaaccacuaagaacugucuguguccucucacuguauaucugauucuuaauagcugucuauguaagauacacauagaacauuuauacgugaacauuuuuauauacauacacauacacucauuaaauaugcugaguacuuuuaugucauaggcaaggaaauuggcacucagagagguucauuguuuauagccaauuggugcuagaaagggucaguuuaaauccaauacugucugaccacaaaucuuaugccauuaaucucccaguacuaaucuuaaauucugggcacuuuaggaaugcucuuagcauucuauacuguucucagcguacuucaguuuagccuaguuagucuagaaaaguucuugaccuguauuaucuuaaaaacagaucgggcacuuuucuucaaguugccugcuuggaucucuuggaaguguucuuuccuuucuuuccuguucuaaagucuuuuuaauaaauuuccacuccugcuccugcucugggaaacaaacaaacaaacaaaaaaauggaaaggacgauggccaugcuucucauaucuuuuagaagauacugaguacccuagcagguauccaaguuuuaguuaacuuuuuaauagacuguggucagauucugggguuuuuuaaauuagaguacuuauaguauagcucugaaaaaaaauucuguagaaauaauuagaaucuguaucagccacucucgauuuuauauucuguaugucaguugcacaugauccugucuuuaggggguuuuagaaaaaggagcugcagauccuuugccaguucuuagcauucucugaugagugaagaaucuacuaugccacucuucagaaccucccuuacauaaaaauucucuucacugcuuugaggcuaauguuuacauauaauucaguuuaugggucuaaagugucuaaccucuuuguauucacugcuuauaaaucauaguaauucuuguuuuauauguuaauacuuauuuacggaaguuuagauuauagaaauccuauuuaaaaauauuuuauuuaccaaaaucagucagugaauuacuuuuauuucagaucaguacuugauauuuggugccgaagaagggauuuauacccucaaucuuaaugaacuucaugaaacaucaauggaacagguauguuauuuuguauauucuuuuuuuuuuuaauuuuuaaguuaccauaaguacacauuagaccagaaauaagguucaguuucaugacuugcugccucuuuuauucuuuuuuguuuuguuuuguuuuguuuuuugagaccaagucucacucuuguugcccaggcugcagugcaguggugugaucucggcucacugcaaccaguuucaagcaauucucaugccucagccucccaaguagcugggaguagaggcacgcaccaccacgcccagccaauuuuuguguuuuuaguagagacaggguuucaccauguuggccaggcuggucuugaacuccugaccucaggugaucugcccgccucggccucccagugugcugggauuauagacaugagccaccaugccuggcuaauuuuuguguuuuuaguagagauaggguuucaccauguugcccaugcuggucuggaacuccuggccucaagugcugggauuauagauaugagccaccccaccccagcgucuuuuauucuuaaaauccucaugacgccgagcaugguggcucacgccuguaaucccagcacuuugugaggccaaggcaggcagaucaccugaggucaggaguucgagaccagccuggccaacauggugaaacccugucucuacuaaaaaauauaaaaauuagcugggcaugguggccugugccuauaaucccaacugcuucgaaggcugagacaggagagucacuugaacccgggaggaggagguuacagugagccgagauuacgccauugcacuccagccugggcaacaaaagugaaacuccaccucaaaaaaaaaaccuucuggagcauguucuaauuaccagauacugaagacagguuaacaggacuaguccauacccuugagaagcucaugaucuaauagggaaaacagguguauaaaccaguaacuacagcacucaggauuagaugucauauuaggaaugaguauaagauauuggccacagagguggaugucaccagcaccuccuguggggagaugaguagaggcauuugagauggaccuuaaauuaugaugaauagaaguuugucacacagacaggauaagcaugauggcauagagaugugaaauagcauggcaaguuugggaacaaugacugggcauuugacuggaguacagaaugguaacaauagauggagcuggguaggcaggcagaagccaaacaccagagcuugguguacuaugcugauggaacagaccuguguuuuagaaauaucuguuugcaguacggugagagaugagacuagaaaccauggucaaaugguaaaagaguguuaauucagggcaaagguagagaacagaggggaaaagauauuuuucaaaaacaguuuuaucgagauauaauucacauaucauacaguucacccacuuaaaggguacaauucaguggcuuuuaguacguucacagcguugugcagccauuacaccaucaguuuuaggacauuuuuaucaucuccaaaagaaccuccguaaucauuaguggucauuccccauuucucuccuccucucccccaguauggggauguuuuugagugucacaaugaguggggggagcuuuuaucauuuaguacccacgagucaggaacauaaaacaaccuacaaacugauaauaauggugaugcuauuaauagcuaauacuuacauaaagcuuacuauguguccacgcaguguuuuuaaaugcuugacauauauuauuuagucuucaugaaaucucucacagguagacaccauugauaaucucacuucacggaugagaaaacuaaagcaccgaaaggauuaguaacuugccaaagacuccauagcuauucaguggcuggacugcgauaugaaccuaggcaagcuagcuccagauuccaugugcuuaacuacuucaccauauucucucuaccgauuguauaguuccuguagagaaaugcuggaccuagagaaagaucagagaucuagaauugaccgaauugaaugaccguuucaacauggagguugaagagaggucuagguuaacuuuagguuuuccacuugagugacugggugccugacaguaacagaaagauggaguauaguauacugaaggauguguugauuugaagagaaugguaaugcuuucaauuuggucauacugaguuuggggugccuucgggaugugugacuaauucuuuuaucaauauaaaucgauuacaaggccggccgugguggcucaugccuguaaucccagcacuuugggaggccgagguggguggucaccugaggucaggaguucgacaccagccuaacaaauaaggugaaaccccgucccuauuaaaaauacaaaaauuagccaagcauggucaugugcagcuguagucccagcuacucaggaggcugagacaggagaaucacuuaaacccgggaggcggagguugcagugagccgagaucacgccacugcacuccagccugggcaacggagugagacuccaucucaaaacaaaauaaaaauaaaaauaaauugauuacaaauaaaauggaaagaaaaauauauaaguaaugauuuauucaugacuaaacaguuucaucuucauuuuuuaaaucaaauuuucuagcaagauccuaaacuguaugauauacuguaaaucuuuuaaucuggaaaugguguacagugaaauggcugaaaagugccuaagaacagggaaagggaggaaaaggaucuuguaauuauaauaauuaguaaauaauucaaagguggucauauuuuuauuggguauaaugagauauccaaaaauaauauugguaacaauauuaauuguaaggaauaaggccagcuuuaugcauagguggaguaagcauuuaucaaccuaauuugaagaacucuuuuguuguuguuguuauuuuugagacaggguuucauucugucacccaggcuggagggcaguggcgugaacacagcucacugcagccuugaccuccugggcucaagugacccaccucagcguucucaguagcugggacuacagccacaugccacaaugcccagcuaauuuuuugauauuuuguagagacugggauuucacuuuguugcccaggcuggucucaaacuucugggcuccagcaguccuucugccuuacccacccagugcugggauuacaggugugagucaccaggccuggccaggacucuugagagaaggcacccaucaaccacaccuagccccagucugcaauaacuucccuucuuaguugcuuuagcauuugaauuacauuacuagaguaauuuuuuuugaaacauugcccuucaaaggaaacauuuuucccuccuagagggagccuauaagaguaaagaauuaguauauguggagccugaauuuuucaucuuacugugaaauugaugauuagguugauuuucucuagacuuuauaggaaacaggguggcgugagccuacuaaauaggggaagauucugaaaagugagaagaugacacuaaucaggguccugauuuaaaguuuuuuaucugcuuuuauuauuuauagcuaacauuuauucaguacucagcacucuucuaagugcuuuacaaggaguaucuuguuuaauuacuauucagcucuaugagauacagguauucuguuuuacagauaagaacacugagacagagauucaguaaauuacccaagaucacacaaucauugauaaaacagauauaugagucuaggcagaauauagaagcuacccuucuuaacuguuauauucuuauuuauuaaacugaucauuucaccuagaaccuaacucacuaaaggaagaaagcauugaaaaucuaguaaagcuuuagauuuguaaaaguuguuaaaaaugaaaauucagggucaggcgcgauggcucaugccuguaaucccugcacuuugggaggccgaggugaguggaucaugaggucaggagaucgagaccauccuggcuaacacggugaaaccccgucucuacuaaaaauacaaaaaaaaaauuagccgggcgugguggcgggcgccuguagucccagcuacucgggaggcugaggcaggagaagggcgugaaccugggaggcggagcuugcagugagcggagaucgcgccacugcacuccagccugggcaacacagcgagacuccaucucaaaaaaaaaaaaagagagagaaagaaaauucaaaaugaaauccaguacuuuuuaaauaaaacuauacauaaauaccuuuucauugucccuauguugaaaauaugaaaggaauuugugucuugucuugcuacuuuauauauguuuauauuaaauaagcaaaccuacuuacauuuggaaguauauaauuuuauaguaaaccaucgauguaguaucagauacuuuuuuaguggauauguguaugaaaacccaguucaacacugaauuaaauaaaaaucuguaucuugcuacuuugauaacacguacugauauguggucuggaauaagucauugccccuucucuaccugauuuuuucaguauagccaaugaagucccaauuuuguugugaauuuuuugugaaaagcagaaaguaggaaauggauguugauaacuucucuauuugaggcacagguauaggcacauuuuacaaauuaaaaaacuguauuggcaaugccacauuuuaguuguuuggagaaauugguuauuuuauguaaguacauuuucccaguaaaugaaauaaaauuuuuauuaaaauguuacuuuguuucuccucccuuuuauuauuaccuuuucucuuuuaguuauucagucccauuauuauggcuguguuuccauaaaguaauguccuuagaggccuugauguguuucaucauucaccccuggguccucucuauuccauucucucaucucaauuaguuuuggaguaacuuaguuguaggaauugccagagcaaacccagcaacaaagguuguuaaaucaggaugucuaauuauguacaucaguggcucucaaacuucagucugccucagaauuacuuggaggccuaguuaaaccauagauuccuggguccuccuucagaacuucuugcuucaguagaucuggggugagguccaagaauuuacauuucuaccaugugcccagguguuguugaagcugcugguccaaggaccauuuaaaaaccacugauacgcauaacgaaaugucuuaaugagaguauuuuuuuuuaaauauauagauuguguuccaugaaauuccuuuuucuuugcucuaaguugugaccacuuucaggcuuccagagaugccucucaguucuuaugguacuaaauuuuaguaauaaauuucauauauauauauaucugcuuugugauuuaugaguuuucaucaucuucuaucucagccuuuuuuuucccuccauaccuaguguuucuguauccuguguuccacuacaccaugaugcuuuuuccuguaucauacacccuagaaugcauauugugccuagauacgucuauuuugggaggaguagagaggagaaucuuauucaaccccagaaccaaaauaaaggaauagauguuguuugaaaauguuguuauucccugcauaguuugggguuacauagcccuuaaucauaagggagacuugagcugaucauaucguguuuaggcuaaaauuuagccuaauuuauuuuuucucucacauaaauauguauguauauauaucaucuugguuugaauccuugauaaaguuaauuuauguuaaaaauaauuuacuuuuaaagaacugaccuguagauaagacagcuuacgugauuacuguguacagauuuacauugccauuauguauuauucuuuguaaacuuugugccuuuuuuuaaucagcuauucccucgaagguguacaugguuguauguaaugaacaauugcuugcuaucaauaucugguaaguauauuaguuuuuaaauaccuuacaauuguuacuauuuauuauuagcuuuuaugucauaucuguuuuucuuuauagguaaagcuucucagcuuuauucccauaauuuaccagggcuuuuugauuaugcaagacaaaugcaaaaguuaccuguugcuauuccagcacacaaacucccugacagaauacugccaagguaaggguacauccuuagaggcaauaugauauuaacaguucauucucauaaauauuuauguuacagaaagugaaagagcacucaguuuggguuaauaaaaaucaugaugaaaaaauaauaaguaauauacauuaacaagugcuuagugaucacacucuuguucuaaaauuuuucuacuuuguacuuucaaauuauaucagacauuuucucucugaauuuuuuauucuuuuucugcaaguuuaaaacuaguuuuuuucuuguacuuugccauaauuuuacauugcauuuagugccuuugcuuuugacauauguguuaacuuuauaaaauuuuucucaaaguuucuauaccuagaaaaucaaaaugauuuauugaaaaguguuuuugcaaccuggcaugguggcucacgccuguaaucccaauacuuugagaggcugaggcaggaaaauggcuugaggcuaggaguucaagaccagccugagcaacauagcaagaccucaucucuacaaaaaauauuuuuuaaaaaguagccaggcaugguggcucgagccugugguuccagcuacucaggaggcugaagugggaggaucaguggagcccuggagguugagacugcagugagcuaugaucaugccacuacacuccagccuggcuaacaaggcaagaccgugucucaguguuuugcauuagaagauaauuaguuugaaguugagugguuuugccuuucuaguuucaguaauuuguuauuaugcucuguucuuucguuauuuaauauaauauuggaccucuuuauugacugaaagauuuucuagcucugguauaaauuguauuuuacaaaaacuuuauaauaugccuauucuuuuuuauaauauuuguuguaaagcaacuaacauaaaaccuuaauuuucgaguaccuugagaaucugcuguucucaauagagaccuuuuuagcuuauuugcuuuuagcuguguucguuucuuccagauuuuacugaauacaccaaauguguaugaaaugucccauguauaaaugagacaaaauugaauaagauauagucucuuccuuuaaggaguuuccauaugguaugauuuuaccuacgcugaauauagguacuuauuguaccauauuauaauucauuuuuaauaaagcauaagcuuuggaauucaaguaaaguugaauuuaaauccuggaucauugacuuacuagauaugggaccuuggauaaauuauacaaccuuuccccauguguucagcucuaaggguauuucaccuccagguuauuauuucaggaauuuuauuauagucaaucuuuaguuuuuuuaauaguaacagccacaaauauguccuucccacuuucuucaguuucauuaucuaguaauuacuguaaaaucuuuuaauucucucacuuauuggcaggaaaccuaaaaacccuuuuagcaucauaauauuuuauauaugugcauucauaccauuucuucugccauacagugagcacaacuuaaaccucuacugagugucuuauucuuaaucugaugauaaagagccucaugguucucauucugaagauagguacucauuguaccauauuguaauccauuuuuaguaaagcauaagcuuuggaauucaaguacaguuguaucauuuacuuacuagguaugggaccuuggguaaauuauacagccucuccacguauauucagcuguaacuggaaccuauauacucaucuggcagaguuguuuugaaaaugauaaaucguguauguaaaguaccuaccacagcaccuaguaagcucucaagaaauagaccuuuugucaucauuauugggcaugauaaauugaacucugccuuguaguguacucuaaaauauccuauguuaaauacauucagacaguuaauuuagaauuccaguuaauugggugcugguaaaauaaguuguauuguguuucauaaaaucaugacuaaaauuaaggcaagucuauagaucacuauagaacauuaacuaaauuuuugaaacauuucaguguacugcccacaacucuuauuuugaaaaguuuuugaaauccuuaauucacagccauacuuaauaguugauuucuguuuguguaguagucaucccuauggucuuucagaacuuggcaguuaauccuccuggguuuugacuaguucaguguuuuaaccccuaaguuagcuuugggagcuaggacacaaguucacaaguguggacaggaacauuaaacuuucugccagccgaaaucugucaggagcuugguucagauuuuuuuuaacucuaaaaagcgcuuugguucaaagcagauucguuaagaguguggggaguuuuuguuuuguuuuauuuuaagcugcauuaaacuccaauguauaugaaaggggcauuuuuauaauuguaaguuauaauguaaaacuuuuccuaauguaaaguuagucaaggguacaaugagguguuuuaaccagaaaaucguaaucagaauauucuagauugccauuguagucguucaguguuucaacaucugaauaaauucugugucauuguuuagcugucacagugugaaaaacguuuugauucacaaagacaaguacuuaaaaagagguaacaguuuuugacagcuuaccuugcacacucugaauaauguucauuuaaauugauacagccuguaguuccagcuaccugggaggcugaggcaggagaauugccugaacccaagaggcagagguugcggugacccaagauugagccacugcacuccauccugggcaacagagugagacccugucuccaaaaaaaaaaaaaaaaaaaaagaccugagcaaaaaucuaagcuucagauuucuaugcuguaaccuaccucuuuauuggagggacugaaugacacagaugucuaaaaugcauggcacauaguaaggacucaguaaaugaagcuaaaauuauagcuuuucauaaauaggucaauauauaaaauguauuaaggguuaaaauuacaguacuacgauauuauauuuuuuaauauuauauuuaugcuuaucauucaguugccaauugugugguuacaagaacauccaucaggaaaauuguucugagcuuguuuggaauugcacugaacaucacacaugugcuguacaauuuuauauaaaauuguacaacucuaaaaaaaaaaaaagacuuguacagagcacuggcaucuaucuaaucuuuggcaaauuuacacauuuaaguuuaaguggcucaugccuguaaucccagcacuuaaggaggcugcacuuuuggcagauuacuugagccucaggaauuugagaccagccugggcaacauggugaaaucugucucuuucuucuaaaaauuauuuuuuuaaaaaaaagaguuuagauguuuguagaagucaggcacgguggaucaauugaggucaggaguucgagaccaaccuggccaacaugucgaaaccccgucucuacuaaaaguacaaaaauuaguugggugugguggcugaugccuguaaucacagcuauuugagaagcugaggcaggagaaucacuugaaccugggaggcagagguugcagugaacugaggucaagccacugcacuccagccugggcgacagagcgagacuccgucucaaaaaaaaaaaaaaaaaaaaaaauagaaaaaaucuuuagccgggcacaguggcucacaccuguaaucccagcacuuugggaguccgaggcggacggaucaccugagcucaggaguccgagaccagcuugggcaaaguggcacaaccccgucucuacuaaaaauacaaaaauuagcugagcaugauggcaggcaccuguagucccagcuauuuggcauucugagacaggaggauugcuugaaccugggaggcggagguugcagugagccaagaucacacccuugcacuccagccugggcgacagagcgagaccuuguccaaaaaauaaaauaaaauuuaauaauaaaaaguauguacagaaauggguuuaauuugagguuuuuacaauuugaugcaccaacaaccuuuauuauauuacauuuuaaaagacauuugaguguauguguaguuuuuaaauuguaguuuuuaaaaaaauucagaauugauuuuuaucuauuaaauucgagucagauguuugcaaaacaccuauagcaccuuugcagaacaucuguaucccacuuuuccugaguagagaaacaaagauuucuaaaaaagaaauucuucacaaauuuuuauaauaagacagcuuuuuacaguacauguaaauguauuacauguacuaaaaauagcucucuccaguuuuuggcuuuucauuuucucaaugauaucuuuugguaaaccaaaguuacuaauucaguaauugacugccaccuguaguuugaggugcuaagguugaaucagugggggcaaaaaagccaauuaaaauguaacagcauuuuccuguaugauuuguuguuuuuguauuucuuaaaucccaaggucauauauuucuauagacuucuauaguuuguuuucauauuuaaacccuuaacccauuuggaacugauugggggccaugagaaggggauccaauuuauuuaauuuuuuuuuuuuuuuuuuuggagaccgaguuuugcucuucuguuguugcccaggcuggagugcaauggugugcucucggcucaccacauccuccaccuccuggguucaagcgauucuccugccucagccuccugaguagcugggauuacaggcauacaccaccaugccuggcuaauuuuuuuguauuuuuaguagagacgggguuuuauuauguuggccaggcuggucucgaagucuugaccuugugauccgcccaccucggccucccaaagugcugggauuacaggcaacgugccauggcacccggccuuuuuauucuaauuuuaauagaugagcuaguaugucagcaccaguuuugaacucauccuuugugcacugaucuauaacaguagcuuuuucauauacuaaguuugccuacauauauuacguacucacuuuuauuuacauuuaggaaauuuucuguaucagcaaaaaucccugaaaccaaauggugccagaaguguuguguugguaaguaaacuguccaauagcauauagcucucugagacuccuccuaaaaucuggcauaaaacaguacuaccccagggcauucugccagcaauacuuuauuuuuccugcuuaaguagaacaaauuucuuggcuguuucaucucuguguagacuaagccuaauacauaguaccuugcaaauaauuuauuugcaaauaaauguuuauuagcaaauaaauuauuugcuaaacaaauaauuuauugccuagguaaauggagaaaguuguaugacuuuuuuuuuuuuaccacauuuuaucacacccuguuuuccaaggguccuguuacguaccauucaccauucugcuuagcaauggcuugugagauggcauuuauuccuucagcauguauuuuuauguucaccuuccucucaccuaaauuccucccccaccccaauaacaauuaguuguucuauuugcauguagccagagcaaaaaaugauuucuuucccuuaaguuacuauuauuauaaaagggacgauaaacacaugagucauuauaccacaaguauaguguggaaaggacucuaaacauaggcucacugaagaagguggcauuugggccaggccucaaaauaaggcagauucagauuugaacugaauagauggagagucauuucaaacagaagaaaugacauaacauguggaggcaaaaaaaaaaucauaaagguuacauaauaaaugcugacuauucgcuuagcuggauacagaugauagaaaggagaguggcagaugagugugagccauuggccuugugugagcauguacuuauuacugugcaacaaguaaggaaggaagucuugugcuagagcaguagcagugcaaauagcagggaaggaguaucugggugugaagggaaaagaugucagagaugacugaggccucaaacccaaaagacuggcagaagggcaaguguuaacaggaagcgagaacagcugguuuagagcaaaagaggaugacaagguuggguuuagacauggugguugagucucuguuagaacugcagcaaauuuacuugacucuaccugaggacaaaggggcagguuuuuaggaaaaguuaauuauaggaaagaauuuccuauauagacuucucuguuuucuuuggcgggacaguuuugcuguucuccuccucugccauuuaaauauuucaaaucuauuugaagugugugaacuuuacugcuguuccccuuuucacaguucaguuuuuuuaucuuuauuccaaauauauuuacuucacauauauuuacuuuacuucuucugguuuauaaccagaagaaaauuucaaaaucugagguaauucaauuuuauuauuuguaaaccaguauuuuaagguucgauuaauaucugugauguuuucuagugaccauaagaauugaaucaaaagggggaagauagacaaguguuuuauuuucagaaacaaaacauuauugccucugaacauuaccaccaaaagcaccuugugaaccacccgaauguguuguaucuuaggagucugacaacuucuucccaaauuuacuuugacccuuuuaucagaauguugccaccucagguaauuuuccuaccaucauaagacgaaaaguccuuccucuuaccccacagccucauuauaaccagcaguuucauuugugcauacaaauaaaaauccugcaaguuaagagggcauuuccugcuauuaccugaaacaguauuuuuuucacccagcccucuaauuaagaaacugaacuggcaaccagcuuuugauuuuguuuuauguuuaguuuguuuaguuuuguuuguuuuuuugagcaugcaauuauugucauaaugacuuuguuuuauaagagaacucauuuauauuuuugcuuugacaguaagaaauccuuacacgggccauaaauaccuauguggagcacuucagacuagcauuguucuauuagaauggguugaaccaaugcagaaauuuauguuaauuaagguaagcauaaaagucagacuaucuuauucuuacuauaaaagcuugucaaccuuacuguucuuuaaagaaacauuuuuuucaguuaauuuucaaguuaauuuagugauuuuagauaauguggcaggguuguaaaaaucugcccaguuguaagcaacuuaauuggccuaguaaaaguuuuauaagagacuagagaaauaaugcaaggguauggcgguggggagcuggaaauagugucucacauacagagccugauggcagaaacaggaaguacuaaaagaucagugaaauauuuugaauacacucucugguugaccuccaucacagcugaaaacaacauacagguugcaguuuggccuaggagaacuagggguaaccauaaugacagggaaacaaguuguuuuuaguuauauacccacccauuaauuuaccuaggccuuuccacagauuuuuuuuauagaaucauuuaauuaaugaauaauuuuuaaaauauuuacuguuacucaucuguaacuuacauuuaaggaaaaacuaacuuuuaaaaugugugaaguacaggcucaguuaauuacaucaaggaaauaccaaaugaauuuuaaaagucauuuuccaugcuauuauauauggacugaguggucuuauuucaugugcauuugaucucaguagaaauuagagucggaauauagcuggagugggguucuuccuaaauuuuauaguauuaagauguuuaaaguauugacucccuguuguuuaaaauccuguaagugacuaagaaaucuaguuuucguuuucauaucaguuuuacccucgagauucacuagggcuaaacagaugaaaauauaguuucaagaauuugaaaccuauugaaguauuaauuucacagguaaaugcacugaaacaaaaauuauuuaaacugaaagcucaggggaaaauagccuuauaaguugucuaaagcagaacuacugaauacagcccauuuauggcaaacauuguuuuguucucagcuccucuuuauucuuguuuauuugacaaaagaaugcucuauccaagauggaaugguaaagucuacacaguuugauuuuucaucaaccucuuccuuuccuaucuuuuuccuuucuuucuucaggcuauuuuaaauaugucccuccuauuauuuucauuccuaaccucuaucaaaaugaaaauguuucaucauaucaguuauucuuguauacugauauacugauuaaccugguaugaaugaauuuuauguguuaucuaauaugguaaaccauuuaugcuaauauauaaugaaagaugcuuuucucuguuagaggaauuguccaugucaagagcaugcaggagggaauauauacuuugaagacauaggacgcuuaaaaauuacccauccauggcuucucuuuuccggguagaugguaccagggugcuuggccuggcucuaaugaggccucuuaccagcauucugagauagugaaccuguaguacaauacuacuugcaggucucccucaagauuuuaaucacucuucucccuuuucuuaaacucucugagcuauaauguuugccugccuuccuuaaucuuaaccuagcuuuccuuuccgugucucucugcgucaagacuucuauaugggccgggcgcgguggcucacgcuuguaaucccagcacuuugggaggccgaggcgggcggaucacgaggucaggagaucgagaccauccuggcuaacacggugaaaccccgucucuacuaaaaauacaaaaaaaaaaaaaauagccgggcgugauggugggcgccuguagucccagcuacucgggaggcugaggcaggagaauggccugaacccgggaggcggagcuugcagugagccgagauugcgccacugcacucccgccugggccacagagcgagacuccgucucaaaaaaaaaaaaaaaaaacuucuauauguauauuuugucuccauauuuaacauuauuucuaucaguauuuaugauguuucuauacuauaacccuuaaucagauguauucaaaaacauuguuacgcuuucuauauucuuguuuccuccuaaugacauuucugacaguuuuugcaucauuagacugcuuuuauuuuuuuuugagauggagucugguucuguuggccaggcuggagugcaguggcaugaucucagcucacugcacccucagccucccaggaucaagcaguucucugccucagccucccgaguagcugggauuacagacacccagcuaauuuuuguauuuuuaguagagaugggguuucaccaucuuggcuaggcuggucucgaacuccugaccucaggugauccacccgcgucauacucccaaagugcugggauuacagguuugagccaccgcacccagccuggacugcauuuucauuauaaauaaaaguuaaaaauuaaagaucucuccagcaaacaugauguaccuauugcaggcaaggcaccguguuauuuacuagagagacaaaaauacauuagauacaauugcugcccucgaggacaauagcaacuggauuuaaaacuauuagacaugaauccccuucuguuaaugacuuauacaaauugcuuaguuauuauuggaagcaauguagaaguaaucaaaaucuguuguguuuuuuuuuaaagcguuguuucuguguuuaaacuguaaaaguuuaaagaugcgucuuuaaucagaagcauugguuuuuuuucugcuucguugcucuuuauuucaaagagaauuauuuaaguugcuguaccuuauuaaaaaugacagauuuuaucaaaagcaugugccccaagguaaugggaaagcuccuagagaagagguuuggagaauauugaugaagugucugugcccguggaauggaggcacuuuagcagccacagggaaagaaggacuguaggaacagcaggugaacacagagcuucacauuccagccaugaguaccauuuugugucuuccaacacuuuaaaacuaccuguuaggauaucccccguugcaccuuuuacuuuucuuuagaauuuaugaguugccagauuaaaaagaaaacaaaucaaauccaguagcuucauaaaaugcuagcaauaaccauuuggaaaauacagugaaaacacagccaguuuauaaaagcaacaaaaauauaaaauauauaagaaugaacuaaauaaaauaugcaugagagugguauuuuuuuuaauuugugaagaaaaauuuuagaauucccuuugucauccucccuuuuagucagcucccugcuucuuuuuuacaaaggaaaccuagaaaguucuuccuuuuuucucuuuuuuuacuaucuaagcucauaucccuaaacauuagaacuaauuuuauuuaauuuuucaacaguauuuaaguggaauuauaaaguauauguucauuugugucuggcuuuuugugcaacauuauauuuguauaguugcuggacauagcuauaguuuauucauuuuucaguugucuauauauaauuuuuuauuuugugaaugugccguaauuuuaucuguuuugcauuugucucuuguauauguguacucauguucuuuagaauguauaccuaggaguauuauugcaagguccuaaggaaugccuacuuccagcauuaauaaauaaugcaguuaacuagucuggcuaugccacucuaugucccaccaccaguguuguaugagcauuugcuuacuccucugggaugcuuauucacugucauucuuuuuaauuuuagccauucgguggguauguauaguauuuaucucauugugguuuuauuucuugauuacuaaugaaguuaguguuuuccaucuauuuuuuuuguccuucagaaugugaauuuauucuuuguagcaauauaaauuuuaaacauauaaaauuaaaauggguuguauuauaacugaguugauuugauaaaaaucacuugagauaugaagcuaauuuuuuuugauuuaugacuuuuucuguucacaucuuacaagaggagugucucuugcuaauuagcauuucacuucucucauccauguuugcucaguugauuaagaaggcagaggaguauaacugaagaagcaucacauugggagacaggagacucugccacaaaggccgggggaccaugggcuggucacccaguuccugggccccagguuccaacucugaaaagagaggguuggacacgugacuuauaaauucccuuccagccuuaauguccuaaaaucauguaauuauaacuuuaaaauauuuugcggugguaaaccuaaaauguuuauaaaagagaguccauaauuuagauuuuucugcauuaccugaauuucugugacaagaugcagucuuuauuguagaaagcuguuuuauaguauucucauagaauuauucgguuuuuauuuuccuugguuuaauguauuuuuguuucuuucucuagcacauagauuuuccuauaccauguccacuuagaauguuugaaaugcugguaguuccugaacaggaguacccuuuaguuuguguuggugucaguagagguagagacuucaaccaagugguucgauuugagacggucaauccaaauucuaccucuucaugguuuacagaaucagguuuguaauuuuuauggaauuauuaaggguaauacauauacugguuuuauaaguaguaaguuuacuguaucucuuacuaaggaaaaacugcauauacugccagucuucaauaacuauuauuaaacuggaagaagggaagauuacucucuuuaaaauagcuaauucauaugacacauuuaaaacauuggcuggcagggcauggugggucacgccaguaaucccaguacuuugggaggccaaggugagaagaucgcuugaguccaggaguucaagaacagccugggcaauguagcaagacccugucucuaaaaaaauugcauguaaguuagcugggcaugguggugcaugccuguagucccaccuaccagggaggccaagaugggaggauuacuugagcccaggaggucgagggugcagugagccauguucgcaccauuguacuccacccugggugacagaaugagauccugucucuaacuaaccaacuaaaucaagcaaacauugccaaaacaugauacugagagcacauacaccaguuuuuuuauuuagaaaugaauauaaggaucugauccucaaaguccuguguauauuauugguauguauauuugguauauauuaauaaacaauugugcaugaacacaccucuuacuauaaaaugagguauacaccuggguuguuauuugauuuuggugauauguauuuuaaauaacaaugucucuugaaggacacuguguauaggaaacccguaaagucauguuugcauuaaucuuucuuggaaauaauuaaauuaauauuacaaauuaaaugccaauuaaggcacuuuuuuucuucaaacaaaagggaaauaauuuauauagacucaaauauuuuuaauauuuugauaauacuuuucauuuuauauguuucacauuuccuuuuuggagaauuuuacaugcaucaaauuguuuugacuaaguucauuaauaugaaaaugaauacgaaauguauauuaacauaggaaacauuuaaaacaaaacuuggguacuuaacauuuucauaacucucagaaauuuuaaguauuuuauguauuuuuaagugguguauaccugaaaauuugcauuuuacacaacuccaguugcccugccucccugaggugauguuaccuuuuugaucaucuuccaucacuucacuagggguauugguaagagugaucauugaguauguaguauguagcagcaauuaccagacuugagcauucaucagaaucacugggagacuugugacauuucugagccccacccccggagcuguucauuuauagucuagauaggaccugagaauuuucauuuccgugaauucccaaguguugcugaugagguugacacaaagaccauaguuuuggcauauauagacaaaccucagccuaggcgauauagcaggaccccaucucuaaauuuuuuuuuuuaauuagccagacaugguggcauacaccuauggucucagcuacucacaaggcuaagucaggagggucacuugaggccaggauuucaaggcugcagggagccaugaucacaccacagcauuucggccugagcagcaggcgcaaaaaaaaaaaacaauuuucauuuuuguaaauucccaggugaugcugaugguguugauacagcaaccauaguuugagaacuacauguauuuacaaaucucccacuaauagaaaauuugguuuuuaaaagaagaaaaguugcauuauaggauauuuuaaguauguuuguuuucuagugcagucggcauucuguauccauguguuccgcauugccaguaguauugacaacagccaacauaugcucuguugagcacuuacguuguuuagcacuugcaucagcauuuaaacccacuagccuggcucagucacuacauguguauuacagaagacauauccguuucaaguauuguuauccucagaauucuuuuucuucaauguuuccaugcuuuaaguaucacaguuucuguagguuuaccaaaauuuguuuguauuguagauaccccacagacaaauguuacucauguaacccaacuggagagagauaccauccuuguaugcuuggacuguaaguuuuuauuuaugaaugucuuacuuuaauaagacuucuuuuaucuuaguuucugagugacuuuuuuuccucuagguuguauaaaaauaguaaaucuccaaggaagauuaaaaucuagcaggaaauugucaucagaacucaccuuugauuuccagauugaaucaauagguaagucaaaguuuuauaauucuuugcauuaugaacuccuuaaaauaauuuaucugcuaauuauccaaaauuaaagauugauauuauuaagauucuuuuuuuaaaauaaaggauauggcugggcaugguggcucaugccuguaaucccagcacuuugggaggccaagguggguggaucacuugaggccaggaguucaaaaccagccuggccaacauggugaaaccccgugucuacuaaaaauacaaaaauuauccagguuugcuggcacacgccuguaguccgagcuacuugggaagcugaggcaugagaaucacuugaaccugggaaggggagguugcaaugaguugagaucgcaccauugcacuccagccugggugaggaacgagacucuugucucaaaaaguaaaauaaaauuagaggauauaauaaauaugaggucacuaucagccuucauucuuacacauuuucuaaaauaguuuaauaacuguaguguagauaauguuaucuuccugguaagaaguaauaucauuucuuuuuuuuuuuuuuuuuugagauggagugucucugccacccaggcuggagugcaauggugcagucucagcucacugcaaccucugccucccggauucaagugauucuccugccucagucucccgaguagcugggauuacaggcgcccgccaccacccccggcugauuuuuguauuuuuaguagagacgggguuucacuacuuuggccaggcuggucucgaacucuugaccucgugauccacccgccucggccucccaaagugcugggauuacaggcgugagccaccgcgccuggccuugaaauaauaucauuucuuauaacauaguuuugaauucccauuuccuccagacuccuguaggguuuuucuauaagugcuuuaaaauuuaguacucaguauaccagauuauguuuuggcuguugugucugcugcucagagaauuuuaaguauauggaaguuccuucuugucauucucacauuuugcuuaauaggaguauuuuucuggaaaaggauuucugacaaucaauacuuuuaaaugacuacauucaggaaaaauaaggugaaaaucaucuuauguaggauagugcugggaaaaugaauggugauuaauauuugacuaggcacacuuuuucugguguuccuuaucaguaaagauauuugcguguauguguauuagcagacgguaaggcuaaaggcaguuaguucauugucuuauuccugguucuguuuucuacauucucccaacuagaaugucauucauccaacaaacaaaugauuauaauaagucaguuucgagggauaucugaucaagauguuaaaauggaauccgcuuucaaagacauagccagggucaaaaagcaagaucaacaacagaaucucaaagcaguauacaggucugaagcuaacaggccugcugggcuccaguuacaaaaguaucccacaggagauggagaaccacagccaaguucauugcuugugguaccugauaaucaggcaugaugguuuuuuuaccuaccucccccauuaaaggaagagauaaucccuauccugugcaaacuguuucagacuacagacaaggaauucugaauaaaucaguguuuaauacugaugcuaaaaucaaacaagauuaguacagaaaacaaaaauuauaaucuuaugaaaaucauuuuuaaaaaucuaaauaaaauauuagcaaauagaauuacacauuaucaaauaguaaacuaucccaggaaagcaaggaugguucagcaucagaaaauguauuuauguaauacacaauaccaaguauuaagagaaaaucauguaacucuucaguagaugcccaaaaagcauucaguaaaaucugucauuaaugauuuuuuuuaaauaauacuucuuagcaaauugggaauagaaaggaauguccuucaccuagcaaagccuguuaaaaauauguuuaaugaucaaauuaauucccauuaaaguggagaacuaaauaaggauguuugcuauuaucacauuucauuauugucuauuaaaugagaaagggaaaguaugaggauuagaaagaaagauaaaaagaucauuuuuugcugaugguaugauuauguacauagaauauaaaacccuauuaauaaguuacuagaguuaguaagagaauucagaguugcuggauaugaguaacaccaaagaauagcuuuccuaaauaaucagugaaaaacuuaauuggaaaaaagaucccuuucacaaaggcaauaaaguaacauacauaagaauaaaugaaauccaaacauuuuuaagaucauuaucuaggaaccuccaaauuauuuuuuuuuaagacauaaaagauucagcaagugaagaacuacaucauguccauggguagaaagacuuaaaugagaaagaugccaguucuucaguuaauccacagguucaguggaucugcaguaagaaucccaacaugauguuuugugccacuugauaagcugcucuuaaaauucauauggaauggccaggcgcggcggcucaugccuguaaucccaacacuguaggaggcugaggcaggagaauugcuugagcccaggauuucaagaccagccuggacaacauugggagaccccaucucuacaaauaauuuuuuaaaguaaaaaauaaauuuauauggaagagccaaagaccaagaauaagaaaauaaauguugacaaaucguuuucuacccaauauugaaacuuacuauaaagccauagugauuaagguagugugguaacaacacaggaauaaauagguagaagagugagacagaagaaaaggcccagaaauagacccacauguaaauggaaauucguggcauuauguauuaguggggaagaaaugggccauucaacaaaugaugcugguacaauugcuuaccugcagaaaacaaaauaagauuuauuccucccugaauacaugccaaaaaguauauuaaaaauauaaauauaaaaagcaaaacuaaaucuuguucuguuuaugcccugugcuucaguaauucuaucuaugggugucuacccucaagaaagauuuguacauguauucaagauguacaaaaauguuuauugcaaaauuguuuguaauaaugcaaaacuagaaauaaccucaauguucaucuuacugaauguaugaagguuggaaauauucaauauaaaauuuauauugauaguauaaacuuauaguaauaguaaaaacaugcaugagaaugauaaauaccaaauuuauaauagugguuaucucagggaggaaggaaagaccagaaaugggaauagggcaggguacauaggggaugccagcuguauuuguuuuuauuuaaagcaaaaauggcagaauguuaggaucugauuguugggugguggauacacguauauuuuugugcuguuuucuguauuuugcaguauuuuauuuuugaaaauuaccaaaacaggccgaacacaguggcucauggcuuuaacccuggcacuuugggagggcgaggcaggcagaucacuugaggccaggaguuugagacuagccuggccaacaaaguaaaaacccauuucuacuagaaauacaaaaaaacuauaacaaaaauauuuucggugaauuuuuuccuaccaaaaagaugcauaagcucuguauaguauauuuuuaaacuuuucaaauguaaagaugccauauaaauauggaauagcugacauuaguugugaauugaaauauugcuguaugagauagagggaugaaaugaugcuuaucaguugaacuuuuguacuauuaacaguaauugagcuguucuugccugcuagugugccuacaagacagugugcuagcuuucuggaaacauggaaugcaagguagaaguuuuagaucuaaugagguaaguaaauuauguccauuaaguagucacaagacauuaucaaauuccacuucaaacaguucgauuccuaaaugauacaaguaaugcuugauuggcuaacuuuauuaauacuuacuguauuuagucuauugauaaagucaguagcccauacucuauguccaccucucucucucuccacuacucaaacaacuuuagugcauauuuaaugugcuuccagauaaucagucugaaauuuagaacaagaacuugcuaaucugcuaaaagugagccaacuaugauuuucuuucaacuuucccagaggaaccccaggagcaagagugcuagugcuggcucucucuggccuuaagcaccuuuucuaccuuguacuucagaaauaaugaccagcgcagacuauaaguaaagaguccuauauuucucuggaagcccacuuaccucuuuauuuucaacauccuuauucauuugacauguauauaauucuuugcccccuuuaccuuuccuuuuuauuaaccuuuagcuaugcaucucaugaauccuuccuaccucacagaaauaauuuaacuccaagcugugugacauauucaagucaguucaacauuuaugccggaaaguucugagguuauaaacaugaacaagauguggcacuugcccccuagaauguuacaagcacguaaaauugucagaaauucuuccaguacccccaagccaaucucagucauguaacuuggaaggaagcuuauuuguuucuuaaacugucauucauuaagcucagagcguuuauuucuaacaaaguaagcaauauaccacaguguucaugagccuggguuccagaguugagacacuaggcuucaggucucaaguucagcuaguuaguagcugggugaccuuggcaugucaccuaacuucuuucuaccuauauuuuuucaucugugaauugaguuguuaugauuaaaugaaacaaagcguguaaugugcuuggccugguuccugaccuauaguaaguguuuaaaagguagcugcuggccaggcauguuggcucacgccuguacacucagcacuuugggaggccgaggcgggcggaucacaaggucaagagaucaaaaccagccuggccaacauggugaaaccucgucuguacuaaaaauagaaaaauuagccaggcgugguggcgcgugccucuagucccagcuacucgggagaggcugaggcaggagaaucgcuugaacccaggaggcggagguuccagugagccaagaucgcgucacuguacuccagccuggcgacagaacaagacuccgucccccuccaaaaaaaagguggcugcuacgauguuucuaaaaguaauccccacaagugggcucacacuuucuaaaaucacgugaggaacugagcagggagauaagaacagucaacagcuaauaaacacuagucagagaaagaaaagcauuacagacaaauacagaagugguuuaaaaacuaaaaggaaaaaguucacccaaaaagucaccugagaacuacacaggcagcccaucaauacacaccuccaaaaauguuagcuucuucuaguaggcaaaccccaaaauauauugguaaucacagucaugaugagccacaggcauugaagugagcaugcugagcauguuguuuccugcagguaugcuggguuacaacagaagcuaagagucauuaguguuucuagaaaaucuaauuguagggguauugauggaauaaauuuaauuucaaauccauuuuuucuucagccuaccaaauuuuggggagaugcuaacugcccuucuaauucauaauauuuuguguucaguaagcugugaauaguugguuucucuuuuucuuguauauuuauucuuaauuccccaacugguaguuggucacacugaggacuucuugaaggauauauggucauuagaaaauauuauuucaagagaauggggaagaagugggaaagauaauuauuauguauugagcacuuccuuagcuaggcauuauacccacuaauccuuauaagaacacugcagggcucuacugcaugguagaucuuuucuaucccaucuugcauaaggcaaaaccauuucuagcggauuacauacguugcccaguaagugggagaacugacagucaaacucaaggcaugucugccuuuuaaauauuuccuguuacacuacguggcagccuuuuuaaguaaaagaagcagaucuaaguagcuuacugcugccaguaaccuugccauuagcguuaacauaaaugaugaaaguuucuaauaaauaaaauggauuuagugcuuugcuuuuaaguuuuucccuugaagucuuaugauuuaacaaggaaaucauuuuccuuugccugcauuuuaugauuaacucaaaauuaaccacauuuccccucgacuaacaaauugauguaucuacaugcugacuuuaacaaacagucaugcaggaauauguuuucauuuuuagcgaucauguuucuuuucuguugaauuauaaugaagugcccauuaaaaauuuugugucuuuaauuucagaaauuaaauuuguguuuuaauugaacagguaacacaagaaauuucagauagcacaagaauuuucaggcugcuuggaucugacagguaugaaaacggacuguauuaaauacacaguacuaaacguguuuuauagauccagcaugaaacagauuucuuuuucaagagaauugaaaugucugcaauauguucaacauugaauuuuucacacuauaagaauucacaggucagaaaguuagccuuugaaaauguaccugaucuuccaaguaacaggaauguauggaucugucaguacuaguuuccauuaaacauacugacaucugauuugcagcagaagaaagaggaaauaccauauguuaaugaacagaacuuuguguuguuaaugccgauaggauuuuggagaccuguucugauugacuguaagacauuggucaggguggugggagagauuauaaaguuauaggaaauagacacaaaccuucuuggaaggccagaagguuugcauagcuucaguaaaagauuuggcugaaggcagcugaauucucuuaaaagcuuagggcauagauacauaggaauguagaggaguuuaucuaaauagcuuguuuacucauguuguccuaaaaccaaccuuugaucaugcgggcaggacugcucuuuccuggggagggcaaccugauaaauuacccacaaguagguugacucaaagccuuugucauuaaaucugugcugaauaaaugccugcagggacagcuagucagggcacacggccacuacaacucuuucugugagcgcccuggcccccuagccagucuuucacugaauaccagugucuggguacguuauucauccauugugcagcgugggucucugggucagacccuggcaauuuagcuucugguucuugaacugcaaaucguuuuuagaacuuguaauaagaauuaaguucccccaaauaauuucuaauauagguuucuccccacuucugacucuuagaagaacacuggccuagaggugggagguaguggacagcaaaauuacuucccagagcuagaacuggcccuguaaucacagugauagcaaaugauuucugcccacgaucaaaugagcagcauuuauagaggcacauauuggagaagcaauggaaaauuugggagcuaacauuaauuuucaggaauaacuuuguuuuguuauauguuuuuuauuacuuucagggucgugguuuuggaaaguaggccaacugauaaccccacagcaaauagcaauuuguacauccuggcgggucaugaaaacaguuacugagaauuguugugcuuugacaguuaacucuagaaagaaagaacacuaccacugcaacauuaauggaugcuugaagcuguacaaaagcugcaguaaccugucuucaguuacuuuguaauuuauuguggcaugagauaagauggggaaaauuuuguuuuaagugguauggauauauuuagcauauugaaccacacaagugcuuaauucauuguuauguaaucuuuguacauauaggcaguauuuuuucugugaaacuucauauugcugaagacauacacuaagaauuuauguagauaauguacuuuuaugagauguacaaguaagugucuuaucuguacagauguaaauguugaugaaaaugcaauugggguuaauauuuuaagaauucuuuaguauauucuuggguguggcuauauuacaaaaugggaugcuggcaaugaaacaauacauuuaacacuauuguauuuuuauuauauguaauuuaguaauaugaauauaaaucuuguaacuuuuaaaauuguaauggaggcuguaaucauuuuauaaucuuuuuaauuuuaaugcaaguacacugguguuuauauuugcacaaaguauugauaugugauguauuaagucacaaaaguaagcugugacauugucuauaagcauuuggcuccacaaauguauuuggauuguuuucuaugugaagcaaaccaauuauaauuaaccacauguuguaguaacuggucuuuuuauauuuaagcagaauccuguaagauugcuugucuuugcuuaaaaacaauaccuuugaacauuuuugaaucacagaauagcgguaccaugauagaauacugcaauuguggucagaauuacaguaugcacaaagaauuaauuagcauuauuaaagaguccucacuaaacauuucauaugaucacacugaagaacuguaacauuccauagagugaagugguucaaauuucucuuggaauuuuuacuuuuguuggccuuauuuuaugauccuuuucauauuucuuuugacuuagaguauuaauacauggccaaaauaauuuaguuacuaccucauacaaacaauauaaugguuacuacacaucacaggaacuuaguuuugguuuaagucauuuuugauugcuuuuuuccaauggaauauguauauaccagguuuuagcaaaaugcacacuuuuggcucuuuuugguauauguucuuuauauuuuaaugugaguauauacacuaagaacaaacuaaauugugauuuaugaucuucauuuauuuuaaugauaaugguuuuaaaauauguuccugauuguacauauuguaaaauaaacauguuuuuuaacaugcugu

SEQ ID NO: 18441 - RNA, 583 nt, Homo sapiens
cggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaaaaaaaaaaagaaugaac

SEQ ID NO: 18442 - RNA, 1770 nt, Homo sapiens
gguucaaagcccaguguggacucgggugcggggacagacggcguuuggagagcuuuuuccagaaacuguccggagcccagcucggguucugacaucgccccuaaggauuucucagggaaggcaucccagccacggcuuuuccugccgacuuugcucuuccuaccgccgcgcggggcgacccacguaccgcgugcucagagggcggcuacacgccccaucccccagccucggugccgccugccagcccgcggagggaagcgguccccgacccggccccggcccccacguucuggggcgcgaguccugagaaggcgccuaacguguagcgcgccuggacccucucgagaugcugcccuuagagugggaugaaagucuggggaggaacgccuugucaccggcaaaaacagccuuucucuuggucuucgucugcauccuccuuuucaaaauaucuugauuucccccgcgcaccccugacccggcugcagcaccggcccuccgagcgggaagagccccgugaaggcuccgcagagcgaucuaccccgcgcucuuguccgugcccagaaagcggguuccacuuggcagggauuauuuuaaacugcuaccagcaauucauucaccugacacccgacaccggcagcccagcccgccggaggcgagacaggugaguuguaaggcgaaccguguuagaugcaaaacaaauacuagaagaaaaaaauaagggugggguagggugagaugcggucaucugaccacaggguaaccuggcugguuaaagggaagaguuuuucauugcccucuacuuuucguaauuuuguaggauuguccggugcccgcuagaggucgccaaacggaguccuuuugcgcugguucuuaaguggauuccuagugaaaaggcagacaacugaaaaugugagugcugucuuuuaaguaaaaucacucucgguggcuucuuaaagaaugaaaaucucugugaguuguuuauccccagacuuggauaauuuaucuuaagagcacuaaaugugauuaaaagcucaaaaacaggaguuauuugcuacuuuaguaucuacuaaauaguuugcuauucaguaucuauuuugcuauuuagugucuacuggguagauacugcuacuuugcuguuuaguaucuacuaaguagauauuaaacaagaaaaauaucuguaagaaagugaguuucaagacagaauuggaggugcugauggccaugaguuggcacagagaaagggcaaaacauuccuaguagcaaaaucucgaauguggagguuuaaagucugugaagaaguauaaugcacuugcccacugaaacaauggggaucucaacugcagcauuuaaauuggaucccauaagcaauggaaucccuggagguuuccauagcagaaauggcuugaugaaagcuuuauuucaggaagaugccuuugcacuuugggucauucuaaggagaaggucauuucgcaacccaggaaugggauccccaaccccgugucugugaagaugaagaagggucuguucugagaaacgcugagaccaagaacuuugcaggucuugaagauggauuuguuguaggacgugaggauggggaaaaguuugcagaugugagccagagaugagccuggcuugauaccaagagccaauucaucaggaagccguuaaaaaauacuuucuagaagcaucacaagcaauagaagacagaacuauagugccgauuguuugcucuaacauuauuguaggguuuauuuccuguguucucuccgu

SEQ ID NO: 18443 - RNA, 1442 nt, Homo sapiens
cggagccccugugcccuucaccaggccuguuuacaaggcccaggacagccgccaaaaccccagcugugucccuguccuugucugucuccagcggacaugacugacuuggaaggaaggcgugcccuugucuguggaagaggacccguauucagcacccaguggaauccucggggcaccuucugagggaaacgucuauggcuguucagggagcagcugguccagguuacagaugcagaaaacagaggugucccugaaaaacagacgcccugggaggaagcucccaaagcaccagcccugcuugugcacaagaauugcccggacuccaggacucccucagagccaaucuggauccccaggcggggaccugugccccgguuuucuagcacugcucaccauugcagcgucagcacugaaagccugagcucagaaccuguuuguuuaauagugacuguucacugcugggcucugggagcccugacagcuggaaagacagagcaggugccccaacacgggugauuuuggaagccccagagggucccugucuacucgcuuuuccucuuucccugauguuuguggcccaugucugugggccuggacacucaagcagccuccagaaucccucccaguguucaacaaugagcccagaaauggugcauaguagaaaugggaacaaguagggugccuggagagguagggaggccagagacaaugaugccugcgucaccguuuugccaaggguccccuugacugugggcacugcccagacacagggaggccagaggccaggagcagagggaggccauucccuaggcccagcccugccagccagggugagccuugauggccguuacaggccguugcuaucgucccuuaucuggggcuccuggcucuuacaccauguccccaaccgccccuggaguguguguguguugagggggggccugcuguucccucccuaaacagaccguuacuugguuuccguuguuuggggaggggguggggagcugucugcuuaauuaaucauuuuaggccauccugggaaacucauuaagccaccucucagggcugggagcaggaacacagcccucaaaguuggaacuuuuugguuugccauauccgggucuaguuuuccuuccacucaugugcacacaugugcaugagagugugugugugugugugugugugugcaugugugagagagugggaguacaagggagagugcccuuguagcuaugauucuguguguguuugcguuuccuagauucugcaaggaacuuccccugauucuucuuaauuaccagccuagaagaaauucaagaugcuuagagcaaaggucaaacuccaccuguuuucccugcacuucauuuucuggcaguucccacaauaguacagauaaguaaaagauuaaggcaaucuuuucuaauuaaaguaauuaaaaaacg

SEQ ID NO: 18444 - RNA, 1592 nt, Homo sapiens
uuguugagacuauugucugcuuuugucugcaugaccuggaaaggauuccuuuuuuuuuuuuuuuuuuuuuuuuuuuuuugagacgcagccuugcucugucgcccaggcuggagugcaguggcgcaaucuuggcucacuacaaccuccaccucccagguucacgccauucuccugccucagccucccaaguagcugggauuacaggugcccgccaccacgccuggcuaauuuuuuguauuuuuaguagagacgggguuucaccauguugaccaggcuggucucgaacuccugaccucaggugagccgcccuccucggccucccaaagugcuaggauuacaggugugagccaccucgccugggcaggauuaagagugugauuuaaaaaagaauauuuucaugucaaccuccuccugcucugccccaccaggugaacacaucucugaagugaucauaucaaacagaggcaaugugaggagagggacaaaucuagcuugcacaccacuuuccugaaacuuggugacuuugugacuuggagggacucugcucuuaauuugucauuguguguguguugcuggcuugguggguggaagucacugcggggcaggggaagugugugcauacucuugaguaugcaugugugaguaugugucugcaccagugccagacagcugccuugagggucucugccuggaacaggguucuccaccgugcugagcauguggacaagcugaggaugccccucacuucccaucugaguggucugaaugaaaagacuggcaucuaucucccggagaguggggcugugcucauuccuguugcccaacuggcagagcagccacagggcccagcccagggacagacagcauccaggccagggcuuccuggggauccugugaagauccagguuccuuugcaguaggucagcagaggcugagauucugcauuuguaaccugcuuccuggugggggcgcugagcagcugcucuccagccuaugaucugggcagugaggugggagagagguggcauggugguccugcugcccacugagaaggcaaggcugucucugccacugccucuucccuguccccugcgucgggggcuggccgcugccaggcacagguaccgcccucaagggacaacagcugacaacuucuaaaccagggcucuguggaacaaaccacaccuaacgaagguguuuuuuccccuuuaagagaauacauuccucagcaggauaguggccccagguucucucccacuaccacuuggaagccaggcagaaaaauugccuggugggcaggauuacaggauuagucagcuuucccaaaacagacccacaggcucuuagguggaaaugaguuuuggucugagcccuucuuuccuggugacagauguguuugcugggcccucccccugucucacuccucaagucucgccucuuccugagugcucagaacucccaugcucccucacucaggccccgggaauuggggggaaacagguuugguggaaaugagccuuaggguucaagcauccaggcccugggaggaggguggcacugcuuggaccaaggggcuggcuuuaccgaccccu

SEQ ID NO: 18445 - RNA, 13735 nt, Homo sapiens
gguggagaaaucgagcagcuucccugaagucacaccacugacaaucaauggagucagcauucaaaagacccagcugaucaaacgggaugcaaucaagaagccagccaaaaccugagagugggacuccagagccggccucaccaaccccugauggucuguuaacuccugcccuggagccgagcauguccuuuggugggaaacuauggagugugguggccaaaggcacuggccaaagagccuagcugccuggguuccucuuccaguuccucuuccuguguggaugcuugagugcguuacccagccuucugugccucaguucccuccucuguaucacaugaaggugcauggaugggacuaggugggacaggcacucccacccacucagagcucccaaguccaacuaccucacggaaggccgccuuuguccuuggccccacacuggguccagucugucgcaguggagugcaggccugugguacaaugcaaggcgaccacauguaguuccugcaccagagagagccaugggauggggggcugaguuaaaaacucauagaccccucaucaacacaguggccagcacaugugcagcccugugccagggacccuggagcuuaccacccaugcuccuccagcccaucuggagcuccugcccccaaccccagcacccuauuuaucuauagcuacugcacccuggaaugcacccuaauacauuuuccuggaucucaccugugaauuuccccaguuaggcugugaguacccuaaaagcaaggacucuaguuuccucauccuccaucuuugauaaaggcuggucuggccgggcaugguggcucacgccuguaaucccagcacuuugggggccgaggcaggcagaucacgaggucaggagaucgagaccauccuggccaacacggugaaaccccgucucuaccaaaaaaaaaaauacaaaaaauuagccgggccugguggcaggagccuguagucccagcuacucaggaggcugaggcaggaaauggcgugaaccuaggaggcggagcuugcagugagcugagauugugccacugcacuccagccugggugacacagcgagacuccaucucaacaacaacaacaacaaaaaaggcugcuccagacaucaggcccucaaaacacacuugaaauggauggaauuggguuugggggcuuagcuacuauaacuuuggagugguacguuaaauauucauucuuacuagagguggaaaaaggaacaguauggagggacuggauguggacuuggaugcaaauguaugcaaaccacugugcaaugauaugcagaugugcauccuggaucugugggaaggaguucuaugacuucagaacccugguucuggcgggcuuugcucucugaggggcucugccccugcuggggaucuugccaucucgcauggcaaugcugacagcuggcugccgugcggcauucuggcgccaguggaaaccauuuggggauccaugucaucuucugauccucggugaagcagcucccacccaccagggcagaugagccaacaggaggcuauaaagacagaggccugcaugaggaaaggcuggcguguagccagagcuggaggcuccuggguuccagggacacagcucugggggagcacggagcgugggaccagggaggaaagaucacacuuggucucauuuccagcucucugcuguggccaccacuggggagcccauggcugccugacacuccucaccaccacucccagcccuaggccgugcugcccaccagccgucagccagugcccugcauggcaggcaggccaugguaucugggagagcuaagggcuuccuagcacuguagccaccauguauggggcacccucucuggccaggcaccgugaccaagcacuuuaaccauauuauaucacuuaaucuuugacagccccaccagguaggcaguacucuuacgauccuuauuuuauggaugaagaaacagaggccagggucauccaaccugcaaaugguugagccgggauucaaacccaaaacuguuagacuccaaaaguggcccucucaacugccacuuccugccuccucucccacaccacaauggccacuguguacccgguucccaugagggacauuuggggagggggacaaguccaggguugagagggggaaaguuccaguguagugcuugggguuccccgccccaugcaagguaagguaagcuggcagccaccuaauugaaacacacacccccaccacacccccgccacaccccccugccucaccuagaaugucccccacucaacuacugcagcaccuggaguccugccauuagaaccucaugcuuguuuuagagaaugcuuuuucugugggacaagagcuguugucuuuagucuccuauuuuaaaagacaaauccucuuggaaggcaggagaggcugaggucagcagggagguccuagagaaauguaugcaaaagccaggagggcccagaaggcaaauucugugaucaaauucagugauguuauggcccugggaugaggaugacagugagggugacccuuggcacccuaccuagggcaccugguacucuuucccaccaguugcacaucauauuccacacccagcagacccucaaucaauggcauucuaauuagucauagcaggaggguaacccuaagagauguagcagaacugcaauuuucaccccacuuuagaguccaggaaacugaggccuagagaggcugugaguagcuccaacuugacagugggucagagaagaaccagaucaguacucaggaguccagaguuggugguuggaggggguggcgugcaaugagaggcugguggguggggucaugcauggcaaugcaacccuggaggccccaucuccuucagagaagucaagguggugaggucaaggggaaggggaaggaggacaggagcagagaggugaugugagggaagcagggugggcuggcaggggccgagaaccccagugccugggaaucuucaggggcucugcgaggcggcccaaggccgggguucccacagcggcagguggucaccaagcgggccaggccggacagggcuggcaccgacucuagcagggguggaggugccagcucucacccgccagccggccugccagcuggggaagcuucauuagaauuccucagcccuccaacccauuuccuuccuggugaacaggacagcuaauggccccaguugccugcugccagggugaggugggucgggcuggcagcuucaggccaggcuggggguagcggugaccucuaacaacccaggaagcaugccucuccccugcccugggggagggagcagcccacagugugacccgaaauuuccccaaguuaaagaccaucugccugucugucuauccauccccccagggcccagggggcuggugaguguggacagacagacacaggcugugggaagcugcagugauuaaugagugaugaaaaccagacuucgucaggauggggguggggacauagaagcagagagagguugucuguuuuaugcuuggcucagcucuaagcccacagcucaggggaggaggguggaggcagcugagggcaguacugggcccuggccucaaaaucccaguccgagcauagggccccaguucauagacaccccccucaucccccaguaccuccuucagccucugcccuggaagguuucccuaagaggaacuagcuuuacucccaaaucccagggacuugcacuggcccucaaauaccauccaucccagaacaccccagaagccauggggaacagcagggaaaacagccucaccaacccuccaaucuucuugucauggggccaacgauucuggggcccagagccugaagguccucucacccuucaccccgacaaacacaugaccacucccacauucccaaacucugcccccaggaccugcugaagucaagcagauuuuucucaaaugucaaggacagcaaaagcuacuucuaagaggauucagcucaaaccuccaaaccugcaaauagacagucaggauaaacccaagcaggagagaggcuugcacaaccacugcuuuugguccccacccgacagacaccuugagggaccuuggcaacauccuccuccccugcccgaaaauauucccacacuggcccaucugcuccagggccuuggauuccaccauucaacccugaccucccuuugcaauacugaacucgaagacucuugccgagguuucaaguguguccccgcucccagggccugggaucuggccagggagggcuggaaagaaggaaaugcgccacagauggaggaaguagcuucggcaaggugaagcacaaaggcaaacuuugcugacagaagacucuugcugcuggccaaccaggccugccugucaugagaaucaaaauuguuuucuuuugucgaaaaaauauuuccaagguaguucuuguguugugcucaggcacguggguaaggaagcaauagugagugcuuccuucuugccugccagggaccuugugcauaucuguuggcucauugcaucuuagaaacuccugaagaaacugaggcuuggggagguugccugcccccacgcaccccucagggacuaagugacagagcugagauccccagucggccagacacaaagcccuccuacuuucugaagccccacccugcuggggagggagaacuggacgccaucugggaagaauuaaggagguuuuuagaaaaggccucugcaggaaugagaaaaccuucauuagggcuuuuuaaucaauaaagcaggaacaaaaccucccucccugcaaacauuucuggacuccuaggagaugcccaacugugcccaacaaaugauucagaaaacgaguauaaaauucaaaaaauccccaucccgacaagucagagaaugcuuuuuacuggauguuggggaggggaagccgaaccucauggcuccuuggaucucaguuccugucucuugccuuaacagagcccagacuugucaucugagaggaagggggaggcugaggucacugcccuucucugguuucugccaagagcucugcucuucuccagggagguggcggggcugggauggcuuuguacccugcaggcuccagcaggauugcaucugcugaggugcaucuuagaaaggggagugugagaugcaggucccccaccucuggugcuccuggccaaggcugagugccugugguuccuuuguggccguucaggugggaaaagcguuugugauaccaaaaaaucagcuaggcucagcccugagccgcagcugggcaccugcaaaccgagggccucacuuagccugucccaucugcagagggagucgucagaugcuucccaaagaccuucucaggguuaaaugagaaaguggaguauauucguuuucuauugcugcaucacaaauuauuacaaagcagcuuaaacacuacccauuucuuauuucacacuucaggucagaaguccaggugggcucagcuauagucucugcuuagggucucacaagcugaaaaucaaagugugagcuggcuggcuccuaucagaagcucuuuuccagaagcucugggaaagcaucuccuugcaagcucauucggguuguggcggaauuccacuccugcaguugcaggacugagguggcggucagccagggaucucuaucagcuccucgaagcugcucucucucgaguccuuuccacaugguccccuccuucuucaagucaucaaagauguaucgaacccucccucacacuucacaucugugacuuccucuccugcccccagccagagaaaacccucugcuucuaaagggcucgugugauucgauuaggccccuaccaacucaucuuucuuuucuuggacucagagucaacugauuucuauccuuaaugaugucuuugaaaucccuuugccauauaauuucacaugaucaugggcuugaugucuuaucauguucagggguucggauggaaauauugggggccauauuuagaauucugccuacacgggaagcaaaagugcuuugucaccucuaaagugccagacuuaggcucucauuagagccuaaugagggucuaacccuuagggaggguuuccuucccucugccccaggagcgcaaaggaaagggugacacuggauuagggguggcugccuguggccccugccccuuccccuccuccuccuccuccuccucuugagccuaccucugggcuuuucaugacuuggagagggagcccugucucaggaccccaggacuuaaucuguccgucaccuuccccuuccagaucuucagccacuccacacccccugcaaguuccuuccugggcucugcccuuccuucauacucucuggguaccacuccuucccgggaucuacgacggcggucuacacucgccugcucccaucucuguccacuggagccuggcgccuaccagcccccacugccugaaucuguucucccucccuuaucccaguggacaccuuccaggccaucucugccaggccuuccugugauggcaaccauagagucugucuuguaccugcgguauuauucccaacacccacccgggugccaggagcauagcagacacucuagcaaacauucgucauuguuugucugcauccacguaucuaugugguccacgugcuaaugugcuccccugccugccccaaaccugaggauacgucuccugcugccgccucagcaagugacacccaugucacccucucccucagcccgagggcagugaccacagugagaggaagcaugaguguggguccaucaggauaaaaggccagcacugagucuguuucacgcccccugcccccaccccaccacacacgugcacacaccacaggcucugcguucuccuuggccuaacgcuggggagggcaagagccaccacccaccagcuuucuacccuucacuauaccugggccucaacucagcuggccucucuaggaguuacuugugcuggccuuaaucuuuuuucuuuuuuuuuuuuuugaaucggaaucuugcucugucgggaauacaguggugcaaucucggcucacugcaaccuccuccucccagguucaagugauucuccugccucagccucucaagcagcugagauuacaggcacccaccaacacauccagcuaauuuuuguauuuuuaguagagacgggguuucaccuugucggccagucugaucucgaacuccugaccucaggugaucugcccgccucagucucccaaagugcugggauuacaggcgugacccaccacgccuggccaaucuuuuuucauuccgucccugcauuuaggccuauguucucuucccccagagacccacccacuuccucuuggggaguccagccgaggacaguguggcuugaagaacauucuaaucccagcccgagagcucugagagaaaaaaugacuacaaacccuggaaugugaagccugcugcuuccugcaaagcauuuugaaugaaacacguaaccaacagcugcagcacagagaauggaaacucugaggaacgucauggcuccagguuccaaauagcaggguugugagcaggacaggcucuucauuucagcccaaccuggacacccucagcagcaccccucccugcucuccuuccaggaagcgggcccgucaugccaaggaugugccgcuguugcucgcuuauuccaaacacccccggcccccaacacagccagacauccccguguauaggggugaggcccccuucccacucaccagcccccagagacauugaggacacccaagcccagccacucugcccucucaggagcagguuaaugcaucccucaacaugacucccauccuggaacucagccccaggccaggcugggcagugccagccaauucaugcaaugcaggaagauaucauugccaaagcugcucuagggcagacuuggggugagggggcaggacagagagcccaugaggagcaagaggcccuagaauuggagaauuccugaagaucacuccugcaugaaggggagacaugcgaacauuuuuucaacuucuuuagggagauauaacacacucaguaaaacacacucgucuuaauggcguggcuugaugaacuuuuacauacaaacacaccuggaugaaauguagaacacugcaaauaccccagaagauucccuggauccccuucccagucaacauucgucccccucagaggugaccgugauuuggaacuucucucaccaucaauuaauuuugccucuuuuugaaccucauugaaauggaaucaccaacagcaugugcuuucaugaccagcuuaccuaguucauccugucuaugagauucauccacgaugcagacacacuaaugaccccauggcaccucccacacuccaggugcuguaccaaggaugucaugguuacuuguuuacacuaaggccuugacauugaacccauuuuccagauaaggaaguugguugaaucagcaguucauugccacacagucaggacuuggagagacuggaauucaaacccaagagagaaccagaacagauucucucuucuauuuucucuuaacaaacuuacagagaccugccuccauuauaccuagagaucuacagccuggaauuuccucacaagggagaccuguuucaggguuuugugcucuugggaacccaacaggagcacccauuuuacuuuaguccccuauuccuugggggacaugggcaaggcagaagaggaggggugagcagcaggugaggaggggugagcagcagguaaggagggcgucucaggaggcccagacccaggcagaaaagguuucacaggaagagaaugaagagguucauucauuuagucagccaauauuuauugaaugccugcuguauggcaggcgcuguccuaggcacuuacuuuuugguuaucuaccuguauguaucaaaccacucuaaaaugcaguggcuuaaaauggacaacaaacauuuauuaucucuuauaacuuuauaaguuggcugagcaguucuuccacugaucucaccaagggacuuuuaugcugcugcagccagauggcagcuggaacugaagucaucugggagcuagacugggcuggcugagucaagaugguggccucacaugucagguacccuggaaagaaccuggagggcugggcuaggcugggacuggugcauugaugggauuccuucucuccugcuguccuguaugggcuccuccuucuccauguggcccuuccacaucuccucuucaugcgcauuucuccaagaggguauccagacuucuuacaucacagcuaagggcucccagaaguaauaaaguggaagucaccaagccuuauuaaaguuuaggacuggcaauggcuuggcaccacuuuggacauauuuugcugcuuaaggugaauuacaagccuggaccagauucagcacgggaaggaacucuagaagggaaugaauaucauccagggccaucuuuggagaguagcgaccacccccccaaaaagaaaaucauugucuuuuuucauuuauucaacaaacauucacugucaggcacauaguuccuucuuaaauagaguacacuuaaaguaaacaccacuuuuguuugacucacuaucauucaagauaccagccacugagaagcucuguaaaggguaaauagcauucauugagaguuuacugcauaccagacccugagcucagugcuuuacaaagucuaacucauuuacuccuuacuuguuuucccuccuuugaaguagguauuauuguuuguccuguuuucuagaucacuuagaaaagagguuauguauugcugaauaacaaaccaccuccaaacuuagugguuuaaaacaacaauaaucauuuauuaucauucaugguuucuuuggaucagcugggaaguucuggcuuggggucucaugaagcuguagucagacugugacugaggauaggaucaguuucaaggcuucuucacucacaggucuggugccugggcugggaggacacaaacaagcggaggcugcgaaagccagggucuuucaggcaucucucuaucugugugguuucuccacaugagcucuccaacauggcagccccaaaauagcuggacuuuuuuuuuuugagacggaguuuugcucuuguugcccaggcuggaacgcaaugacacgaucuuggcucacugcaaccucugccucccagauucaagcaauucuucugccucaaccucccgaguagcugggauuacaggcgcccaccaccauggcuggcuaauuuuuuuuuguauuuuuaguagagaugggguuucuccguguuggccaggcuggugucaaacuccugaccucaggugacccgcccaccuuguccucccaaagugcugaaauuacaggcaugagccaccgcgcccggcuauagcuggaguuuuuuacauggccacucagcaauccaaaggcauauauccagagagacagaagcugcgucacuuuuccugauccagaacuuggaagccaugcagugucacuucuaccucauucuauuuguuaaggcaguuaaaaaggccugcccagguacagcaggagggagaaacaguuccauuucuugauaggaaaugggucaacaaucugagccauauuuaaaaccaccauagucuauccucuggacauaaauuauuuacauuccuuucacauacaaaauauacucauuccuuugcaaagaucccccaaaaucucaucuauuauggcaucagauuuaggcuagagaggucuaggaucccauuauaucaaccauucagguauggaggaaguuccucagauguaauuccucaggcacauuuccuuaaguacuauuccucuuuauucagagacuugugaacuaaagagacaaguuaucugcuacuggaccgcaugcaguggcucacaccuguaaucccagcacuuugggaggccaaggcaguuggaucaccugaggucaggaguucaagaccagccuagccaacauggugaaacucucucucuacuaaaaauacaaaaauuaauugggcaugguggcaggcaccuauaaucccagcuacucagcaggcugagacagaagaaucgcuugaacccaggaggcggagguugcagcaagccaagaucacaccauugcacuccagccugggcaacaagagugaaacacugugucaaaaaaaaaaaaaaaaaaaaaguuaucugcugcuuacacacugaacauccaaugaugagauaggcauaguguagccacuauaaacacucuuauucaagagaggggagaggaggcacagagccaugacugguccauagcaauucugaaauccauucaggcucauauuguguugccaauuucuugauuagggcucaguucuacugccugggaaugauucuuuguggcuuuuggcucuguucucuagauucuugguuccaccuucugaaucauccuucuuucucuauaaaaaauggcuggugauaugguuuggcuaugucccacccaaaucucaucuugaauuuccacguguugugggagggaccuggugggagguaauugaaucaugggggcaagucuuucccgugcuguucuugugauagugaauaagacucacgagaucugaugguuuuaaaaaaagaagcacaagcucaucuucucuuugccugccaccauccacguaaaaugugacuugcuccucguugccuucugccaugauugugaggcuuccccagccauguggaacuguaaguccaauuaaacuucuuucuuuuguaaauugcccagucucagguaugucuuuaucagcagugugaaaacagaccaauacaccugguguuuccaacugaguaguuuucagcuuguuuccuucccauagaauuuuggggguccaaaagccuuuuuucauuucacacuauucugacccuuuuugcccaagcugguggugcuucugacaaaauaauucuauuaaaaacuguguggguuucccaugaauccuauuggggcucacucuguuagucaaaagcuauaaccaaacauuucaucaagaaaacauucucuacauucucaaugugaggcugguguaaaacgauuuacuuaagauacuuagaagcccuguuguuuaaugaagaggaucugugaggcacacucuuuuucauuuuauuuuuaauuuguuuuuauuuuaauaugaagugcuucaugaauuugcaugucauccuugcacaggggccaugcuaaucuuuucuguauuguuccaauuuuaguauacgugcugcugaagcgagcacugaggcacacucuugaaauacuuagagggccuuugucuauucaaaauauuuuaugaagccuuagauauuucugagauuuuaacaaagguucuuauagucccacucuggguuuuaucuuuguccugaagcccuuucauacuuugagaaucuuuugccaucugggaggcugagaaugaaaagcagauuuauuuucaaauccagcaagccccuggcucuuguauauguuuuauaaauuuugcuugaaaguuaaagcuuccuuuuaacucaucuuucucugucuuuaucauauacagcuaaaauaauccaacuagcauuuucuaauccaacuagcauuuucaacagucugcuuaaaaauuguuuuagcccaaaccauuaguucauuaggcauauuuucuuuuucauuuuucuuuuuuuucuuuuuuuuuuugagacagagucuuacucugucacccaggcuggagggcaguggcacagucucagcucacugcaaccucugcccucugggcucaagcgauucugcagcuucggccucccgaguagcugggauuacaagcaugagccaccaagcccagcuaauuuuuguauuuuuaguagggacaggauuucuccguguuggccaggcuggucucgaacuccugaccucaugugaucugcccaccucggccucccaaagugcugggguuagaggugugagccaccgugcccagccuucauuaggcacauuuucuauugcucacauagcuucaagugacaauguuacuaacuuucuuccaccacguaauaaggguuuguccccuuuccuccugcuucuaauaaaaauuucucacuuuccuuuaagcccucaccagcaacuuccuugagaacuaucagacuuccaucaacaauauccucaaaguccuuacaaucucuacccaucucccaguccuaaagccacaugacuuagguucugugauggcagcauuccguuucuagguuauagaaaagucugcaucagcuaucuauugcaugauaagaaaccauccccaaacaguggucuuaagacaacaacaaucauuuauuuuguuccugaaauuugaggguugacagagacuaagcuaggcaguucucacucagggugucucaugaguuugcagucaauugguggcuggggcugaggucagcucaaaugcuggggucuagacuaggagguucacacugcuuggggcuggauggcuggaacuccucaggaaucucucacuuuaaaugcagucccucuacaaggcagccucaggguagcugaguuucuuucacagcagcugaagccucccgacaugagugucccuaaaggaaucaucagaagcugcagggucuuuucuaaccuagccuuggaaaucacacagugucacuuuugccacauucuauuugucuaggcacucccacauuuccacccagguucaaagggaggg

SEQ ID NO: 18446 - RNA, 863 nt, Homo sapiens
ugugggagaaugagcgcccggccgggccgcgaggagacugggagcucugucucucgcgccccgcgcgggauuacagcggccagggagccggggugggcagggggcccagggucuuuucugaagucugcacgacuccucagaaagccucgugauuuccauggggcccuggaggagggcgccauggaaaugguaaugcggggcauugaagcuggcucguagggaaggagggggguugcguccaggcugcccgggcuguggcacgacucccgggugggaggggccgguggacggcccaguggccaggcccgggugcccccaccuguaccaggcccucccggacaccgggaaaaaugcauccaggaauaaaggcccgagucuggguccaaggagccugcaguuaaguuaggggcgggggauguggugccuccacaguaacccagcuccgcuccaaggaccaccaggagagcugguugaaagcaaugccuacacacgccugggccucaccaccgggaauucaggcucccaacuucccaggcaucugccuaagcucuccaagcaccucugaagcccaccaacauuuggugaccacucagcacugucccgggaagguggcuccagugcuccacgucccauuucacaggcgggaaaugggcccaaggagauaaacggacuuguccaagaucacagaacagagcuggaacuggacccucggcaugcugguuguauacaaaagcagaacagaagaagggagagggugcuagaaaggggggcucaggccucacuuccuccgcuaagcauccccuggcagcugggggcaucugaacucucccuucccuggccucuccuugcaggagacgugccug

SEQ ID NO: 18447 - RNA, 17711 nt, Homo sapiens
gccugugcucuccuuucuugccagcacauucuguaaagguccucgacgucuugacggguuagacuccugcagguuaaagcccuuuucuuuuccaaaaagaguguguguagaaaccaguuagagucgugguuuuauuuguaaaaaguggggagucguugcuaggaguggagauaugcuucugucccuugcggcaucccugagcagaagugggugguugccuaugcccacuguagaaggcagaggggugugugugugugugugugugugugcaugcagagcagugacugugugugucuuacgaauggaaucauauugggggcaucucuaagaguguguagugugaggggaaaagcugccccugaguccagggaagggaggcaugggaaggugggugcuuucuugggugggccucuucugggcagaggaagcugcaugaccuccccagcccacaaggggaaugggugcuguugggccccaaacugcugugcacccccaguauucgucccacuucccaaguccagccggccacaagucaacgugcuccccuaggcgcuuucuuggagaaggaauugcucuccugcugcaauggcacccucuccccaaccagccuuggcccucccccugcuuaagccugggaagcugcuccccaucuucccucagacccuuccggcucccgccccuucccuguucucuccucuccucacuuuuuguuucaacucccucuccuuucucucccuuuuccuuuugccuuuauccucacucuauaauuuauagcccucuucuucacucucccuucuugcucugcagaacagcauaacaugggcguuuagggguggauuguaacacagaggccucuguuuaccugcucacucccaacagcaggcaugcuucucucaaggugcuuaucuaguucccuaccuaucuucuuugggcccuagccuaguguguguguguguguuugugugugugugugugugugugugugugugugcgugcaaugaauggguggucugugagucccuagagucaagcucugugguuuggagguuggcaugccucuggguggcaugucuuaugucucuggguuggcucacagguaugugugugugcccgaagguuuccucuguguguuugucauggugacuguguaguggcuguguucucugacuggauuuauuguucauuuucucccuuucuuguguuuaaacuuuugguuagccccagcacacuguguacuuacaacaggcugugcacuaaaugucuauuggugcuaaugccauuuuaugcagauguguauuucuauugugugaaucuggguagcucuguaggagggugcgauugugagccugggcauuuugugcgugcgacuguacagauuuggagugcaugcauccuggagagugugccugcaggaaaggcagaugaaggauucuuguguuuguaucugaggaccgguguagaauccauaaggggaaaaucagaaaggcaggccuuauguuguguagagaagcaggucuaugggugcugggaaacugcucugagggcagguaggugccugagggaaggggcucggcuguguuuaugauggcacggcuggaggugaggugugauauaacauagagggcauguuuauguagaugagaugaauugcacauacguguguguguguguguguguguguguguguguguguguguguguguguagccucugucagccuggcuguuccugcccgcucccgccgagccccgcccggcacaguggagcucaaucagccgcugcaugaauacacucgaauggaaaguugugcucagcugaccggagaaauuggagccgggcuaguacugcuccccuccuccauggcucccucucgccugcccccgcccucccucgggccagacggccaccggggcccgcacacuggggccagggagcuucagcucagcuggggccggaaagggccggagcggugggaagccgugggggccucagcgcgcguaccagggggucgagcgucccgcgggccgggcaucucagcuccagcgcugggggacagagaggacaaggggaaggcccgggaaagucccugaggcacagccggugcuccaggugacggccacacaaaggcuuaggcgggacugacagggccacggaggcagaggaagaagagagggagaagagacugcuccaagacgccgagugcauccagugcgccacaggccugggaauggacuucgagcuccggggucccgggugaugcgcugggucgagaauguaccaggcuguccuauucuccuugcagaagaaccugggggccacuccaccaucacagcccccucggcaagcccaggcaagggccuucccgcugccucacugaaccgucuccccgcccaaagucucaggcacccccaggcugggcccuucgucuucaaccccauucccagccgggacuggccagacucgugccuccagccccacuauugaucggcaucuccgccccgcgccguggcagcuuccgggucauuucauuuuaaucaguugugugucucgccggggauaaucaacugcacuggcacugggcagucgauuccgcaggauucaaggagggcaagaagagaggccagguggggggcucagggccagggcuaggggcagggacggaagagggcugggugcggagagagugagcaggccagaagggguagacgggccucuucccucaggcaggcacaucuaggggucaaggcuuugauacagauuugcccaguuucacaccccauucugccuguucagguuuccaaugcaaaucuuggauugucauuauuuuucuuugagaaaauagccaaguuggcuauuauuccucaagccucuggaaacuuacgguaagugacugagguacacaggaggucuaagcacacagggaaggcuccgagccagaacacuccgcugggaugccaggcggaagugugcugcgugcaggguagugggugcggacucacuggaacgccagaagcagaggagccagccuacuggcugcugcauggcccagacauaggggacagaugguuagcacuuaggccugcauauugggucugacccaggcucacaagacccacgagagagcacacaccaaugcacacauucuccuggccgaggcacaaccugcagcauucccaggaggugggggcugugcagugacugagauggcuuucugcagguggaacuucagccuggccuugcccucaagcucugucugaguggcccguaggguguugaccgcuuuggccagggcuuugaggggcccagaaaagacuaggccuaggccagcagcugguaaaaggcaagaucuggccagaaaggggccucuauucucucacuccgauguuuaaaggggcaaaggccgaaucaaccacaauauccccaguaaaucaaacagaauaaaggauggacugggauagccaaagagcccaauccccuucugcccuccagccaaugaauacccauugagaucccuuaagucuuaaagggacaggaagaccuguuagaggugggcagccuggcagucauaucuagggagugccuagaacaagggaacacacacaugucuacacuagacccaagacccacaagacacaugcccaaguaccuuguagguguauuggagccccccaauaugcacuccuugcagaacuaaggacagagaaacuggcuaagccauacacaaauaccugugcuaugcaguauacaugaaaacauacuggacacacaccaaugcacuguacacacauuuauaccaaacaucacacacacacauccuuuuguaugcccucagaccuugacugaggguugaaagcccagcauccagaauugcacacaucuacacacccacaacaaacacacauguccuuccugcagggaaccuauauguaaggucagaaaguacaaagcauagaguauugguauucgugcagaccuggauggaaacacaggagaugagagagugauacaugauagauagcaggauagacagauagacaacaggcugcugacacccaguaaggcccaggcccuccaaagcuaaaggcugcuguggagucugauggacaguuuucugcaauacagaaggagugggcacuggaugccccaaaucugcuuucucugcaccguguguugagauaggaaaucauuuuaacuuccagguuugucuccuguccccuagacaaaaaggcaccugcuccuugauguccucuaucuaggcaggcccuuccaggagucacccuccagcagagcaacuucuugccuuucauccgucaauucuggucaguuggcugagcaguguccauccagacucuccacacugaggcaggcacuucuuuggguuuccaggcccaagcucugugucaaguaugugacugauuaucuaaaagcaaaggugggugacagagcuccucaucccagaacagaggcucaaguuggguagaauccaggcaguccuuuucccaaauuccuaccaccuggucgauauugccugaaauguggcaggacaaggaauauuuucccgagcagugaacacacacagagauucugacaccaugugccaggccacagaacuugggagcucuggaggucagcuggaugcucugguucuaaguaggggcgcacucaggaaccuucccugccuggcaaaugcacgcccuggacaugcaaggucccacuggaacacucagggcaccucugggccagacagccucucugcccagccuggcccuccuaaacccccuggugcuggugcugcuggggauggggacaaaaggaaaucggaagucaaaauuaguuuggaaacggaugcaaaauuccaggcauguuucccccaauccuccuugcuuuggaaauuggacuuucaaguaaaagcaaguuuucugaaauuaccccuuuugcuccuccuugggugcaggccacccuggcccagagcggcagaugcacggccagccaagccaucccagggaauugugggggccccggccagggcauggaggccuuggggccagugggaacaugguuaguaagagguggugacuuuuuuguuuucauuuuaaaguguaaaccaacucugaaaugucuuaggggcucgagagacuccagcugaaccccagagaugggaagaaauuucagggagacagaucgagagccguaaggcaaaucacacugucacauagacacacacucaggaggugaggaggggaguccauccugauucuagacccuaaacucugcaagcgaccuccucccucacuccuccugccuuccccacucaggccacuguccucaccaccaccccaccccccaaaaagaagacaaaaccugucagcucuacucgggauggaugcugggguuuggcggccuuguauguuuuuccuuuuaaaaaacaaagcaacaacaacugaaagacgcccagcacacccccaaggacccacagggucuuggcaggcuacaauuccggcugaaugcauacuguggugaagugggccuagcuucugacucugaagaaacuggcgguagccucccgcucccaacccuugaaccaucuuugccuuuuugcucaggauccagcuuuggcucuuuuccggagggccuguucuggucuucccaaugcccucaggggggaaaaaaaaugcugagauccagccuugaaauucugccccggcucaggugagcaggaguggaagugaaggccgagcaccccgcggcugcgggccaggggcagacaaaaacaccagucucugggagugauaagaaaauggagaauacuguauuugcuuuagaaaguuuuuacauauagauaaacacgcaguuuaagauaacaguaaaagcgcccuacagggagugagagauaccucugaagcugcuaagaaauacuggaaauagcuuuugcauaagaauacuacaaucucacucuccgcuuuugcuagcgacagggucccucuuccuaacccaggccaccaugccucuccuugacugccaagucgacaccaggagcaccgagugggaggagaaccccaaaaagaaaagagacaguugagcggggagaaagacagagagagggagaggagagaaagagaaagggagaggagaaaaagcaauaucauauacaggcaauuucuacacauauauuacaaacugggaaaaugaccgaucauuaagauauacauaauucauauaaaauuuugaaauaaaaauaaaaaucuguuacagucauaacuauucuuuuuccacauuuauaaccaguacccacacaggcagugacagaguggagagaaaaaggugcuuacgaagaaaaugauugucugcugaacaaaaaacagaagauugcauuuuuuugaccaauacuugacuuaaaaacagagagaagaagagaaagaaagagagcgagagaaaaaaaaagagagagagagcaacaaaaggcaagacacauuugcuauuucccucuccaggaguucuuuuuuuuuuuuuuucccccuguccuuuuuuuuuuuuuuuuuuuuuuuuuuaacaaauucggaacggagacggcgauuuuuuuucuuuuugucuguuuugcuuuugcccucuuguccucgugguggugauugauuuuuguauagucgacucuuuaaaucauuuuuaacuagagagaauauuuucccagauacaaauaaaucgucaugcagguggggugccggguccaugggaaccgaaaggagaagccgugcuuguccuagaaaguauacaauugucaccucuuuuauguuuucugcccgcaacaucagcguuugacugucuguuggcgucgggguccuuugggguggccguagugguagauggugguuggggguuguugauaguuugcgguuaauuuguuauuuucuuguuuuuuauauauuuuuggcuggggugggaguguguguggacuuguauguguguaugguuggguauccugauuucgguuuguucuggggauggaggaggagaaggaagaggaggaagaggaggagggcuaggaggcggaggggaaggagugggggaggaggggaaggagagggaggagggcggccuuggcuaucauacaucacauuccgagucgcuggagguuaccgagaggauggaggugccggugucugcgcgcuccgucaggcuggacacgcugguggucgggcuggccgccguggacggcgacucugccgagccgugcguggggcagccgggcucggccagcgagcgcaugccgcucgguccaauggccuggugcuggagccugcgggagaaagagauccgcgcccgcccugacacagaggcccgccacccggcucccccgcgccgccgcuccccauuccgcuuucgggagcaucccaagucuucucagauagaggcuggccucggaggagaggcagaacccgagcccggccgcuuggggaggccugggugcaagcgacaaaguacgccaagcccuggagaagcagaagucggagaggagccgggcgcuucuucccuccgcagucccuggggcucuucaaacugagccggcugccccgcgaccggucgaguuccccuaguaaccccgucccugcucccucaaacacacaccgggagcugcggguuccccaccgcccggccagucuccggguagaacugcauacuuugcucucuggaugccagcgcagagcgcaggaccgaggguagagaaaauaggaaagcuggcgguggaaaaguggggaaagagcagggagacagaaaaggggcaaaggagaaggcaagagaggcgcacagagcagucuccagcugcccuuucccccaccgggaaccuucugccuggaccuggugucuggaauucucuccacaaggaggccuuggcuugacccugggcgcuccccucaucagacgaaaagugggcuccacggcaggggugagagggccaugggcucaggucccggccgccuaaacucgaacacaccuccagaaacucacacccagcccccacccacgggcagcugucagcagcuggggguccugcucccugaaguacaccaggcccugggccuuccuggcuggauagagaaagacacaggcuccacaucagggcuuucacccaacuuccucuuuucuuucucccuucucuccccacuccuuucgccuauccacuucuuucccucugguucuuuuucuccuucccccaggcccagcuccugugauguuggucaagcccuauacaauuuugugacuuuguggccaacuugccggcaacgaggcugcucgugcccgcuucccagcuuagaggaccaaagggauucuccucggcugaaacaggagggcgaguacaugcacacgggcgugcacacacacacgcacacgcacacgcuaggccucuccacucccagcccggcucuccugcucccggucaggcaacgugcagcguugcggggaaacaggcccgcugcgcaguggccucuggccuuuuccccuugugauagggacccagguucacuuuccucucucugacgcuaguggauuucucucgggguuuugcaacgcacagaaauaagaaccagauggcaaagagugcuuuccuucccucccugucucuaggcuccagaggaucgccgagcuggcggcagggcugaggaggcaggcacgggugcagcgcagggcuaagucucccaggggcugcggguacucgggucgcaagcacacacucucugcccugacgaaagccccucuuggucaaagcaaucaauacacccacagccagcccggcccccucuuccgcgcgucccggacaagcggaaacuuucuccgacuggccaggagucacggcuucccuggcucucagcggccgcuccgcuagccccaucucaaccccucuccccuucccaggccucugaggcuguagccaggccgcgggccccgccacuaaccuguucuuggccgccgcggcgcggucgcgcugccgccgguucuuaaaccaguugccuacuugugugggagugaggccgguggccugcgccaguucgcguuucuugcugggguugggguagggguccuguagguaccacucccgcaacaggcuccgaguccgcuccuugaagcaaugcgucuucugcucgccgucccagauggugcguggcagcgggaacuucuugcgcacgcgguacuuguccaccgggccgagugggcggccgcgcagcuucucggccuccugguagugcgccucgagccacauggccugcagcuugccgugagacuccuuggugaacuugugguucucaaggaugugguagaggucgcggaaguugcccguguggaaggcgaccacggcgcgcgcgcgcaggaucgacucguguuuguugauggccucgcacgccccgggggccacgggcagcgaccagaggaagcggcccagccgcucgaugucgcccgucuccuccagcgucucacagacgcuggccaccugcuccggcgagaaguugagggugggcagcuggaacauggacaacucuuccgggggggcccuggagccgccgccgccgccgccgccugcuccgccagcaccgccgccucccgcaccguucccgccgccgcugccgccucccgcgccgccgccgccucccgcaccguucccgccgccgcuacucgccagaaguauggagcgguggugagaaucggcgaaguuuggcaacaagaagugggaggaauagaggucuaggggggagcggaauaccauggacugaccugagaggagaggagaaaauucagggagaggaagagagaggggaggaagaggaggagaggggcgaugaggaccaggaggagggagaggagaggggggaggaggagaaggaaaggaggggggagcaggaggaggagggagaggaggaagggcguaagggacacccacaccccacacacauccacacacacacacacccgcgcagccacauagagagggagguaggagagcggcccggugcgcgcgcgcagagagagaacccgagacagagagggagagggagagggagagaggagagggagagccaaccaccgccgagucaagauucagcgauuccaccgcaaucgcccuaaugacaacagccucauaauaucuccccuaaauccacagugagugcagcauugaaacauuuuguuucgcuuuucuauuggucuguggcgugucguuguggcguugccacggcaaccacugccaaucacugucagcccugccaaucaauaccgagaacguaaggacgguuuuaccacuuagccagagggcggggggagggggagagcagggaaggagggagaaguggggggauaaagagaauuuuuuuuaucuuugcaacucuuaaucucgcuaccucccccuccucucuucucucuucucccucucucuccucuuuucucuaccgcugucucugagacuucuucuucccuuuuuccuaaagaaguugauccagaaauucgaaaagcccugggcagaguuguugaaugggaugugcaauuagagaggggauuuuguugggaggcaagagggucccccaggcuccacauaguccaggucggcaggcaaggaaagacggcugaccagcccagcgggcgcgguuugcacaugguuugcacgucgggccgccucuuucugccuaugugagcacuaauaguggcaaggaagaaaggagagaugagaucauggggcccaccaagcaccgaccuuggcccagcgggccguggcgccagccggggaucccggauuccgaggguaucuggcgccagggagccugagcccaauucccagggugcuggaggccgcucuugccucccccaucggugcccauggaccgcauucaccucaacucccucuucaucaauuaggcuucucuuuacucccuccccggccaaggagccucgauuucccccaccacccuguauuuuaaaauaacaguccaaacaguacacuucuuuccaucuuaagaagcaacucaacucuuuguuucuucccagaauucagcugccucucugaggagugguggaggagcugcgggagccgagaagcccaagagcccucuggacccagaaaaguccuacagaugcccacuccucaccacacaacagaaggagcucugguccugccugccagccccagagggcacucaaacuuuggaggccagccacccggaugaagugaauaaggccugaaaauugcuuguuugcucguauuguaaaauaauaauaauuaccauuauuauuuuuaaacugucuaauuucucuagggaaaguaacaucgaaagccuaaaacagacgccaaaaggcccauagaacacagagggcccucucugccucuggccaccacagccccuaggccaggcauggguauuuauucuuagguauguugcuuuuaagaagcuguaaucagcaucuugagccgggccucccuuugugaggcuucuguaacuauggaagugugauuuacgcagauuugucggggucagagacgucuuucccugagcacuguguauauuuagacaggacucgguuugguguuaaaaaguguauauguugaauggauucacacacaguagccaacaaugaccacauugucggcccguguacaacgcguauugaaacgcagcgcccagacuucaacuaaucugcccucaauaaagcugaaauaauuauccuaagcugccuuuccagaagaaaaaucauugaggaauucaaaacuuuuuuuuuuuuuuuuuaaagaucuuuucugcauuccgaugcagaucugggggcaaggcgccguguccacaccacuuuggugaucucaaugagggaagagagaaagagagguugagagagaauuuaaaugggaaaccuaacgugacuggggcugugagugucccagccccuaaaccccgagcuggagcccugcuuaggccuugacucccgcagugccaggccucugagggccggggagaagagcaagccgacaagugcaagccuccuuggaggauuccgggcggcagggaggcccuggguccggcgaggggccaauacuggcucacuuagccagagacagccgugggguagcaggucuucaacacgacgacuggggcagaaaaauauuccuccaaagggaagaccugccaagccccauuucagugcucucuccacuccauauauauuuccucuccuccuggccaugaguccuucuccacgcagcugaaagcucugggcggucauucacugagggcccagaaagagcccaaagguugggacacaaaaacagacacuucauguuuucuucccgaucccuuucucucguaggggaaggauuauaggcugaagggugggagggggaaggggcaggaggaggaagcgggggaggaaggaaugaaaaaggggaggggaguggguauugugccgcguguggggggagaauuccuacggguggguuuccgaauauuguguucaacuuuuugaaagcagcucgugaccccgaaacugcaucccccggagccggggacccaggcgccgggcgggcgggugaacccggucaguccccuccccguccccgaaacccccgccuccgggugguggcgaccuggccucucccugccacugcccggccagccccggagggaggcugggcaggugcugcgggcucugccgaaagcgcugaaauaaaaaaccaucgccacucagggagaacugaggcaaguggggcugagacucuggcgacacccccgccccccagccucugccccagcgccugccgcccugccgcccugccgcaccccgccugcuuggguggcgaccgcgguuccggaacgcgaagcagggcagagggcugcagagaggcguguagcuuugugcgccaggacccgguggggcagguggcagccccgggcuguccgcgccucccagcagagccgagcucggcgccgcccaccgagcccaccucgcgguccagccgccgccagcgccuuucggcucuggccugaagcaguacucccgccuccuggagcggguaaguugagaguccggagagcagggcagggaggcggggcggcuggucccagagcggagggccggacuggcuccccgccgggcugggggcgcaggcuccauaggaucucagucgagggguucugagugcguguuugggugggaagcagggcuguggagcgccagagcuuccccucccaaauucccaggcgcugggcacuggggaguggagcagaagcagagggaccuuggguuccggggcccagcggccuuccacgcuggucugggaaccaagcaagcccuagggcagugcgaggacugggaagggacccugggggaccgcuagaggagguggcgcguggagggcgccugcacccuggggucgcucagagcggagagucucggguggauaggucagcuugcagauccucuaggucucuucucugcucucuggccgcucugauugcgggaucugggacuuggcgcccguacaggccgggucaccugugcagaacaaauuugcugccaucauccccgcuucaauccuggccccggcgaucuaaaauaucgccuucagguggggcagggagaaaagaugucuuugggguuuaaauaguguucuccuuguacccggaccaacuggcauuuauuuacaaaugucacccgccaccccagcacugggaaagucucaaccacaucuggagaacgcccgagagaccucccacucucuccuuguuuuggguuacagggaaagccaacgggucugcaggccuccgggagacgaggauccggaggguuggggcagcugcacccacuuggccuugcucagcucuaaacagccgaccaggaggccgggggaagguuugcccugugggggcaacgccccuuccggcucccaggaugucgggaggcggaggcuggccggguggcccguagucugggccuccccgcaagcugcaaacugaggcgcuuggcgcgggcggccagggagggcgcaggggagcgcagcacgcaggcggggaggccgcgaagcccuucaaggaccccgauuacuuuccuuugaaaaacaacaacaacaacugcucccuccccgcacccccgccccccgccuuagccuccggggacuggcgcuccaagcaauugucgccccggacaguaaacacagcucaguugccucaacuuucuccaugcauaaaaguuccuggcgugcggggaaauuugaauauuugaucagccccuuugagugacccucauuaguccggcgcccugcuaaggccgggcauugcaagaaagcugcugggcucggcauuuguacgccuuguuagcgcagcuuaaugaagccgccccgacggcucaaaggcggccucaggggccggcgacgcgcaccucucggcacccugcucugccuaaugagccccgccgcccucuaaaggacccuccaccccccacauucugaaacaggggaaguuuggcucugucuugaaccacggcaccucccacugccaggcccaggagggugggcacaaacccagccuagcugccugcaguuacccauucccaagagagaggggcuggagaguugggaggugugagccauacugguugggggcagugcagggaggggagcggguggcaggagaggcuuuugcugucucaggauccagcccagggagugcacugccagccucucccaaguggaccaauugcaaaucaauuagucacuccaguuccuuaaaggugcaucuggacuaaugcugggguggcugagggucagccuuccauccuccuaucaccuuagguucccuuggcuuccacugcccagaggccacacacuucuucccaagguuccccuucugaacagccagaccuggugugccaggacuuggauuugagaaagggugggcagcuccccucccuaacccaucauugccuccaccauucacagagcccagucacauguuaugacaaguggcaguagggaaggcaggggaccacagcccguccugcacucccccucaacagagguaucccuucuuuggcuucuagucccagggaggccuggcaaaaaaagugcuauaggcaagaccacccugcaagacuggccuggcagccuggcagagaggcagagagccagagcccuggaaggaagggaaaccaaagcagucaucuacuucaccuuuucuuaguggggcagcugacauggcuggccaguaaauauaagacacccucuuaaaaauugugcuucaguccucaggaaguguagccuuccuucccuuucugucuccccucuccucugaugcccuuuucccuggacagucggagcucaagguccuucacucccuccuugcauacacagcucuugggcccuuaaggguuacuuuuggggggaauuaaugcucugggcuugggaagcaggcugcuccaaauccacacucaggacuuucuggaccccaccccccaacacacaaacacaaacaugcccaggaucccucagacacacagugggccuggucagguugguaaccucaggaccccgugcccgcgugagcgucucugggaggucguggaaaggaaccaaaaggccagguaggcccugggauacagagagcccuccaaguccaucugguuugcuucucuuccuuucucucucccuagcuccgcuagcaugcccugccccauuucccaucacauaacccccuaacuuaacccuaaacuggcaaucuuuaggcaucaccucugagcugggcaaaggcggugcccgggccuugaucgacccagagggcuaaaguaggggcggggaagggaggggugugcgcugcuggugagaaaggggaccugaggcgaggguagaacucagcccuguggccucgaggccaggcccaccggcugcucaggggaggaggcgaggggagggggcugggaguccgcaggcaucggucggggcagcagggaccucaggcgucggcguggggggcuagauccggaggagaggggaggggaggcgggggucgggggaucgcgcagggcggaggaggggugcagcucuuuaagagccacacggcuggcaggagaggcgcgcggcccggugcugguagagcacugaccccgaaggggauuuagcgggaagagaguggccgggcucuggggguuuuguccgagggggccgggagaggccgagacacaagaauaaggagcggccgcggcaugaaaggcggcgaggagaggcagcacugcugcucuugacuucugagcagggcuuagagagccugccccggcuuaagccgagcugcuggugcugacccugagcgccgaguccgcgagcucugaguccggagccucccagccguggagccgugggaugaggggggcguugggggacagggcaaagucgaucuugguuguacagccgcccgauccuagcgcggagcugcgagccugaccggccgcgucuggcauggucagagaaagaauuuucuuuucccaacuccggcuuuugguuuuguguguccaccuugcgcaacuccggagccagccgaccccacauggauucucaacagguggccggguaaguccguuuaaagaauucugguuauauggucagccccuccccgaccuucuuccuuuuccccucccucuucccccuuuggcugggccggguuccccgugcuccucccgcaggcgacggcuggggugguggugggggaagaggcgcccuuccccugggggucucugggcuccgaguugcagcccaggaagccuggcgggcggcccccaaggaguuccacccgguacccccaagucccgaucacucuuagcuccuuggucugggcccuggcgcccugagagggggagggagaaagaacgcgcagcagcaccucaaaagccgaaguccccgggaagggggacaggggacccgguggccgggcagccuuuguguggggguuuacggcggaaacagaacuauucuucuugugugagaggcccgggauguggccagggggagcccgcgccagccguacaauagccggcagaagagcgccucagcagccgggguaggagugggguagggugggguagaccugggugggggaggggagggcgagagaagagggaggggaagcagagaaaggcaaaggcgagaaauccagggcguccgagugaaaagucggaaaauguuuccagagcgcgccacaaacaggcgcgcgcgcgcgcuugcgggcgcauagucucucugucucucucucgcacacacacaaacacacucuuacaugcucacacucauuccacacauggagcccacgcacgcgguuccuagucgugcagggucgcaugccugggcacccaaagugaacgcagaguagagccgcccucccacccccaccaacggagagcccucccgcccagccacaggcuccccgacuggggagcuaggagggcccccggggcuggggcacagggaggaucuuaccugccgaaagguaagggaagccgggagcacggagcagcggcggauaaauauucauuaguaagucucuccuuuuaagccgcgcggugcgcucucuggcuccuaucucucuuucccucccucccucuguccucuugugagccucucucccccucucgcucugucuuccccccaccccuuccugcgaaaugccggguggaucccaguauagcuaaccuguugggaagccuga

SEQ ID NO: 18448 - RNA, 5943 nt, Homo sapiens
ccucccuagaaguaaguacauagaagagugggcucuggcaccucacgggacaucaccaaguccuguguggcuggcuaggcugucccaagguggcuucaggcaucacuugaaucuuuugagaccuucaggcaguagccugccauucacccugucagucagcagaaguugggcccacacaggccauagaaacacagagcaguucccgggaggaccugagcugucccugagagcagagcuuccaggagaggccgcaggaacugccuugaccggaauuccucuuggggugcaaagguggagggacacauggugcgaccccaggcagaggacugcagccacuccgugcagucccagccucugggguagccccuugaccuccaggccugcacagauccaaggccgagguccaggcuccagcgccaaauuagcuggccuagcagccugcagccgcucuaaucucaacuaggaaggaauccuugcgcuuagaaaguccaagcgaaaggguauucugauuuuaucccgguuuuaccagaaaaugcugaaaggaaaagccccgagaggacacagugcucuaggaacucggggcgccacgagcgccucauccccucccuuccgcccggccgcggugcccuggucgcugagggacgcggucaguaccuaccgccacugcgacccgagaagggaaagccucaacuucuuccucucggaguccugcccacuacggaucugccuggacugguucagaugcgucguuuaaaggggggggcuggcacuccagagaggagggggcgcugcagguuaauugauagccacggaagcaccuaggcgccccaugcgcggagccggagccgccagcucagucugaccccugucuuuucucuccucuucccucucccaccccucacuccgggaaagcgagggccgagguaggggcagauagaucaccagacaggcggagaaggacaggaguacagauggagggaccaggacacagaaugcaaaagacuggcaggugagaagaagggagaaacagagggagagagaaagggagaaacagagcagaggcggccgccggcccggccgcccugaguccgauuucccuccuucccugacccuucaguuucacugcaaauccacagaagcagguuugcgagcucgaauaccuuugcuccacugccacacgcagcaccgggacugggcgucuggagcuuaagucugggggucugagccugggaccggcaaauccgcgcagcgcaucgcgcccagucucggagacugcaaccaccgccaaggaguacgcgcggcaggaaacuucugcggcccaauuucuuccccagcuuuggcaucuccgaaggcacguacccgcccucggcacaagcucucucgucuuccacuucgaccucgagguggagaaagaggcuggcaagggcugugcgcgucgcugguguggggagggcagcaggcugccccuccccgcuucugcagcgaguuuucccagccaggaaaagggagggagcuguuucaggaauuucagugccuucaccuagcgacugacacaagucguguguauaggaaggcgucuggcuguuucgggacucaccagagagcaucgccaaccagaacggcccacccggggugucgagucuugguagggaaaucagacacagcugcacucccggcccgcgggccuuguggcauauaaccauuuauauauuuaugauuucuaauuuuauuauaaaauaaaagcagaaauauuucccgaagaacauucacaugagggcauuacggggagacggcaagucggcggcucggggggcgcgcucagccgggagcgcuguagucacagucccgggaggaagagcgcgguguggcggggccucgccaagagagaaggaggaggggcguaugacgaggcggcguuuaggggcuucuguggcgcugcccuuucucucucacuuaaguuacuagacgaaaagcugacaccugcagcucccacugacccacaugggcgagggaaaaggccucaggagauggccuagguucaaagucccuguauuuucucuccucuucccucucccacccccuacuccgguaaagcgagggccagagguaggggcagauagaccaccagucaggaggagaaagacagggguacauacggagggaccaggacacagaguacaagagacuggcaggagagaagagaggagaaacagagaaggagagagaaagggagagacagaaggagagaaugaacgguggcaagcuagaaaucuagaaggaaagcaauacaaggagagggagaaagacagaaagcagaaaaaagaaaagagaaggaagggaaaggaagaggaaagggggaaaaggcaagacaagagaggguaaaaggaagagacagagggagagagagaaugacagugguguauaauuuauucccuucugugguucaagacucagucuccagccccaaaaggauccuaaaaguaacuuguugaaaauaaaucccaaacaagaaccaacauagacagcuaucugcccuacccggcuguucuacccgcucagccugcgggucuuucaguaccugguggggccgcaggggcggggcgccccuggacaccgccacuccacguccccagugucaagucacaaaaggcaagcucaucaaggcaaauggguucuaggagcccagguccacgagguuggcugacaugggguugaggauggaguccugcaggccauggugguguugcaguggguccgcuccaccuccgccuggcaccggcacuggcacugcgcuggggcccggaggguggcccaggcugugcagggacggcagcccagggggcggcgggcugaggagcagugcggggcuggaugaugaguggucuggcguccccgauggagucuucucauccuccgagcugccuaacaccgacuugccgcugccauucagcggguuguggcuguuagaauuggaguucucguuguucucccugcaagugcgggagcaaagcagcggggucagcagggacaucgagaccacccagcgccaucucagucacagucagagccagccaccagccucgggagacagaucccgggcuuguggccugcggguguuuucgguuucuaccauuuccucgaccuggucuggguucuccuuucugcccguucucuccaucucucaacacccaauuucucuugccccucugcccuuaucguccccaccucucaugcugucaaucucaucaauaucuuuucuauauuuccucuuuccccccuuccccaauauuucuuuucaggaacagaggugcaggagaacaggguucccugaaguuguggggugagccgggaggaagagacgaugccuggauuuucagaucacucuaggcuccacaagccagguuugcuggguagauguggggcuagcagguuaaggaacccuggaucccaggucaagggauuuagggccucucacaagacuucauuucccuuugcuuuuucugcccgagggagaccccuggcugggagacaggcuccuggggcuaagcguccuuucccuguagcuccaaacugggcagcccugugagggcucuccuugcugggccuagagacaaggguccaaggauggaggacucccuuuccguggugguacagugaaaacgucagcucggagaccagaagcuugggggauaaagggcagccccugggagaaggccgaggcuuuuccauuguaaccagccacuccgggaaucugcagcucucaucuggggccuggucugagaacccagguuuucaggagucugaucacaugccgguuuggguggagggggacccagcagagagaacccaccuccuucuaugccuuugacugacagcuccuccccagauuuggauauuuaaaauccuggguaggaucucuugucaccagcuucgggaggguuuuucuuucugcuuuccugggagggagcuucccacagggcuggcagcugagaccucaccacuguggaaacuccaaccucagggucucagauaccuggaaguaucugagccugcagcacucccccuaagauguuucugguucagcacccucaccucugacccugaucauucaaacucaggguggaacacaccccauaucaccaaccccagguguccuguuuugcucuuaccccgggcuggauucuguucccauaauaaguuucucuccagguuugagguccugagggguuauagggcaggcaguggcaagggccuaaugaucaaccuuuaggcugguucaggaaguccugguuuaccugaggacauccaacucccagccccucugugccucucagcucaccgcagacauuccgaccuacccaucagagguagggccuaaggagagaggcaucaagggccuggagugccagggaagggcggcuaucucuagcaaggcagaaaacagggcaugcgucucuucucucccagaacugacacuuccucccuuucaccucuggauccuuucuaaggagauaaaggacccgcucucaacuccaugugacaacgaaaauucauggccuggcuuuuccccauccaggucauucuagggaaguuccagccccagucccgaccccaucacacuuuggccuggagcuaaggcuggggggaaaugccgggaagcaccaccagcaagaaaucugcaaauccccuuucaucugggcucaaaccccucuguccugaggaugaccagaccuacugugccugccucacaggggauacaggcccacaguucugcgcugccccgaagcucucugcuucuccacccuuuuccucuagcgaccgaguaguuaguugacaacuuccugaauugcucugcccgcuuuagacaaaucccugcucgccgggucuccggcauagaaaggccuaagcaucguccaagucaggccgggcugccgcugggcuguggccgggccugggggcccaguuuaggccucuccgggggaccggcagaagcccugcgaaccccucccuugggccccggggagcuggcgccgaagaaggucuacuuacucguaccuuuccuuggccucggccgcccggucgcgcugccgccgguucuugaaccaguugcugaccugugugguggugaggcccguggccuccgccagcucacgcuucucgcggggugaaggguagggguugugcgcguaccacucgcgcagcacgcugcgacucuuuuccuugaagcaguagcuggucuccucgccgucccagauggagcgcggcagcgggaauuugcggcgcacgcgguauuugcccacggcgcccaggggucggccgcgcagcuucuccgccucgauguagugugccuugagccacagcugcugcagcuuggcgugguugugcggcgagaacugguggcucuccaggaucuuguagagcucgcggaaguugccgcgguggaaggccaccacggccuuggccuugagcacgcuuucauucuugugaaggugcucgcaggcgggcagcgaccacaggaagcggcccagccgcucgauguugccgcccugcugcagcaccucgcacacgcacgccacuugcuccugcgugaagccgaaggugggcagcauggacauggugccggcugcguccccgcccgcccgcgcgcgcccucaccgggccgcgcggucccgcaugggagcuuccucgccgggccguccgggccgagacgcgggcggggcuggcccccuggcccggcacuggcccccggugagccccgagucacugccguacguccccgcgccggccgcgggucccacgaagcuccgaaccccaacggcccgcgcgccuggcccaagcccucgcccaagcccgggggccgcccggggcgccgcuccgcaugcuccgcgcccgcccgccguucccucgcucgcuucucacucguucucccucccgucuagcugg

SEQ ID NO: 18449 - RNA, 5943 nt, Homo sapiens
ccagcuagacgggagggagaacgagugagaagcgagcgagggaacggcgggcgggcgcggagcaugcggagcggcgccccgggcggcccccgggcuugggcgagggcuugggccaggcgcgcgggccguugggguucggagcuucgugggacccgcggccggcgcggggacguacggcagugacucggggcucaccgggggccagugccgggccagggggccagccccgcccgcgucucggcccggacggcccggcgaggaagcucccaugcgggaccgcgcggcccggugagggcgcgcgcgggcgggcggggacgcagccggcaccauguccaugcugcccaccuucggcuucacgcaggagcaaguggcgugcgugugcgaggugcugcagcagggcggcaacaucgagcggcugggccgcuuccuguggucgcugcccgccugcgagcaccuucacaagaaugaaagcgugcucaaggccaaggccgugguggccuuccaccgcggcaacuuccgcgagcucuacaagauccuggagagccaccaguucucgccgcacaaccacgccaagcugcagcagcuguggcucaaggcacacuacaucgaggcggagaagcugcgcggccgaccccugggcgccgugggcaaauaccgcgugcgccgcaaauucccgcugccgcgcuccaucugggacggcgaggagaccagcuacugcuucaaggaaaagagucgcagcgugcugcgcgagugguacgcgcacaaccccuacccuucaccccgcgagaagcgugagcuggcggaggccacgggccucaccaccacacaggucagcaacugguucaagaaccggcggcagcgcgaccgggcggccgaggccaaggaaagguacgaguaaguagaccuucuucggcgccagcuccccggggcccaagggagggguucgcagggcuucugccggucccccggagaggccuaaacugggcccccaggcccggccacagcccagcggcagcccggccugacuuggacgaugcuuaggccuuucuaugccggagacccggcgagcagggauuugucuaaagcgggcagagcaauucaggaaguugucaacuaacuacucggucgcuagaggaaaaggguggagaagcagagagcuucggggcagcgcagaacugugggccuguauccccugugaggcaggcacaguaggucuggucauccucaggacagagggguuugagcccagaugaaaggggauuugcagauuucuugcugguggugcuucccggcauuuccccccagccuuagcuccaggccaaagugugauggggucgggacuggggcuggaacuucccuagaaugaccuggauggggaaaagccaggccaugaauuuucguugucacauggaguugagagcggguccuuuaucuccuuagaaaggauccagaggugaaagggaggaagugucaguucugggagagaagagacgcaugcccuguuuucugccuugcuagagauagccgcccuucccuggcacuccaggcccuugaugccucucuccuuaggcccuaccucugauggguaggucggaaugucugcggugagcugagaggcacagaggggcugggaguuggauguccucagguaaaccaggacuuccugaaccagccuaaagguugaucauuaggcccuugccacugccugcccuauaaccccucaggaccucaaaccuggagagaaacuuauuaugggaacagaauccagcccgggguaagagcaaaacaggacaccugggguuggugauaugggguguguuccacccugaguuugaaugaucagggucagaggugagggugcugaaccagaaacaucuuagggggagugcugcaggcucagauacuuccagguaucugagacccugagguuggaguuuccacaguggugaggucucagcugccagcccugugggaagcucccucccaggaaagcagaaagaaaaacccucccgaagcuggugacaagagauccuacccaggauuuuaaauauccaaaucuggggaggagcugucagucaaaggcauagaaggagguggguucucucugcugggucccccuccacccaaaccggcaugugaucagacuccugaaaaccuggguucucagaccaggccccagaugagagcugcagauucccggaguggcugguuacaauggaaaagccucggccuucucccaggggcugcccuuuaucccccaagcuucuggucuccgagcugacguuuucacuguaccaccacggaaagggaguccuccauccuuggacccuugucucuaggcccagcaaggagagcccucacagggcugcccaguuuggagcuacagggaaaggacgcuuagccccaggagccugucucccagccaggggucucccucgggcagaaaaagcaaagggaaaugaagucuugugagaggcccuaaaucccuugaccugggauccaggguuccuuaaccugcuagccccacaucuacccagcaaaccuggcuuguggagccuagagugaucugaaaauccaggcaucgucucuuccucccggcucaccccacaacuucagggaacccuguucuccugcaccucuguuccugaaaagaaauauuggggaaggggggaaagaggaaauauagaaaagauauugaugagauugacagcaugagagguggggacgauaagggcagaggggcaagagaaauuggguguugagagauggagagaacgggcagaaaggagaacccagaccaggucgaggaaaugguagaaaccgaaaacacccgcaggccacaagcccgggaucugucucccgaggcugguggcuggcucugacugugacugagauggcgcuggguggucucgaugucccugcugaccccgcugcuuugcucccgcacuugcagggagaacaacgagaacuccaauucuaacagccacaacccgcugaauggcagcggcaagucgguguuaggcagcucggaggaugagaagacuccaucggggacgccagaccacucaucauccagccccgcacugcuccucagcccgccgcccccugggcugccgucccugcacagccugggccacccuccgggccccagcgcagugccagugccggugccaggcggagguggagcggacccacugcaacaccaccauggccugcaggacuccauccucaaccccaugucagccaaccucguggaccugggcuccuagaacccauuugccuugaugagcuugccuuuugugacuugacacuggggacguggaguggcgguguccaggggcgccccgccccugcggccccaccagguacugaaagacccgcaggcugagcggguagaacagccggguagggcagauagcugucuauguugguucuuguuugggauuuauuuucaacaaguuacuuuuaggauccuuuuggggcuggagacugagucuugaaccacagaagggaauaaauuauacaccacugucauucucucucucccucugucucuuccuuuuacccucucuugucuugccuuuucccccuuuccucuuccuuucccuuccuucucuuuucuuuuuucugcuuucugucuuucucccucuccuuguauugcuuuccuucuagauuucuagcuugccaccguucauucucuccuucugucucucccuuucucucuccuucucuguuucuccucucuucucuccugccagucucuuguacucuguguccuggucccuccguauguaccccugucuuucuccuccugacugguggucuaucugccccuaccucuggcccucgcuuuaccggaguagggggugggagagggaagaggagagaaaauacagggacuuugaaccuaggccaucuccugaggccuuuucccucgcccaugugggucagugggagcugcaggugucagcuuuucgucuaguaacuuaagugagagagaaagggcagcgccacagaagccccuaaacgccgccucgucauacgccccuccuccuucucucuuggcgaggccccgccacaccgcgcucuuccucccgggacugugacuacagcgcucccggcugagcgcgccccccgagccgccgacuugccgucuccccguaaugcccucaugugaauguucuucgggaaauauuucugcuuuuauuuuauaauaaaauuagaaaucauaaauauauaaaugguuauaugccacaaggcccgcgggccgggagugcagcugugucugauuucccuaccaagacucgacaccccgggugggccguucugguuggcgaugcucucuggugagucccgaaacagccagacgccuuccuauacacacgacuugugucagucgcuaggugaaggcacugaaauuccugaaacagcucccucccuuuuccuggcugggaaaacucgcugcagaagcggggaggggcagccugcugcccuccccacaccagcgacgcgcacagcccuugccagccucuuucuccaccucgaggucgaaguggaagacgagagagcuugugccgagggcggguacgugccuucggagaugccaaagcuggggaagaaauugggccgcagaaguuuccugccgcgcguacuccuuggcggugguugcagucuccgagacugggcgcgaugcgcugcgcggauuugccggucccaggcucagacccccagacuuaagcuccagacgcccagucccggugcugcguguggcaguggagcaaagguauucgagcucgcaaaccugcuucuguggauuugcagugaaacugaagggucagggaaggagggaaaucggacucagggcggccgggccggcggccgccucugcucuguuucucccuuucucucucccucuguuucucccuucuucucaccugccagucuuuugcauucuguguccuggucccuccaucuguacuccuguccuucuccgccugucuggugaucuaucugccccuaccucggcccucgcuuucccggagugaggggugggagagggaagaggagagaaaagacaggggucagacugagcuggcggcuccggcuccgcgcauggggcgccuaggugcuuccguggcuaucaauuaaccugcagcgcccccuccucucuggagugccagccccccccuuuaaacgacgcaucugaaccaguccaggcagauccguagugggcaggacuccgagaggaagaaguugaggcuuucccuucucgggucgcaguggcgguagguacugaccgcgucccucagcgaccagggcaccgcggccgggcggaagggaggggaugaggcgcucguggcgccccgaguuccuagagcacuguguccucucggggcuuuuccuuucagcauuuucugguaaaaccgggauaaaaucagaauacccuuucgcuuggacuuucuaagcgcaaggauuccuuccuaguugagauuagagcggcugcaggcugcuaggccagcuaauuuggcgcuggagccuggaccucggccuuggaucugugcaggccuggaggucaaggggcuaccccagaggcugggacugcacggaguggcugcaguccucugccuggggucgcaccaugugucccuccaccuuugcaccccaagaggaauuccggucaaggcaguuccugcggccucuccuggaagcucugcucucagggacagcucagguccucccgggaacugcucuguguuucuauggccugugugggcccaacuucugcugacugacagggugaauggcaggcuacugccugaaggucucaaaagauucaagugaugccugaagccaccuugggacagccuagccagccacacaggacuuggugaugucccgugaggugccagagcccacucuucuauguacuuacuucuagggagg

SEQ ID NO: 18450 - RNA, 252952 nt, Homo sapiens
acugcagaauuaguuauguuauauuuacauauaacacagcuaguguuauguaauauguaaauuauauguaaguuauguuauauuuacauauauguuauauauguuauguuauaguuacacuguuaagacaauaauguaaaaguuaucuugaugaaucaucaggugagugaccacaaggugcugugacuuugagggaaggaaagauagaucacugaggccuaaagugguaaggaaagucccuguggaagaagagagguggacaaugggcauagacaagaugcuagaaguucagagguagagaaaaagaauggacauuccugcuggaguaacuuccuacuaaauacacagaggggugaaccuaaagauuuaauccaaugauuuuuaaacaucucuuuggggacagcacuuugcuaggcauggcauaaaauugaaaagaaagaugagagccccuuguuuaaauuuuaguuacuauucccaugaaaugauuaaauagcacuauaagguagcauuugaucgagauaaagacgguagaaagaaggcagaggucacaugggcuuccuggaaguggcaaaacccacgggcuaucaugaucuguaugaauuaggguaggcugacugcucuaacacguagauccccaaaugcauaaaagcucaaacacaguagucauuuacuucaugcucauguagcaguauuggguaggucaacaaaucaaaaggguggcccuguccucaggcuuccacagucacccugaagguugucaccaguggagccauccagauagagaacagauuacuggggagcaagucugggaggguguuaugggccaggucacucgcaucccauuggcuaggacuuagucacauggucacauauaauugccagggaggcugggaagcacagcccuguagugugcccaggaagaagaggagagccuggcuuuuuggugagcagugagcaacgucucccacuggguccuuucauccuuugcuggagauaaggaugaucuguuuggguuaacccucagugcagaauugaaccccucuccauuuuccucucccuuuccccaucuuauuccguauaaaaaaggcuaugaggacucuguggugcaagugaaagagacacaggugcaggugugggccaagauaaggacgaugaggugugaugaagaggaggccaugcacugggcuaggugugucuagagaggacauucucuuccagcuucucuccuucugcccauuaaaaugccaaguugcccucaucucuggugugaguuguggcauggugggagucauccccgacucuuuccugggagugggaggagguccauucccaacccacaaaugaaacguggucaguguccuccgugcaggugaccuuagaguugcugcaaugcagugaaggcugaugagcgagucaccuggcacaggcuucagauguaaugauggucuguacuuugaacuuuuuagggagcuuuuauauccaucccuccuuuuuccccucuucucaaccacagugcagggcaaguauuauucccauuuuaaagacggggcuacuagaacucagagaaaguaaaggacucaagugcaucagauccaagaggagagccugguucuccagauccccagacaaggcuucccuccuaugaccaaccuuguccacuuuauaugugaaaugagcuggugaguauguuuuauaauucccuggagucugagucuccaaggaagcccccccaccccgccaggcaaaggccacugcuccagcuggugcgcugcacagagacccaggcucagacaucaggaccuuccauccgcucuuagcugcugaccuggccugggggcuggggaggugaagaggugagugcauuggcaucagaauucaacaggcaaggcacuguucugcacacggggaaacaaagcccacacugcccccuaaggggccuuaacagccccuuggacaccuugcugaaugcuuucagaggggcacaaacuuuaccccaccuuuggguuaggguagaugucgcucaagcuuuugccucacugaaggauuuccuauugacgguuagucuuuucccuauaucucucucccucugccucuccccugucuucccuuucucugagccuguuagaccucaggguuaacuucugacaaaggaagcuuuucuggcucauuuuguucuugcaaaugcaaauguaagcuaaccaggaaagaaggccagggaccucaaagcagguugguguucuuccuggagcgugagaaccaaguauggaagccuucuccuagggccugagaugucucagggagcuuggagaaaagaugacagcccugcggaugaaaggguccuguuaaccucuaggguguggcagcucaaggcucugcacuuugggaccaucccaggugcuuccugaucuaggaaaggaaggagaaaacgaugcuguccucacucccugaaaaccaugccagcuccucuuccuugccugcauccugucccuauuauucccucucccaggacucccuggcccauucugugggccucaccuuagaaggcauuucuucuaagugacucuccugaucucucaucagcccacacuacauuuuauugucaucacuguucuacuugcuuguuucccaaaaagcagaauuacaguggugcucauaaggcuuaagcuuuagggcccuucauuugcugugcucccuccaagccccacuuucuaauuugguguucuuuuuccaaaagagggcucuccaaauugcuuaagcuucaggucccaugaaacccagguucacucauggccuuucccacuacugugcaaacuuccugaaucagggacugugcuucagauuccauggaguauuuuuagggaguggaggucuuccuaggcuccaauaaacauuuguuaaauaaaagagaaaggaagaaagaauucuuagcuagugcuuagcugcccagugguucucaugaagacuccccagcacugucaccugugcaauccggauggcucuuauggggugcccgucccuacagcacaguguagugugcaggaggaauccaucugggaagcucuaggaucuuaggaaaaucaccugccucucgaugagccugcauuuauucaaaugcaauaggggguuguaaccacuaauuaccaguaaguacaguagcuggcacaacugcaucucagaaaauaauaguuucuguuauauacaccgucccuauggaacauuucauucuuaauucuuuuagcucuaggaccuacagcuuccccuuucccccacggugguuccuggauaaugggguuuuggugugaagagucagggcacacaaagggauuugcccugcacccagcgucccacuaaguuuggcuccaggaccagaucuggguaucccccuauacacuguuccuucugacagcgagauguagaacugcauggaaagagucaaagaacuugaaugaugauauaaaugaaauauagggaaacaaugugguuaagugccuuucccuuugcagccaugguuuuccagccauuugacccacuggaacccuaagguauguaucucucagugcgguaaaggaguaguuauuuuucucuguuuccacagagaagaaagugagacugaaaugaccuugagccacaugccugaagugccagggcuggcaaguggcagacccagagccgcagcguagguccauguucuuaucacccuggacauggcccucauccccuguccuucagugaaggauugauccagauccccagacaaggcuucccuccuaugaccaaccuuguccacuuuaugugugaaaugagccggugaguguguuuuauaauucccuggaaucugagucuccaaggaagcccccacaccccgccaggcaaaggcugcugcuccagcuggugcgcugcacagcgacccagguaaacaucgcucaguuccugccccaauucagucauccugugagaaccaucaugugcaugccagaacugacccugcugccacaacauuuaaugugucauugugguuuuccucuaacaagaacugagaaguggucaauguuucucuuguuuuuuuucuggugacauccauacauucauguuugcaggaaccagggcuugaaaauucaacagcaaaguggguaagauaugcaguaggagggcagagugugaggagcauuuuacaacuuauuacaaguuuuguuauucauuucuuaaaaugguaguaguaguaacaacggugauaaaagcuaacaacuauugguugagaacuaugugccagaaaucaauauuuaacuuuuuuuuugagacaaaguuucccucuuuuugcccaggcuggagugcaguggugaggucucagcucacugaaaccuccuccucccagguucaagugauucuccugucuuagccugccaaguagcugggauuacagguguaugccacuacacccagcaaauuuuuguauuuuuaguagagaugggguuucaccauguuggccaggcuagucucaaacuccugaccucaggugauccacccgccucggccucccaaagugcugggauuacaggugugagccgccacgcccagcuaauuuuuguuuuuuuuaguagagacgggguuuugccauguuggccaggcuggucucaaacuccugaccucaggugauccaccugccuuggucucccagagugcugggauuacaggcaugagucaccacacccggccuuaacaauuuuuuuuuuuugaaacagaaucucauucugucacccagacuggagggcaguggugcaaucacagcucacuguagccucgaccucccauguuuaagugauccucccacuucagccuccugaguacguggaaccaacaccaccaugccugguuaauuaaaaaauaauaauauauauauauuuuugauagagacaggcuuucauuauguuucccaggcuggucuugaacuccuaggcucaagcuaucuucccaccucggccuccugaggugccaggaucacagaugcaagccacugcaccuggccuuaacaacucuuuaaucaucagaaaagccaaacgaaauauauauuaccauauuucuccaauucuaagaugcacauuuuugucacauacuaucaucuuauguaauccaugaugagaaaguacuggcauacuacuauaguugcuggugaguuuuuuguuuuaaucuccuguaguacuuuacauuaggauaccuuuuauaaaugaacccaguaaggugguaaaaaacuaagcaauguccacaggaucaucccacaucgaguagguagcagagccuggauuuauagacaggcgguccaacuccagggcucccccauuuguuugcuuacuggcuuauuuguuuugcuaucugggccauccuucagacaccuuuucucauagucagccauaggucuauccauuaugagcugggcucgugccaacuucacaaucugcaaaacaggagauacacauguaucuuuuuguauuaguccguuuucacacugcugauaaagacauacccgggacugggaaauuuacaaaagaaagagguuuaauuggacuuacaguuucauguggcuggggaagcccuaccaucauggcaaaggcaaggaggagcaaguuguaucuuacauggaugggcggcaggcaaagagaggagcauuugugcaaugaaacugcccccacccuucuucuucuucuuuuuuuuuuuuuuugagacagaguuuugcucuuauugcccaggcuagagugcaauggcacaaucucggcucaccgcaaccucugccuccuggguucaagcgauucuccugccccagccucccaacuagcugggauuacaggcaugcgccaccaugccuggcuaauuuuguauuuuuuaguagaaacaggguuucucuauguugaucagccuggucccaaacuccugaccucaagugauccacccgcuuuggccucccaaagugcugggauuacaggcaugagccaccgcgccugacugaaacuccccuuuuuauaaccaucauaucuugugagacuuauucacuaucaugagaacagcaugggaaagaccugcccccaugauucaauuaccucccacugggucccuccuacaacacaugggaaucuaaaaugagauucgguggggacacagccaaaccauaucgcuuuuauaugcaugugagcauauuuauauauauagcauuuauauuucuuuuguuuuaauuugcacaugauucuguucugucuuccacagaaacucugaacuuagaauauucccuaaagaaaaauagacgcuaaguuaaacuugccagaaugggccugggucagggacagggaugagaaauauuuccagaaagaaaaucuacuccuguauuugcuuguuaauucuuuugaccuugauuaaguuacuuucauucuuuggcugaaguuucuccaauuguaaaauaaggagccugucccaguuccaaacuuuguuuuucucuuuuuguuaccaaaggcauccaaagaccaaacaucuuuugcaucaucuuuuucuuuuauuuacaaagaguaaaauuaauuuuuguguguguacaguucucugagcuuuaauauauauagaucugugcaagcaccaaucaauacagaacaguuccauuaccuccuccccaaauucucucauguuaccaguuuguagugaaacucugucuccagcaccuaaccucuggcaaccacugauuaguucaucaucucuguaguauuaccuuuuccagaauaucuuauaaauggaauuguaccauagguaaccuuugagacuuguuucuuucagaaaccuuugagacuaaacuuagcaaaaugucuuugagcuucauccaugucauugaucauaucaauacuuuguuccuuuuuguugcugaguaugauucauugaaugaaugcauuacaauuuacuucgccauucagucauugaggggcauuuaaugcauuuccaguuuugguugauuaugaauaaagcugcuauagacauucauguacaaguuuuucuguaagcaucaaguuuucauuucucuagggcaaacaucuaggagugggauggcaggguuauauuguaaguacauguuaaacuuuauaagaaucugccacacagauuucagagugucugcauuuugcauuuccaccagcaaugugggagaauuucuugcagcugcucugcuuccucacuaguacuugguguucucguuugguguugguggugagggcgguguuugaauuauagucauucgaauagguguggaguaguaccuuauuguggucugaauuuucauuucccuaauggcuaaugauuuugagcaacuuuucauaucuuuaucugccaucugcguaacuucuuuguugaaauguucauucgcauauuuugccuauuuuuaaaauuguauuguuguuuucuuauuauuguuuugaaaguuauuuacauauucuggauacaaauccuguguuggauauacaauuugcuaauauuugaucccaguuuacagcuuguucuuuuaauucuuaaauacuuaacaauguuuuuagccaaaaaaaaauuaauuuugauuaagucuaauuuaucuuuuuuugcuuuuaugaauuggauuuugaugucauagcuaaacauuaucaaaaacauauguuuuaaaauaaacauguuaguuucuaguuuugcauuuagaucuaugauccauuugagguuaauuuuucuauagauuauacucugauauauagcuuaagguucauuuuuuugcauauggauguucaguuguuccauuuguugaaaagauuauccuuuauccauugaauugccuuaauaccuuuuucaaaaauugucaauuuuguacuuuaaaaugguuaaaaugauguauuuuaugucaauuuuaucucaauaaaaaaaucuaucuucaaaaaucaauugaucauauuuuuguggaucuauuccuggauugccuauuuuguuccauugaucauuguguguauaguuucaucaauaccacagggucuuaaaauuauuauacuucgcuuuagacuaaguuuuaaaaugguuagggugagcuaacucuauucuucuuuuucaaauuguuuuguuuauucuauguccuuugccuuuucauauacauuuuagaaucagcuugcuuauguuuuaaaaaauccugcuaauauuuugauucuuauucaucaagucuauaaaaucauuuuggaucuuauaugguucccagacaauauacaugcuauccagcuaaauuugaauuucagauaaacaaggaauaauuuuuagcauaauuauguccaaaacauuccaugagacauaauuauaccaaaaaaacuauugucaugaauguauguugaaauuugucaaaugcuuuuucuguaccuuuuuguacaaacauuuuuuucuucagacauuaauaugguggauuacagugacugauuuuaaaauguugaaccagccuugucuuccaaaaauuaauuccacuugguuuuuauuauuguuuuuauauauugcuguauuugacuugcuaauuuuucuuucuuucuuuuucuuuuuuuuuuuucagugucuuacucuauucaucuaggcuagagugcaguggcgugaucauggcucauugcagccuugaacuuccgggcuuaggugauccucccaccucagccuucuggguagcuaggacuacaggugugcaccaccaggcccggauaauuuuuuguacagacgguguuucaccguguuccccaggcugcucuugaacuccugagcucaagugauccacccaccuuggccucccaaagugcuaggauuacagguaugagccacugugucuggccagauuugcuacauuuuuaaaagaauuuuugcaucuauaccaugacagauuaucagucuauaguuuucuuucuauucuuauuuucucauuuaagcauuuagugcuaaaacuuucccucuaagcauugcuuuaguuacaucauuuucauuuaguucaaaauacuuuauaauuucccuugauauuuccucuuugaucuauagguuauuuauaagcauuauuuagaugucuaaguuuugggggauuuuucagaugucuuucuguuguugagcgcuacuuuaauuccauuugguauuauucgguaaaccugguauuauuucaguuaucuuaaauauauauuaaacacaucucccuuccuggucuucugauggaaaucuagggcuuuagucucuuugcucuccaauuuguuuccuacaacuaagucuaccuccggggaaaagcagcaggaggauaaauagagaaaaaagcaccugggauuugcucuacauuuuuaggaucacaguuccaaugauuagagagaagcauuccucucucucuggguuuuaugugucuguuggcagccacugccaucacacgauugugauuuuguaucuggggcucaccuggggcugagaugggagagaaaguuaaaaugagggaggagauucccuccaaaucucuguaucccgcaggggcccucuuccugcucuucagaccagaaagaaaagcuuuucucagggcccacaguucuuggucuuuguuugaguccaggcugggagacauggaagagaaaaaaauaaaaaucgccaccaacucauuaguacuucaaauuuugguuucuuucccuuguaugucuguuaucauuuacuuuucagagccuuuggauggcuucucuaagcauucuguuuagguuccuagcugcuuacuccaucuuccagaacuggaugcccccagccuauguagauuuaauucuuaauaacuuuuuuuacagguacuaccauacauguacuauuuauuuuacaugcaaaauaaaaauuaaaaugaaauuuuaaaagaaugagaaaaacuuucacuucuaaauaagauagacuaacagagauaggguuuacucucugaaacaaacauaaaaaaggcaaaauaugugaaacaaugauuuuucuagaugcuaaugucaggcaacagugaagagauagaaaacaaggugaguccugugacucagcuuaaugcauugagaggguuucuaggcuaugaugcagugagggggacuccaggcagagccugggagauugcugaguugaggagacggagcugacagucuggggagaccacaaugcuagagccucaugacacagcgcuagagaggugagaagcacauagaggggcuccucuguauaagugaagaggguucccucaaguauucaucuguguacugaugagugcaugggaugggggguuggaguuggggggacuaccugaagccugggaaagaacuacgggacaggauuagagagaauaguguaugcugcucccacagggccaagaauaguaucucuuuccaccagccagaauaggaaacuucaggauucacaggcauugauuagaagauuuagaaaggucuugcauucgugguggggaauaaucagcucuagacugagcacugaucuagcuguaccuaacaauuuaaaaaacuagaccuaaaaggaccaaacuauuuccaaguaauuuaaccaugccccagaauaaggcucaugaauauucaagggaauacaaaaauguccauuguguugcaaguuaaaauucacaaugucagcauccaaccaaaaauuaacauuaugcaaagaagcaagaaaauaugucccauaauaaggagaaagaucaaucuauugaaacugaccuagaacuggcacagauguuagaauuagcagacaagggcauuaaaaguuauuauaacugaauuacaaauguucaaaaggcuaaauagagacaaaauauauuuaaaagaccuaaguaaaaaaucuagagauauucacuacaauaucugggaagaaaaacacauuggaugagauuaauggcauagacauuacagaagaaaagauucagugaauuugaauacagcaauagaaaugauccaaaaugaaacacagagagaaaaaaagauuucaauaaaaaggucaucaaugagcuguggaacaacuuaagcauccuaauauacaaguaacuggaguccuggaaggagaggagagagugggaaggauuggacaaauauucaaauccaaaccuuccucuuuuuguuuuaaaauuuuuaaauguuuaauaugcaacuaauuuuuuuauuuuuaaaaaacauaauuucaacuuuuauuuuagauucagggaguacaugugcagguuuguugcacggguauacugcaugauguuaagguuugggguaugauugaucccaucaccuagguagugagcauaguagccaauaguuaguuuuucaacccuugcucugcucuagcaguccccaguaucuauugaaugcaacuaauuuaaaaguuaaaaauuauugcaggccagacauggcugguagguugccagccaauugcaggucucugguauaauggcgugaguaagauaagauacaucucauuacaguacaacugcauaaugaagcaauaguuuuucucccaaugcuccagugcccaaaccuauacucuuaucagugcugcucaguggguaagaugcccagagccuuugugcuuugaagaaaccugagguagacuugaaagacaaggguaauaacaagaaaagaauaaucuaaggcaguaacucauagaauaaaacugguagaguaucaaaugcacguguaagccuccugaguguagugccagugagagguggguuccuggcuaacucaaaagcaggggcugcccaaagaaaacugcugcuuucacauuuucucuggagggaaaaguuucagccuuuaccuacaggucacagguucagaaucaggcugaguuagauauggcuaauuucccuauauagucuccaggcugauuuaaauccagauaucuugacacuuauuccucuaaauuuuugagaacccaucuucaggcgauauuugaguaggcaaacauuuuucuaaggagacauucugaguuuugaaaagaacuuucuuccuggugcuuugaaaccucgguuuuguauguuuguuuguuagagauuggggucucacucuguugcccugacuggagugcagugacacgaucauagcucacuuuagccucaaacuccugagcucaagccauccuuccaccucggccuuccgaagugcugggauuacaggcaugagccacugugccuggccuaaaaccucaguaguuuaaaaauacugaguggacauccuuggcuauuucucugaugauuagguaggugucuuuugaaagaauauugaaaaaugccuucucccacagacucuugcauuucagaaguaucacgauugcacaucagaaauguccaauuuuuuuaugccuuucagucaagugcucccaacaagguauguuccauguggugaagcagccuacauagcaggaucaacccaauggccagugggaaaggaaauaacuuacauggagugcagacacuggugauugccuuccaaaaaccacucaccaaucucuacucccuuguuuuguucuauuauugaugggaaguuauauguuucucagaggcuggguccucccuacuuucucagcugcuggagugaauuccuggucagucuaaggcucuaagccagucauaggagguauaaugcaucccccgugccuaagaguaguuuaggaaugagcauaugauacaaaacuauacagugagaagugagaguuggagaguuuucuggagagagcuuuccaggaaaaguuuucucacugaugagaagaaaaugauaaaaagaaaaaguuccuugcuaugccuaaaauggcacuauuggcgacuauuuuuccuuuugaauuaauaauugcccuuuucuuuuagguuauugugauauuucuagugcaaauaccccugggaagaguaauacauggacucacauugccagaauuaguuggucagcucccuaauagggguuaggccagguaugguggcugacaccuguaaucccagaacuuuggaaggcugaggcaggagggucacuugaggccaggaguuugagacuagccuggguaacacagugagaccuuuccucuacaaaaaauaaaaaaauuagucaggcaugguggugcauaccuguagucccaacuacucuggaggcuggggugggaggaucuuuugagcccagaagguugaggcugcagugagcuguaauuguaccacugcacuccagccugggcaacaaagcaauauccugucucaaaaaaaaaaauuaauuaaagauaaaaagguuuaggugguauaguggcuugcacagugccuucaaaaagauauguccaugucuuaaucucuggaaccuaauccuuggaacugugacuauuauuuggaaaaagaaucuuuacaaauauaauuaaguuaaagaucuugagaugaagaaaucauccuggauuauccagguaggcccuaaauugaauggcaaguauccuuauaagagugaaauagacauugaugcagacacagaagagaaagugacuugaagacagaggcagagaguggagugaugaggucacaagccacggaagcuagggaaugcagacagccaccacaagcuggaagaggcaaggaagguuucuccccuucagccucuggaagggggaaggcccagcugacaccuugacuuuggacuucugggcucuagaauugugagagaacaaauuucuguuucuugaaaucucccauuguguguuaauuuguugcagcagccaugggaagcuaauucagagggcaugggcuugcugagggcuuaaaagaaauaaagauccaaaaaggggagucugggggucagaaagaggagcucguggacucugcaaguuugcuuggagucuuucuuuagcaucccaacuuugacuguaagagggccgguuagccugugccuugcuccauagcuaaacacaaauucauaaguucuccucaccacacauuuuauccugguccuagcuagagauagugccccucaucuuggucaauugucuucaaaugcaugcccuuggacacacaaaagccagauaaacaguacaguggauuguucaguacaaacauuucuccuuccugggaguaaaacucaggaaugucucucuaugagcuuuuaggcuuccauaagaacgggacauuugguagauucacuccucuaggugaaucugcucagguaacugacauaguuggagauucuggcagagcuaggaguagaagguggaagcaaaggaaauaauauuuguugugcaagugucaugaccccggacccauguuagauguuuuacauacacaaucucauccaauccucacaagaaucucaugaaguaaguagucguaguauucuguuuuauauaugugaaaacuggccccagaaggacauaaugugccuauauucacacaucuuguaagugauggaaauaggauuccuggugcucuauuggguuccaaaucccauguuuuucacgcuaggaauuucugccuccuuagaaaagguuuaagguugaaggcaaaggaugaaugagggaaccuuuggguucaggcuucuccaucauucuuuccccauagacagcagaaaaauaucuucagagucccuggaaaggaggaacuaacucugaugaaaugagucuggagugauuguuuaagaaagaaauaccacccuguguaugaaaugacacagagcuuucacauggcucgcuggagaccugggcuccuagguuaccucgggaccacugaucacucagagaugaaaagauaacgagaguauuugccuaucucgggcuuucgggcucguuucuacccaggccuagugaccagugcaggugugagccaaaaguuuauuugaaaaaggaggcugcucuauuuacuuuuccuauucuaguucccccauucccccaauccacccucccucagccuguaggacacauuauccuggaaaagguauacucacccuguuugaacugggccauuagcuuucagggguggcauaacuaggaacaaagccagagucucccuuucccuccaaauauuuauaagaaauuacccagugagcagaagcuaagcuuuuaagagaaaaagguucagcuuaccacagggaauauaaggcuuuaaacacucacuuucccgguuauuaucaccaauuuuucucuugcacccccacaguuucagaaaaucacacuuccuucucacugccccuuaucuuccuuagaagauaacugguuguuguuguuuuuuuuuuuuuuuccaguaaaggaaacugucuaagugucugauuuucaaaucaagcaaccacacacuuauuccuucaauuaacaaguuugguucagaaaaggcagguggaaggcugucucuggaaaggcauguuguaaauacagauugagacuaguaucuccuucacugguucauuugcucuaauuaggcuuaaaguuucccaaagacucuucuggucaucuuccaagcaagaucuauucaccugaaguucagcuuuccugugacauuucuccuagaacaugaacaggauccaggcaccaagucccugccuaacuaguuaguuaccagcugugugauuccaagugaaucacuuaauggcucugagucucagaguccucuucuauacaaaagaggcaagucauuccugccaccuacucacaguguuggucucaaaccagagaagguaugugaaaacacauagaaaauguuagagguuggugaagauguagaauaacauaauugugaaaauccucaccccacaagguggguggguaagcugucacauuuuuguucaggcuucagcacugggcagagauccugaacuccaauaccuuguaguuucaugcagaaggaacaucucuuuauauccauuuaagcuaagagcuuagcugugauccacucugaauugcagauggaguauccuaaaacagaaucccaaacccugagauccguacggagacaucuuuucuucccauguagggaccucugcagcaacauuucugacagcaucaucaagccucagaugagacccuucuguuaaaucucuuucugggccccuuucucacaugggucaguuauaacuguuagaaagugauuucuaaauaagaacccaaagcuacuuucaccauuauuuugccuccuggaaucacauacagaagguuugcccacuccuucauaggcuggaagauacuuguacacagccaucagguccucauuagacccgcccuacuuaccaccucaaguguauuccacaugugacaggacuucaaaccuagugcccuccuggcuguccuucuugggacauacuuagguuugucagugucucuucaagugugcauauuaguccuaguccuauauugcuguaaaacaaauuacccuaaaaccugguggcuuaaagcuauaagcauauauugucuuacaccaacucagagucaggaauccagcaacggcuuagcugaguggcucugcuccaggccucucaugaggucccagauaucagacugauuggaauucgaugggaaccuaauccacauuucuucaucacuuccaccaauauaucacagauaauaucagacauuuugauuacaucaaauaacucuagcucuuccagauuuuccugaccuaucagauuagcaauacaauggaauuaguggaaaggaauuuaggaauuaauagaugcaaucuccuuauuuuagagaaggaaaaacaaaaugaagugacuugcccaugcucacuaguuauugucugaaacagaacuugaaccaguuccauucuucacccuguuauaccuguuguucucuguagugugucacucacagcaucagagaaaggaaauucuauauaggguauacucauuuaagggccugccaaagcaaguaucuccuugguucuuuccccauaucacagccacaacccagcuguggcauaauccuguguauauuccugguucuuucuaaucaucuccuuuuuuaaaaauuaaaaauguaugccauuuuuacucuuuaaaucuaacaaaccaucuguuuaauaauguauucacaaccuuguuguggauggaaaauuucacuacucuguguuucuucuaaucuacaguuuccagauuuguaauaaucuuuuuuuuuuuuuugagauggagccuuacucugucacccaggcuggagugcaguggcacgaucuuggcucacugcaaccuccgccucccugauucaagcgauucuccugccucagccuccugaguagcugggacuacaggcgugugccaccacgcuuggcuaaauuuuguauuuuuuaguagagacgggguuucaccauauuggucaggcuggucucgaacuccugaccucgugaucugccugccucagccucccaaagugcugggauuacaggcgugagccaccgcacccggccaguaauaaucuuuuaccucuucuaaagucccuucuucuuuucuucauuauuucacaaaaguccacaacacuaauugucauaccucuguguuuguuuuagugccgugguuuguauuuguucaggcucagaggguguaacuucuguaaaagaucuagauuucauaauacuuuguguuuucuuuuaugucagacauaaguucgucuuuuaaaacaauuuuuaaaaaagaguuggagucuuacuauguugcccauggaaauccugggcucaagugaugcuccugccucagccuccugaguagcuggggcuacaggcaugcaccaccauucucagcuacuuuuuuuuuuuguagagacgggggucuugcuauguugcccaggcugguaucaaaguccugggcucaagugauccucccuuggccuuccaaagugcugggauuacaggagugagccaccacacuuagucucauucauucuaagaugcauacauuuucacauuuguugucucugaaauuagaaugcauuguguaauagauaccauaucguaguuuaauugacagggcuuugaaaauuuuucuuuugcaguaguauacgcaacaauggcacaucuugcaaaccauggcaucuuagcuuugauaaaauauauuauuugcauuuguuuacauaugcaaaguauuuuguuugaaaggauucucaagaaacugguaaaaugaacugcucauagggagaagaacuagguagcuaagaaacagagugacagaauuucuauugcauuuccuuuuguaucuuucacauuuugaaucacaccacaaaucucaacaaauaaaacauuaggacaauagauuccaauuuaaaaaguacaacuggacaugagcccuugcaacaccaugacuucacagagauuugcaugcaguucuguguuuguuccuagagauggccaaugagcaaugagcacugugaagguacggcuuugccacugcaugcuucucucuuaaugcaggguccaacacggcgccuggucagggacuaacuuuaaaugauaucauuccuuucucccaagguuuuggucauguuuaaaucauuaaccagaucuuuguugguuaaaauuaaguucaacauaacuguuuuccucauugcuuucuuuaccuuccuguugaugaaauuguucuacaaggaaagacacaaauauaucagaugcucugcucuuacuagauuuugacuuccaacagaaccguagaacagcccguagggaaaugagagaaacaucuugagaagaaaagaaaaacaguuuaauuggcaccaacgcgcuugacaauugaguuacugugauggcucauaugugguauuugcuaaaugaaccaggagauucuggaaaugacuguaagauguuggcaguugugcaugucacuaaaaggaucacuguugauuccuuccuguugaugaggauauuuagaaaugcaaauagccacuucccagaccaugcugaauauuaaaugcacaaaaaagccacacuaaaucugaaguaagcaaaaucaaucccagcaauccugcguggcaaagaauaacugauaaccagugaauaccuaugauaccaggucuacuccaaaaauaagucaaaaagguuaaugcagaauagagauacaguuuucagggccagagcuuucaaguuugacauagacagaauccaagccagugcugguuggguguggaaagggcaggcuccagggugauuacuaucaauuuuuguuggcauuugugguucacucuuaucagaaaguugguacagggugaagucaacuuaaaacucagcaguaaaaugaacaauuuuuuuguggcuuguuuguuugggauauggauacaauaacgucauuuucuagaauuaggccagauuuaauuuaauaauuuaauauaaauuuacuuuucaauaagacuguuaauuaaaugugcaaccaacauaaaacauuaccuguaauaacuuuucaaagcaaagcauagauuauuuguuccaaucuaugguacagaaaauacgguuuucuuauuuaaauaccagaugauaaguuuuacucccaaaucuucuuucccaugacuucccuuuaagaaucacuggcuugccuguuucccuguggcuuuucuuucucugucacacauuuuguacucugugauguaauucuuccauagguccugugccagauauccuuuccuuauuccucagaucuacuugccaccuuucuccacccuacuuucugccccaggaggcugaccccuaugggcaaccucaagggcucacacccacggcuuauggggaccucuagcaggaaaucaggguuggggguggagggucaagggagaugaagucaggguauguauucuccacuuuugccaacucaguuuggcugugucccuugaccaaagagaucagccauauuuacugcuccucucaaggggaccaaccauauaggacucucuccagcuguaguaaccauucccucucaucaugccuucagguccagagguuauagcagcauucucucucuuuuuuuuuuuuuuuuuuuuuuuuuugagauggagucucgcucuguugcccaggcuggagugcaguggcaugaacucagcucacugcaagcuccuccucccuggguucacaccauucuccugucucagccucccgaguagcugggacuacaggugcccgccaccacgccuggcuaauuuuuguauuuuuaguagagacgggguugcaccauguuaaccaagacggucucaaucuccugaccucgugaucugccugccuuggccucccaaagugcugggauuacaagugugagccacugugcccggccuacagcagcauucucuuauuucccccugugguccccucuuccuugcccacacccuugcaaacaguauaucuuaauuugaaugcaacguuugucuccuacugggauccugauugauauacuccccuauggaagaccuagccuaaauuuaaucaaaugcaauaaaaugccccuugaaccaggguauuaaagagugcaccuggcagaugauccacaucacugucauuuggaacuugauuaaaaaggcagauuucccagaccucacccaacucucucucuggaagucagaguggggaaucaguauuuuaaacaaguuuucuaggugauaucuagacacagcgaaaugggagaacuugucacagaacagaugauguuuuaaaaauaugcugcuaaugaagcuaaggcuuuuucaaaucuuaucaggaaacuagagcauuaucucaaucucccaccaggacucuagauugcuuuccaaaucucaucaagaaaccaaaaauaaaaccaagaaaauuaaugcaagauaaugacuaguguaaauugguuucccagugacuaugagaccuuucucagggugcgaaaauucuuuacaaauauggcauaaaucucagaggucaaccauauaaacuugaaaauuuucugauggaaaaaucauuauaaguaaaauuaagagacaaaugauaaacugagaaaaaauauuugcaauacauaucaaagagccuugaagugguacuuuuggacaauauucuccaguuuuccaguuucuuggauggggaggggagagaggauuuacugaccucgucacccuaccaaggcuggaagucccacuucagucuuaaaaaacagccaagcaaacaaaaucucaauugucuucccacaaagcaccuaacaaguagcacauuuaauaugcuucaguuuccuuccccugcccaucccuggugaaaauaaaagcaaugaaauaauuuccuaugacucaaaaauuggaaggggaaacagaguagguggcagaaguaguccaaguucaaaaugaagagcauguggguaaaucaguuucucagcacuucagggauaguuauauuuaaaaauacauauuucuuccuuccuuucuuuuuuuuuugagauggagucuugcucuguugccuagguuggcaugcaauggcaugaucuuggcuuacugcaaccucugccucccggguucaagugacucuccugccucagccuccugaguagcugggauuacaggugcucaccaucacaccuggcuaauuuuuguauuuucaguagagacggguuuugccauguuggucaggcuggucucgaacuccugaccucaugaucugcccgccucggccucccaaagcguugggauuacaggugugagccacugcacccaaccuaaaauauguauuucuauuaacauccaccuugcuauuucaaacauccucuuaaaaagucacaggauauuuauuugaugaccuaaauuaugucaaaacuuuuucugcuuuucagacauuuacuccauggccccaccugcacugacaccugcugacucaacccaagaaacucucugaaaugauucuccauggucauguagacuaaggaagguuugauggaauuagaauaacagcuuauggccagaaucauuucaucccccaccaaacccauagauguuugaugugaacuucaugaggauuucuguuucuguaggaaauaaauaugacauggucacagagaacaaguaggcuuugcucagguccaaauucugugugacuucuuaaaacauucaaagaggaauacauuugagugagguuucuccucuucuccccuccucuucuuccuccuccuccuucuucuuuuuuucuaucuuucucuucuucuucuauuaauucagacuuauucuuguguucauuugaacugugcacuauucaggcauagcauucuuuuugcccuucaauugagcugacacugaucaggcaggguggcucaugccuaugauuccagcacuuugggaggccgaggcaggcagauugcuugagcccaggaguuugaggccagucugggcaacauaaugaaaccccaucucuacuaaaaauacaaaaaauuagccaggcgugguggcacaugcuuuuagucccagcuacuugggaggcugaggugggaggaucaccugagccugggaaguugagauugcagugagccaugaucguaucacuucacuccagccugggugacagaaaaaaauugaguugacaccaucaauauaguaugacuuucuuguauauuaccaguaaagacuuuaacagcauuauucgucuacuaaaugaagucuacugcuuucaaauaaaaaaaaaaacaacaacaaaauucuguuucuuauacuuugaaauaaucuggcauauugauuauuuuaauauaucuuugaauaugcacucuuccuuauucugacucuggcucucuggacuucaacucaugcagauuguuugccaggagagccgguggauuauugaaaauauuuacaacauuaaaaaacauuuugggguaauguauuugcagcaauagaugacuaacaaaugcagauuuaguugaaguagguacugcauauaauuauuauuauuuuuuaguucuugagguuuugauagauaaauuaugcucuguaccuuuggggaaaauacuuaaacucccuaaacuucaauuucauccucuuaaaauggggauaaguauaucaccugucucaaacgacuauuuuaaaaacuaaaaaacaaaaugaaacaacaaugugaaagcccuaaaauaaguauauaaaguguuuauuacaauaucuugaaaauauuaaggcaaucuauaaggguuaucuauuuuuauuauuuuugauuaauaaacuacacaauaguagucaauguggcuagcaggaacugugaauaucuggucugccuuuuggaagggcauguuuaaggguaagccccauaaaauguuauacagcauuucaaaaccauacugcuguagcucaguucucuagcuuucuaagucaaguacacacuaagaauuagggcagucuuucuguagugcauagaacaccccaucaguaucaccuggugucaucauagacauguagaaacuaccuuagacccauuaauuugggaucuuggagucaagaucccaaauuaaaguuggacauugggauuuuaaaaagcucuccuggugauucuuaggugaauuaaaauuugacacauacuagcuacaugauuacugguaacaggccugaaaguuacaggaauuauagaccugggauauucugacugacaaaaacuuaugguagaaagucacgagaggcccuuguauacgcaauaccuacuucugcuaaacucuauauuccaggaugccacaggaguuucuugguaaacaaucugaauuuucuuauauucagaucaugguccaaucuaaacaaaauacccaguuauacuguaugaacauuaugacuuagcuaacuuuccacauuauuugcuaaagcuuauaagugccacuuucccaauuuuaaaacauucuuuuaguaugauaaauucauuuacuuuaagcucauaauuuugucaucuuucaaugugaaauuaggucauuuuucugcaaagaauguguucuaucuacauugauguuggcauuaggaaaguucccauaugguaaaaauguuggugguuuugauuucaccugucagcuagcuucuugaaggacguuuggccauaguaaaguuuucuuuguggucaacgaaggaaucauuuuucugugugcuacuaugucagcaguugccuguaauaacauacaccucuuaaagccaggugucauauuugacaaaggacugguauccacaauauauaaauaacucuuguaauucaauaaacaaaaagucaaauuaaaaauaaaagauuugaacagacacuucaccaaagaagauauguggauggcaaauaaaugcauuacuaauacaaauuguuagucauaagggaaaugaaauacacacauuaggaugccaaaaaauuuaaaaaccugacagcaucaaguucuggcaaaaagugguacaacuggaacucucacgcauuucuggugggaaugcagaaugauacagcuacuuugaaaaacuaaagacacacuuaugacucagcaauucuguuccuagguguuuauuuacccaagagaaaugaaaacguuuguccauacaaaaacuuguacauggauguucauagcagcauuauucauaacagacaaaaaguggagacaacugaagucuaucaacugaugaauggauaaacaaacugugguauacccacacaauggaaugcuaacuggcaauaaaaauaaacaaacuacugaugcaugcaaugaugugcauuaaucucaaauguauuauaauaagugaaagaaaugagacucaaaugguuacaugccauaugauuccauuuauauaauauugauaugguuuggcuguguccccacccaaaaucucaucuugaauuguaaucccccaaaucuccauaauccccacguuucaagggucagaccagguggagguaauuggaucaugggggugguucccuccuugcuguccucaugauagugaaugagucucaugagaucugaugguuuuauaagcgucuggcauuuccccugcugacacuuacucuguccugccacucugugaauaaggugccugcuucuccuuugccuuaugccaugauuguaagcuuccugaggccuccccagcaaugcagaacugugagucaauuaaaccuuuccuuuguaaauuacccagucucaaguauuucuucauagcagcgugagaauggacuaauaaagacauucuggaaaagguaaaauuauuggaacagaaaacagaucagugguuugccaggugcugguggaaggggaaaagauugacuauaaaagggcauuuuuuugaaugauuaaaguguucuauaucuugauuguggugaugguuacacaacuauauguguuugcaagaauaaaaaagcugacuuuuacucuauguaaauuauacuucaauaaaccugacuaaaaaaauaguacacacaaauuuggacauagacugaucugacacaccaugcuuuucugaauuugaauuccagugugugaaggcucuaguacuaaaauucugacaauaugcauuccuagaugaauguuucaagcaagcacuuugcaggauaguuucaauuuauuaagguggaagauggaccaaugguacuagauauaauauuuaguucugaauuacaguauccagacauggcuaccugugguuaguccagauuugacuaaaauaaaucuggccccauuaugcugccauuuaucccuuccuugaaacccagccagccauggcaucaucaggaucuuaaugagcccucugggguuuccauacuuggaucucagacuguuuaauagauauuuuaggccuuugagauggucccugagcacuacugaugagaaacucaacaggagaaaaaauuucaauauguuugcucaugauugcaaccaauugaaugccucuuagccagugacuuugcaagguaagugaucaguggaagaguggaccaugcaauagauaugguauuucaucuauuauuuauguuuuuuaugggucuuaauccuauuuauaacugcauucauuacaaaauaccuuaggaauuuguacaaaauaaguaggauaaagcacugaacauuuuaguuuucaccuaaagauacaaauuauauuguauuucaauaugcaguuuccauaauuuuacuuugugugagauaaauuugauguauacaaucccuuugauuccaauuccuugacaaaucuguacaauuaauuuccucaaccuuaacugaugcuuccuccagauccauuuaauauuuaauaaagacucagguuuuaaucucuugaaucuuuacucuuucauaagaaagacugacaaaguuacucuggcuagaacaauggcaucagcacuagucuagcacuuuggagucaugcugcuguucccagcuagauugaaagaguuaauaggacaggccaaauuugagaacccaccuaccagccuggucagccucacuaauaagaaacuccuuuuucauuugggaaacagaaguaggccccucucuguuuacuagucucuuucauuuugcaguaaaucuccagauuucuggcugaauuagucagagaaggucauugaagccaaagagcuuuaguguuuaggaauaagaacgucugacagugggaaaagaggggagauaggagcuaauacauacuuuuuuuuuuuuuuuuuuugagauagagucucacucugucauccaggcuggagugcagagugcaguggcgcaaucuuggcucacugcaacauccaccuccugggcucaagcgauucuccugccucagccuccagaguagcugggaccacaggugcccacuacaaugccuggcuaauuaaauaugcaaauuuuugaacuagggcucaguuuguuugcucauucuuuaaucugaaacagccauuauuauuaucauuuuugccuuugcuaguuguauuagaauucuccagagaaacagaacuaguaggguguguguguguguguuuguguaauaaauacagcauaaagauauaugagaauauuuuuuagggaauuagcucacaaaauuauagaggcugagaaguccagugauuggccaucugcaagcuggagggccagggaagcuggcaguagggcucaguccaagucugaaggucucagaaccagagaagccaaugguguaacucucacugcauggccaaaagccugagaacauggggcugagaggguacacugauuuaaguccuggaguccaaaggaacaugcaguucuaaugcuuaaaggcaggagaaaaagugugucccagcuccaaaagagagagaaagaaaauauuccuuuccucuuuguucuaucugggccucagccaauuggauaguguccaccgaaauugggugagggcagaucuuccuuacuuagucuacugauucaaaugucagucucuucuggaaauacucucacagacacacacagaaguaauguuuuaucagcugucugagcaucccuuaauccagucaagaugacacccaaaauuaaccaucacacugauugacucucagagauaaaauguuugaauuuucauaaguacacuugauuuuuaaaauggcaacccaccuucugugucaagagcuuuaacuuacuuuucucauaagagaaauuuguuuguacucuagacauauuauuggguccaggaguuaguguacuauuuuuaaugaguaccuauuauaugucaagcauuauuaggcacuguguggguggcgggagaagguggagaggggaggaaaauuuguuuuuacuuuagacauguuuuuggguccaggaguuagucuacuauauuauugaguaccuauuauauguuaagcauuauuaggcacuguguagguggagggagaaguuggagagggggagauaaaaaauuaccaagaguuaguuccuagauccaaauaucuauuaguaggugaaacaguugcaucuauuaauauauuaagaauuuuuguucuuaugaaacuuaguuugaggccaauagagagaauagcuuuguuauguuucaggugguuagacaguacuuuauuuagaguauuuagagauucgacaguucuggagcaccuuaaacauugagagucucacuggccaccauaguggagcgagaaaaggucuuugcuuugaguuugugguacagcuggccaucuguaucugcauucauggauauggaaccugcagauguggugggccaacuuuuucuaucacugauugguugaguaucuguaaauuuugcuaucugugggggguccucagaccaauccccuguggauagacagcaaauuguauguggauaccuuucagaguacuugcuuuggaguaaagcagauuauuggauuugaaucucagaucuacaauuuauuagcugaugugaccuuagaugaauuauuuaacuucuuuauaccugguauucucauuuauaaaaaugguuuaauagcaauauugcauugggguaauaugugaauuauauacauaaauacaucuaaaagcauuaacuuagugccuggcacagguaaguaaucaauaaagguaaguuauuacuauuauuauuacauuugcccuggggagcuagaacccauaggggaaggacuugaaaacagauaauaacauacaaaugauaauguaucagugaauaucaugggaagagcuauauacuuuggagggauaaaacaaccuccaucaaauccaaaacauguuuucauuacucccaaacccuauugcauagucucagguggguguccggauuauuccaggcuuucagucuaaacccaugaauuucuuggaauucagcacuugagauccaaaaguaaacaauagauugggcaauguccuagacagaaaaggcaguuuuugugggagggccuguuuuauacuuaagugauuacaaauuuuccuugacagcguguagugggagugacucucuuauagaauuccaagggaaauauucucuggacaguccuuauuggccuuuagaguaggccacuaccuacauacuuuaauuuuagagaaccugcuucagauuuuauuuuccccagaugucugaugucuaaaaucuuaacaggcuauuuauuuuugugauuuuuuuuuucuuccccagcuguaaggcaaaaaucccuuguggggagaggaaagucaagcuucaaugcuuugcuggcccacucuuacucuccuccucacuguaguguggcuacuaccugcauacccaacccuugaagcuagacuguuuugcuugggugucuguuuccucuggcuguaucugguuccuacucuuggucguaaauuccuccagggcaggacuuaugucaaaagacuuugcaguauauuaguucaccuuuacccuuacuaccucugcaaugauuggaauguccccuucaaaaauucaaguugaaacuugucauuguaauaguaugaagaggugggaccuuuaggaaaugauuaggucaugaaugaguuaauuccauuaucacaggaggguuaguuauuucgggagucaauuggguucacaugccucccccaccccuaccccaguaugaugcccuccaucauauuuugacacaacaauaaugcccucugucuuggacuucccagccuucagaacuacaagccaaacaaaucucuuucuuuauaaaucuaccagucuaugguauuugguuacagcagcagaaaauugaccaagacaaccccuuaccauaaaccugaguagcaaaugcaacaucaaaaguaggugaauaguaaguaguacauuauuguuguugauuucuaugaucugguuucucuucccacaauccugaacgguaagguguucucuaguauuucuucaggaccauaaauugugaaggagacugugauuguaguagacaauucuaggccuucuggaaccaucacuaaaggcaacauacgacugugcuaauuaaaaggaaaaaaaaaucccuaaacaaucucggaaacugaucuuuccuggccaacaaucucagauauagaagauuagauuuacuaaauuuagaaagaauccuuuuuuuuuucccccaaucacaaaaauuauccaguaaaaucuaugcucacuuccgguagaucugcaacaaggcacggucacaggucauuucaauaacuugcuaggcucuucaguacucagagucccuggaaauaagucauuagcaguggaaagcugcuuuuuagaauuuucuaaaacaaauccaugggguuuugaucugcuaaauucgaauguagacaacagcagccuuauuucccuacuuuuauaaucuaauuuauuuggcuguaucugugggcuuaagaguuuaguguucuugguaaauaacacguaaaaaaaaagucauuuuucauuucuacgaaccagccccaccccggcgcucccucgggauccucgcucuagccccgccuccguccagccuggcuccgccccguucgguagcgccgcgccuuggaggucuguggcuaacuugguccggaagaagcgaggcggaccuucuggcguuugaaaaacuuccggcgggaaccggaaggugcgguggcacucacggaaucucgggucuucugacgugccgggcgggaaggugagcugugcgugcgccuuggcggucgucuugcggguucucaagagcccggcguccgggcuccgggaucuuuggggccauuaaaaaaguucugagcgcucauuugggcaauaacaccccuuuuuuaaaagugagaaguucauuacauuuuacugucagcggucucucacaaccgaccacccgaaaaccccuccuagcuaccucgugacaccucuuuucagccaaauugcugcagcucuuagcgcauaacagacauagaaaagccugggcaagccuguuuuuuuuuuuuuugagacggagucucccucugucgcccaggcuggaguguaguggagcgaucucggcucacugcaagcuccgccucccggauucacgccauucgccugccucagccucccgaguagcuggggcuacaggcgcccgucaucacacccggcuaauuuaccuggauuguuuuuauaccuaaaauuaucggaggugggagaggaagcacccuuuucacggucaugguggcccugucugaaucaacugcaccuucuguagugcgccuggcauguaggaggcgcucaguaaccggaggaaaggaaugaauugggaacucucuaggcaacuuuccucgaaccccucacgugacaugucauuaacauauuguguguggaaugggaaacgagacuagucuugguguuccaggcacugggcuauaguccuuugccacauaucuuuccccuuugaguaaacuguuucaccucauugggucucagauuucugaauauagcgggacugucugaucucagguucuuucagcucuaguauuuuguuuuugugacuugggaaucugcuaacauucaagcacucuguugguccuucauggaaacuuguuuaggugcuucuuaagaaauuguccuccuuuguuugccuucuugaauuuaaauuuuuuuuuccaauuuuaauuuaguauuuguuagugugcacguccuuuugccccuuuguccugauuugcagucguccuaguuuaguggcucuucccuuaguaacaucauagcaaccuccaaauuauugguuuggaauaugcucaugugccuacagugauuaagauaguuugaaaggagggaaaaaucccaagucacugaagaauaggaauauucuuaugugccaucacuucuucagaaagagaugaaugcaauguguggcauugccuaagagugguggaaaauaaauguauauuccucuguagagaccauauuuguacauauuauguucauuuaauaguuguagggcaucuguuaagugcuagguucuaugauauggaagugaauaaggcacaugcauuuccuucuuucaugguauuuacucucuugacagcagugcaagcaauaaacaaguaaaauaaaaauaauuacagauuguguuauaaccuacuguauacaggaaguaaauaggcuccuuuuaaaauauaauugagaaaccuauuuuaggccugaaauguuaagaucuaagggaugcaaggagccagccaauugacaagcagggggaagaauacuccaggcagagaguaccugaggugggaaagaauguuaugacaagagcugaggagcuccagcaaguaguaaaggugguuagaaaggugagcagggcucaguccgacagggccuuuucaaaggccucauaaaaauguggcuugauucuaagugaaggauggggugggaaguaauucguuguuucuaaagcauauucuaaaugaucuugaguugauaaguggagaaugaguugcaggggcaagaguggaaguagggagggcaguuaagaggcgagugugguaguucaagugagggagguugaggacuaaaggcucacugaagaucguggagauucaagacauuuuggaggaggaucuuaugugacuuacuaauagucuggauaugugagaugaaagaaaaaaagauuuguaacauuuugacuuagcaaauggaacuuuggaggaugauaauguguucauuuucuugauuguagugauauguauacauaugucaaaacaucaaauuugcacacuuuaaacaugugcaguguauugcaugucaauuauaugucaaugaagcuguuaaagaauuuucuggccaggcgccauggcucacacuuguaaucccagcacuuugggaggccgaggcaggcagaucaccugaggccaggaguucgagaccagccuggccaacgugacgaaccccgucucuaucaaaaauagaaaaauuagcuggguguggugguacacgccuguaaucccaguuacuuaggaggcuaaggcaggagaauugcuugaaccugggaggcagaguuugcagugagcugagaucacuccaggcugggugacagagugagaccgucucaaaaaaaaaaaaaaauuuuuuuuuucaagguucuggcuuagcaaauaggugggugccacuuauugagaugggaaggacuggaauaggaacagguuuuagagcaagaaauggucaucaagaguuccauuguggauguguuaaguuaacugugagacaucuaaauaguuucagagacaggcaguuuauuauagaaaucugaauguuaaaggcacgguuugggauggagggauuaggauuguuaauaaguaggugacaucgguauguaaaaccguggagauggaugagguuuugguuaaucuaacaaguuuuaugacacaaaguaagaggauaugggaguaguggagauggagaaacaggccucaagaauauugguguuuaaacuggagaauacauacuccuggggguguaccugucguagguaguuuuaaagacauaauuuccaagucuucagcuuuuguauauauucuuucuaaaucugaucugcuugaaauuggcuuguguguucaugcagauucugcuuucccaccuuuccuuuuacauugauauuuuuaacauuugugaaaagaaauauuacaacucacucaucuuuccaugguauauugcuuucggggugccuuauaaagaggcaguuggaaauauuugauuuaggggagccuucuuuaaggauaaugguuaagcaaaaacauaagccugccaaggguuugccugucccuauuuuaaacacauuucuguuaaggcugaaguguggagauagaauuaguauaugguagucugugugggaauguucugaauucaggcauauuguagaauguggugguaggagugauuguaaggugaucuggguggguuguuugaugggaagcuuagcaccuucaaguuuuuacucuuggacugguuagauucuccagagaaaagccuucccauucuccucccuagagggcaguauuuuaggaauuuaguggcggaagacuaggguucucugccuuuagcauucagucuguaugguucccaugcccacagucuagacuguuucauuaauaccuucuccagagaauaaacuuacagucuuuuuccuggggcaguugccuaauagcaugaagugagguaggacacuuagagauauuccuuugucaguuuauacacagcccuaacccguuucaccuuuaauuccaaagguaucagcuacugcuucauaugaauuuuuuuuuuuuagaauacugcaggguaaauugguuugguucucauaugcucccacuacuggcuugggauuuuaauuuuuauguguugcaauuuguuagucuuuuugguuuuggaauuuugaggagucauauuuaggaaaaccuccauuuccccaucuccccucaauagugugaaaagaaucaccuuuauuucuuaguucuuuuauaguuuuaauuuguacauuuuaaacuauuaguuauuggggaauaaauuuuuguuaaugguguggagguaggaauuaaacuccuuuuuuucuucuagaggaauagcuaguugucucaauaccauuuauugaauaauccauuuuuacccugcccugauuuuaaaugccacccuugucauacacuaacuuccuccauucuuauuuuguugugguaagauacacauaauauaaaaaucacaauuaccuguucuuucaugaucaaugucuaaaaaauacuaauuugagaaaggaugaucuuuauaaccuaauaugccaaaaagagagugaagggaaagauggaagauuauccugucuacuuccugcagacugcuuuccuguuguucuuuugguucccucugagcacuauuuugcccaaucauuguguacuuacuggacugaguugagcuauagcugcugggagaacauauucccuuuugugacaaccccuuuaguauuuccaugagagauuauuuccucuucuaagcggauguuagaaccagaggcauuauaacauaugacugggucagaaacuuguuuaaaggguuccaaacaugucagagccuaguguaguccuuauaguuugaugguuuuaugguaauaauaucaggcagccacuuauaaaguccuuuauuaauuaauuuuaacagcuaauuaaucuuaacagcuaaaguaauuuuauuuacuuucccguauuaugugaugucucugguuauuugucuuaacuuuuuuuuacagcuuggccuucgaauuugguaaauaguuuuuagucacauagugauuaaucauuuuauuuaaguuuaaugaacuuuuauuauaagggaaugauuaucuuguuuuaagaauaaccuggcugcuuacucagucaaucagcaucauuuauuucauugccaacuuuguagagagaccucuacuuuauucauuaagaauauauagaauaggcugggcacagugacucaugccuguaaucccagcacuuugggaggccgaggugggcggaucaccugaggucgggaguucaagaccagccugaccaacauggagaaaugcugucucuacuaaaaaauacaaaauuagccggguguguuggcgcaugccuguaaucccagcuacuagggaggcugaggcaggagaaucgcuugaacccaggaggcggagguuguggugagccaauaucgugccauugcacuccagcuuggacagcaagagcgaaacucugucucaaaaaaaaaaaaaaaaaaagaauaggaaaaaaauguuucugucuuugagauauaguuuaauaaaggacuuuguaaggggcugccugauauuauuaccauaaaauaacacagaauacuuaagcacacaauucuuaaaaaaugaagcacacaguuuuccuacaggugucacccuguaggaguuuauauuuuuuaaaagauggcccauacucuuaagaguuuuaaaccauuggaaggcuguuagcuacucuuuuuuuuucuuuuuuuuuuuuuuuugagaccgagucucacucuguugcccaggcuggagugcaauuaugcaaucucagcucucugcaaccuccaccuccuggguucaagugauucuucugccucagccuccccaguagcugggauuucaggugcccacgaccacaccuggcuaauuuuucuauuuuuaguagagacugaguuucaccauguuggccaggcuggucucgaacuccugacuucaggugauccgcccuccuuggccucccaaagugcugggauuacaggcaugagccauggugcccagccagcuacucuuuuaauuggcagcuacauagcagaggaaacugauguuugggcuugugaauaaacaucauuguuuuuguuuuuuuccuaugaaauguuaguuuugaaugacccauuacuuguagccaaauaaagugauaagaauauucaaguguugcugauuuuauuuucuguuucuucuagaugucaucauugccaagaagagcgaaaguacagguccaggaugugguacugaaagaugaauuuucuucauucucugaguuguaagcauacugguuuaauauguggguaggggaaugaugaauauuuuaauaaggaguaaugcauucugucacuuucuaacuccuuaagugauguggguagaaaaaacuuuuuuuauucauucaugcaacaaguauuuguugaacucaugcuguguuccagguucugucuaguguugcuaauaaaguaucgaaaggagagagaaaguaaccaacuaaauauguaacauaauacuuacacuagaauauaagcuccaugagagcauagaguuuuauauauugcuuuagagcaggauuuuucaaccucugcacuacugacauugugugcaagacaauucuuuguugugggggcuaucuuuuuucuuguaggauuuuuagcagcauccuuggccucuacccacuggaugccaauagcuuccugcuaaguuauaacaauuaaaaaugucucuagacauugcuagauauccccaguugagaaucucugcuuuagagucauauuaggugcucugaagauauuuguuaaguaaaugacugguaauauuuauaguaauaaguacuauaaagaaaaauaaaacagggcaggggauagagagcauagugagugguugcagucggggggcauuuuggauagaguagucagaaaguuauugcggaagauguggcaagagaucuagaugagauuugggggugcagcuugcaaagaucuuggggauggguguuccaaauagagaaagcagcaagugcaaagacccugaggcaggaauaaguuugguguguucagggaacagcaagaagaccaguguggccagucuagagacaugaggcagagaguaguaagaaaugagauuguaaugaguaggaucuggaucuaauaggcuuagauccuucuccuuagucccuuuaacuucucuucucaccacccucuaaauguuggaaucccucaaggcuuaauucuaagcccuccccuuccuccaccccccuuccccucuccccucccuguuaguagcugaucuugucuuauggcucaauauaaaaaucucaauuuuauacaguaucuccaacuugaucuucccugguauuagaauuuuauuugaaguggguugggaggccacuggaagguuuuggguugggauguuacaugaccuggguuuauauuuguaaaauauucugguuucuugguggagaauagacuauagcgggcaaaacuggaaguaggggaaaugaguuaaggagauuauuguagaagcauaggauucuagaugugaaagugaugagaaauggucuaauuugggauauauuuugaagguagaguggacaggacauggugguggauuggauuugggguaugaaagaaugacagacauuuuggaaagacuggaagaggaacaggugugagagugguggaaucgggaauucaguuuuggacuugguaaguuugaugugauugcuggacauucaggugaaaguggauauacaagucuugagcucaagcggggaaggucgaguuggagauacuauauaaaauugagauucccagcugggugugguggcucacaccuguaaucccagugcuuugggaggccacgucgggcugaucacuugaggccaggaguccggagucuagccuggccaucauagugaaacccggcucuacuaaaaauacaaaaauuagccaggcaugguggcacgugccuauaaucccagcuaccugggggacugagacgugagaaucacuugaacccaggagguggagguugcagugaaccgagaucacgucacugcacuccagccugugugacagagggagacucugucucuaaauaaauaaauaaaaauaaaauauagauuccuguaucgagaaaauacaagauuaccuggcaagagagcauagagggcugaggacuaagccucgagggauuccagcauuuagagguuagggagaagaggagucaaaggggcuaaagagaagcugccaggaaguaguaugaaaaccaagggcugggguuccuguauguaagggauaugcucuaaggggugagugccagaugcuccugagagcucaagugauugggaaggagaguugacuagcugccuuagaacuauaucauguauaacacaacgguaucugugcuuguguuuuguucauaauaacuaaagggccuuuaaucuuggugauauuccuuugugaaauaggguuagucaguaauccugguugauaggugaugagacuaaggagggaagaagucauccugcucaguuugaugauaguaugaggaguggaacccuaguuuucuauuucauugguuuucuaauuauaguuucuuucaguuccacugcuguuauguuauucugauuauuccuguuuuuuguuugauuguuuguuuuuccuuaccaggcuuagugguaccucugaagagaacaccaguaguuugaccuaucauaauuauucucuucuagagcauaauuuagcuaagaagucauccagucagguuuuugcccccagcaagaacuuaacauuaaaaaacccagacuucccuauucacucaucucaguaaaggaagucucacuaauauugaccuuuuacauuagaguagaaauggaauuaacuggguuggcaggagcaugaugguccuuuaaaagaguucccauggcugcuuuuucucugcucuugcugugaguuugauucuucguuguuagaaaaguacuauagucgcaccugauccaaucuaaucaggaaagaaauccauucugugaaaggaaaaaaggguuaauuaaagcaguuggaagggucuuggugcuggcuuuuaauguaauuuaguguguuuccuagagccauuucucaauccuuucauugauuugaauaacuuaauacaauuuaaaugaauuugauuaguaguugggaacuuauuuaagugcuuuucacuguuaaaauugaaaagcucacauugacuauaguuugacaugacccaguaaauuacuuaagguaauaaaugauuuucuaugucuugaaugaauguguguauguguuugucaguuaggugagaagagaauggagagacagagcugugauuuacagcauacugcgguauuuuuauacugguccgucaucaacucuguugguucaauucuuagcaauaacuguucacagccuguacucaaucacuccauuuuauauuaaacaccuccuacuuuaucauuuuuucaagaaucuugcaucucuuuuuuaccuuugacauuugcuuuuauuuuuccuggagauuauucuguugauuuacuucuagaucaucugccucugaagaagaugacaaggaagauagugccugggagccccaaaagaaaguucccagaagccguaaacagcccccucccaaggaauccaaaccaaagaggaugccucgggugaagaagaaugccccacagaucagugauggcucagaagucguuguuguuaaggaggagcugguaggugcuacagcuggauagagggaacucuguagugucuuccugauuggugauguuauuuucuuauucuacagaguaggacaaggcauguaaaugacaaaaacugccagcaauggcauccccuacccugggucuuaauuuuugggucuguacuguguuucuuugucuauucccuuuucccucuccuaggaguuggucugggugugguagugcugguaaugaugguggcauuagcaaauaguugagugcuuaccauuagccaggcaaugugcucaacauuucauuuaaaugaucuuaaucuuuauaacaaccauugaggcaagugcuuuuaugcugauuuuauagaugagaaagcugaagaaagauguuaagugacuugcucacgguguacagauaguaagugauggaacuggguuucuaaguuaggaacaugauuuugucaacauuuugggaacagauauaucucucuuggguguuuuuacaucaguuguguucacaagagagauaaauacaaccagagugcugguuuaauauuuaauaguuuaaaauaauaaucuuaaggacuugaaauucuuauggccagcauuucguucuccuuggagccuaaucugaauagggaauuaaguaguaaucagaaauuuacuugaugagcauggacucagaauaggaugaugagauaaauccauucguuugaguuuauugaauguccacuguggucuaggcauuaugcuugucacaaucacaauugaauguuuuaauagcuugaagcuaagacaguggcugacaacacccuuuaugauugacacuuucuuuagauaugucaauucauuugauuagguuaucaacucuuuuaggccugggaguuauuuuaucuuuaugucucugcucugauccauucuauuuugggcaaaaaauuuaauacucagagggcucucuaauguucauuauuuucaaguucagaugguggugguggcagguuggcauucagguggaggugcucuuuauuguaguucuuaauauuuuuaauagugauucuggaaaaaauacuugauaaaagagaagauagaauuuugacuaaaauuuaguuugggaauuguucauguuugugccaucugcaucauuuagguaacggagaacagaccagcuuagggguagggucuuuaucuuauuuacacuauacccagugccgagaugggugccaagucucauuucuucacacuugagcugucacuuggauuggggggcaguggcagugcagaguguagucccuagacaccugugugggcugcugugcggacucuuguuaaagaaaaaugccugacauuagccugcuaucauucuguguucuauccucuacucuucagcagaaauugguggcauguguagccuguugaguuguaugagugaaugaguguuacuuuucugucugcuaagugguugacuuugauagcaaguuuuaaucuugguuuucuggcauguguagaccuauccuuuacucauuuuuaaaaauuaaacugcuuauuucuaaauaguugacaugcaaugggaagaaauaauagaagaauuccauguacucuuuauccauuuuuucccgaaugguagcaucuugcaaaucuauaguaagaugucacaaccgagauacauugauaaaauccacugaucuuauuuagauuucuccaguuuuacuuguauucauucauguguauguauauguauguacuugguucugugcaauuuuaucgcacauguagguuuguguaucuaccaugacagaaaaguuccaucaccacaaagaugccuaguguugcccuuuuauagccacacccaccuccccccaucaucucugacccuugccaaccucuaaucucuucaggaauguuauauaaauguauucauauaguauguaacuuugagauuggcuuuuuuucccacucaacauaauuuacuugagauucuuccaaguuauuguguguaucaauaauuuguucacuuuuauuugugaguaauagucccaggaaauugcuuuuuaucuucuaauucucauauguucucuuugugguuugauagaauagcucuguggcuauugcugauacugcuuuagaagacagaaaaaauaaauuggauacuguacagacucugaaaacagccaagacaaaacagaaaugugcagcgcagccacauacaguucgaaggacuaaaaagcugaaaguugaagaagaaaccagcaaagccagcaacuuagagggugagaguaauaguucagagacaccauccacaagcacuguguggggagguacaugcaagaaggaagagaaugacgaugacuuuacauuuggucaguccgcuuuaaagaaaaucaagacugagacauauccucaggggcagccugucaaguuuccagcaaaugccaauaguacuaaagaggagguggaaaugaauugggacaugguacagguaugugcagccuuuuucugucacuuuaguuguuuugagugcuuucuuuuugacuagcauagggguuguacugucuaagggaagggcuggggguuuucaauucucucuucaguuuugccagugauuucuggaggcuuuccuacuuguaacuuucuuggguacacuguuuuguguuguagcuaaucaucaguucuucagcuaagauguguggccucucuuggccuuugcuaugguguuuuagugaacauaaacuauauagacagauuguaccaacugguugggcccccacagguucauuguuaaguuuuugcuuugaacuuggacuguauuuuccuauaaaagcaguguaggugauuaggucacuggcuguucauacaucuauuuaacccuuaguauaauguuguaauguacuacaacaaggccuagcgauuuuugaaaggaaauucuguaagaauuccaacuugagaugccagaauuauaugucuuacuacaggggaaaucagauuucucccaguuuuuuuggcuggcuuuggggacaguauuggagacccgaagaguagcuagugagcuuuugucugucccagcacauucugggaccauuuuagacuuaauuaugguagugccucucaggguaggugggggugacuucccucccuguuaucugucccaugugauucuauuguguacucuuucccuugcuaugauuguggcuguagagcugagggccucugcuggauccugauuccacuucucaaucugggacugccugugugucacaaaugucuuuguacccaugcugccuuuucuauuaccucuuaguaaaacguaauuuuuuuuuuuuuuugagacggugucuugcucugucgcccaggcuagaaugcaguggugcucacugucagcuccaccucccggguucaugccauucuccugccucagccucccgaguagcugggacuacaggcaccugccaccacgcccggcuaauuuuucguauuuuuaguagagacaggguuucaccguguuagccaggauggucucgaucugccugccucgugaucugcccgccucggccucccaaagugcugggauuacaggcaugagccaccacgccuggccugucacugguaauuuuuaaucaugauuuuucuucucuguggugcacuaaggaauagaauguugcuuuacagcuuuuccucuuaccuuguuccugaaugaauaguccaagguaucuuggaaaaacagaguauaauuaggcuccuuucuaugccuucuuuuucuuuguucauuuauaccuagaaggcaguguuuuaaagugugguccauggacuaccugcaucagauucacccugaagccuuucuuaaaguucuugguuccagaccaggccuacagaggcagguggacauguaccacuucccuucucuuuuccuuuucuaacgcuuuuuaagguuauuuccauuguugacauagauccaccucugguaguuggcagugugcaggaggaaguuaagaaguuuuagacugugaagucucuggucuuugagacuugguaauaaguuauucguaguaaagagcuacuuauucuaugacucugcuucccacccucuguuacagggaaagagauguagaaaauggcccugccuuaaccuuuugucucuagguuacaaguauauaagcucuuuauaaugagcuuaaguagaaaagaguuuuucaccaaggacauagggaccuuucaaagaacaaaagggacagaauguggucaagucucccaaaggacuugaaccagaaauuggaaacugugaggacucagagaaggugcuguuaguuuucucucuaucuggugucuuauaaucaccaauuucugcugcuucucuguuugaguuauuauuuucucagcagauaagauuuucuugcuucuuuacagaggauagaaaaugacagcucccuaguuuauuugccauuaguuuuauuaguuacguagacuaaccaguugcuucuguauugcaguuccacauuuuuuuuuuuuuuugugagacagagucucacucugucgcccaggcugaaguacaguggcgcgaucuuggcucacugcaaccucugccucccagguucaagcgauucuccugccucagccuccugaguagcuggaaccacaggcaugugccaccacgccuggcuaauuuuuuguauuuuuaguagagacacgguuucaccauguuagccagaauggucuccgucuucugaccuggugauccgcccaccucuuucucccaaagugcagggauuacagguguaagccaccgcacucagccuccaguuccaaauuuuaagaagaaagucugauuggcugaauuugggucagguauccaucucugguccagugccuggggugcugaggccucacuguauuuuagaaauauggcugccagggcugugugugugugugugugugugugugugugaggguuguggguguggguguguguguuaggguuguggguguguguguguguguguguguuaggguuguggggggguguucucugagaaaaggagggcauuucugggccagaagaugucuacuucaggguucagcuuuagaauguaaauuuauaaaucuaggugaugauuagccacuguugacaaauacuuagguuucuuuuaccauaauaccuuaagguguugguuuacagaucuuuaauugacaagggaucauaauacuuaccauuuauuuauagaugacuuguuaugagcucggcucuguacuaggcacuuuagauuuguuuacuacauuaucaugauggauuaguagaugcaauggguuaaccaucaaaaaauccuuuauggauaggaguaaaauagacagaaaacaguuuuguuuguucagaaaaaccaucuuaaaguuaaaacuuacugagaaauuacugagaauugacucaaaguauuuguagaauuuaguuucuaguuugcaucauuucucuaauagguauaacugaaggugauuucagagcuuugagagaagaaaauuuguucugcaauccguuaaccuagacuuuuaauguuugguuaggaaugaauaucuggguucacuaaugcguucuguaaugucacuaaaauagcagcuaaacaaagccuuuuggaaaauacauuccaagagaaaggcaagauuacuugcugaauagaaugaggagggacaaguguaugaugagcgauaggugcccagcugccagaaggugagugacaaaggaaaaguaaagaaagaaaaguuuuauuuguaagcuaguagcaguaauguccuuuguuguguugugggaauagugacuuggaagcaaguugucucauuuaaaggcacaagaacuauuuuauggccuuuugcccucuuagaaaauauuuugaaaauuauaggcaugcuagauuuuccuuuuaauuccaagcaauuuuuuuuuccucuuccuuuuuugaagugaauguugacagcugaaugccuauucucugagaaucugggcacuccuugccugugaauugggaagugguuuuugggacgcugccaccuuugcugagcaaucugauggcaauuauuaagcucagcauuuuccugguggguuuagggaaauugccugggaaacuauuacaugugaauuuuacauguuuggguucuuuuuauuuaaccaguugcaauuauccuuccuuaauuuuaacuugaauuuuacagacaauuauugugguauauguggauuuccuuuccuauacuuuuaaaauuucuccguaaacaggagaaacuuugucagagagaaaguaauuuugucuuaaaacuguauuccugcuuguaaacaugguugagaacagggguagauguuggaaaaagagggaacugacaagaaugagagucaaguaauaccaagccagaaaaucagaaaaguccugaacauuuggauaaggaucagacucaacaaaauaccuguaacaugcauauuaucugccacaaaauguauguccaaauucuuugggggaaauccugaauaguuaucuaguuagcaaggaaugguugugaaacuuaauuguauggaaauuauuaaguauuacuaguugaacauguggaaaugucauuuauauauccuuuauuuuguguacuauuccccauggccuuggccacaaugauaacuugguccucuguuuuuuuccguucaagguguauuucucaacucugaaaacuacagauuuuuuucaggaacaucacugucuuguuuggagaggcagaacuauauagucaacacuugauuuaguuuuaggcuugucaaaaggacaaaauuacaaguuuaguuuaaagaucucuguuggguuuaugauucuagaaucaagcaacacuucauuucauaaaauaggauaaguguucuaaugaauuaagcagggggguugguuuuauagauaggacuaaugaaagcagaaacaacagaaaguggauugcuuuccuuguaaaguggagagagggagacagaaaaauagaaaaauaacagauaaaaugaaguuacuucagucuuuuuguauaaggauuaaaguagagggaacuuuauuaucaugccuauugaagauugaaacuggccuguuugauaaauuggcuguuaucauucuuuagauuucuuggaaagucagauaacaacuuuguuuuaguuuggugacuaaaauuuuagccagggugaguucauuuugauuuuuagucuauggaacauagggucuaucggggccuacugcaggagcuucauccaaaacaauggcuuccuauaauguuuuaacagacauuauacaugaauguauuuuguuucuauuuccugauccgggguuggggaucaccaggucuuuugacagaagcaaccuacuccuuuucagcccuuucucccaaacugcaaaugugugauugcgaccagaaacuaguuuuuguuaaaguuauuuugcagauauguuuuggauaccaugaacuauaagaauuugaagaagugaccagcuacagacaauuuuugggaaaauuaaacugcuccaaaggugguuguuguccaguuucuuucgggaguggugaguguaggggaguugagcagccauguguaauaucuuaguaaaguuugcuaaacagggagaaaaggcaaacaaaaccuuuuuuauuagcuguuuucccuuuguugcaagagauuguguggaauuguguggaauuaugugcgugaagaaagccaugggaugacaaaauuggggaaagaagugagacaaaaaguggucaacauuucugaguuguguaucucagugcaauucuguguauaaagguggaaccacuuauuagguuuaaccuauuuguccaggagaaauuaaauaagagaaauugguacuuuuuguuaauauaauuuaguugguaguguuuauuauggucuuuuuaaaaaacaaccuuuuuuugaaguauaacauacagaauauuguacauaaauguacagcucagagauguucaaaaguguaaccaugcaacaagcuuccagaacauuaccaacaucucaaaaucccccuuuauacuauuuuccaauuccuccuucugucucauacaaccacucuucugauuucuaacagcacugguuuuuccuuuugcaaucuguaaggaaacuuguguguguaguagaauaagugauacagugaaauaacuagguaaggguaaggagaacagcagaaaucaacagcuuuucagaggggagguggccagucgcugguuugggagugauuuagaauagaaaauucucucaauuucacucauuagagagucauuuaacuuagauguucuuuuaaaaugcagaugcugccuggaugauuaaggcuauaguuuauuugguugaugccaagauguuuucuuuuuaacugaggaaauagcaauuuccuuuuggaggaguaaaucucaggacacuuugggaaaaagcauuuucuuggagguuuuagagagggcauuuuaagccaucagaucucaugagacucauuauccugagaccagcauaggggaaaccgccccccauaauucauugcuuccacuugguugugcccuugacacaugaggauuaugccugaggaaucaucuugcuuggcauauaaauugaauuuuugaagagguuauauagcuuguggaauuuugggcaguuuacuuuuucggcccucaguuuuugcauuuauaaaaugggaacaauaaaguaccuuucucauauaguuuaaaugaguuuauauugacuguguaagaguguuuggaacguaauagacucuauagaggaauuagccuaaaacaacagucaaaauaaguaccucugucuuagaaguacaaaaaauucucgagagugccuuuuuuccccuuuacucucauuccuaucugccaguuaauuuuuaaaaaauauaaaaguaauaaaugugaaucgcuuauaagugaaaacuaugguaguucuuugcccuaccccuucccaacucuaagacuuguucucuguuuuuagcucuuuuaguuguuucuuuguuguuugccuaauuuuucucaaacacacguuauuaaacccccaccccagaguuucugauugaguggcuuuugggugggacccaagaauuugcauuuuuaacaaguucucagaugaugcuuaugcugcugguuuggggaccacacauuguaaaccacugcuguaguucauagaucucaucaacucuugaaaaggggguugacucaacaggugagaccaaacaaugaguggauccauuguugaauggcuuuguuaccaguggaagguauccaaguuacugaugucaaaucuguaagggucugcagcaaccucaguuuuugccuccuccuccaaagaauucgacugaggggcauaaagcaagagagaccaaggcaaacuucagaguaggaguggaaguuuguuuaaaaggcuuuagaacaggaaagaaaggaaaggaaaguaugcucggaagagacccaagcaggcacugaggucaagugugguguuuaacuuugauccuaggacuuuauaggccagccccuuucccgugauucuucccuuagagugggcugcccgcaugugcagugcccuccuuaugcuugggaggugaguacaugguguguguuuaggaaguuguacauagcccaucugaggcuuucuuugcuucuuugguggugugucccuauguauuagucuguuuucaugcugcugacaaagacauacccaagacugggaagaaaaagugguuuaauuggacuuacaguuccacauggcuggggaggccucagaaucauggugggaggcaaaaggcacuucuuacauggcagcagcaagagaaaaugaggaagaagcaaaaguggaaaccccugauaaacccaucagaucuggugagacuuauucacuaucgcaagaauagcacaggagagacuggcccccaugauucaauuaccucccccugggucccuccuacaacacgugggaauucugggagauacaauucaaguugagauuugggugggcacauagccaaaccauaucacacuggaaggucauacuccaccauuuugucucucagugugcauguccgggaaguugcuucucccuggugucugcauucaguuaacacuuuaguguaauaaguauggaccaucaggaaauggccucuuccuggggcuggcugccaauuuaucacuuuuagagaggcaaugugauaauugcugaaccaucacccaacauuccuaguuggggaggggggcucuccugccaugcucaugccugucuaacuaccuguaacagcuucauauugaguauaggauaucaaguucaaacucuauagaauucaccauguagccucauccaccuuuccauuucucaccugaucuucacacuccuuguacauguaacuguccaauggguucauuuugcccacugccuacacagagccuauuuaucaagacaagagaauugcaguagagaaagaguaauucacacagacccagcuguguggaaaaccagaguuuuaguauuacucaaaucagucucccugaaaacucgggaauuggaguuuuuaagauaauuugguagguagggggccagugagucaggagugcugauugguuaggucagagaugaaaucauagggagucaaagcuguccucuucugcugagucaguuccugggugggggccauaagaccagaugaacuagguuaucaaucugcauguugccaucugauccauguagugcagggucugcaaaauaucuuaagcacugaucuuagguuuuacaaugggaauguuauccccaggagcaauuuggggauuuuuaaaauccugaagccuccagcugcaugacuccuguauuuguccauuuucacacugcuaugaagacauaccugagacuggguaauuuauaaaggaaagaggguuuuuuuuuuuuuugagaguuucacucuuguugcccaggcuggagugcaguguugcaaucucggcucacugcaaccucugccucccggguucaagugauuccccugucucagucuccugaguagcugggauuacaggcgcauaccaccaugcccagcuaauuuuuguauuuuuaguagagacggaguuucaucauauugaucaggccagucucgaacuccugaccucagguuauccgcacgccucggccucccaaagugcugggauuacaggcaugagccaccgcaccuggccagggaagagguuuaauugacuuacaguacagcauggcuggggagaccucaggagacuuacaaucauggcggaaggggaagcaaacacauccuucuucacaugguggcagggaaaagugcaaguagaggaaaugccagacacuuacaaaaccauuauaucuuguaagacucacucauuaucacaagaacagcauggggaaaaccaccccuuugauucaauuaccuccaccagguucugcccuugacacguggggauuauggggauuacaaaucaaggugagauuuggguggggacacagagccaaaccauaucaacuccugaaccauaauuucuacucuuguggcuaauuuguuaguccuacaaaggagucuaguccccaggcaggaaggggauuuguuuugcaaaaaugcuguuauugucuucguuucaaagcuaaacuguaaacugaguuccucccagaguuaguucagcguacgccuaggaauggacaaggacagcuuggagguuaggaacaagauggaauugguuaggucagaucucuuucgcuguaauaauuuucucaguuaugauuuuugcaaaggcaguuuuauauauuucagcauuacugaacuuuuagcgauuuaaaacaugugcauugguuucucaucagaggcuuuugauguuauucucuguuccuggaauuccugccucccuguuuagcugccuggaaauaccuucauucucuuuuugcuuuuccauugcugcagaauucgauguuuccaccuuuccuguggucuuaaaacaauguauauacacuucugucagaguaugaaccauacuguauguugacuauuuacaugucugucugcuuuuguuagcuuguuagcuccuugagaagaggcacuugauuuuuuuuacaucuugauuaucauuggcuuaguaugguuauuggcauauaauaugagcuaaaauaaauguucaacugaaucaauauagaaaacauuuggugauuuggaguccccagaaugaagacugcuuguaugugguuuuguuagccuuaauuucaaggaucaaauuugcauaagcagcacuguacacucccauaacauacaugaugccauauggauuuguuaggaccuaguaccauccagugucuggagucuuagcugucuuagguuucuuuuauucaacaauaacugagcuguuggguagugggagcccauggauugcucuaacaaucacacaguuccaaaaugaugagcauuccugucguuuccaccugucaucucugucuuucagaaucuugccuaucuuucaagggucaaucaaaaugcuauuccuucagcaggccucccuugguuaccucagggagaucuuuucuuuaaaaacauggugccacuuauugccuggcacaugcuguuuuauuuuuacuuauuuggauuaauauuuuaucuuccccucuagauugcuaacuucuucaugagcagccucaugaaggccucucaagagggaagugugguugacccuuaccuguagguagcuaagagucauuggagcuuaaguucaaacaaaagaagaaaauaaggggcuugauuauauuuguauuuuagaaauaucuguaguaaugcagaugggaugggugggaggcauagacaacaauaaauaccuacuauggguucagaucaaagaugcuauuaguggaaacagagcuugaggggggagggaacagacauuuuauaaguucuguuugccuccuuggugacagaguagauggaugugauagagaauauacagugaugcuuaggccauugauuagaaugcuuuugauuacaaugaaagaaaacugucucaaacuaguuuaagcaauaaaggagauuuauugaccuauguaacaggaaauuuuuggucaguucacugaaacaaucuacuauucucuuagcaccaccauccucauaacaauaaaauggcuacaacuuugaauuucuaccucuacaaacuguauuucuucagaggaaguuccagcccaaaucuuaacuuuaugcugauugggcuaaucucucuggccagagcaaugcagcacucaggcuguuaauucugaaaacagcugguuccuugagccucaugcuguagagcuggaguuagggucaagugcugucaagccacauagcugcuauauaauggagagagguggccacaguauuaugggagauaaccacaguaucuccuaagguuucugugguagaugacaugauguggacuggaacaggaaacaggaaaagguacagguuugagagagaaaauauaaaugaguugauuuugugagggucagggaagauaacaagcaacaggaguauuucuaaagagggaggagccucaugaaggccucuuaagagcaaaguaacuggccuuguucuaggaacugagagaaggcuauugggcuggcaucuaaugaucuagggaaagacuggauaagaugagguuggagagaggcugcuuucuuuugggucaugguaaggaguuuggauuccaaaugcaacgggaaaucagugacaggucaacauccaguauacauuuugaaaauaacauucuuguugcuuuguguauacuggaauagaugagacagaguggaugcagggagaacagguaaaagcuauuucauuaguucaggcuagaacuagacugggguguggggcagaagaaaugaagaacagugacagaguaaggaaauauuuugcaguucaaguugacugguucuuaagauggauuggauuuaagaguugaaggaguuggaagaguuagacucaguuuucuggguugaauugccauuugaauagcauaauauggguaaaaguagaggagaaauaaguuugagaagaagauaacuuuggaaaugcaagguuugagaugcccauuagauuuccaagagaaugugucaaaauaguuagcuaaaugagucuagagcucaugugaaagagagucagggauagaaaugugaaauuggcuuucuugucagaauuggcauuaauccaucagaaugggugauaagauguagaccucaggauuuaaugugccccgagaaugagauauccucuauagucucuggaguuuagccauuuauuucauauguagucuugaaauucagucuguuauguaucuggacuugauuuugauaaucaguugauuacgauaauucuuuaauaaauuuucccuguuuuuuaccccaguuucugucagaucuugggcauucaggguugaaauaauaauaaaacguacuccuuuuguucuuuacuuugaaagagcugcuuaggguuugggaagcuacuaaaauuggauuuuauucuuucucuuuuccgggcugacuuuuguaaacuuuucuguuuaacuguacauuuugcuaaaaccuguagacuuaaaaauaauuaaauauuuaaauaauuaaucaucuuuuaauauuauuguaaauauuaguauuuuaauauuauaauuaacaucaauuuuaauauguauuuaaaauaauuucaaauaucuuaauauuuauaauauuuuaaaauaauuaaauauuuaaaaauuuuuaaauauuuuaauauuuauaauuuaaaauaauuaaauauuuaaaaaauuuuaaauauuuuaauaauuauauuuuaaaauaauuaaauauuuaaaaaauuuuaaauauuuuaauauuuauaauuuaaaauaauuaaauauuuaaaaauuuuuaaauauuuuaauauuuauaauuuaaaauaauuaaauauuuaaaauaauuuuaaauauuuuaauauuuauaauuuaaaauaauuuuaaauauuuuaauauuuauaauuuaaaauaauuaaauauuuaaaauaccaaugauuuuaaauaaauaauauuuuaaaacaaauauuuuaaaaaauaauuaauugccuguuucggugguucaugccaguaaucccagcacuuucggaggcugagacgggaggauugcuugggcccagguauuugagaccagcuugggcaauguaguaagaccucauuuccacuaauaaaaaaaaaaaaauuagccaggugugauggcguggcuuguagucccagcuauuuggaggcugaggcuggaggaucaguugagccugcgaguucaagguugcauugaaucacaguugugccacugcacuccagccugggugaaagagcgagacacugucucaaaaaaauaaaaaaauuaaaaaguaauuaauuagcuugaagauguuguauuugugcaugauacaaaauucaaaagauauagaagggucuuccaacucuaacccucacccaaccaauuaccuuuuuauuuccagaucuugugaaucauuucauauuaguucauauagagcugccucagauucuuaaaugcuugcaugguauuuaguaugggcauaacauauuuuccaguuccuccauuguaaacuuagguuuuugcucaccuuuacucugcuagggacaguucuucaaaaaaaaauuauuauaaauaauauuuucuagaggcauguauauguuaugauaaauuuccaguaguagaauugcugcugggccaaaguuuguuuaugcauuguaaauuuucauagauauugccaaauugcucacuagcaaugacuaaaaauggcuuuccuuugcucucaugcugacaaagugaguuaccaacuccuugcuuugcuaccaauaugagagaugaaaaguauaucauugcaucauuaaaaagugcccucauugaacacuggaauuugaaugauacagugguuuggauuagauuuuauugaauuugugaaauggcuauuuuaccauuaugauugucaauggauacauguauuuuauauggcuuucuuuuuuuuaaaaaacuauagcaaguaguuucuaagucacuggagaacauuauuugauacuauguuuuaaauuauacaugauauagauguuuaauuuucagcauuuuaaaucacuaaguaucuuuaauuugcagguuuuaucugagagaacuaauauugaaccuuggguuugugccaacaucauucgucucuuuaaugaugauaacacaauucccuucauuauacguuauagaaaagagcucauuaauaaccuugaugcugauuccuugagagaaguucagcaaacccuagaagagcuacgguaagaaaccuaaaaaagaauaagccuaguguaaggggaaaaggccaaugaggaacagugagaaagugaaugacgguauauuugacaauuucaacauuuuguuuccuugaauuauuguaaucuggauauaguccucuuuauuuagcgaguguauggagucccucugcugguguguuuaugcauagcuugagcauguauuagcaaaaaggucauuugcaguaaaagugugugccucagaguuugacugucaucuucuuucauagaaaagguugggcauaauggcaaaauuaggacugccagcaggaaacucagaaaguacauuuuauucuaacucuuuuaaccacucacauaaaucuguccuuuuaauuucauaaaguuccuaaguggagaguucuuuggcaguauagaguuugguaggaaauauguauauuuccuuuucccaucuuuuuuuuuuuucggagacagagucuugcucugucgccugggcugaagugcaguggugcaaucucagcucacuacaaucucuguaucccaggcucaggcgacucuccugccucagccucccgaguagcugagauuacaggaaugcgccaccacgccccacuaauuuuguauuuuuaguagagacaggguuuugccauguuggccaggcugauuuugaacucuuggccuuaagugauccacccgccuuggccucccaaagugcugagaugauaggcuugagccaccaugcccagccuuuuucccauacuuuuaaugguuaugguaauuuaacaauaguggauuguaaguuuuguaugguuacagaauggaaaguaccuuuuuaaaaaaauuaugccucuggacucacugcuaauaacugagaaauauguguacaaagacuacaagacugaccauauuauucgauaggguuuauuaaaacacuucacugcuuaugcauuuauugcaugucucccaugggcacuguguuaauguguacauucuucaaguguacaaaaaagaucugauuaaaauuggauuaucauucuacuaugaagccauuuuaaaaguauuaaggguaauuuuuauaacaagcuugacaagcuuucuguuauuuugggggaacuugcaucucacuuuucuaccucuugacguucuuuuagugucaggagaauuaaagugcuaauauguggaaaguuauacuucauugagaggcagaaucaauuugccaauguaaaaauauaaaugacuaaaucaaauagucucagaugcaaauguuccagagccaggcuaggauaaucaagcauggggaauaagaauuggagauuacaaacccugucuaagaggggcaacccuugcucgucuccaguagauuacugucaugcaggguugucugcccaguuugcugguucuuccuguuucugaaaagaagcugguaauuugaguuuuuacguaacaaauuucuaggccaaacaaaaccacucuugaccacaccuagaaggccagcaguuugcaaauucugaaguaagcuuucuguuugguugaaggcaagguaauuaagaaagucugaggguuuuggaucugaaauuggagaaagccucacaagcaagaaaagcuugcuuaaaaaauuaaaggguagucuaacaauauuugguuguaugggagacaaauaggagcuguauaucaagaauauuauuauuuucuuuuucuuuaaaaaacccuucuauugcaaaagaauuccauucucuggguuucuaugaauaggggaauacauugaauauuaguagaggagugaauauuccuugaaguaagugggggcauugacuggaacuuaagagaucuuuuucuauaauacagaaauuucuuucugguaaugagauaugaucuuuauuuuuucuugagcucagcauuuucuauaacuagagcauugauuuucaauuuguuaauugcuaccccuacaugagaaguaaaaccaauuuaauaagucauaccacuuaaaaaaugaaauagugaauagaaaauacaagaguacauuuaugugguaaaggcaaauauuguuucaugaaauguuucaauuauguagcaucuauauguauguauacuggguugcaacguaaaacauuuuuaaauucacuguugaaaagugaauuaaagaguaugauucuggauaguaagaaaaguuuucuguauuuuucucuaaagauaauucucuucuuccuuauaugcaggcuaauaggacaaaaggaauuggcuuuuuguuaaaaugaccugguaggcuuuagcccuugaaaacagucuugggcuaccaugacuauagaagacauacagguuguaaucuaaguacugcauauucuucuuuuuaauuuauauucuucucuuuaauuuauagucuucugccuuuaguuuuuuuuuuuuaauuuacaaguagauuuaauuuucuuuuccaucgaucauuuugaauaaaucauauuaucaucucuaacuuuugcccaucauuuuagcaauaccauuauuaggcagauucuauaaauaggagguaauacaauaggaugagaagcauuaacuguaacaacaggauuguauauucacagugaaaaccuguuguaaagugggggaacuacugugcccacccuuccuuuugucguuaguuguuuagugaucccuguaaauugauuccuggaaucaacuuuucuacauggaauccugguucuuuuuaguggggaaugguauuuggaaaccaauuaugggugcuaggugugcccauccugagcagugauacuccaguagcaaugagcauaucuaguaccuauaccuugguuuuuaaguaucauucuucugauuccagggcuggggcagggaaacuagaagauaagccugaaauaucauaugccagagaauaaggaagugcucgcagaaugacagauacaugucaaaaggacacagaagcuagcuugaagggguuacuuuuggccaaaucuggaaaaauuugaacauuaagauaaaugauagcaauggauuguagcacuaaguaaaauaaaaaaccauuaaaucuauagugauauaaauaaaucagugaauaaauucaaaguuuaaugaggaaugggauaauuauauagucucaaaguaccucuccacaaaauacuuauaauuacaagaggaauaaagaguaccugugucuuggagaaacccacagauacuaccuuaaucaaaugaucaaaguuaauuaguaaugagacaaaucaaaaucauuugucaccuaauaacguguaguaagaacacaguaugacuucuaugauauuucugccaaagaugcuccaucgguauuuaauugugaggaaacaucagagaaacccaagcugcaggacauucuacaaaauaacuguccaguagcguucaaaaacaucaaggccuuaucaaggagaagaaaaucaaggagagacuaaaauauuguuuuagcuugaaggagacuguaguugcaugccaacuacauguaacccauaauucuuaacugaauccacuauaaaggauauuauugggacaguugguaaaaccugaaugagcucugcauuagaugguaguaauauauuaguguuaauuaccugauaaugaugguuauuuugugguuauguagaagauuuguauuuguaggaaaucacacuaaaguguuggagugcagggauguuaacuuauucucaaacaguucagagacaauaaaguuccuuuuacuuuaccugcaacuuuucuguaaguuugagguagcuuugaaaagaaaguuuugacauacaguuuugguauauuacaaaaguuucucuuuucagggcuguugcaaagaaaguucauaguacaauccagaaaauuaagaaggaagggaagaugucugagugcuuguuaaaagccaugcugaauuguaaaacuuuugaagaacuagaacacgugguaaggaauccuuuuuaucuuuuaauguaauaccugaauauauugcaauuugggucuucuuaugauuaaagaacaccaagaaauaaaaagcuaacgucauuagccaccauuauuuaaugcaacaaaauauuuauucuuuauucaauaaauauuuauagaguguuuuuuuugugcuaggcacuuggguuuacaaagaugaauaaauacauagucuuugucucaaggaauuuccagucaaguagggaaggacaguagauuauacaaacgugaagcuuaucagagagggcugaacuagagauccagauguggaugucuucagccuguaguugguacgugaaaccaugagaauggaagaacucaagaaguguuuguuagcaggucaggauugaccacuggagguuaccaccuuuugaaguguggauggaggaugugagagcauaaggagguaggaaaaaaauagagaaguaugaggagaaucaggagaugauggugcccuggaacagcagggaagagaguuuuagauggaggucaugaucagcaguuauguguagcagagaaguuuggcagaaugaagacugaaaaaaauauauauauuugguaauuaggagaucaucauggauuuuugugauaucauuuccugcaagguaugugagaagagaagccagaugaugguggguuggagagugaguggauuaagaaguagaagaauuggcugggcgcgguggcucaagccuguaaucccagcacuuugggaggccgaggugggcugaucacgaugucaggaguucaagaccagccuggccaagauggugaaaccccgucucuacuaaaaauacaaaaauuagcugggcgugguggcgggugccuguaaucccagcuacucagguggcugaggcggagaauugcuugaacccgggaguaggagguugcagugagcugagaucgugccacugcacuccagccugggcuacagggcaagacuccaucucaaaaaaaaaaaaaaaaaaaaaaaaaaagaaguagaagaauugaccggccaggugcgguggcucacgccuguaaucccagcacuuugggaggccgaggcgggcagaucacgagaccaagagaucaagaucacccuggccaacauggugaaacccugucucuacuaaaaaugcaaaaaaaaaaaaaaaaaaaaauagcuggacguaguggugcgcuccuguagucccagcuaccugggagacugaggcaagagaaucacuuaaaccugggaggcagagcuugcagugagccgagaucgcgccacugcacucaggccugggcgaaagagcgagaguccaucucaaaaaaaagaaaaaaacaaaaaaaacgaagaaguagaauuauguguagaacacuuuuaaaggagcuugcuugaguugaggacuuugcaguccaagcaaugaguuuuuaagaugagugaaaccaagcaacuaauuuagcauauagaaaaauauaaagaauaagauaaagcacauaccaucuucauacaguaaagcauuuucaaauuaguuuuaauucaucucugaaggaagaggaaaagauugagaaaaggauuucuuuagcauucucagcauguccucuaauuuuguaaccuaguuuuaacuuuuguuuuuuuaaaacauaaucauauguuuucugucuuuauuuucuagucugcuccauauaaaacuggaagcaaagggacuaaagcccagagagcaagacaguugggcuuagaaggagcagccagggcacugcuugagaaaccaggggagcucagucugcuaucguacauuaggccugacguuaaagguacuggcuuuauuuacagagaucaacuuuguuucuuuuuuuuuuuuuuuaauuuaaaaacguauguuaaaaaacuguuuuguuaaguacugauuauacaaaagaauauuacagcguauguagaauaauugaaauaaauccugacauaccuauugaguagccauucagcuuuucucuuuugaugaagugccuguucuagucuuuugcccguuuuucuauuguauuguucuuuuuaaaauuauuauuuuaaaauaauuuuugucauuuauauguguugcaaaucuuuuuucccaguuuguaacuugucuuuucacuuucuuuauggcaucccuugauaaauagguauuaguugaguuuuauuauaguuaaucaucuuuuaagauaauagcuguauuuucuuuuuaaagaaauuccuucauaucccaaguuuauaaagauucuccuauauugucuguuacagcuuuuauuucugaaaauuuguuuacuugcaaaagucauaaauacucuuuaaaaaugucaagaguuuugacauccaggaaguguaaagugaagcuccacucucacacuucuacuguagaaguaaaguguauuuuucugaaauuucccuccaaguguaucuuccuguuuugugugugugcaugcacaacagagaauaagagagggaagaaguaagggagacauauuucuaagaaaaacucaagggaaaugacaguugauaaaugucaagaugcauugguuuuauuguaaaaaugagucuuagagugacaacuuugguuaagaguggcuuuuucucaggaauucgcuguuaggauugaguggggaaauugauguuuugguggucucuacucucaaaaaauuauuuuuuuaauauuaaaaaauuauauaguuaacaugugcaacaugauguuuugauauacauauauuaauacauagugaagugaguauuauagucaaacuauucuauacaugauaaucaagcaaauuaacauauucaucaucucacauaguuaccuucuuuuguguuaagagcaccuaaaaucugucuuagcaaauucacaguauacauuacgauauuauuaacuguagcccccguguuguauguuagaacucuagucuuuuucagccuauguagcuacaacuuuguacccuuugaccuacgucuuuccaccccgcccccaccuccaguuucuuuuguccuucuguggaucccauaggcugggacauguaaaugucuguagggggcagucucugauaacaaaauccacaguauguacuaaucuguagaaaauuauagcauacuauagccuguuuuuauuuuacauaacccagcaaaugugaauuugugauuuaaaaaacugagugggugugucuguaaaauccaaauaucuguucauacccaaacacacuuaaucuuaauguuuggagaagggcaauaaugaaaaaguaaaaaaggauuaugugaauuuagagauggguugaaaugaguaaaauucaaguuuguuuaauuuuuaauguguauuuauaguuagauuuccaaaugguugcaacacuuaauauuuuaauaauagcuaagacuauagcuaagcauuaagguuaaccacagugggaaacugucugugcccagucaucauauguuuuauuaaaauggaauguugaaacuuucagaauguuagaugcacaaaggcuuaucgacugcuuuuauuuuuauuuuucuccuugugguugauuuucuuuccuucuacuucucacuaccuuugguaccaaggucucuugaguucucucauacacugaguuccuacuggguagguuuuugauaaccauaucucuuuggauuguccuacauggugaugcugcuggaauauaugacaauggacacuuggugauacuucuuauaauguggauaguucagggucuagcacaguuacaguaguacuguacuagcagacgugugaggacuuuuguuugcuuuacucccucuuucuuuuacccugaucaaaaauguagaauuauuauuaguaagucuauauaagcuagguacugcuuuuuuuuuuaaguuugauaggaauguuuucucuuucucuuugucuccuccuccuuuauguuacacacaaucaugaucauccuuaauuuuacuuguuuuucgaaagaaguuucauaauuccuaucauuccugaaagaaauauuuaagaaaccagauaguucaguuuuuuuuuuccccaguagaagacacuucuugcuugcuugccacagaccaguaagcauuuggucugaaucauaaagcuauacugugccacaaauggacuauguccugggagauccaaaauacuacuuucguguccaagaggaaguucugucauacauaagaagagguagcuuaagugcggagaaagugaaaagaaauguuggccuuucgguuuuuguuuacagguguggagguuugaagauucuguagcugggaagauuucauuguaaggcaaaggauaugauuuucugguucuguguaccauauuuccuccugauuuaacugaggugcuaaacuuuuggaacaucuguuaucuuggcuguauuaaacccacaagaucuauucccuuugauugggaaaggagcuuuuucaaaacacagaagacuuuccuuuuaaauuauuuuucucccugguuggacugagaaggggaauguaauuugaaagagugucccaaaugauucugauaauuucuaucucccauugagaaccacugcucuagaaguagcucaaggcauuucccuaguggcaguuuuuuaaaguugaaugaguaucagaguuaucugggacacuccgugaaguacuucauuuccacagucuagccauucauaguuuuaacaaguaccugguaugauuuuauuuuuggguccuuggacuacacuuuacaacauuucucuagcgcucuagcacaauuuuaauuagauucauuaauuacauaaaguuucaaauuauauuccccucuuaugaugggggauuuucaaaggcccuuucuuauugcaaagucuauaauuucuucuguccucugcuuccauuaaugguucucccuguagguuccaucuuuacuauugaguuaucacccuguuguugucauuaaacuucaugugaugaugcucugggauacuuggaacuccaggaauuaguucuugugaaugguuuuccuagaugaagacugagagagcuaacagaagagcaaauguuuauugagugcucuauguguuauagcuguuuuaaguccauuagauauacagucucccaucuuguaaagguaauuuguuacugaaaauucccucauaggaaaguuuucuuaaaauguaaauagaauuacuauuaguuucauuagccacauuucuuucuuuaaauuucuuuaaaauguaauugaccguugcauaauacagagauuaggggaacaacccccaccccccccgacucccucuucaaaguugaaaauuuagguauaacuuuugacuuuauaaaaacuuaauuguuaauagccuacuguugaccugaagccuuacugaugacauaaagcugauuaacacacauuuuguguguuauauguguuauauacuguauucuuacaauaagguaagcuagaaaaaagaaaauguuauuaagaaauuuguaaggaaaaaauauauuuacuguuuauuaaauggaaguggauuaucauaaaggucuucauccucaucaucacauugaauaggcugacgagaaaaaggaggaggaggaggaggaggaguuguuucugucucaggaauagcaaaagcagaagugguggaggagguggaaggggugacgagaggcaggcacccuuguuccaacuuuuauuguaauuaauccauguagaagugcagacuggugcaguggcucacgccuguaaucccaacacuuugggaggcugaggggggcagaucacuugaggucacgaguucgagaccaggcuggccaacacagugaaagcccgucacuacuaaaaauacaaaaauuagcugggugugguggugugugccuguaaucccuguuacuugggaggcugaggcaggagaaucacuugaacccaggaggcagagguugcagugagccaagaucgcaccacugcacuccaaccuggaagacagugagacuccaucucagaaaaagaaaaagaaguggaccuguacccauguuguuuaaaggucaacuguaaacauaauuacuucaguagguaacauagcuauccuaacacaaccaaacuagauauuuucuauuuauuaauuaugccauaacaaauaucuuccuguccucuuuggcuuuuguaccuuauuacuuauuaaaacuuuacuuacaggaaaauauacauaugauaugcagugcuuguguaauucagguuuagugcaaaaaacguuucaugcaaauagaaugauaaagacaaaagaaaugaaacaaagcagugcaaaugaucucucucaguguaaguugauaucagaaagaccuugauuuacaagauucauugcuauaaauuagcaaauuagaaaugcuuaaagagaacuuaaugcucaucuguagacaauuuaacugugaagaggaacaacugcaugaaaacucuuguuuugugcuuuugagauuugugaaauucaaaugggucguugaaaaugugaaaaaaugccccauaauccaaaauagaaauugcuucuaaaggauaauuuuuuaaacaaauggaguagugucccuuggguuuugacucuauuaauauauauuucccauaacaucuuuaguauuuguaaucacuucauaaaggagguacuguuaugauuccauuuuuauaggaaacugagguacagaggagucaaguagguugcccagugucucacaacuggcaaaugguagaaccaggauucgacaaggcagcuggcuccagagaugcauuuuuaccacugggcaguauauuauguauuaugucuguauuauugcuuuuggagacuuguuuuuguuacaaagggaagcuaguauacugcugcaauaucuuucugucuuaagacugucaacuuaagguuuuauuuugacuggaauuaauuuacugugauuuaguuauagaauuuaaaaccaaucguauacuuuuuguuuuuguuuuccuuuuuacccuucuccuaaagggcuuucaacgcuucaggauauugaaauaggagugcagcauauuuuagcagauaugauugcuaaagacaaagacacgcuugacuucauucggaacuugugaguaucucuuuuauggaguuuucugcuuuauggacucaugcuguuaagggucacacgguuagugcuaauaccaauguucauuaaaaacuuuguuuucagacuuuuuuuuaaaguagcaaaacucuuuguucaaacaacagagcccaaauauauaaaacagauaaaaguaaaguuguuuuaauugaauucuggacagggagccuggaacucugccuacucacccuccuuacacugaggcaucucaguggaggggccugaugaguuuaaaaaccauugccuuacacaauauauacgaagagagauucauguccuuuagaguggcauugcuuuuuaaacauguugauugugauguaugcuuauuuuauaguaucucguuucugguguuuaccagugauuggcuuuacuugagaauguguaauaucagauaugaauaaaaguacugaccuccaaaugauuuuuagcuguugaggagagcagcuuaucuauggcaucacagucccaauuuaucagacauuaaagaucuuugaccuagagccuucuugggcuuauggauuuuaugcaucauuaaaaaaacacauuaauuaaaaacccuauuuuuguauuauuuuguucuuuuucugcuguguaucagaagacagguuucugcuagagguuuguucuuccucucucucccuccacauaucuagcuguuugagcugugcagaggagaggaaaggaggagaugaccuaguugacuacuguugcuagaaagaacuuuuguauuuucucaguggcuccagcaggaaugaguugaagcaaaauaauugcucagguuuuaaaauguguuuuuauaaguaauuaugccacuuaaauuugguucaguauuauaaauuguuauuggaagcuguccugacacauccuuuuguuucucuuuuuuuaaguuuuuaauugacugugacugucuuagugauuagaaaagucugauauuuagaucagagcuauugguuugauuucuauagauaguuuugaucuuuugcauaauugcagaugguuucugaauucauuuaggcauuuuaugggaagauugaguagauauauaaauagaucuggaggacuaugcuaguaugaauaggcaaagaguccuuuugaugggguaguaauaucaauuucauagcugggcaucauuaaaaaaacucacuugguaauggcuuaacuuuuuuugcuauccuuauuucuauauauucuuuacuaaagcacaaauuaauaacugcuuguuuuuugaacacuuguguaucugaacaggugccagaagagacauguuuguauccagucaucucuggcaaaaguauccucaaaaaagguaaaugagaaagauguugauaaguuucugcucuaccagcauuuuuccugcaacauaagaaacauucaccaucaucagguaaauaaagaaacugcaugugcaugcugauuucguaauaaugauaauauuuuggauuugccugcuacuuuacuaagaauuuaaauaauuuuaugucaacuguuuucuuuuuucuuuauauaaauucuuauaauauugucauauccuugccgcuucacaaauugggaaguaaugacccggagaaguuaacaagugacauugagaauuauuagcagagcugacaauauaacauuuuagguaucuugacuuuuuggcuggugaucuuuuuguuagacucugcuucccaguauccuuauauuugagcucaauucuggaucucuucccugugaaauacaaauaugagauaucugauuuagaauaaagugugagaggucucauuuacuuauauaaaucagucauuguaucucaguguuuuaauuucauuuuucaguuuacuaauuuuuuuuccuaaguguagucguaggcuauaucuacauuguggaauguggcuuuuaaauuacauagggcaaaaaggagauaaaaaccaaaaauacaguaacacuggcguuuauauuuacauauaucaugacauuuaucaguguucuuuauuucuuuguauggcuucaaguuacuaucuagugcccuuucauuccagucugaagcacuuccuguaauauuucauguaaggcaggucuacuagugacaaacuuccuaguuuuuguuuuucuggaaaaucuuaauuucuccuuuuuuaaaaaauuuauguuuaauugugguaagaugaacauaacauaaaauguaccaucauaaccauuuuuaagcauacaguucaguaaugggaagcauagucauauuguugugccaccaaucuccagcaauuuuuuuaucaugcaaaacugaaacucuaugcccauuaaacauuucauucauuuuuuuauagagaguuuuuaaaauauagaauucuugguugaugguuuuuaauuuuucccuuuuaauacuaaauauaccauccacucuuaugguauggccuccauaguuuuuuaugaggaaucagcuguuaaucuuacgaugccuuauucaugacaagucucuucucucuugcugcauucaggauucucugucuuuaucuuuugacaguuugauuauaaugugucuugucaugggucuuucugaguuuauccuacuuggaguuuauugugauucuuagacguguagauuaauguuuuucaucaaacuuaagaaauucuucauaauaauuuuaaaaaauauccuuucugcgccuuucucuccucuccugggucucccauuauauguagagaguaugauugauagugucucacaggucucagccucuguugcuuucuuuucuuuauuuuuuucuuuuuucucugacuguauauucccauuugaccuaucuucaggcuuguugauuuauucuuuguauucaaauuugcuguugaaccccuggcacauuuuuauuucagucauuguacuuuucagcuccguaauuucuauuuuguucuuuuuuauaauuucuaacucuuacuuuucuauaugguugaaagaucauucuccuggcuuucuuuaggucucuguucaugauuuucuugaauucagcauauugaauagaguuaauuuaaaaucuuuguuuuguaaggucaaugucuaagcuuccucauggacaguuuuuuuuuuuuuuuuuuuuuuuuugguaaagucuggauauguuguauuuuauaacuugguaacucuggaaaucagauucucuccccuccccuguuuguuguugcugcuuguuuugggguugguuugcucuagugacuuuucuaaguauuuuuguaaauuuuguuugcuauguguggccacugaggucucccuuguuagcuuaguaaccaucuaguuauuuaacagagauuccccuaaaugccuggagccaaaaacaaaaacaaaauaaacccuaaaagaaaaaaauccccuaaaagaaaaaaacccaaacucucccagacuuugcagauuggcacuuuguuggggcacuccuucaacacuuagugaggccauuaacagcucugccguagccuuuucuuccuguuugcauggagcccaaaguucaucuagaggugaaagcuuaagguucccucagaucuuuucagagcauacaccuagcccucagcaugcccaggaauuuuaaaaagccccuuuucccucaaauaucucauuuccaaguuuauuuuuucacagguuuuuuguucucuguguuaguugcuccuguauuaucccuuaccccucauggcuggggcuaauauauuugccuuuaaguacuuuugacaaaggccaccugggaggcuucuucuguccugaguaaguuccaaggcaugugaaauaaagacaagcccuugagucaguuccucagggacacaccagacaucaaaacacacaaccauaguuauuugagaauaagguccauauugcuccuucugcaaccugcccuaggaacgugggcugucaucuucagaggccacugcugagcuggagacugggguacguuaaaagugcucucuuauagaaauucugcaacuucuuucuguguuucuuucguuguuauaaaauuuuuauuagauuccauaguugcgaaaaaguuaauucugacaguuuuugcuaccuuaccaguuaccuuuguggagggauggaauuuagaguucccuacuccacaauuuucagugaugucacuccuaacaacgucuuuaaaauacaguaucgcacacuccucauucuauuccagagcuggaguguggcuuuuaacguuauauaaaguuuucuuuauuaccuuguuuaaugcuuuuuauccugaagucugcuuugguauuaggauugccuugcaaccugugcuuucuuaaaggaaauugaccccacucucccuacucuuguuuuaaucucagcccuacaauuauauuaaaugcuugcccuugguccuuuugccagagcuuuccaaagccuuuagagugaaugaaacuuauucuguagucuaguauacaguugguaaacuuuuucuguaaagguccagugaacaaauauuuaagguuuugugagccagauggcuuuuguugcaacuacgcaacugcuguguaacacaaaaucagucauagacaaugcauaaugaaugagcaugguuguguuucaacaaaauuuuauucacaaaaacagguggcaggcuggauuugacccaugggccauaguuugcuaacuucugcucuagugaaugucugaagaaagguauauguguacaauauucucugaguucuuacacauucaaaauuguuuucuauggccuuaacacuugaaggauagcuuggcaugguauaaucacuuuuguuugcauuuucuuuacuuaaguuucuugaauauguugcucugcuguuggcuuccuuuguauguuauauuugagaaaucugaugccaguauaauucucugucuccuagaaaugcaaagagguggguccuauguuguguuuuauuuauuuucuuuauugguuuuauaguuuuuugagaaaggaagggggagauuugaaauuaggaaacugccaguguuuuucaaacgcggaauuucucaauaaauaauuuuaaaauuuauuuuucuuccuaucugcauuuuacugcuauaaagagagaauaauagaaaaaaaacuaguauuccuaaccuuucauguaauacuuaauuuucaucauuaagaauguaauuguuuugcaugguggcacaugccuguagucccagcuacucaggacccugaggcaggaggauugcuugagucuaggauuucugggcugaagugcgcuaugccgauuggguguucacauugaguuuaguaucaauauggugaccccacaggaacgggagaccagcagguugccuaaggaggggugaacuggcccaggucagaaaaggagcaggucaaaacugugcugauuaguagugggauugcuccugugaauagccacugcauuccagccuggucaacagugggacccugccucuuaaaaaaauaaaaaaguaauuguuuuucauuuaagaugacacagaugugaaaaauuuuuguuuuguuguaacaagacaugaagagugugaauuaucccacaaguauuuccugaaagguuauuuuauguuggguccuguuuaggguguagagguaacauggcccuugcccauuuaaagauuugaaauguuucacuauuauaucuaaaauugucaauuuuacuuuuguguacacuauauuuaccacaucaggugaaguacauacuuucaauauuuugaaagaaaguacagugaaauuuuacauacguaguuauuauagucuacugauacagguauaacauaaugaaaaguaauuuuuaauaguaccagugacuaaguauacuaacauuccuuuugcagaaguaguuuuucugucuuauuuuguccaccuuuuauguugauuuaauuuuauugcaacuuuggaaaaacauuaaugcuuuuauucuguuaaaaccuagccuucuaauuucugcuugaaaauauuuuauugggcucugcauuuuaacuaguguguguagcaaauguggcauucugaguuagugacugaauuuaagauuaugauugacacaggcuucugggugugacaguauucaggccugggaaagcagagcauuuuggaaaugucaguuuugaaaaacagcacugcuguuuuacgaacuuuuuaguuuaucauguacaggccggagugaugauaugcuagguuacaaaaacagcuucccaauuccuauagugcugagaccucauguccuaaaucugaaccuuacuuuucagccuuuauguagauaaccccagcacaguaucacagaacacagaaaugaaugcaaaugaugaaagacaguguggugaaggaaaauuacuguggaacucucuccaaguacugugggaauagccguuaauagcugcuuaguaaauucuuccagcugcaucuuuuuuucuuucuuuuucaaauugguccuuagugugaucuuuucuaccacaugaauuuguaacucagucuucacauucucucaugggacuuucuguuccuuaucuuuauuggugugucuuuuuacugacgugcaauuuccugugucuuaacuaccuauuuccuguucaaugucaccaucugcaguaauuccgcuuuaacccacuacucacuuucaauuucaguuucugucccaagcuuuauuauuucuguuaccuuauucccuucuccaccaugggucuuccugugugucaggauuuuuuguaaguuugacguauuacauuacuagguauggugaaaaagagcaaaaaaccuccaauaauguauugugauauuaugguauacuuauguaaaucggaauuaaauaacucuccucuauauuguuguacucuacuuaauuuauuagagaaaauuucuuguaugaagaacuucuguuuacuaagcuggcacagccuauagcaaauacggaagucucugcugagcucaaacugaaguuuauuuuguauucacaauuuauuucuuuauagauaguucugugcaguauuauugaauauauuguuuuauguaagcuuacuuuuuuuuuuuuuucuuagacaguaucuugcucuuucacccaggcuggagugcaguggcagaaucccaccucacugcaaguuucgccuugcgggcugaaggcauucucccacuucagccuccugaggagcugggacuaugggcaugcacaagcacaccuggcugauuuuuguauuuuuugagaguugggguuucgccauguugcccaggcucaucuugaacuccugagcucaaccaguccuccugcuuuggccucucaaagugcugggauuaugagcaugagcccccauacccagccgaaacauuuauuucuaagugauuguucuauuucugcugauguuuacuuuagaaauuucucaaguauauaagaaaagaaaaaaguccccuauauaauuuuuuuaaaacucugacaauuuguuugauauuuaaaauuuuacucaauauuuuuaaaauuuaaauuaaaguuacaaaaaaauacgcguuuuaucuuuugacauucuuuucaacaugaagcacaaauugagaaauuuucgugguagaauuauuuugugguaauauuaaguugaauuauucuaagcuuguuucaccacagauaggaagucuaaguuuuuguuagagauccucauggaaaugugcuaaaauuguuaaaauaucaguuuguguccuguaaagggagaacuuaguuuauuaaaaucccauucauuaagaguaauuggaagaaagccauuaagaauuagugagaaaucugaauauauguugaagugauguuguuuaauuuuuaauauauaauauacauaaauauauaguuacagacuagcagauauuuaagggaggcuguuaacuugauuaaauuauuugguuaauuuguguuacuauuuaucaucuuaauaauugguauuaaagagugcuuuaagaaaagaguguuuuaauuuucuaauagguuuauugaaguaaaauucauauugcauuuaaugcaaccauuagaacuuuguaaguucaaugguuuuucguaaauucacucaguugugucaccauuaccacaagcaauuuuaggacauuuuucucccaaauauuuccuugcaucaagcucuaggcagccaacuuucuaucucuauagauuugucuguucuggucauuucauauaaaggaaucauacaauaugcagacuuuugccgcugguuucuuucacuuagcauaaugguuucagaguuugucuguuaugguauguauuaguaugccuuuccuuuuuauugcuacguaauauuacauuauauggauucuccacauuuuacuuauccauucaucagucagugaauaguuugguuguuucuacuuuuuggauauuaugaauaaugcuaugaacauucgugucuaaguuuuuguguggacauauguuuuuauuucucuuggauauauaccuaggaguauaauugcuguguuauaugguagcuuuacauuuaaccuuuugaggaacugccauauuuuccagaguggcuaugccauuuuuacauucucaccagcgguuugugaagguuccgauuucucuacaucccucccaacauuuauuguccaucuuuuuguguuuugauuugcauuucucuaaugaugcugagcaucuauucauguacuuaucagucauuuguauauaauuuuugaacaaauaccucuucagaucuuuuguacauuuuaaauuggguuguggccaggcgcgauggcucacgccuauaauccaagcacuuugggagguugaggcaggcggaucgccugaggucaggaguucgagaccagccuggccaacauggugaaaccccaucucuuaagaaaauaaauaaaugaauaaauuggguuuugucuccuuauuguugagcuguaggaguuuuaaauauauucuagauacccuuaugugacauaugauuugcaaaaauuuuugucccaugccgugcauuuucuuuucacuuucuugauacuauucuuugaggcacaaaaacuaaaauuuguugaaguucaaucuaguuuuuuguuauugauuacacuuuugguguuauaucuaagaaggcuuuaugacuugaggucauaaaaauuuucuccuuuuuuaauggaaauuuuauaguuuuaguucuuguauuaaggucuaagaucaauuuugaguuaauuuuuauguauagcgugaaguagggguccguccacuuuuguucuuuugcauguggugaguucuaguuauucaugauuuauugaaaagauuggauuuucuucauugaauuaucuugguacccuuguugaaaaucaguugacacuauauguauaaguuuauuucuggacuccgauucuauuccauuguaugucuauccuuaugccaguccccacugucuugauaacuguggcuuuguagucaguuuugaaauugggaagugggaaucuuccaaguuuauuuugauuuuuaaaaauugacuuggcuauucucaguccuuugaauuacuauauguguuuuaaaauuaguucaccaguuuccacaaaacaugccaauugggauuugauagggauuucacugaauuuguaaaucaacuuggggaguguugccaucuuagcaauauuaggcccucugaucccugaacaugggauguucauggguauuuauuuagaucuucuuuaauuucuuucaacaauguuuuguaguuuucauaguacaguuguuccuugguauauacaggagauugauuccaggaucccugcauauacccaaaucuauguauaugcaagucccagaguuggcccugcagaacccauguauaugaaaaaucagcucuccuuaugcguggguuucagauccugcaauuacuguauuuucaaucccuguuugguugaaaaaaauccacguguaagucaacacaugcaguuuaaaccuguauuguucaaaggucaaccguguaaguugugaacuuuuuuuguuaaauuuauuccuaaguauuuuauuccuuuuggugguaucauaaauggaauuaaaaaaaauuauuuucagaauguuuauugcuaguauguauaaauuaauuuuauuuguugagcuuguguucugcaacuuugcugaacucuuuauuaguucuaauaguuuuguaguggauugcuuagaauuuucuauauauaagaucauguuagcugcaaauagagaaaguuuuacaucuuccuuuccaauauagauggccucccuucuuuucccuggcuagaaccuucaguacaauguugugagaguggacacgcuugucuuguuccuggucuuugaccaguaaauaugauguuagcugugagauuucugugcacaagcccuuucucauauuaaagaacuuuccuuauauuuccaaguuuuuugaguguuuuuuaucaugaagggcuaccugauuuugucagauguuuuuccacaucuauugagaugaucauaggauuuuuguuauuuauucuauugauauaauguguuagguuaauugauuuuuuagauguuaaaucaaccgggcauuccuggaauugauucuaguugaucuugguguauaauccuucuuauauauuucuggaugugguuugcuauuacuuuauugaggauuuuuacaucuauauucauaagagauauugguuuguaguuuucuugugaagucuugucugguuuuuguaucagaguaauacuggccucauagaaauauaugugaaguuuuuccuucucuaauaucuuuuggaaaguuugugaagaauggauauugauucuuuuuagaauguuugguagaauucaaugguggugccaucugggccuggacauuuauuugugggaaauuuucaaauuacuaauucaguguccauacuuuuuauagguguguucagauuuucuguuucuuuuugguuuguuuuugguaguuuguaucuuuuaggaauuuguccauuuuaucuuaguuaucuaauuugucauacaguugcucaugguaucucuuauaaucuuuuuuauuucuauaagguccuuaguaguggccucucuuuuguuccugaucuugguguuugaguguuuccuguuguuuuucuugauuagucuagcgaaaggucuguuaauuuuguugauaucuucaaagaaccaacuuaugguuuuguugauauuuauugcuuuucuauucucuauuuuauuuuuacccuauuauuuauuauuuucuucugcuuguuuugguuuuguuuauacuuuaaggaguguuuuuaauguguuuuaagacagucguucuuuuaauauuuuaauuaagagcauggacagauugaucugaaguuuaaauucuuuuuuugcuacuugcuagcuuugugauuugcaacaaguuaguuucagaaaaauuauuauauaaagugaagauaauacacacauuacuggugacucuaaggauuacuugagauaauauauuuaaagugcuuagauaggcucuacaauuaguaaugcucaauggaugguaacaauuuguagcuacuaaauauugcaccuaggauuuuacauguuuguauuuaucuuagcacagguuaucuuuucaaauuauaaaaaguauacccuuccaacuccagauaaucaaaaauuuucaauuaguagaaucugaaaugagauuuuuagaucaucaaagucucuucuuguaaauguguuagauaggcuuuguaucugcauuuuauuuucuaagagcauguuaggguuuuccuuaugugggagguauguuacuugaaaaaaguguaaguaaaugauuauuuuaaaauguauucuuguuuaauaaacgaguaaaaaauucauauagcugucagcuacauagucgccugauuuguuucauauauuuuguggauuauuagucuuugccuuauguuugcacucagauucuggcaauuaaccguggagaaaauuugaagguacugacgguuaaggucaauauuucugauggagugaaggaugaauucuguagguggugcauccaaaacaggucuguuuacagauauuuacagaauuuucuuuguuucuuuucuaaaauaugauaccgauaucuauauguacugauauguaaagaugucuauuacgugaacauuuuuaaaaagccagugacaggccgggcgcgguggcucacgccuguaaucccagcacuuucggaggcugagggggguggaucgcgaggucaggaguucaauaugagccuggccaagauggugaaacccugucucuacugaaaauacaaaaacaaaaaauuagcugggcaugguggugcacaccuguaauccccgcuacuuaggaggcugaggcagagaauugcuugaacccaagaggcugagguugcagugagccgagaucacaccacugcacuccagccugggcgacagagcaagacuccaucucaagaaaacaaacaaacaaacaaaaaacccaccaauaacagacaagguauguaguguccuuuuugaauuaaaaaaaauaauaaaauaaguaugugugucaugcauauuuaaacagagaauauccaggagggugugugaggaauuuuugauagugauuaucucuguggagaagaacuguuuuacuucauuacuuuucuguacuauuugaaacuuuuguaagaucaucuuuucccuugcaaaaauaaacuaacaaaaauaugcucuauguaucauaucugaaguguuuagcucuuuaaggaugauggaaacaaaaauuaacuuauuggauauuacaauauaaauaagcauucuguauguggggauaaauguugcauguuaaggaugauugaaagaaacauuaaauuuauuagauauuuuaaggaaaugucuaagcuuauguaauuuuuuauuacccuuuuuauuuguuaagggagccuuuuaaaauagcaccauguuuguauaauacuuuuuacuuuuaguuuuaauuuuucagaguguaauugauccucacaaaaaucuauuuaguugguagagcagauuuuguagccaccacuuagccagugagaaaacugauacaaagagguaaguaaaguggcuuccuagcagcuaggagauguaaauuuugauaaaguucaucaccagcuaguucuguguaacuuuaggauaaagagauugcuaggaaugauacuuaaaaaguuagaugacuuguucuuugaaaauaaguaucauggauuuuggaaaucaguuaucucauucaacacaacuguuuuguuaauucauuaaaagcaaugaaggaucaacuugcuuaacaaccaaauacuacuaacuaagcaaccauuaaguaaaacaacagucuaaauguuaaucaauagguaaauugcuuaagccaauuauguuauauccauaugguggaauucugugcagccauuuugaaaaaguggaaauagagcugaaguugaaauaugaacaugucuuacuaaguuaaaaagacaauuuacaauuagcauuuauuuauaguaugauuucacuaguggcaaauaagugucuuuauauuacuguguauauuuuucuauauaguuucuuuucuuuuucuuuuuuugagagacagggucucacucuguugccuaggcuggagcacacaggugcuaucauagcucacuacagccucaaucucccagacuccagugauucucccacuuuagucuccuguguagcugggaccauaggugcauaccgcuggcuaaacuuuuuuuuuuuuuuuuauuuaagagaugaggucuugccauguugcccaggcuggucuugaacuccugggcucaagcgguccuucuaucugagccucccaaaaugcuggcgugacaggcgugacccaccaugccuggcuaguugucauuuuuuaugaaugcuuauuuccuuuauaaauaagcaaauaaauuccaaugaaaggaaagaggaaauguaugccuaaaagaaaugcuagauuuaaaaaauuaggaaauuagauaauuuaagauaugacaaaacucuaagauaguuucauagaggaaacuccuaagaaguagauauauuugaguuugaauuccaguuauauuacuuucuaccucugcaccuaugggcaugcuacuuaauuucuuucucaguuuugucuauccuuaaaaugguaauacuuuacuuguagauuugagagaauuaaaugauaaucuacguaacuguauagcacaaugucuggugaagaacaggccuuugaugguaucuguuauuacaaaguagugggauuauugugcuaauucuuuuuagaaauguuuuaguaaaucacaaagacaauuucuggcuuauuuuucuguaaauauucauaauacucaguaucagagucaguccucaguaguuaaagaaaaaauaugcuuuuaaccuauuuauuaucuuuagacuaaguaaaugucaaggaauuuuuuuacagugauuuauuuuuccauggcuuauuuauauuuuauuuaguucuccaauugaaaaauuuguaauauuauuuagccuacaauguaacauguuacaucauuauggcauaguaauauaauuuucagucagguuuggaaguuuuucuuuuucuuuuuuuucuuuucuuuuuugagacagggucucacucugucugucacucaugcuggagugcaguggcaugaucuuggcucacugcagccuugacuucccaguuucaagcuguccucucaccugagccuccugaguagcugggacuacaggugcgcaccaccacacccagcuaaauuuuucuuucuuguagagacagggguuuugccauauuucccaggcuguucucaaacuccugaacucaagugauccaccaacuuccgccucccaaaguacugggaugaaccaccccaggcaugaaccaccaugcccggccugaaacuuuuucuucauuuagauaauuccaagagcugaaacacuuuucuaggaccuaaaaaauuauucucaaaagaacuuuuuuuuuuccuuuaagcacaugugaaugacuagaaaugcuuacuugaugaaucuucuaguuccuuuuuuuacucucuuuuucccuauuucuucacccucuucuguauguacuuauccauucaaguuaugugcuagauuuuggagauuccccuguaaauuagacagauauacugcuuauccaugaugacagcguaguuuaaugagaacaacacugggaaaaucauuacgaguauguugagauuaugaaggaaaaguguaguaagaagaagaaaagugcuuguaacagagcccugaguaguguggacuugacagcuagguagguuggagauagaaggagaaggaagagaagugacauggaaugaagauugagauguugacacagguuagaucauacauagcuuucagguaugcuaaagauuuuuuucuuuuaaggauggugggaagccaauaaggauuuuaaauacaggagugugaugaucagauugcauuuuaagaucacucaggccacaguguagauaauuauuuggaaggaaucaagaguagauauggcacaagagauuaugguagcuuagacuagggugguagcaauagggaauaaguagauagauuugggcaauauuuaggagguagacaggggcaggacaagguaucugauuaaaugguggguggauugguuagggagaggugaagugaagcaugaaauuuguguggcggcugggcgugguggcucacgccuguaaucccagcacuuugggagaccaaggugagaggaucaccugagaucaggaguucaagacuuugagaccaaccugaccaacauggcgaaacccugucucuacacaaaauacaaaaauuaaccaggcaugguggugcaugcguguaaccccagcuacuugggaggcugaggcaggagaauugcuugaacccaggagguggagguugcagugagccgagauugcgccauugcacuccagccugggugacaagagugaaacuccaucucaaaaaaaaaaaaaaaaaaaaaaauaauuguguggcuugaacaauaagguagaugauauaguuacuaucacacuauaaauauauuaagaacuauguaauagggcaaauagugauuuaaauggcagucuugucauuacauaaguuaauuagcauaacaaggaauaauuuaaagcuaauguauuaguauuaaaacuaauauuuagguccagauucagcaaaugaacaauuccucauuuggaauuguauguuacuaguacaagauaaguaugaagaggauuucuaagcuuuuuagaugcugaaauaguugcuguguuugugagaaccucaguaauuuaaguuucugcauuugcucucuaaauaaaaacguaucuaaggaaauuuuuuuuaaaaaauuaagaaaacuucuuuuuagagacauuaucucacuauguugcucaggcuggucucaaacuccuggauuuaaacaauccuucugccucagccuucaaauuagcugggacugcaggcaugcaccaccacaccuggcuucagaacuugucuuuugaguuugcagauuuuugugucuuugacuugauaaguuaauuuuuauucucccuaaaauugugcugcuguuuuucauguaguagguuuaagggaaacugucucuacuuuaaauguggaaaaaagaaagcccaguggagagagccugucuuuaucuuauauauaugaaguugggagagcauauuucuuugccaaaguggagaauauuucuuuggaggaguuugugaucccucaccucaguuuugugcuucauuguaugcaacauacauagcauguguuuugcaauguauauuugguuuaagugaguccuccuuaguuuuauucagauguauuuaacuguugaauuagaggaagaaucaaguuuugagaugacuuccuguaaggcaaacccaucauauuuucuuuaaguuuaaagauuuaagcaacaggguuugugaauuuacuauacuauuucagguuccuuaguaugcuaagugccuucaauaaaucccaggaagccggugaagggcaggaauuguuuugguguaaggagcaaaaaggaguuucuauaauguaggaaaugaauguagcuguucucuuucagggcugggucuaguggucuaaaguucaacugaaugggcaugauugaggcauccucaaguauuaaauagacccauagcucucuguuccaggaaggggaggagagcaguccaagccaagggaggaucuugagacuugaagaagacuacuggggguuugagaggguauggguaggugauauuuaagauuucuggcuuuuuccugcaagcaguggcuuaaagggcaacaccuuaggagacaaaucagauacauacauuaaaacaaaucccucuguuagggucuuccuaccucuaaggacuaucugucuagcauacuguugcaugauucaggacuauguucucucuccuaccucgucaggcuccauagcuuuguguauaagacccuuuaugauccagccacugccacauuuucuacccucaucuuuccuccuguugaucuugccacuuuauuuccuagaagcgcuaaccuuauaguuacuucaauuuaccgugcuuuuucaugccucuaagcuuuuacauaugcuauaauuucuucccagaaugcccuuauucuuuugucuugcuuggcaaacuacaauucauuaaaaaaaccuaucucagauguuucuuuugggaagucuuucuugacauuggauuccccauauuaauaauaacagcagcagcagcagcagcaaaaacuuacauagaauguauuaggcaccauuauaagucccuugcuuauguuaacucacaacaauucaaugaaguagacuauuauuacucccauuuuacugaugaagaaauaguagcacagauauacuuaaguaaauccaccaugaacauagagcaaggccagacauggugggucacgccuauaaucccagcacuuugggaggccaaagcagguagaucacuugaggucagcaguucgagacuggccugcacaaaguggugaaaaccugucucugcuaaaaauacaaaaauuagcugggcgggauggcgcacgucuguagucccagcuacucgggaggcugaggcaggagaauggcuugaaccugggagguggagguugcaaugagccaagauugugccucugcacuccagccugggugacagaaugagaugagacucugucucaaaaaaaaaaaaaaaaaaaaaaaaaaaguaauagagcauagagcagaacagaucauacuuuuaacuaguauauuauacugcuguuugcugucacuucugcuuuugagcucuucauaucuuuaacauuuauuucuguuuuuacauuuauugugccauacauuuguuuagauauuuguuucauugaaaaaagguguguuuguugaauucaugccuuuuuucaauggaguagagaaauccuacuccucuguaucccuaauuccuucaggcaaauguuacaguagggagcagcagggauuuagguggaaggaaggauguauauccugccuaaaagcacuuccacuaaaauuuaaaaacuguaugacacuuucuauggaagagauucaguuaguugcuauuauguaaucuuuggaauaaaacauuguaagugcuuaaauguuuguucagugaaauguaguucauuuccuagccuaagauaaguaaaggggaugagaguacccuuaagguaauauuaauuaauauuuuguuaaugguuuucauucaagagggcaagggcagagaugcuguagauggaugaaaacacagaauggauaguaucauaggaccaacagguuuauaugcccacugugccguaacagacuaauacaccaagacagcaggguuuguagcagagaaaagaguuuaaugggccuggcgagguagcucacgccugcaaucccagcacuuugggaggcugacaugggcagaucacgaggucaggagaucgagaccauccuggcuaauacagugaaaccccaucucuacuaaaaauacaaaaacaaaaaauuagccggguaugguggcgccuguagucccagcuacucaggaggcugaggcaggagaauggcaugaacccaggagguggagguugcagugggccgggaucgcgccacugcacuccagccugggcgacagagcaggacuccgucucaaaaaaaaaaaaaaaaaaaaggguuuaaugauugcagggcacugagugaagagaugggaggaggccuugaaauccauuuuuccaaaaaauucugggcuggguuuuuuuuguuuguuuuguuuuuguuuuuaagaaagggucucuguugcuuagcuguagugcaguggugcaucauggcuuacuacagcuucaaccuccugggcucaagugauccuccugcuucagccuucuaaguagcagggacuacaggcacacaccaacacauccagcuaaauuuuuauuuuuuguagagacaaggucuggcuauguugcccagacuagucuugaacuccaagugauccucccacuuuggccucuggaaggccauacucugggauuacagaugugaguuacugugcccagccugggcuaggauuuuuaaggggaucguggagggaaaggagcuggaaauuuguggucuuugauugguugggguaagggggauaaaaucaucagcauauggaaacuguacuguuuggugagucagcuucuuggugggagucuuucauaguagcugaugucaguaguuucauugguacacaggaccugaaagaguauucaaauggaaaacuuaacauuucauaauguucagguuguuaccuauagagcaguuaaggggagcuauaaucuaguaacagggucugugugauucuaggacaguaggcaccaaacaacuaugaggaagcaggucagagagugagcugaccucaugauuaaugcugaaugugcugccagcuugguuuauuuucauuucuagcccuccuuucuuuccugauuaauuuuauaagguuuauagggaccguuucagugaggcuacauuuguccuuuuagcuugugauuuucucuucuauucuuuccccaguguucauuaacaauugguucuguggcauuuauaguccucauuacauaugcagauguugccugguagagcauuguggccugagcaauagaguaaguucucagaaauggcaagaggcaaggguugaaacagaguuucugcuuugcucagucuacuuuaacucucagaaagagauaaagaaagggggaaaaaaggauacaguggcugucuuaacuuggacuaacauaacaaaauaccacagacuauguggcuucaaccggaguaauuuauuuucucauaguucuggaggcugagaaguccaagaucaaaaugccagcugauucauuuucuggugagggcugcccuccuuggcuuguagacagcugcauucuugcuguguccucacaugguugagaaagagagagaaagagcaagcccucuguuaucucuucuuaucagggcacugauuccauccugagagccccacccuuaugacuucaucuaaaccugauuaucccccaaaagccccaucuucaagguauggauauggggagggacacaauucagucuguagcagugguguaauaauuuuuuggugacuuucuuguaucuuaagauuuuggccauuauuaauaaugcuuuggagacccuuuacugaagaggaaauuuuuuccuuguuuuauaucugaccauagauaguuacuaggauuuuuaaaauaaaaacuccagaugucauaguaauaauuuucagauaccacagccuuuccucacagauuauguuacuuuggcuucaauaaagguuuuccccgcuucuguauuccaucucccuucuuuuugggagccuuuuuauggccuuauuuauuguugcaucaguuuuagugugggcuuuucuguuuugcagguggagaccacguagcuuugcaaggccagaguuaaugaagaucuuauauaauucacugaaugauuccuuuaaacgccuuauuuauccucuucucuguagagaauucagguauauaucuugucuuguuuaauuuuguguacugauuauuguuauaugauacuaguaccauuacaguguguagcuaauguuuguugauugauuaaccaaucgaaagaauuuagucagcaucacaaaguguuaaaguuaaggcuugauuucaaucuguagaugcauucacaugcauagaucauaaaaauaguucuuaauuaugauauguuuuucaaaucuugaccacuuaauguguaccccuugaaauccugcaauacuagucuugcagcuggaggcaguuuuuagagguaagagagccaaagaaagcauaaggaaaucaguaggguacaugaugaaucaauuacuuuguuuuuaacuccaaaugggaguuauuuggaugaaaaauuaucagcaaugauaaauauuaggagauuauuaaaauggcaaugugaacggacuaauagaaggacuaaguaauauagaugaaaacugcaaaagaggugaggugcagaauuguuuucaggacagaagauggaaagaaaagaaauguagggaggcaaaacuccucucucuugcuucucuguaacccuuguuuuugcacccaaucuuuagaaacuagacauucccuaauucauuccuuccaaaauauuauagauuaucuucauucucauuucuuuguagguuucagcaagggcuacuugaaaacuguaguuuuguagccaucucuucaaccucucuagaauuuuuagcagccuauguagggcuuguuucucuuuugcuggacuugaccauugaauuaagauggguucagagcagggagugagcagguacuauuaaaaaagacacauaguccuguuguccaauuucuuuuuaccaaagucauuuaaucucuuguuacauccauuuuagccuagauguagccuaaaaauauuguuccuuuuagaauuguauuucacuucaagcugucuaacaucgcuugcuuuugagagcuagggcauacacuuuaaaaauuaggaauuugguucuuccugaaggaaaaaauuauguuauuuaaaauuucaauuucuuuuuguauguuuuucuuuuuauuguuuucucauguugcuuaugucuaguggcacuuuugacauuuuuugcauauauuuuugauuugaguagcuucacugcauguggaauaauuucaucaagguuuaauguaaacaguuugaugugggaucauuuaauguauaaacuguuucugaauuccauuagcaguagauaagcaagaguacuuucucuuucuuuuucuaaaaugcccaugguuaaaauaauauaacuuauuucaguuuauaaguuaguuugcagguauuaucuacagauacgccuccugauaggaauacuuaaccugaauagcaguuaaagaggaggacacucccacuugguuuguuuuuuagaccauuuuauuuugcagucacuuaauuugguugacuguauacuaugcauagccuacgucugcauaucuuauucccgugacugucaugaucauucauccaugugucauuuuucacaucuaucucugucaucaguucuacauugucaguuacaaagugcuaucuauuuugccaucuuuuauuauaacuugaauuuuuccuccccuuuaucuccguggugacugucuuaauucaggacaucaucauuuuuugucuggauuacugaacuagcgucauagaugaucuuggucuucugucuugucuuuuccaaugcauauuacaaaucgcccuuucaaaauucucaucucacaauuucaugcuuguauacuucuuucagcugaucuuguuugucuccaggauagaauccaagcucuugagaagaacaugcaugacccuuugugaucuguuuuuuucuugccucuacuucugucucgcuguuucuuuuuacuuuagcauacgaaauuacuugcuguuucuaugaugagccaugagccuuuacauaugcuguuuccauuguccgggauauuuucucccugcccacugugccuacuuuuguuugcaucccaugugacauucaaaugugcguacacucucugucuuucucacauauacacauauuuauaaauauggguuuuauauacaguagagagcagauagagagguaauguagguaugauaaacuuacaagacuugcuucagaauugcuugugguaucauauuacugugauuagugaaaauagacucaauauaauuuuuguauauuuuucucuuaaguuauauuguuauaauaaauuauccuuugagaaauaauuguacaaaaugaauucugcuccuuuucuggaaagaaaauuugggugaaugaaaaacuuuuucuuuucuucuauuucuaaagagccaaacuaacaucagaugcagagaaggaaucaguaaugauguuuggacggaaccuucgucagcuccuuuuaacaagcccuguuccagggcgcaccuuaaugggaguggauccugguuauaaacaugguugcaaauuagcuauaauuucuccuacuaguaaguugucuugcaauuuuccauguaaaaguuguuugguugguuauaaguuucacuucauacauuucaugaggauuuggaaauaauguuaauuuuaaaggcuuaaaaagugguuuucucacauacagggguguugggaaccagauaaucaaacuucauuuuucucucauuuguugaucaaacuccucaauauacaacuaucauuuauaugcuuccuauaucucaguagagauauugaggauuaauuaggcucggacuugaacucuauuaauuccccaucagauucuauuauugugaugcauuuauauaugaugcauuuuaauucugcuuauauuuuaaauaccaaaagacauuuuuauuguuuugcucaauuuuuuuuccuguuuacuuacauuuacacugauauucuucauuucuuuugcauuuccgugcuuccauuugagaucauuuucuuucugccugaagaacucuaugcuauuacuuuuaaugagucacauugucuuaguuuuaguuugucugaaaacaucucuguuuugccuucauuuuugaagaauauuuuuugcuugguguagaauucaagauuggcaguuacuuucaguacuuuaaagaugucauucuuuuuuuuuuuuuuggcuacuguaauuuuuguugagaagucagccaaacugugguuauuuguuauuguuccuuugaagguaauauguccuuuuccucuggcugcuaagauuuucucuuuguguuucucaguuuucuuaugaugugcuucaguggguguguauguauggguuuucuugucuuuucuuuucugcaugaauuccacuuaggguuuguggagcuucuagcaucucuuucuggaacuccaauuacauacauauuauaccuuucaguuucuucucuccuuuuuguuuauuuucuguugaucaucuaaguuaauuaauccucuauccugcuaugucuaauuuguuacuaaaaccaucuacuggguucaagugguugguuuuucaguuuuagaauuuccauuugauacuuugaaaaauaggguuauagcucccuaugaacuucuuuauuucuaauguuuuugaucuuuuaacuucuuguuuuauuuucuauuagccuuuacuauuuuaauuuuuuaaguuuagauuuucauuucugaaauaauuuuuucuuucaucucgaauucauucccaguuuaucucaucuaauuucugagauuuucuaauuuugacuuauguuauucuuuuauuuauuuaacuuuuacugagucagggucuugcucuuuuacccaggcuggagcacaguggcgugaucucagcucacugcagccucugcuuccugugcucaaacuauccucccaccucagccucccgaguagcugggaccauaggcacgcaccaccaugccugccuuuuuuuuuuuuuuuuuuuuguauuuuuaguagagacggaguuucgucauguugcccaggcuggucuugaaauccugagcucaagcuaugugccugccuuggccuuccaaagugcugggauuaccagcaugagccagaauuaacguuacucuuauuuucuguaauguuuuuuuuuaagaagcuuguucucauacauuaggcacaucuuucuguaaggacauuauauuagucuuuuaaaaauuuuuuugcuuaaaaaaauaaucauucuauauagaauuugacuaucaugcauuucuuuuguuuaguuuuacauacguuaguuugaacuuuuaguagaagcugggucaggcaaguuguucucacuguauaucucuagaacuugcucuucuguuuuuuccaaaucauuaaaaaaaaaaacucuguguggauugagagauaguuuauaguuucuggaaucugcuucucuguugcuuuccuuuauuuuaucugggcuuucuuuuuccuuugcuguugcuaucuuuacuuugcucaguuugaaugugauuaccaauuguuucuccucaguguggaauuuuugucuuuaaagguaucuuuuacuaguuaguuucaagaguucauagggaucaguguuuuccaauccuuucagaaguacuggauccccuuugugcugaaucucucucaguuucagcuccuguucucaaacugacuguugagauuuccagggaaguagccuuugacauuuuugggauucuccuguucucaguuccaucauauauuccacuguuucuuucugcuuccuuccaugcagaugcugaugcauaggugucuugucaguacauuguucccaccugcuuuuuuggaggguggggguuuguggggauauuuuaucuauguucuagauauagucgugacuuuuuguuuuuguuauccuaguugucuuuuuaugcuguucauuuuacagccagugggaaauauauuuuaucaguguuuuuuuuuuuugcaucuguucauauaucauguggcuuuuguccuuuacuauguugcugugauuaauuauauuacuagaauuuuuuaaaaugucaagucacacuuuccuuagauuaauggaacuugguuaugauacuuucuuuuggguguguuguuagaucaguuuucaguuauuguauugcuuauaggauaauuguucuaaaaaugucacaaacacaucuauauucuuaagcuguuuugguaagauauuucuaauuaucuguuuucauaauuuaauauaaaguuguuuauaaugguagauaucuuuuaaaccuguguucaaucucuaguuauaucuucuuuuuauuccuaauauaauuccuguauuuguaucuucuauccuuucuuuuacuugauugguauugcuaaaaguauguuuuucucuuaagugauuuguaacuacacuuuguugaucuuuucuguugcauuuuuuucuguuaauuuuugcuuuuaacuucaacauuuucuaucuucugcuuucuuuggguuauuuugcuguucuuuuccuaacuuguaaguuagucucuuagcucaguuuuauucuuuagguaguuaucuucaaauuuuaaaaaauacuuuuaaucaaaauaauuuuaauuauuuuaaauuuaauuguuauaaauauuuucaauaaaaaauauuuuucuuuauaaugcaauauagaaaagcucauaagucuuaaauaugcacaagguaaauaaagucauguaucuacaaccagaaaaaaagaaauaggauagucucacaacagugucugacauauacuaacaauucaguuaguguuugcuuuugcuacuauuaauguuagauguuagugaaaaccauuuuucuuuuagguauccuagcauauucuccaauuaauaguaguuuuguguagcaaacagaauccugugaaauuggaaagagcaauacuucagagagguuaggaagaaucugauuuagugaauaugaauaguucagacuucauuauaaaaaacaagccagucuccuuuucuguuacaacuugcuuaacaaaaucauucauguguuucacuuuguaauuucuuauaaaauggcuuauucuuuucauuuuuuaaaggucagauacuucauacugaugugguuuacuugcauuguggacaaggcuuccgagaggcggagaaaauaaagacacuuuugcugaauuucaaguaugaaaauaaguaaucuuuugaauauaucaguggcucagucaaccagagauaccuuugaagccccuaauuuggagggagggauuaagggaggugccuuugugagagacaauaaaccauauaaaacaguucuggggcaaauugcuggagaacucugcauguggagacuugagaaacgcugcucccuuccuuugccaccauuacaaauaaaggagguaauaugggcagaugugagcaguucauucuucuguuccaauuuucucccucucucccugccuucuuuccaucugaggaauagaugugguuauaguuagaaguuucagaaauugacaauauauuauauaauuuaaucauaauaucuuuauuacggcuuagauggcuuagaaugcuccagaguugacuuaucucugauuuugguuccuucuugaugggaagaaagcugacuuuuuugagauagugugacaguaaaauacuucucugcugccuccuauaccaaaugcagggcagugucuuuuauuccauauaagucuguguuuuccuuaugcaacaguggacagguugcuuguauauaugagagaauaagagaaucauauaauaguauuugugcauucuguacauuuucuccagcugauuucaaagcaugccuugaaauucaguuugucauucuguuucugccuugaagcugcagcacaguagugauuggaaauggaacugccugcagggaaacagaagcuuacuuugcugaccugauaaugaagaauuauuuugcaccacuggauguuguuuacugguaaggcuauuacauauaucucuuuucuuggagaagcaugggaacuuuaaaguugcuuuugugaugaauccucccuucucuuuuuaagauguacaucuucuuugcccuccagaccaccucuugguguucaugagaacuuugcaggauaauguaaagugucugacucuuggagaaauuugagacaggaaugauuagagcaggacagaguccagaaaccucuuacagaagcagcacguuagggcucaguuucauuggauuuucuaggcuauacauugugugaggguucuaguuaacuauugaauaauaaguagaaugauguaccaggcuagcagcuaguagacugugaauaacuuagccuuuuucucccaaagcuuugaagccuaugaaucauuacccuucagaacugagagccaagguaaguauuaugaauuaaaaaguauuuccaguauucuuuccucauuuaucccuuggucacaaacuuuuauuucauauaggcauacagauaacuugugaauagcuuuggauuagaaagacccaauuucucuagucuugccccugcauuuguaguaguucugcuuucuuucaccauuguuucccuacuuccucuuuggaucucaauagucaugucuuccuuuuccaaacuauaguagaauauuaaguccuaaaggauuuaauucuaggagagagaguaguuauaauggcugauauuuaacagaaagugaucaagagcuaucucccacugcuagugagaaaacuaauaacuaaaagaaugguugacugaugagcaggugacugacaggaucaacaaaguaacagaaaguaaaaccuaacacaggaagaauucuaggauuuguguagguaggccaaaagguaaaggccaggcaguuauuauagucaagagugccaagaguguagucagagucagucagaaaaacaaacucaggguaacaaggggaguaagagaaggugaggaacaaaccgauaggugccaugggaucaugauucaagaaggaaacagauugaaacauccacugcagaauuuuucccucuuucucugguuguaauuuaaguuggccugggaaauacgguggaucuucccuauucugggaacugcaaacgugcacccaguccuuuugagaaacuaacacaagcacugauguagcugguucaguuuauuucagguaccuucucugauuuuuuuuuaacuuguucacauuaauuucauguaaauaucuugcauacauuuguagugguuauaaguacaacuuucaaaucauaaaaaauauuaaguagugaagaugucuucaguuuuuucuucauuugcuuauagaauaucccuuuauugaacuuuaggcaguauguacuauuagaaaggaaaggaugaacuguggggucagacaaaucuggguucaucuguuuuuuuuuuuuuuuuuuuuuuuuuuuuuuuuaauugagacagagucucgcucugucacccaggcuggagugcaguggcacaaucuuggcucacugcaagcucugugucccagguucaugccacucuccugccucagccucccgaguagcuggaacugcaggcacccgccaccacacccggcuaauuuuuuguauuuuuaguagagauggaguuucaccguguuagccaggaugaucuugaucucuuaaccucgugauccgccugccucagccucccaaagugcugcgauuacaggcaugagccaccgcgcccggccucaucuuuuguuuuaaucauuuacuaguuauguagguuuugaagaguuacuuagccuuucuuagcuucacuuuccuucauuuuuaaaauggggaaaagaauaccuaccuuacagguuuuuuaacaguauuaaaagugagauaacauaaauuaaaacacuaaggguuuaauaaacaauauguuuuuuuaugaguguguuuguauuuguuuauauacguacuuuuauuauaaauauaaauuauaugucuuuaaaagugcugugaaauuagaugcaguauuuucuuaugcaaauuaauaaacuuacauaaaguuuauuuucaccuugaugcaauagggaugauaguaaaaucuaccacuuuggauaguaauaaugucuaucguacuuguguaaaaucuauguauugugguaucaugagauguucagucuuauuaauggauaugaauuagaugccauuuuaguugagccucaccauaggugcugugguaugaagugaaguaugugggcuauagagacgaccuagguucaggccugccaccuacugccucugauuagccauauaguuuuaauccucuuuuagcuuuagcaucuucaucuuuggaaauguuacuuaccuguuagcaccauugaccacugugaagauuuaaaauggaauguguuauguaucuccuauuuuuaaggcuauuuguaguaaauauguuaagugugggcuaaucuuugaguuuagggagaccccauuaauauaaauuuuuuuuuuuuuuuuuuuuuugagccggagucuugcuuuguuacccaggcgggagugcaguggcgcgaucuugguucauugcaagcuccaccucccagguucaugccauucuccugccucaaccucccgaguagcugggacuacaggugcccgccaccaugccuggcuaauuuuuuuauaguuuuuaguagagauggguuuucaccguauuagccaggaucuuuggugccuucuuugcacuuuuaugaauauagucucuauuaggcauuuucuuucagaagagccccauuuuguugcaauuuaagacuugcuuuggaugguagucuuucuccuauagucuguuuucuccuuucugcuauaauuauuuggguuuuaaaaucuacccgugugguuaauuaugguagcuauuuucuacaguugaaccauuuuugcaguucugauuuaacucuacuuacacuguauuagucuuuuaauguacuuuuugcauuuguuugcuaauaugugcuuuugaaguuuuuaaaugaugcagauaucuaauuggaauuuauagcaagugcuuuagaaaaaucagcuguuuaauuucauuuuauuaucauuuugccaauucaaagugccuguuugagaaaaccauguuuucucaucuuacacuuugaaguuacacugaaauugaaaucuccagucuuucucuggcagccauuuuuaauaccuucugaacagauaaucugauagguuaaucuauaaucuugucagccacucauccugaaaaaccuuuuccagccauaucuaccagcacauuuccucuuaucuguuccuuccaacacucuuugcccugacaugcugccauagguuaacaaaugccaugauauauauccuaauucauaaaccccaggaaaccugacccauucaucugucuuuucucucauucauuucucucccuacccuuaaaauaccuuacgaaucaugauacuuacacauauuagggggcaagucauccaaaggugcaaauucuaauuaccaaaggagcaaaaaguuaaacuggaguuaaguugcagaauguaaccaugcugagucucaguuaucacauacugaauugugauaguugaaguugaaauguucaugaaaaaaugaaaguugaaaauguucgugaaaaauucuacaguuuuaugggucauuuguuuaaaguauaugcuagaaugguuugcaguuuucaaucuuuugacauaugguaggcacucauuuugcuuuuguaguuauacauuaguuuguguuuuuuagauuuauacauaaugaaaucauacaguguauaaucuuuuauuggcuucuuucauggagcaugauuauuuugagauuucauccuuguugcugcagaaaccagugguucuuuuuauuccugaacaguauucauuguuuggcuguaucacaauuaguuuauucaaucaccuguugauggauauucgaguuguugcuaguuuuuugcuacuaccaauaaagcagcaugagcauucauuuacaagucuguauggauauaugcugucauuucucuuagguaaauagcuagguguggaaagucuguguugugugguauaugguauacgguacauguuuaacuuaagaaacugucaagcuuuuucccaagaugguuguaccaucuuacuuucccaccaacaauguaucagaauucuagugguggcaguggcagcccaucuggagcagcugcugggaagacacuggcugcagcaggggaguuguggcuuggguugcaugcuccacaggugaugggagccccaccuccuaccagguuaguggggcagaggagccccaugcuccugggcgcaguugcagcugcccagcuacagcucuggaccugggcaucccugcacucucaggggccugcgaugccccuuccccugcaggcucggaaguaccugcuccaccucccuggccucucccugcucccagcacccgcuccagaacagagcaaaguuguggccgagccuaggcacuguugcgaccuggacaggugugccugcacucgaggcagugcugacaccagccccugcugccucagccuguucaggauuuugggcaccaaccaacacaggagugaggcugggguggggugauggcuaagggcagcuuggcacaggccuacagguguccccuggcacaaacagcccaugcaccauggaugcaugcugauggugggaggcagacauuccugugcagcaaggggcaggucucagugaaacccccaccuccaagccagggccuacgugaagucuggaggccagguugccaguucuggguggagucuguggccgggagugugaacuuaugguacuuuuuccagacaugcccauggcugcccauggaccaaucagcaugcauuccucccuucugagcccauaaaaacccuggacucagccagacugacacaaauguugggacuaccagcuaugggaaggagccacccacuuugggucugcucucugcugagagcuggacacuugucaggagaccugucugcagaauggggcuacccacugcccaucuccucuccacugggagcuggacacucauugggauaaccugccugcagaaaggggcuacccacugugggucuccucucugcugagagcuagacacucauugggacaaccugccugcggaaaggagcugcccgcuuugggucuucugagagcuguucugucacucagugaaguuccucucugccuugcucacccuccaguuguccacauaccucauucuucuuggacaugggacaagaacucugguuccaccaaaugguggaucugaaacagcuguaacacaaacagggcugaaacaugcccuccugccugccaugcugcagaccuugagaaggagaaaagagcugcagcccuuuggggagcccagaccuaggugcucccuaagccagggcuauggcacccucuuugggacucucugguuccuggcaucucccaccuuccaggaaccacuguguuccccucguccagaugugggugucugcagugguaguugcaugugauauaucugguccagccacagccuugcauggcaccaccugcccugccacagcuggcacgccuagcucugcacaguggccggacccugugcucacucacacaccgcucaccgcacuacgccuggcucacccuuggcagggugagaucugggccaguagcaccagccaagcacagccugccagcuugagugaguggaacgagcccagggggccugagcaaaacucggacaaaggcaccacuggccacagaggugucuggcuggaaaagugacacccuaaggauuccguaacacuaguuucucuguauccucaauggaauuaugaaguuauggucagugcuugguauggucagccuuuuaaauuuagcugcccuaguggauauguagugauaucucauugugguuuuaaucugcauuuuccuagugauuaaugaucaugagcaucuucauuugcuuauuugccauccauguaucuucuuuagugagguaucuguucaaaucuuugcauuuaaaaaaauggauuguuuuccuugugauuauugaauaagaguauuuuuauuuauucugaauuaagcccuuugucagguauauguuucauaaacauuuuuucccagucugugacuuuucacuuuuuuuuaaacaggaucuuuugaauggcaaaaauuuuaguuuugagaaaguccaauuuaucaauuuuuugguauaguuuuugcuuuuuguuuucuauucuggaaauuuuggcaaaaucaagguuacugugauuuucuucuguuuuguacuagaaguuuuauaguuuuaacucauuaagucuguaauuuaauuuuuggagaauugacauccacucauuuaauuuuuuuuuuuuuuuuuuaagauggacucucucucugucgcccaggcuggagugcagcagcacaaucucagcucacugcagccucugccuccuggguucaagugauucuccugccucagccuccugaguagcugggauuacaggcgccugccaccaugcccagcuaauuuuuguauuuuuaguagagacaggguuucacuguguuggucaggcuggucuugaacuccugaccucaugauccgccugccauggccucccaaagugcugggguuacaggcgugagccaccaugccuggcccauucaauuuuuaauuucaguuuuauuuuucaucuagaaguucuguguuuuucaaaucugcuugaugauucugucacuuuuuuccuggcuauauuuucaagccugucuuuuuuuaaaccauguuaaauuuugcauuuuacaaucuguguaauaauucuagaauccuuguaauuuuauuucugcuauaugcuguaauugcugguucugcuuugugaugcuuucuuuccuuuuuuguucaguucuuaagguaagcuuuuuauuuugguggaacuuugugggaauucauuuaggccuggacugaugguaaguugcuucaaagaggauuugcauuugcuucugcuacacucccuuagauacuaccaguuugggaucacuuaaauuaaauucucggcuugaguuuuuuucugaccacccagguagugugaauuuaggcugcagaccagacagauggcuuauaguuccauauucucaucaguaguuccccgcuacaucagcccgugacugaguuugagauaguccauuuucauugugaucuccuggggguagaguauagugaguuauaguucuguuuuauucuuacacugaggguuuaaccuaacucuggaguccuagcuuuacauaugugagaguaggugggggaucuuuuguuaacaucuauaucuuagguggauccuggguuuucuauuuuauucuucugguucugugaagcucugugaggccaugaaacuugaaaauaaaaugcacuugguucagcagaugcccucagcugaaagucagcuucagaaaucaagguucccacauauacuucauuuuuuuuuuuuagcaaaaaaauuucuuucuugccaacucauagaucucuuuaagaagauaggucuuuuaguuguuuucagugaaagaugaauccagguagcucauuucucauauugguuuuguauuuuaaauuuucuuuaaauguaaaauuugcuauuuuccgacaccaaaguaagaccauaaaaaaaaauagauaaugaucuuuucaaucaucuaaauuuacacuugaguuaagaauuacuuguuucuuuuaguucuuuccucaggauaucuaugccuguggaaacauguacaugauauagccuucauucucuggcaauuuaauauucuuuuuuuuuaaaggaugcuuaagagggagaucuugagaaguccagaaaaauacccagaggaaaauaaaaauuauugguacugucauuacucagagaaucauauuaauguuuuuauauauuuucuuguaguuauuuuacuuaugcauucauuuauucaacaaauauuuaucaccuauaaaugucagauugaaugagauagacucaguaagguacaagaagagaacaacuuuuucuuuacuaccuccucucuuuauucaacucauguuuggaugaacucauguucguuccuggcugaaauaauggacaggucucauagccuuuucagucccucuuaguuauuagcauagucucauuucagcaguugaaauaucuucuguagugcaauaaucagagauccaaacuugagauaaguucaauuaaaugucaggccucuuucacucuggaagaugcuacuucacuaucgggauuugcagguuaguuuaucgggauauguaguuaguguccucucucuuuuccucuuuguuauucuuauuuucccuaacucacuagcugaauuuucugaucccucuaaguuuaguccucagaguggaguagcaugggaaaaaagagcauggucuuaggaagugggaccaguugcauucugggguaaggcccucuggguggcccaaauacaauugcugaugcuuccuuucaugggguguuaugaagaauuuuucuauuuuuguuuucugagauuucccuugcaaggaagcugugauguagcugauaucuucuuugguugacugguuauggcuuuccuucucucgcccugggcuucagaccagccauucucaucugcguuacuucgcugcucaguccucuuggacagaaucuguugaaagccuaccauacacuucuuccugcaggcccauuuggcucauaccuccuugccugcucuccaauggguaucaacagcuuauccuuagcacagcugucucccuuuuaaauuuucucucucauaccuuaggcuugcaccuauucucuuucuuacccauccuugccuuccucuuguacuuuucugugcugucagagguagcucuuccuuuucauuuuucuaaggcauguuuagcacuccauacucugggagcauaugugaagcucaugaaguguucccaguaaagcgccuuccacuuggcaugugauggaugagauauucuucuaugugaaauguugagagagcaggaaaaauggcauagcaucccaaucaucuucccaaagaaauuuuuucucucaagucuaacucuugucccuccccccaaaacacacccauuuuauaggacacagaugaaugauugcuauuguuggcaaaacaggccuuugaugcuuuagcuagaacaaaaacaucccauuacuccuguuucgaucauccagucagcagaguaucccucagaaccaagacuauguuacaggcacaguauugugugcugggaaagaaagcaguacaggcaaagucccuaccccucuugaaguuugcauuccaauggagaagacagacaaaaagauaagaguguguguauuuuuauauaugucaguuggugaaaaauucuguaucaagaauuaaaagcaagguaaggcgauagugacaagaaguacaauuuuuagguaaguauagguauaaccgauauucuugguauaugagacacauuuuaagaagacuccagugcugaaguaaagugugaugaauuuguguccuccuuuauccauacuauccagauucauguucucuuuauccucauuuuucugugucguaugagccuauguuuuucagauuguaacuuguaacccauuggugaaaugugaaguccauuuagugcgucuuaaccagcauuuuuaaaaaguuaaauagaaaagaauaggaaauagagggcauuucaugcaguaagcuaaguauugucucaugaauauuuguuuugguuacauguauauauguguacuggguugugauguguuucuuaugguugaucauaaaaguuugaggaacauugcucuaugaaauuacaguuuucagccuuuaaaaaugcaaaguuaagagagaagauuggcccgcaagagucuuuacugagaaguuagaaagcuuuuagaaauaaaauucagacuaccuuauacaauugcaaaagauccucugaagggaaguaaauagaggaaugguucugagaacacauugggauauguaagcuggacaaauguacucuuccaguaaaauaaugagccaugauccuuaccauauuccuuggaaaaaaguuaaauuaauggauagaauuuucccaaucucaauuaaaauuccucaugucaaagaaaacuuuacaaauacuuuaguuauuaacacaugauaaaacuuuauuauaaucuuauuucaaggcaaaagguuuuuaauaggccaauucagagaugcacucuuuguaacaaaauuuuauggaaaagagaacauaauuccaguagagaaaaacacaaauaaaaauguuugggugauugguuugcuagaacaagucuucuaccuauuagaguaugucagaaaauugcuuaaguauucuaucaaguauguuuuuuuccccuagaagaaaaaaaagaaaggaaccuuucuuguaugaauuaugucauucauacaagaaaguuucuuugccaaaccaaguuuggaacaauuuaucuuacauuuauguauuuuucuuaauuuguuggugucuacuaguaacuaguaucugauuuagcucuuauauguuuaauuauauuauauaauaugcaaauauucuguuguguucucaguagagcacauugacuuccaggggcuuugcaaccagaaaaagauuaggaacuaaaaguaaauuaauuuguauguauugacugcauacucccugccagguguggauuuuacaaggacauauacaaagcugaaagaaguguaaguaaccaagaauguguguaagagggaaguuacugaucuguuaaaaauaguucuggaagaccaaaauuuaagaacugaaucccuccuuuuccugcuuccccccauguauagcauaaaagucuuuuaaugauuaucuuuggguaaagagaguuagaaaagaaaucucauugcuucuagauaauaucauaauccuaaucaguggauaaaagaguagacuuguucaacuucucuuuugauuugugagauaggaugauuuggggggcugaaaagaugaauaaguaucaauaaaagaaaacuaaaacauaauuaaaauaagauauuaagagaucuucuguuucuuauuuuaucuucuggcccagaugaaacauuuucuggaguucuggguggacuuguaccuaaaauuuugauaccacuauugguaauuguugagaaauuguggaagcuuggagaugaacugauguuauuuuguuguuccagagggaaaauaaaauagguuguauagaugacugaguguaaucuuggacagguaagauuauuauuaaauuauaaaggaaugguugaugagcacuuagguaggaagggacaguagaaaaauaaccacuggacaucaccaugcguuucuuacaaauaaaacauuuuggucuuaaccuauuucauuuucuguuaggaaaauuagacugguagaaacaucuggaccucagcacagcuauugauagucucuuaauacccuuauggacaaaguggagauuugguuauguggcucccaaaaagauguugauuagcuaauguguugaugucugguuugaggucucuagugugccacaaacauccuauuaguuaacauuuuagucaauaauucagucaagauuuggagacaugcuuuucaaauuuguggacacugagguguguuagaaucagaaccaaaaaaguuuuugaaagacuugaguuuuuggaccuaaucuaacaauaugaauuuuaauaaggauacauuaauuuugugaugguagggggaauuuuugguagagauuuuuggaugauuucucggguuucuuuuuacucugugggugacuuuaucagaauaaugugcagcagaucuccccuguccugaaccaccuggaccuuuuucuuuugcuuugguuuaaagaaacuuacuuuccaaaaaaucaguagacuuagcuauauaacuuaagaucuauuuagcuauguaaguucauaauguuaugaaguuaauacuguuuuauauggaggaaaagaugugguugguguuauuaauuucucacuagugcaguauuuuccguuucacaaguggaauuugaaaucaggauuuuuguauuuaaauauccugucuccucuauaugcaguuuucuaggaaugauaaaaaccauaaaucauccuuggaacuugggauagccuaaauuguuuucuggauauuaaaacuaauauccagauuaucaugccuaaugacaaguuaaggugcuguguuauuuaaauuucucauuucuuucuacagugauggcuugagaugauguacugugacauucuagaauuuuguugccuuuucuuuauugauauucaucuccauuucggugacuauuaugaacacugggcucuuguuuauaguguuuccuuucuaggauguuugugauauaagguaaauuaaaaaauaaaacuauguuuuacagucaauacaauuuauguucauuuuguugaaaggcagaauguuuuuaaaaauacauauuuaaauagaccauuucagugaaguauguugggaaaggagacauaaggaaugaauaauuuggauguguguguauguauaugugugugugguuuuaaaauacuauuuggauuugaauucaguuugacuguuuuugaucaaaauaaaauguuuuaccaguuuuguaacccauguguuuuuguguucguaaguccaauuuaaauaucugcaggaguuaccccacccccucacuguagccccucuugcagaucuuuguuuauugacuuagauuagaaauggccuaaagcccagugauggucauuucuuguuuuaagauuuuugguuacaaaucugcuuuuguugccagauccaauaaagauucuugauuguuuuuguuaguuuuaaguucuugccaaagauacaauguauuauaaccaaaacagauguccuguuuagacaaguauauuuaggcucuaacagaaccuaaaauguaaauuaaacauguucagcauuaauguagcaauugaugaacuuugggauuguaucaguguuuuugauaaccuuuagaaguggaggaaacaaugccuuacuuuuucucugucuaaucuguuugcguauguacaguuuuacacuccuagauacuccuccaaacugacauuuuacugccauuuugaaaauagaguggaauucaccaauuuccuguauacaauuuuguucuuaaagagcauacaucagauuaacaguauuuucuguuagagaguucaguugaguagaaaaggauaguuucugagacuuuaaugcuuguaaauagguagaugaaauaauuauauauagacccucuuauuaaugguguucuuggugaaguuaggaaccauauuaggguuguaguguccauccuuuaggacuuuuaguaaccaucucuguagauaggguccagugcagucuuaauuucugcugaauucuguguuuuggugaacaacagguaauguagugaauucaagaugaauguauuucuauuaagcaguguuagcucuuuuuuuccaucauaguuucuaggguaaauuagaugugugagggauauaucaauugcuaccacuggaaccauuuuuacuuuaagauuguugacucuuuggccuauucuuauccauauuuuccucuuuucuuugggauuaaacagcuuacuguuuugccucaccuuuggccaacacguuuuaaaaaauguauucaguuucuuauugagggaauaucuagguuuuuucuuaaacuggguugugaagaauuauuuugguucucucucugauuuuaguugcauuaguugaauucaaaauuacugaaauccuuuguugagauccuuuucuuuugguuauauagaacuuggagauucgggggccagaaauugauaguugaaaacaguaguucuugaauucaccuuauuuguguuuuauauaucuuuuggcugcaguggggggucgguaaaccuuuugauucuguguauuuuauguggcuaaaucuuuguauuaugcucuccuaacuuaaugaaauaccucuuuuaaguuccccacauccguacauuucuaagguuacgcccaguuuaauucccauuacuuuuccgcuucauagcacuugcauuuugaaggaacccuaacauuuggguucacauuaugauaauuagguuucaagggcaugggggauuaaagauaucucaggucuaguugcagaauaaaguucagaagcacuuuuaaaacuugccugauugguggguagaggugcuuuuauuuauucucuacucaugcagcauuaaucccuauuucaucagguaccuacagugcuguaauucuagacgugaccuugggucuugauuuacuucagcuccgucuucuuuauaaaugugccaugaaagagguacaugaaagauagccaacaucaaagcgccuuuuaaaguaaauugguugauaggaauucccugguauuuaacacugucugucaaauguuucagcugguuugcauccuuuuacaagcuauugcuugcugcaugaaaagaaauuuaaagcaguuguuuuaagucuuggggagggugguugugauggugcugauggugcugaugguggugauggcagcggcauggcaaaaguuagccagagaagagaguaaaugagaaguuaagaacauguucuuuuucagcugugccccucccaagauuguuuuuguguuuuucuuuggguuggagagucuuuaauacagugcuuaugauuaagaggaggaggcacucaucuugguuaucagaagauugaagaggguggccaaagaaaagucaucaaacuuuagugaaagaaagaauaacaggcagugucaguaucuuauucagagauuguucaaccaguuuaacuuccagccuguuuauucuuuauugagucauaugagaagaagcuguaaagugggaaacugagucugaagaaagaacaaaggaaaaaggacucagagaaggcuugccauauguauuacggaauauuuauuuuccuguaaacauguuuuagaggcuguugucuguucuaggcuuaauauaugggguagaacuucuuacagcuaaguuuugaaacccugguuacuucuuuguuucauaaauauuauuuggcuguuucucccaacuuaagaaaaaaauauuuaaaagcauuuuauuuuuuggauuaucaccaugauugucuuuggaucuauuccuaucgucuuuacuguagaacuuucuuaaucugaauaguggaaaauagaaauuauggaauguuauagaagauauuuacuugccuucaaauauauacuuuauuuucaguuuacugauguaaccuugaccuguagagaucuuuaaaaaucuauuguaauaaaaacuuuuuuguaaauaguauuuuuaaugugcguuuuuacguauugaaaugcuuuaaagucauauauucucuugacauucuguaauauuguuuucacuuaccugcuuaucuuuuuauuuauauacggugaguauggaaauaaauuucaauccagaccuggacuugucaguuaguugaauuaaagacuuuggccuguaaaggauaagaaaccaacacaacaacugacacagaggcguuugguagugaccuuuucuuuucaaggaaagcagauauuugagacagacuguaaccaucaguauagaaugagcuacugagguuucuugggguuuuaugaagagagauagccuaguauguguguguagggagcaguauacgcaaauuauuugacaauugauucugugaugaagaaaguggguggagagguacaucuugcccauuugucuuuguuuuguuuuuguuuuugagacagggucucacuguguugcccaggcugaucucgaacucuuaggcucagccuuuugugaguaucugggauuauagaugugcuccaccauguccagcuugccccuuuguugacauaggcaaaguagaacaucuuacugucauugccauauaccauauaugguucagccccuguauuuggaagagugaccucugggcuuuagagacugauacuaggaacuggguaguagaaaaaagguuggaagugcuauaccuuucuauucaugccacauuuccuuucaaccucuguccugcuccccuucacaguuaauagcaucuucuuucauauauaggaugugugucuuuaauaauuugauaugacccaucauagucauagacaggagacagugaagcaugauauugcuuagaaaguuaagaucuuauuuuguaagcacuuuaacuuuccugagguggacaguuguggaguccuuugauugacuuuugauucaugcugcugcuguugcuuuuuucuuuuuuaaauauucugagguuuuguguauccuacguaauuuaggaucagcauuguuauagcacaugaauuggccuuaguguuguguugucauucaaauauauuaauuacaggcuaguccaaagcuugauuaauaagaguccaccuagucaaggaucguaagauauuacuuagugauaagcaacuugagcuugcaaaugagucaucagguuagcaguuaauggguauauuuuugacugauucuucuguuuacucaauuaguccauuuaccugaaauucccacuaccuuuugaagcauuuuucuuuuuccuuucaacauaaugguuuuccucaaucuaggacuacauaagaaguuugguaggccacucuucuaauuccugguuugaauuuagauaguuccauuguuuaaaccaugcugcugccaucauugccauugucauauucuacuuccuauuuuaaguuauguccagcaauauauuaggaauauuucuggcucagaauucagauuuugguaucaccaaaaauuugagggauacagaugcaaagaagccuuuguacugucuuucauaaggagaaaugcuuugaggaagucuuucuauucuuguaugcuguaauuucuagcauuuaaugauuuccuugucuucaagguucuaggcuuaauuugaguuaaaauucacugauuauacaagaggaacccagauaccuauuuucuuucuucucuucucuccuauuuggggaaucccuaacucaacccauuugggagacucuguaucugguuguaaauaggaaauacugcuuuuagaugguuuagacuuuggugagaaaaguaauaauuaaaauuucuaccaugaaaucagauuuuuuuucuauuuuaauaaaauuuuuauugggugcagaaagacuggaaggguguuagggaccccuguucaaauuuucggauuuuggacuugacauuuuucucauucaagguuuuugguagggaaguauaagaaguggauaaagaaagcagaccuaagaauaugucaguaacauauugggccuuugaaauaucuuaguucuuucagguuugauuuguuucuacucuucauuuuuuuacugcuuuuuccccaucuuccuucugacuacauuuucuuagugagaagugacagguuucugcuuacugggaaaauguaaaauguaucugucuuauugaauuuaauaucuugggggauauuugucuccaaaaucuagugcaugcacagaauccuuuuuugucauuauauagaagggaaauacuucuuuuaaaauccucucuacaguuaagccugaggucuuacuauaguacuguuaauuauugacauuuucacuaacauauucaggaauguuuugguuauauuggaugauucuuucacuuugacuaucaaaauuuauuuacucauucacacaacacauuuuuugagcacuucuaucuguacagugcuuggcaugguagagucaaagauuuguaaaagcauauccacugaccauuuuauguuuaacccagcagccucuucuaagcuguagcuuaucuagauuccuuuucaguuucguacacugcuguuuuucucuccugcuuuugguaauuguacuucuaagccuguuaaucauuuuuucuaggcauucuuguaccucuuccccacucuuaaacuuagacaacacuccagauauuuuccucacccgcuuugucuucucuguauaucuucuuuuccuugauaaucucuucauccacuucuggagcuucaucuuuugcaucuuguggguucuaagucuacauaguuucaaguucucaccagagacauggacucagauucaguggcuuaugcuagucucuagaguaccccucugguaccucaguuucaaccaaauuuagcuuuuugcuuuggcucccaaaccuauuuuuuauguguuuuuuaaauucuuuuauaagucccuccuuuacugauguuaauucucuugggcacaauguuuguacucuuugauuucuuauucugucauauaccccauucaaacuaccaugaaguccuguugauucugucucugaaaugugucuccuauuucuuccuuccaguucuucuuguuuaccauucuucuuuugagauguuaaggcuuucaugagcuggccucaaccuacuuuucauguauagucucuugauacucgcuucuuaacccaacacaugguguucaucauucaagcauuuauaaucugggucuccguauuuauuuuuacauuaugccauugugaugccauuuauuaaggaaucauacaguuuaaagaauuauguaaucaacaguuuauucauuauaagaauuagcccagaguuacaguuacauccuauauuuuauuaaauauauaagcuaaaacaaauccauuuucaacauuguuuuauuauucaaaauugccucagcuaaaucucuccugaucugcuccuauuauuuacaaugaaauuuuggcuccuguuuucaguggcuuccauuuaagugcccuuuccuuucauaccauguauucucagauagcaaugauuccuauaaacaagguaaguuggaauuuaguucuuugaauguguuagguggaaguuuucuacccuuuuguaguuaagagcauaggcuauggaaccagguucaaauuauagcuucauccuuuacuaccauggugacugugcuuaaguuacuuaaucucccugugucucuucaucucugaaguggggauaauaauaguaucuacuucguaggguuuucuugaagauuaaauugaauaguacauugaaaaauacuuagaauggugcuuggcacauaguauacaaucaguaaauauuagcaguuauuuuuauuauaacuucaaaauguguaauaauaauuauuauuuuugcucauccuguuuucuucccuugguauacccuuuccucauccucugccuaucaaaaucuuaccuaucccucagggccugacucagauacauucuccaugagauucucuaauuuaucucagguuagaauuaaucucacccucaucugugcucuccuaaaauuuucuguguacuuccauaacauuuaauauauagccgccuuuguacuguaccgauuuauguaacuuuuuucggaaauucauuuaugacugggguaggaagaaucaucauuguucaucccuuuggaagauaguucacugauuugcccauguuggcacucagaaauuugaauugauuuaaaacuugcuggccccccucccccacacauaauguauguggagaguauguauauauauucauauuuauauguaagaaccuucugugaauaaggcacucccauaaggacuauggaagauauaaaaaauaaaagguaugcuuuucagauuaaagcuacauuuuaaaaaacauuucuaaaaacuauggaaacaacuuaaaaugauuaaaugaucuguguucccagaucgcacucagcuuaagacauguaacguuaucaguacuuuugaagucccuggcugucccuucuuuuucacaucucuugucuuccccuccguagcuauucaugcucuugaguuuuguguuaauaauuccauugcuauuuugcauguuuccuuuacaugaauccuaaucuucuauaacuugauuuuucuuccuuaagauuauuuuauauucauucauuuugauauauuuaacugugauucauuuucaguggugcauuacauaauuauacaauauuuuucuauuuuugaguugauugacauuuggauuucugauuuuuuuuauuguuuuuggaagucuuuauucauuuauuuuguuuaacaguuuuacugagauauucacacaccauauaauuuaccuauuugaaguauauaauucagcgauuuuuaauauauucacagaugugcagcuaucacuacuaauuuuaaaacuuuuucaucucaaaaaccuguacacuuuagcucucacucccuucucucccaucaccgcauucucaccuucccuacuccagcccuaagcaaccacuaaucuacuuugucucuauagauagauuucccuguccugaauauuucuuaugaauggagucauauuaugugguguuuuguaauucacuucuuuccguuagcauguuuucgagguucauucaugucauagcauguaucagaacuucauuccuuuuuauggccgaauaauauuccauuauauggauauacaacauuuuguuuauccauuuauuagucgauugacauugaguuauuuccacucuuuggcuguuaugaauaaugcugcuguaaacauucguguacaaguuuugguguggacauaugggcucauuucucuuagguauacaccuaaaaguagaaguauugugguaacucugugauuguuuggggaacugcagacuguuuuccaaagugguggcacucuucugcauucccaccagcaguguaugaggguucugauuuaucuacaaccugccaugguuaccugacuuuuuggguuuaaccaucuuaauggguaugaaguaguauaucauugugguuuuugauuuggauuuuccugaugacuaaugauauugagcacuucuucauaugcuuauuggcaauuuguauguauuucuuggaucaaugucuauucauauucuuugcucauuuauuuuuagaaccuaauaaaacacaugauaguauguuuaauuggugguuuuaauucuuuaaaaaauguuaauauuuucuucaaauugauaguaaaaaucauagguaucauguacaacaugauguuuugaaguacauauacauuguguaaugacuaaauggagcuaauuaacgucuaucugcauuaccccacauauuuuuauaguaagaacacuuuauauccacucucagcauuuuuuuaagaauacaauauauuguuauuaacuauagucaccauguuguacaguagaucgcuuaaacuuauucuuccuauaacugaaacuguuacuauuuuuuauuuagauaauuugucuuuucauuacugaguuguaagaguucuuuauaguucuggauacaagucccuuauccaaguguaugauuugcagauauuuuaugccauucuguagguugucguuuuacauuuuuguugauuacauuugaagcacaaaaguuuuaaauuuugaaguccaacuuuucuauuuuuuccuuuguuguucagauuuuuggugccauauguaagaacacuuugccaaauccaccgucauaaagaugagcuccuauguuuucuucuaagaguuuaauaguuuuagugccuacauccauuuaguuauugacagauuuugaguuaauuuuuguacaugguguaaaguaaggguucaaauucauuuuuuuugccuguggcuauccaguaguccuaccgacauuuguugaaaagacuguucuuuacccauugaaugaucuuagaacccuguccuaaucaguugaccguagacauguguguuuauuuguaaacucucaguccuguuucauugaucuauaagucuauccuugugccauaaccacacugucuugauuuuuauuguuucauagucaguuuugaaauuggaaaauaugagucuucuacuuuguuuuuucucagauuguuuugguuauucagcauccccuucaauuccacuugaauuuuagaaucagcuugucaauuucuccaaagaaaucaacuggaaaucugauggccuuugcauugaaugaguagaucaguuuggggauuauuguccuuuuuacaaucuuaagucuuuaaauccauaagcauuugaugucuuuccacuuauuuagaucuuccuuaauuucuuucaacaauguucuguagcuuucagaguauaaguucgauacuucuuuuguuaacuuuauuccuaaauauuuuguuguucuugaugcuguuguaaauggaauuuucuuauuucauuuuuuuaauuguuucuugcaaggauguagaaauagucgguuuuuauaauugauauuuuaucuugcaaacuuguugaacauguuuauuagugcuaacaguuuuuaguggauuucuuaggauuuucuauaugcaaaauaauguuaucugugaauagagaucaucuucuuccuuucuacuauggguauuugucuuuuauuucuuuuucuugccuaauuaccauagcuagaagcuucaaugcaguguugaauagaaguggcaagagcagacauucucaucuuguuccuguuuuaggggaaacauccagucuuucaucauuaauuguguuguugacuguggguuuuuccuacaugcuuuuuaccugaucaaggaauuucccuucuaauucuaguuuguugaguauuucuaucaugaaaagauacucccuucugucaaacuccuuuuuuuguuucugcgaucauaugaauuuuguuuuuaauuuuguugacaugauuguauguacuguauuaauugauuuuugguuguugaaucagucuugcauuuuugggauaaaucccacuuggugaugguguuguuggauuugguuugcuaguauuuuguuaagaauuuuugcauucauauucauaagagauauuauuugguauuuuuccuguggugucuuuuuuugauuuugauauuaggguaauguuggcuuuuuagaaugaauuaggaaguguucuccccuccuguuuuuuggaagaguuugugaauugauauuaauucuuuuuuuaaauguuugguagaauucaguuuuaaaaccaccuggauuguggguauuuuuuuuuuaauuacaaauucaguauccuuauuuguuauuggucuauucagauugucuauuucuuuuugagucauuuuugguaguuugugucuuuccaguaauuugucaguugcaucuuuguuaucuaauauauuggcauacacaguuguucuuauaauaauuuuuaauucucuaaggucaguaauaauguccccuguucauuucuaguuuuaguaauuuaagucuuucuuucuuucuuuuucuuggucagucuagcuaaugguuugucaauuuuguuaauauguucuaagaaccaacuuuugaguucaacuuuggaguucauuucuuuauuauuuuucucuucuuuguuuuauuaaguucugcuguaaucuuuauuacuuccuuccuucugccuacuuuagguuuaguuugcuuuuuuuuuuuuuuuuuccagcguuuuggguggaagguuggguuauugauuuaagauguuucuucuuuuuuuaauaugggcauuuauaacuauaguucuuagcuauauccuuuaguuuuauuucuuaaguuuugguauguuguguuuucauuuuuauuuaucucaaaguauauuuucuaauguccuuuuucauuucuuuuuugacucauuaauuauucuguuucauacacauguugaguauccuuuauaucacaugcuugggaccagaaguuuuuuuaagauuucagauuuuagaauacaucugacccuugaacaauguggagguugggauguugacccccucuguguagucagaaauuuguguauaacuuuugacucccuaaaacuaguaauagcuuacuguugacuggaagcauuauugauaacauaaacaguugauuaacacauguucuguauguuauacgucuuguauucgauauuguuacaauaaaguaagccagagaaaagaaaauguuaagaaaauuguaagaaagagaaaauauacuuauuauugauugaguggaaguggaucaucauaaaggucuucauccuuaucaucuuuauuugaguaggcugaagagaaaaaggaagaggaggaguuggucuugguaucucagggauggcagaaauggaggaaaauuuuaguaugauucaaacccauguuguucaagggucaacuguauuugcauuauauacuuaacaguugagcaucccuaauccaaaaugcuccagugagcuuuccuuugaguaucauguuugugcucagauuuugggccaggcaccaugcauggcucaugcccauaaucccagcacuuuggaaggcugagacaggaggauugcuugagcccaggagcucuagauuagcucucgcaauaugguaaacuccaucucuacuaaaaauaaaaaaauuagccuggugugguggugcauaccuguagucccagcuacagcuacuugggaggcugagcuaggaggaucacuugacccugggaggucgagguugcagugcaugccacugcucuagccugggcaacagaaugagacccucugucaaaaaaaaaaaauuucagauuuuggagcauuuuuuuauuuuagauuuuuggauuugggaugcucaaucuauacgauauuuuguuuauccauuugucuguugauguacacuugggugauuuucaccuacuggcuauuguguauagugcugcuaugaacauugguauacauuaucuguuugaaucucugcuuucuccuuuuuuuuuucuucuuucuuucuuucuuucuuuuuuugggagauaggauguugcucugucauccaggcuagagugcaguggcaugaucauggcucacuacagccucaaucucccaggcucaagcgauccucccagcugagccuccugaguagcugggacuagaggcacgugccaccaugccuggcuaauuuuuaaauuguuuuguggagacaggguuucaccauguugcccaggcuaguguagaacuccuaagcucaagugauccucccacuuuggccaccuaaagugcugggauuugaauuccugcuuucaauccuuuuggauauauaccuaggaguguaauugcugguaauauauauguaggaguguaaauauacaaucaaauuguauauuuugauuuuugagaacuaucaaaucuugaguuaucauaauggcugcaccauuuuauauuccuaccagcaaugcaugagggguccaguuucuucacaucuuugucagcacuuauuauuuucucuuuuuaaaauuauagacaucuaguaggggugcagugauaucucauuuugguuuugacuuacauuucccuagugacuaagauguugaacaucuuuuaaugugcuuauuggcuauuuguaucucuuaauuggagaaaugucuauucaacuccucugccuguuuucgaguuugguuuguguguguguguguguguguguguguguguguuuuccuuuuuguuguugaguuguaggaguucuuauauauuguggaacuggcacuuucccccucuguguuucuagcucccugcagucauugggugucaucuagguaguggauuuggaacgggagacuucccugacuccccuugcaggacgugcgacagggguguggcuugucuguuuaguugcugccgcuguucaaaccucuuaugggagggggagcaugcggacagacaguugcaggagcccaaguggacauauguuacaguguguucuuuuagccuugacguccauggauggcuuaaguguuaaccagcucagaggacccucugccuuuuugcaagggcagagggccauugcaauagcuuucuguaucccaagcuguuguccaacauccuggaagaauuggguuacacauggacuugaagagugugaauguggggguuuuacugagugguggagguggcuuucagccagauggaugggagcuggacaaggggauauagugggaagaugaucuuccccuggaguuuggcuguacaguggcugauucuucucuccgaccacccccagccaaacucaucuugguguucagaugcuccuucucuccucuuucucugcugcgccauucugccauuugcuugucucuucaucugcuccuggagccugggguucaggguuuuuauggguucaggauaggaaggcauggugggccaaaaggcaacuuuuugggcacgaaaacaagaaugccuguaucucacuagggccauggauauccagguuugaggguggggccuuugccggggaacugcccucuucucccccguauuucccugucuccugucuguagcaaauucagggaucuuguaacugucaccagaaaugccuaaagcaaacagccuguggcagugucagcaggugcuaauccauauucucacacuacugccuggacuggccauggggcuuuggaggagggucucuucuggaucauccucacuagaaccagauugauagcuuuagcauaugugcuccugcagacaugggcuugacuugacccaguaacagcacaaaaguaccauugaggccagguacccugcugcuguuuuugugcugcucaugcugacagcuuguuggacucuauuuggcugacaucuggaacaucugucuuuuuaaguaguauuauaauugccugggauguaauuuucuauuuuuuuacuuuuguccuguuagugucucuugcuuuaaauguauuuuuucuaaggauaaagaacuuguacagggcagugguuaagaucaucacuuuucugucugaucugccugaguuugaaucauaauuccaauacuuauuagcuuuuuggucuugguuugguuacuuaacccuucugugccuuguuuuccucauauguaaaaugggaauaauaauaaauaguaaccuuauaagguuguugcaaggauuaaaugaguuaacauaugcgaguacuuagaagaaggcuccauuacuguauagcagagacacaugccaccuucucugaaagucaacacauuuaacaagcaucaaagauuucuugaaacuaaaauuccaggaaaaauaaacaaaaauuuuuaaaaaaucacauaauguaugugccugaguuagaagaagggacaaaauuuucuuuugaaccaccaaacacugcaguugucggaauuacugaguaaagaauauaauguaagaauguugaauauauuuaaggaaaugaaagaguaugaauggaauaaucaccuuuggaggacacaggagacacaaugaaaaucaugcuuaaucaaagauacucuuguaaacuacuuaaguggccagcaccuggguccuuguaagcguuaacaggccagaugaacuuuuuguuucuuuacuuuaguuaaggcuuuuguuucccuggaccaauggcggccaagguuuaguuugaaaugugugggucugaagugaggugguagugaggccagugggguccccauguuguauaguuuaggaccccugaguacaggaguaugaugaggguuauaaaguuguacuguuugucuuuucugggaauaacugaaauuuuuacuuaucuauaaaaacuaaacauuuuguuuucuuuuuuagugcccuccuucaggagcuaucuuguuuaaccuuuguagagcuauaaauaugauuugauuaaaaaauuauagcuuauagucacuccuagaauagcuuuaaguuuuguuacagcuuuuugucuuaccuaccaauuuucuaggcuuucucaauauacuuugcuagaaauucugcuagagaaaaauggugagauuuuuuuuuuuuuuuuuuagccuuauucguucuuaggagcucacccugagaaagcucaaaucugucauuucucucugggaaaaaugagauuuaaauaauuuuuuuuacuuguacaaaccaaaacaguacauguuuuggcaguuuguaaauuguugccucauuaacguaaacaaaacaagucaaauuagauauuuguguuugaagagauuuauuugcugcaauacagcuguauccuuuauauagaaaauuuauagguuguuauuuuaugaucugugcuuuuucagacuaucccuuuauagucuguccaaaacauaaaaaagauguuuccuugguugauucuuacaaaggcaccaaacauguuguauaaauguaaguuggaagauuauuaccgacuuguccuuagucaugguuuccauguaacaaggugcuguagauuaagguaaugagagguaugagguggggccaugaggccucuaccagccucuaaauucuuuuucucucuuccacuccacucagcaaacaacuggacugacaaaugcugccagccuaguuuggaaauuauaauacgguucugucauucauucugcucaaaauaaucucauauagcagugcucaaguaaauuagaagguagguauaguggauaauuacuuaaauauucaguagacuuuuugaaggggcaguaucgcacagcagagccagauaucugguuuccacauaaauuuggauauuuugcuaguuuuaugcucuugggugaauuauuuacuuucaguuuuucuaccuguaaaaaugaugaugauaauacuuacaggauuauuguggaggcuaaauauauuauuguauuucaguuaaucuaggauguuacccauuuuaagacacaccuuuuuaaggguaacuuuaaggggaaaaaaagccugccuauuaugauauuacacuuucucaucaaauaaagagagcuuuugaauuaucaucaucaucauuauuuuuugagauaggcucccugucacccaggcugcagugcaguggugcaguuguggcucauugcagucucaaccucccaggcucaagggauccuccaaccucagcccccagaguagcugggaguacaggcacgugcugccagaucuagcuaauuaaaaaaaaaauguuuuugguacagacaagaucuugcuauguugcccaggcuggucugacaccucugggcucaaacuaucccccugucuuggccuucuaaagugcugggauuauaggugugagccaccacgcccagccuugaauuaucuagacauaaauuguuaucauaaguuacucuuguacauagaaaaaaauaaaauauaaacugaauaaaauugaccaaguuauuucugaaacucauauucagagacugaguugagaguuaacuuuuacuuaggauuaacgggaaauuucugauuaaugcuugaugacuuagcuguauacagacuuggucagaacuugucacauuagucuuucauugccgugaaauugcuuucaccuaauccaaaggauuucacaguuuuuucugcuuuuaguugcucugcuguaaccuacuuguuuuuuagucuucuuuguuaccacaacauguuauaaugaacucacuuauguaaaaguugaguucuaauugaaauuaaacauauuacaaagcaaugugauagucguaaaaacaggaacagagagcaauaaaaacaacagaaaaugccaaagcagagcuaaccauuuaaaagauaaaacacacauagaaaacaauaggaagagaacauggccugauaacguuugaacugaauuuuaaacuguuuaaaugauauuuaauuaugaugauuauauggugcuuuagauacccucauuacuguguaugaauuaguacaacccuucugaagagcuaauuucuugguauauuuuaacuuuuugcuauaacauugcuauguauguuuuuagcuauugggcugcacacuuuuuaaaauuuaaggauuaguaaauauuggcuaacauguaagcuccaugggugcaggacauguuuggguauuuauuuacugauguauccucagacauaagagugugccuagcauaugguacucauacauugagugacucaauuaauauauucuguguuaaccagaaccuauggauucuaauauaucuuuuauuuauauuaacaaaaugccuuuccugcagaaccauguuaaaauuccuuacagcaucuauauggugaggguacuuagcuuuuuuuaaaaagcaauacuuuuuugaugaaaucagaauguauguuuuuauaccucuacacuuacaaauuaagaauauuuuuauuguuuuuguggaacuaucuacuccuguaagcacuuuuaacaguacagaauaauccaaagagcaauguagagaauuaucucuacuuccuucaagggguaacaaucauuauuguauuggugaacacuauuccagauauaucuguuguguguguguguuacauaauuuaacagugauaccuguuuuuuccuucacucauuaauguguuacagacaaguaccauuuuaaaggcuucucaucauuuuuaaggauggccgaauaguaucuuauugcaugugcauauuuuaugguacuuuuucagaauguggauuuuugugggggcagggguaccauuaagcacacagaucccaccuuucaaaacagcuccagcugcugcuuaucccuaauauuuauuuucgaaaaguaauaguguacugucauauauuuuuguuuacauguuuggaaugucuauuuuguccccuuuuuaagagcaaaagauucucauuuuagcccuugguacaauucauauauuuaguguuauauauaaaauuuuguuuuuuaauuaaacacaguuccuggcacuuugaaaugugcuaauuagaucuauccuuuucuuuccucuguguuuaaagucaaggcugaauacuugacuaggaguguuuugagaguggaagaaaaacauagguaacacagagggcaaggcaggggcugcugaaguaguuauaucuagggauucccuuuagagugugucugugggacuugucauggagugaaucagccaccaugcccagugauuaugaaaaggugaauuuaugaccugccuacugaugauagaaauuguugacaguggucuuucuguauagagauaacuuagaaauauuacaacauuguacuuaaaucaucuuucaggucuuucuuggcugcugauuuucuuucuucauguaaucuauuuuuguuuucauaccuucucuauuaagacaacaaucaggugagaaagaggaggagaaacagcauagugaucaguuagggguugucauggugguagagucacugccuccuuaggagguaauauagugccaagucaaggagcguagacuccagaguuauacagucuuggauuugaaccucagcucugcuucuugcuagcuggcugacuuugggcaaguuuuugaaucuuucugagcuucaguuuucuaaaauacccacaucucaggaauaugugaauuaaauaagauaucuacgcuguacugaauauaguauauagcucacaauauggguuaagaauauggguucuugaguaagacugucugugcuuagaucccagcucugccaccuacuaguuguauaaccuuuaacaaauuacccaaccucucuaccuucguuucuucagcuacuauaugggauaauaauagguuugcugugauaguuaaagaaauuaauacacauguaggauaacagugucugaccauagaaacugcaaauguuaacacucaguagcuaauaauaaaucuccuuuaauucugaaaugguuccacauguauauaggauauaauuucuucuacucucucuuguucccauguucucauggaauuugcuguucuugagcuugaaacaguauuaauuuccaagugucuuagucauauugcucaguguuauguuuucuuaugaaauacagaaauuccuuuuaaaauuaaaaagugacauccagugauuaaaagacugaauaagaauauuugaucaagaauauggucuguuacagcuguucauagucuaagauagacuuggaguuuuuguuugaaaaugcuuugaaaauuguuagugccauuaaauuuguaagguauaaggaaguuguuaguaauuuuaaaagugguuuaagugcaaauuggaacacuuucaaaaguauuuauuccagagagacugggaugaaaauagguguuuccucuggaaauccugacugagccuauucauugaguucuguaaugauagagccagaagaacucagacaguuucaguacccuccccgccgccaucccauaugauucuggcugagaaggauccagaagugugacacguuuguuuucauucuagccauguauuauguaggcauauaagaaaauuauuuuucugccaaauuuuaguuuaaauguuagcuaaaugacuuguguuggaaugcacucaguagcacuuuaggaguuaaacgcagugguaaagcagucguuuuuuucccuuuucauagauaaguugucacaaauuuuauuuuucauauuuuuuuugagguucauacucauacacuugugaaacuauauuugcauuauuuagaacuggugguuauccuggauguuacuucuucacaacaaauggccccuacuuauuugcuuuguuacuauuucaccacuucguugaaugugauuucaugaacuggaaauuugugaaaaaucagguuauaggaaauaauacacuuaauuguaagaauuucaaauguacuuuuucuuagagaugaauaaaaguagauuuuaguaaauucuuuaauucagacuuuucguaaucauaucccauggcuuuacugcuauuuaucaaguauuuuuauaccuauucuuauuuauuucuuacuuuaaccccgugguuguaaguguuguucacaguugauaggugaggaaacugaacugaaaacugauaaacuaauaugaugaaagaguuuggacuuaaguccaaaucaucugauucuaaaucucaaaguccuagcacaccaugcagccuuuccaccucuccauuguuuuaauaugguagcuauuaccagaaaguuugaauugagagaauaaacuugucuuuagcauccuuuaauuuuuaccuuuuaucuuugguugaggagacaauagcaaaaacaaacaaacaaaaaaaaacuguuuugaacaagaccgaauuuacauucagauuaaugaauuuucaucuuuuuuucagcauuaaagaauuuucguaaauuauacaugauacgguauuugagucagaauacccucaaagaucugcucuaacuccucauuuucuugaagggaccugagggcucaaugaucaagccagccagaguuuguucuuuauagguccuaaacucugccaaauaguuuuuauuaagguugugaaauauaacaccuuuugaauuuuucaucuucuucaacuuuuaugcacuuuagaauucagcaugaagagaauuugucucagugcuaggcugaaacgaaguauuuuauuaacuggucaguuguuuuuuuuuuuuccuuaaggggcauucuggagaagaggaacuuucagcuuguaaucuagcccuuguuacauaacuagacuacuagacuacauaccauauauucucauuauaacuggacaucuuuuuugagccugaaaucucagcagauggcaagaaauaguuagggauuacguuugggcuaacacaguuucguaugaugaagaauguggggaaagaucuguccagcucucuggcaugcuauccuauggauauguucuugcuggagccaugggauaaaaauuauagaagaauauuguuagggccaggaaggaaagaguuucaaaguagaguuugaggccauggggguauauagcucagggguagagcauuugacagcaaaguagagcuugauuucuugcuuuuugauuuugcuuucuguugucagaggggcauguguucuggggguaauuuguguguuuauugugugcuugcuugguccuucucagcaugagguuugugucucuuucuacuucccuuaguagguuaaaggggacagaccuuuuuuuucucuaacagaauuuggagguccauauuuccaugacuagccuaggaauaauacaggcauaaagaaaaauauucacuuacacaaauuccaaacauacaaucauaaguuaaaaguucauaaaauaagggauaaucagcacuuuaccagugaaucuuuggcaauguaaaaauuuaacuuuguaguuccuuuagcuggugagcucuuuguugcauuuaaaauggauuuugacuuauaaaaauucaguuuaagauuuucaugaauccuccuacacguaaagcacaaugauugucuuucuguucaaagcccuaguugguugucacauggaaauaguagaguucgauauuugcccuugguguaaaugccugaauuuagugugccagaaaauuguuauuuuuuggaauuuaaaaguaucucuucaacagauaaguacaauuuaguauguugauaggauuauccuucauagauucaguuuuucuuuucauuggguaagugaugcguauucucaguaaacuaggcugaaaguuucuaaguccagaauugugguuccaauaggacucugaaguuacagauguaguauucaagucaugcaaauguauguaaacuaaggaaguauggucuauagguaaaacacuuggagaaaugauagucaauuacaugaagauuuucuuuccuuuucuuuaagcagccuucagguuuagaagcucaaguuagagaaauaguguuuuaaccaagaaaaucccuuuggcaagacucauaucuugacaaaagcauguuggucugcauaccacuuugcauaaaagauguguauugcauuaacuauggagaagagaagauuccaguguauuucagccucuuugcaggauaaagcaaagcaaaucacguagccaugcugugugucucaaagggcucuuguguggguauuucaacuagaaaggagauuagcauuggaagucugugaucaugucauacauuuguaauugaagguggcuguugaaaauaauucuuuacauaacuggauucuagcagucuugaugagguaaguagaaucaauaggaaaugaucuguuugucacugcuuagccacaaugccaaaaagcuugguaucugggaauggagacuuuaaaaagcgucagcacugggaaguauuugauaauucaagucuaagaggcuucuuaugaaaagugcagaaggaauauaugcaugggaauauauaccauugaauuuuugccgauaacauuguuucucgccacaguuaaaauugaaacuuugaucacucuaguagccacaggucauuugaugauuuuugccaaaccguaaacuuaggcaacuuaaguaccugccucauguaaacggucuuauaugugagcauguuuuuccuguuauuuguauuucuauuccuugacauaaaguuuuagaacuuuuugggggaaguucaugaacacucauagcucuuucugguagaugaacaugacucuuacuucuguggauaaauuauaaauguacuauaaaaauucaucuggaguggcaagugaaaaagauacaguaugauuugcugccaagaacaucuuauuacaucugcauauuuaugcugcuaaugaacggauacugcuaacaagucaguuuccgaagauacgcagcuuuggcgaaacaacaaagugaacaggaaauguuuuucuuagaggauuuuauuugcucauccaaagcaauagaaaaacguuaaaugauuggugguagauuuuauuuuccuggagcaccuuguacagccugcaauucagucgguuauugugcuaagggaugggugcacugaccuugucaaaagagggagcaaggauuucguuugacuuugguuuguugguucgcaauacucauggauaucuggaucucuaaccuuggcuuuuuauaacuauaauccuaggcagucauucacuaugaaaacacuugugcuucucuuuuuuucuuuguauuuguucauuugaaaagccuuucaaaaaggaguugcagccugcaugugauuauagcuaucaguagcacuuaaccuaacugcugagaugaaacuuuucuuuuuggaaccugcuaauuuuacauaucaauagaaaaaaaauuucuuguacuguuaaaaggcccgacuuuacuaauugguagcuacucuuuggauugagcuagaauccuuagggacagaauuugauagaauaauuuuugacauuuuaauuugacaagaaacaauucagggaaacgauuuuagucuugggccugaaguggagucuucucuugcuguuugugauacuuaguguggggaaugccuuugaaacagcacuuuauaaacccugugauccauuuaaugugauaguucaagcugcuuggcuguuuuuuucauaggagccucaccuaaaauagucuaacacaguggaaagauuuuucuguauuuuagaggguaaugcaguaaauucuaaucuuugugagaaaaacauagcuuuccagaaggacaauaaauuuagguguaaaaugugugaauuguaugcuccuuuauccuuuaauuguauuauagucuacaucuuucuaacucaaaaaguacucuuuguuuuaaaaauaucccuucccacacuugaaaaugguagaauaagacuaauuuuaguuacagguucuuuguguguuuguguguauaucucuauauaacagaaaacuuacauuuuuaaauaaugaaguuaaagcuuuaaacaaguagaguauauacacacauaaacaugcgugcuaauuuguuucugaaaaauuaucuuagaaaucuguguuucuccaaguauuuggggggauauuuaaauagccaaacuagaaaugaaauagguguuugaaaaaauaucuagcugggcaugguggcucacaucuguaaucccaacauuuugggaggccaaggugagaggaucacuugagcucaggaguuugagaccagccugggcaacguagugagaccuugucucuacugaauauuuaaaaauuagauggacaugguggcacacgccuguaaucccagcuacucaggaggcugagaugggaggaucacuugagcccaagaauacaaggcuauagugagcugagacugcgccacugcacuccagccugggcagcagagugagacccugucuuaaaagagaaaaaggaaaaagaaaaauaucuggagacaaaccugguuucuaagccuggggaguagauuggaagaaagggaaaauaugaccuuuaguuucuucuuugcguguguguguguguguguguguguguguguguguguguguguguguguuuugagacggagucuugcuguguccuccaggcuggagugcaguggugcaaucucugcucacugccagcuccgccuccuggguucacgccauucuccugccucagccucccguguagcugggacugcaggcgcccaccaccgcgcccggcuaauuuuuuguauuuuuaguagagaugggguuucacuguguuagccaggauggucucgaucuccugaccucaugauccgcccgccucggccucucaaagugcugggauuacaggcgugagccaccaugcccugccuuguguguguguuucuaauacguaaaauuuuguuuuuuacuagguaagguuagaaacugauacucucaaauuugcucauaauagugacuuauucuagaugaggaaaaugcauugauuuuauuaacaauauaucccucggagauuaggguagguagaugauuuggagaaguagguugcuugauaucaauuaguuauguugcuucagaacaagccauuauuaguuuguaucguaaguacuuuagugaaagaaaaaauuuuaauggauuugguggucaugucaauuuguguacuagcauguauucucuuucucugcaccucccugcccccaccucccaacucaccgugcccugcaaacauuuuucugucugcuuuuuuucuuucucuuccuuuuuucuucucucauuuaaacauagggaaaauugucuaagaaugccugugacuguaaauaauucguuucaugaagacuuaugacuuuaaucauuuuuacauuuauuuuaguaaaaaucauuuauuaucuuuagcaauucacuggguaaaauugcucauaaagaagaaauaucacuauucuauuuuccucuaagaaaaaaaguucuaagaauaaaaaagucaaaguuaagucaacauagcauaucacacauugaguuuguauucuaacauacuuuuguuuuuguuuuuuuaacuuuuaacugaaaauaaugcuggaauaugacuccaugugugugauauacuacaauaauauuagagauacuaauuucacauguaguuguccuaauuuugaguuggaaaacuuaacaggaaaaauucacuggaguccugucauauaaaagacuauauuuuuaggacaacaucaaguccuuuaaaauuuauuuuggaauggaggcuuuaugcuuaaaauaaacuuaggggaaauaaaauaauuuuaaaaguuucuucagccauuguguauaguuucuguuagagguaauuuccagcaccggaaaaucaggaagucuguaguuuaaauucuucaguaugagauuauauugccaguuuucuuuacacaugguguucaguauguauuaagugacagcuguaacuuuucuuuuccucuuuuaccuuugggaauuucaagaacacagcuuuagcuuucuucuaauuuguguuauuuuuuauauuuaaaaacaauuuucaagaauauauacauuuaaauuauagugugacugaauagcugaacaaccuucuaaauuuguuuagcauauuguguuuuaaaaauuauguaaauaucuaucggucaggcuuuaagaacuugugucaggggacaguaagaagggaugggagaaaugucauuccuuuuagguaagauuagaccagguuauguucauuuauuuauuuauuuauuuugguucuuuuuuucugccacuuaugaauucaucugagcauugagaauuguuaagauaaaauguauuugccaaaaauuaggcccaacaauuaaguuugaaaauugccagggauaucaaaagagauuuuagacgauuuucauggcuuuaagggagaauugacugaauauggauuauuauuauuauuauuuuguuuguuuuuguuuuuuguuuuuuuugagacggaguuuuguucuuguugcccagguucgaguacaguggcacgaucucagcucacuguaccuccaccucuuggguucaagcaauucuccugccucagccucuugaguagcugggauuauaggugcccgccaccaugccgggcuaauuuuuuguauuuuuaguagaaaugggguuucaucauguuggccaggcuggucuugaacuccggaccucaggugauccacacccgccucagccucccaaaguacaaggauuacagacgugagccgccgcgcccagccuaauauggauuauuuuuaaguuucagagaauguucugugauuuugauaagcauagucuuuugugauuuggcuuaaucaaagagguugaaaugagagucauuagccaagugacauuuaagugccuugguuugucugcuugcuuuucuguggauugaaaaaaacugaccacuguuaauaugauuguacagugacacuggaaauuaugagaugugugucugguuaguccugcuuguauuucaguugagauacauaccaagucugauaaugcagagcuuuuccauuucaugugucuguuuaccauuuucaugaucuuaagcaauaaacauuucuugacaacagcaucagaccucguuuuuaccaacacucauucuuuacuauacgccaaacaugagcacaaauugguuuuuauccauauuaaugaaaaacaaaacccucuauuucagucuauaacacagauacaugagaugcuaggaagucuggaaucaauuaagucagccaagugugugggaaaaaagacagcagacauggaaaucauaucaaaaugacuuguuuuaaagaacuggaaaccugcagacuaaauggugaauaagaaauuaauuuagaaaacacuauuuaauaugcacuauuuaauuuacauuugauuuuuaaacuguagaacauacgugugagaguacucuuggucuucaaaugacuaugggucuguauuaauugguguuuuuauccuuuucaugcuguauauuuuaauuggucuuagaagaagaucugaaaauacaaagaugagaaauuacuugagcauagaguuuaagaauaguacuugcuagcugaugacaaggcaagauaauauaggcuccccugggcugauuuagugugaaauaggcacaaguguauggcaaauaaaugucaguggggaauaaaaaaugucauuagggaguaaaaaagcuggaggaaacuccagcuucucugugagagaauuagaagaucauaccuguucuagauacuuccaaaggccuuucuguuggcacuguuuuauguuaaaguauuacuaaguuaaauacaaguaaaguccuggcuccugcuugugcuuuaucuugugccauaagagaggaacugaggugguuuugaaguaugaaucuuugucccagugaucccuuuguguauuccaauagagaauaaaaaccuaaaugagaacaaauuugcuuuuuccauggauggauuguauuauuaaucauauacugcucaucugagugaacccuaguuuguuugauuucugauguaucuaaccagauggcuugacaguaaauacuccucccuaaacaaaucacugauuuguaugcuucuucagcaucuccugcuuugaauauuccuuaaacauuauuacucuuucuuagacucaggucugaggagcaacaaaguauacuaucaugccaauuguguuaaccucuggagacaaaaaugauaauugacugacauucacaaacaacuuuuaaaagccuccaaagcuuucuuauuauugggaaaaccagugaaaagaugacugggaggagggauuaggcagaggauaucuaaauagaaagaagucugaccuaacaguccagagaucagguuuuuccuaagucaugguuuuagauuauuuuggucugauuauuuaacucuuugggucucucuuccuccaaauauggggagcuuacuuaugauccuaacuuccugauaaagcuguaaauauuaaaauggguuugaguuaauagauccuaaaacacuuucaggaagcucuuaaguauugugcaaaugcaggagauucaucuuauuuacuuuagaauaacugaaaaggaucuugagaaaauuauacucauuuguagacuuaacaaagaauuugguggccauuuucuucucugcauagaaggagccaguuugaccaaauuauacacacaggauacggacaggugccauugugcucagcuauuuucccuuaugugagagccuugaguuggauguuucucugggcagcuaauccuuggcaccacagcuuuguucugauaguggcaucuggcacuagauugauuuaacugagccugagguuugcucuuuucagaaugugcucucuaggcagcuucuuuguggcucugacaugaccacaugcugcugcugcuuuuucugccuucuugcuccacaugugaggcuaagacauucugacaccugccauuuggaaccuuuacuugcugaaaaaugucaagauuuucagacaagaugaagacagauauaacugauuuuuuccuuucucaggaagaggcugagggcauuuguucauagauggaugaguugcugaagugguacaguucauuuauuuuugagagugcaccacagguuuuguguagaagacucgguuguguuuauguguccuuauucuccuuugcaccuauuuggugugauacuaauuugaucuuuguagaaguaaagguuuuagugauuauuuucuggacuucacuagauaauaaugaggguuggcgguguguucccauccuuacuccucguuuuuauuaaagacuucacgaggaaauugcagauuuuugaggaugggcuucuguuacgaucauaugucauacauauguacacacuggugaccaucaaaucuaaaagggccaggcguaagaccuccuguuuaagguccuugccgcuuccucuucccuuuucccccucgagccaucuaaauguccuaagucuagaggacugauuaguaauaaaggacagaaaaaguguuuacuugauaagugauaaguuuuugccuucuaguaauugauagcuaccuguuuaaggaaggaaauuggugaaaaaggaaggcuuaaaaaacuauuauuauuuugcauauuauuaccuuuuaauauuaugguuaaauuauaauuggcuguaugcuuugaguaaacuauuuccucuguuucucguauguugaucuuuaucuugaaucucuggucugauuacaucacagagaugaugauagucuaauuugguguaauuugggaaagaagcuccaaugacucuaaucuuuuugaauugcaaaaaacauaaagaauuuggaugaaaaaaugcccuaaaagucauuuuuuugggaaccagacuguguugaaaguuugugggucagauaugaagcuacauccucuggcaucacuuuggaaagcuuuuucucaaguggcuuuaaguggcacguggaaaagggagaaugaaggauuggccaacaggcuuguaacuuauaggguaauuugugaagacuaguagauaauuuaugaagacuaguagauauguaaaauccaucuugagcaauuagaaggcaaugaggacuaauggcuuuuauguuaucaauaagauccaugaauuggaacauaaauauuugaaaauauuuuauaguaaaaacuugguaguucuucaguaaagaaagcuucuugcuuagggcuuuauauaacucaagacugacuugaguuauauaaagaaggauucuuguugcaaauuuaaacuuucuuuaucuuuuaacuggauucugccuauuauaacaguuuuuccauagaauuacagaauauaugucuuagguuauagaaauagcauucauauaagccuccuccucuuuggauuugcuuuuuggaaguggguaaucacuaaggaaaaaccaugcauuauuuuggguuucaccuuggaaaugaauaaccuuaauauuacuuugaucugaaucaaacauauuuuacauuuguugaaguauguuucacacaguugcuaauuaugguauuagacaagauuugaacuuuagcugccgucuuugguuccucuuaauuugaaguacaauagauuuucaacuaagaaagggaugaauugguaugugaauuauuuuaaauggcucuaaagugaaaaugacuaauaaaauuagacaaaaaugccaagauaaaucaaauguauuuuuaagauaauaugcuuguucucuauaaucuuuaccauggugcaccauuuaucuuauuaauuuguaaaguagacauguuucuuauauuuuucauaaguaggaugucaaaagccauagggcugaccaaugauuaugaaaacacuggcgcagcaauccauauucuuuaguaugaacacuccauccagucuuccuaggugauagcucaggcccaucugaagcugaaauaaaugaaaauaaauuuauuuauuccauaauauauuaaagucaguugcaaguuuucuucauggaaagggcuaauuaauauguuuaggaugccaguuaugauaggcuuugcuaaaacaaaacagaaaaguagaugcuaugaaagacauuuauguauugugcagcuggaaaacucuuaagcuuucacauaguucaagggcuugguauuucuuuugaguuuuugaggcuuuagaacagugauucucgugauucucagagugugggccuagacuucaucaaaauuaaaaacuuuugcugggcgcaguggcuuaugccugucaucccagcacuuuggcaggccaaggcaagaauauugcuugagcccuggaguuuggggcugcauugagcugugaucaugccacuguacuccagcaugggugacagagugauaucuuuuuuuuuuuaauuuauuauacuuuaaguucuaggguacauguccacaaugugcagguuuguuacauauguauacacgugccauguuggugugcugcaccacuuaacucaucauuuacauuagguauauccuaaugcuaucccucccccuuccccccaccccacgacaggccccggugugugauguucuccuucccguguccaaguguucucauuguucaauucccaccuaugagugagaacaugcgguguaugguuuucugucccugcgauaguuugcugagaaugaugguuuccaacuucauccaugucccuacaaaggacaugaacugguccuuuuuuauggcugcauaguauuccaugguguauaugugccacauuuucuuaauccauucuaucauugauggacauuuggguugguuccaagucuuugcuauugugaauagugcuguauuaaacauacaugugcaugugucuuuauagcagcaugauuuauaauccuuuggguaucuacccaguaaugggauggcugggucaaaucaaaugguguuucuacuucuagauccuugaggaaucaccacacugucuuuuuguuaguuuuccuuuuaacagucaggacccuuagcugcaggucuguuggaguuugcuggagguccacuccagacccuguuugccuggguaucagcagcagaggcugcagaacagccaauauugcugaacagcaaauguugcugccugauuguuccucuggaagcuucgucuuggagggguacccggccgugugaggugucagucugccccuacuggggggugccucccaguuaggcuacucggaggucagggacccacuugaggaggcagucuguccguucucagaucucaaacuccauacugggagaaccacuacucucuucaaagcugucagacagggacauuugagucugcagagguuucugcugucuuuuguuuggcugugcccugcccccagagguggagucuacagaggcaggcaggccuccuugagcugcgguggacuccacccaguucgagcuucccagcugcuuuguuuaccuacuccagccucagcaauggcaggugccccuaccccagccuugcugccgcuuugcaguucgaucucagacugcugugcuaccaaugagcaaggcucugugggugugggacccuccgagccaggcgugggauauaaucuccuggugugccguuugcuaagaccauuggaaaagcacgguguuagggugggagugacucgauuuuccaggugccaucugucacagcuucccuuggcuaggaaagggaauuccuugacuccuugcgcuuccugggugaggcgaugccuugcccugcuucaccucacgcuuggugggcugcacccacuguccgacaagccccagugagaugaacccaguaccucaguuggaaaugcagaaaucacccguguucugugucgcucacgcagggagcuguagacuggagcuguuccuauuuggccaucuuggaaccaccuccccuccagagugauaucuugucuaaaaaauauuuuaaauuaaaaaucaaaaaauuuuuuuaaaauuaaaaguuuuguguuucaagugagauucaucccaaguaugcaaggaugguucaacuuaugcagaucaguaaaugugauacaucacaucaacagaaucaaggacaaaaaccauaugaucauuucaauagaugcugaaaaagcauucaguaaaauccagugucccuucaugaugaaaacucucaacaaauuggguggagaaggaacauaccucaacacaauaaagucuguauaugacaaacccauagcuaauacacugaauggggaaaaacugaaagccuuucuacuaagauacagaacaagacaaguaugccuacuuucccacuucuauccaacauagaccuagccagagcauuuaggcaagagaaauauauaaagagcauccaaauuagaaaagaagaagucauauuauccuuguuuacagacaacaccaucuuauauuuucaaaaccuaaagacuccaccaaaaaacucuuagaagugauaaaugaauucaguaaaguugcagaauacaaaaucaacauaugaaaaucaauacuguuggcuggcugugguggcucacaccuguaaucccagcacuuugggaggccgaaacgggcggauugcuugagcgcaugaguucaagaccagccugggcaacauggugaaaccccaugucuacaaaaaaauuagcugggcaugauggcaugugcuuauagucccagcuacuugggaggccaaggugggaggacagcuugagugugggagguggagguuguagugagccgugauugugccacugcacuccagccugggcaauagagccagaccuugucuuaaaaaaaaaaaaaucaauauuguuuauauauacuagcagcaaucuggaaaagaaaucgagaaagcagucucauuuauaauagcuacacacacacauauacacaccauacacacagaauaaauuuaaccaaacacacacauacacacacacacacacacacagagacaugcacagaauaaauuuaaccaaacacacacacacacacacacacaggauaaauuuaaucaaagaagucaaagauuuuuccaaagaaaacuauaaaauacuggugaaagaaauuaaagaggauggaaaguuggaauaauauuccaugcuccuagauugggaggauuaauauuguuaaaaugucuuuacuacccaaagugaucuacagauucagugcaauaccuaucaaaauaccaaugacauucuucauagaaguagaaaaaaaauacuaaaaauucaaaugaaacaacaaaagaccccaaauagcuaaugcaauccuuagcaaaacgaacaaagcugaaggcaucacacuaccugauuucaaaguauacuacaaagcuguuauaaccaaaacagcaugauacuggcauaaaaacagacacauagaccaauggaacagaagagagaacccagaaguagaucuguacacguggagucaacucauuuugacaguggugccaagaacacacacuggggaaaggacagccucuuuaauaaaugaugcugggaaaacuggauauccauuugcagaagaaugaaacuagauccccguuuuuuaccauauauaaaaauuaacuaaaaauggauuaaagacuuaaauguaagaccugaaacuauaaaacugcuaaaagaaaacauugggggaaaugcugccgaucaguggucugggcaaagauuuuugggguaagaccucaaaagcacagacaaagcaaaaauagacaaaugggauuacaucaagcuaaaaagcuucugcacagcaaaggaaacagucaacaaagugaagaagcaaccuacugaaugggagaaauuauuugcaaacuaucacaaagggauuaauaacuagaacauauaaggaagugaaacagcucaauagcaaaagaaaacccacaaauacugugauuaagaaauagucaaaagaccuguacaaacauuucucagaagaagacauacagauaaccacuagauauauuaaagaaaugcuaagcaucacuaaucaucaaagaaaugaaaauuaaaaccacaaugagaugucauuucaccacaguuagaaugacuuaucaaaaagguaaaaaauaacaaaugcuggagagaauguggagaaaugugaacacucauacacuguuggugggaagguaagguaguauagccauuguggaaaauucuauauggguucccuaaaaaaaacuaaaaauagaacugccauauaagucagcaaucccacugcuaaguauauauccaaaagaaaggaacucaguauauugaagagguaucguacucccauguuuauugcaacacuauucacauuagccaagauauggaaucaaucuaagugucugucagcugaugaauggauaaagaaaaugugguauguauacacaaugggauauuauucaaccauaaaaaaagaaugaaacccugucauuugcagcagccuggauggaacuggaggccauuaugcuaacugaaauaagccaggcauggaaagacaaauauugcauguucucacucauaugggagacaaaaaaguugaccucauggagacagagaguagaaugguaguuaccagaguuggggggcaugaagaaguuauauagaaggaauaaguucuaguauuccguaguacaguggggaaauuauaauuaacaguaauuuauuauauauuuuuaaauagaagagaauuguaauguucucaacaugaagaaaaauagauguuugaggugacagauaucccacuuauacccugauuugaucauuacagauuauauacagauaucaaauuaucaauguaccccaaaaauauguauaacaguuauauaucaaguaauuuucaaaaauuaaaaugagcacacacaacuuucuguuucagaaaaccauuaagagaaugacaagauaaaccaaaauugggagaaaauaauugcaaauauuguaucugauaaaagacuugcaguuagaauacguaaagaacaguuaugacucacuaguaaggagacaaaccaauuaaaaaugggcagaauagauauuucacuaaagaagguuagaaaaggccaauaaguacauugaguaaaugguuuacaucauuaaugauuaaagaaauauaaauaaaauuauaaguagauaacacuucauagccacuaaaauagcuauaguaaaaagagagacaaauaguaaguauugucaaggauaugaacaaacuggagccuucauucauugcaccuagguaguuuucuuuuuugagacggaaucucacucugucgcccaggcuggggugcuguggugcgaucucaagcgauucuccugccucagccuccugaguagcugggauuacaggugcaugucaccaugccgggcugauuuuguauuuuuaguagagacaggguuucaccguguuggucaggcuggucuugaacuccugaccucgugaucugcccaccucagccucccaaagugcugagauuacaggcgugagccaccacgccuggcuggcaguuucuuaaaaaaaaaaauuauaugaaauugaauuuuggugaugguuguacaacauuuacuaaaagucauugaauuauauucacuuaacaugggugaauuuuaugcaauguaaaucauaccucagcaaaccuuaaaaagugugggcccgggaccagaaguaucugauucaccagagaacuucuuagaaaugcaaauucucagccacagugaaguagaaacuguggggguguggcucagcaaucuguuuuaugaaacccuccagcuaauucugauguaggcuccaguuugagaauuacugcucuagauugaaggaaaguuaaauggaaauguggguuguuuuugguaccguuuauguacauucagucuacccuguuccuguaacugcaggaaggguuugaauuaaggacuguucuaguagaauuaaaggaaauuauagggcaaugacaguaaaaauaaacuggccuuucauguucuugguauguccccaugagaagcucuaugauugugauguuuguguaccacauguuaguaaauuccuguguucuuuuaggcuugccauuaaugaacauagcauaaacagguucauuugccauagcgacaguagaaguuuagauccuugaaaggaauuaugucuccuaaauauuuacacaguguaauauagcagagucagaaaugugcagugaucacaaaaaaguaaagaucugacucuagauuaagaagcagccggcugaacugagcaacucauucuuucccuccaucuguucaguguacuuuaaaaacuaugauuagaaaagaggcugaucuguacauagcauguguuuucaggauuuuuuuucagcauuagcuggguggccaacagaaauuuugaagguugaggcugcuccagaauagaucuucaagauccaaacuggaggcuacuggguggugaguauguuagaugaaguuuguagauagggucuccuuugacuggauaguggugacuccugcugagguauaaguucagaggaaaguagagguuguggggagagagauaaacaaauguaagagaagggagagagggaggagugaggaauggcaucaugaauguaugucauuuguuaguggaguucgcugagauuguaacaguacaguauagaagcauauuagugaauguagcagaaaccauuguuauuuccaaaacuuuauucagcuauagguaaaaaagaacugggcuguuuguugccggcaaaguauaucgcugcuucuaucuuucucuuuuuaauuauuauuauuauuuuacuuuuuacuguuguuucauuuugcuuuuuuucuguuuguuuauuugggguuuucuuuuuuguugucauucuuuuuuaaugcuuuuaauagucaguauuauugggaaaauauagcaaaauauuagaauauucucaaaguuggcuaauucugucuuacguuauuagauaaugauggaguagaauaauuugcaauauguuuuauucuaaaaaaucuaugccauagcaaucugaacuucucauauuuauuacuggacaaacucccacagaugcauuuaagcuaaaaauaaaaacaaaacaaaacauaggagcaguggaagaguaaaugaugcaaaaugaugcaaacuuuucccuuuguuaagcaaacuucacaauucucugugcagcucucagauuuguaucugaaugaaggugcacuugaaaaguauaaacaaauacagauaaucugguauuauaugaguaaauacaaauuugaguacaaaagacauaaauaauuuuggaguuaagugcaagaaucaggagaagcaacuuuugggugcuuuguggggauggcagguggguugacauaccauguuuuuuaagccaauacauuucaaaauguugaccaaagaccauuuuaauuauaaaauuagaauaguguuuauucccugcccccuuagguuuuguaucuuguuagcagugaaccuggaauguuuauaguacuguugcaaacaacgguuucuuccacaguuaguguuccuuccucucuaugagccugcuuuuccugucccaguaucaaccaggcccuugccucuugccuagucgaaugccacuuacgcaucaggucuuguguuugguccuguggcaguuuuuuucuuuaguuuccuuagugguaccauuaaauacuuuaugguauggcaacaacuuuauguugguaucagauacagguagagaaaaaagauaaaagagggauuuugaaagagaaaagcagaaugcggggagagagggaagagagagagagagugagaugcuuacuguggaagguaaggggaaacaauuucugcuuacgccauucuuuguugaaauuucuucuaccucaguagagguacuuaaucuacaaauaggaaacaaacuuuccaucuuuuuuguccuucaguuuguugauuugcuuuuccccaugauggcauuugaagguaccauugaguuugucaucucugugaaguuuggaaccccaaaauccaaauuaaagcucugcuuuuuaguugguaauucgggucuguccauuuuagguuuauuuugugguuggaaaguguucuuuucauccacugugguauggggcaccaaaagagaaguagccaagauaauucuguucuuuugaaagacugcucuguagcuaagauuugauaggauguccauccuggaguauacuuagauccucugguugguagacuuuuuauuuucucccaggcuugguguggauccucugugugauaacuguaccacuacuagaguuguucucuguggaaaaugaucaucuuuuuugaaacauaacaaacuuaaaaaaacaaaaacaaaacgcugguaauugaagaauugcuucuaacuuguccuccaccagauggugcuaguguuacguaucuaaagguaaacuccuuugguauugaaguaaggagguuguguauuuucuuucucuuuuucugccucaccauauuuugcccuuaguacuuuuucauacaugcuacuuuccuggcauacugcugcaucacuucacauauuuuauauuguagauagugagcugguuaugccuuagugaucaugaaggauaacuugggaggccaaguaaaauucaagagggcaaggaccaagugaaauuuaaggauguauaauuuguauuuucuuauaagauuuuuuuaaucauucauuugcuucuuaaauggccuguguguaaaaguugagaacuuauucuugacuuuucugcuuagcuaucuuucuuuuauguuaucauaaugaugucauaaaaugucauugcuugagaucuucuacaaacaaaugauguauuuaccaagauuuaaguucacaauaacuuuaaaagaaagcuugguaaauuaaaaaaaaaaaguuggccauuaucugauaugauucccugaccaauuaauaauuguucuuacauuuuuaaaccuuuucugauuacauaugaguauuacaugguuauugcagaaaaacuuaaacaagaauacaauuaaaguaauaauacauguuuaaauacuauuaacauuauauuacauaagccugcuuuuucuuuacccaguuuuaacuuaauaauuuaucauaaauauuuuacaugagauaaaaauauuuuacaauaauaauucuuaaugaaagcuuaauuaaaugaacacuguaaugauaggcauuuuuuuccacuuuguuucagucacaguugugcuaucauaaauagugcaguuuaauuuuuuugaauuuuuacauuucauuugcauguauugcuaaaaauauaauagcuaguucagagagaauguacauuuuugugauuuuugaucugauuuucaauuuaccauccaaagaguucugcaguuugaaagucuuugacgggacaugauucugcuuguuuccguauguccucuuaaucacuagauuaccuaauuuauuuuauuuuuuuuuuuuuuugaguugaaguuucauucuuguugcccaggauggagugcaguggcgcgaucuuggcucacuacaaccuucaccuuccagauucaaacgauucugccucagccuccugaguagcugggauuacaggcauguaccaccacgcuuggcugauuuuuuuuuuguauuuaguagagacugggauucaccauguuagucaggcuggucuugaacuccugaccucaggugauccacccaccugggccucccaaagugcugggauuacaggugugugccaccgugccuggccuuaccuaaguuuuuaagaugacuagauauugcucauuugagaauccuugaaaugauaauucaucauuacauaaaagaauuuaaaauugcuuugauauuuucuuagaaguaagcucuacccuuuaagcauuaaaucucagagcccccacuguucgugguaguuuaguuuuuggccuugucuccuaucccuaaaauacaaacagcuauucuuuugauacuucagaacagguuaucucauaugcaaauaauuaagauuuauguugguucauguuuuuagugcuuuguauuacucguugagaaaccuagugcaagucauuuaaccucucacgauauguuucucagucugacaaguuggaagaauguuuuuuagauaaauuauuuuuaaaacuuugagaugagcuaggcauuuggcauaguggcuuuuuaauaccuucauuuuugauaggcagaaggaaggaaaaggggaagaugcuagauauuuguagagccugaagaauucuaauauacuuuuguaaagaauuaaaaagguaucagucaguguugaguaauuauaucccaguugauuuuugguaucuuacuaaauaacugcauuuuuauuuaagcaaauuacuuuuaaauuaaguucuucuguuaacauaaaagagcauguaauuuauuuuaaaaucagaaaaaccaaguuauuuucauauuugggaaaugggaagaaaagagauucaugcagagucuucaugaaaucuuguaaaugaaggugaaaacuguuagcccaguaauuuaaaaaaaaaaauaguuuuggcugggcgcaguggcuugcgccuguaaucccagcacuuugggaggccgaggcaggcggaucacgaggucaggagaucgagaccaucguggcuaacauggugaaaccccgucucuacuacaaaauacaaaaaauuagccaggugugguggcgggcgccuguagucccagcuacuugggaggcugaggcaggagaauggugugaacccgggagguggagcuugcagugagcggagauggcgccacugcacuccagccugggcgacagaacgagacucugucucaaaaacaacaacaacaacagaaaaaaccuaguuuuucuuucucaugaaaauaaucucaccuucccaucucaauuuggcaaaauauaauaaugauaauaacauuccuuauggucagaaugaauagucacuguaagaaaaguuuuuugaaaaccuaguuuuaaacgguucaucaacauacaaucugucaugguagaaaagacuuguaaacuguagagauaucaauucuguuauuuaaacguauaucuuuuauacagaaaacaaauuauauugauuaaugauuagcuuuuuguaaguaacaccauugaauuuuaccuaagauaaaacuuagcauuuuuguacugggcguaguggcucacgccugugaucccagcccuuugggaggcugaggcagguggaucacccgagguugggaguucugaucagccugaccaacacggcaaaaccccgucucuauuaaaaauacaaaaauuagcugggcaugauggugggcaccuauaauccuagcuacucgggaggcugaggcaggagaaucucuugaaccugggaggcggagguaauagugagccgagauugcgccauugcauuccagccugggcgacagagugagacucugucucaaaaaaauaaauuaauuaaauaaagcagcauuuuuaacucaauaggguuuuuguuaaaaaauuugaaagugaaugcguugauauuguagguacuuuacuugcuuuuuacuuuauaagugugugguuuguuuccuuaaaauaaaaauccuaaaaauagugcuuaaauaaaauaucuuaaauuaucaauuuaauuauagagaauuggcauauuaacuuuuagaucugguaaaauguaaauucaaugcuagcuucugaaguguacuuucuuauaucuaaagcuugaaauacuaauguauugguuuaggugaaggucuaaacuauagcaauuugaagggccuucugaguacuguaauaaucuauaaauaauuaguugaauuacaacuguggcaguuaaaauccccccagaugauaaauucugcucagucaucugcuucauggcaaaauacauaaaauaaucaaauugcuaggauuuugaggcuaauuuguuuguacugcugagaaauuuguuuugugaaauguaauauuaaaucguuagauauaugaauuuuauauaaaguucauuuuugcuuucuucaaaauauauuagagauaauuggaauaauuucccaauaguuuauuggaaaauuucccaucaaacagaaaguguuuucguaaauuuaguguacuuuuggcaagugucuauucuugaacucuuaaauaggaaugaaaaagggaggguauuaaaacuuuuguucuuagcaaugucuggaaaaaaaucaucacucccaguuugauuuguuucauuaauucuagucacauauacuucuucaguccuuacauguuuuauauugaaguaaucaauguugagguuuuucugugcauuuagguuauuuaagauuucugaucuaugcugagcacugaacuguguauuagacacauacucuucaguaaguaaagcauaugaaauuuacuacauuuuguauugauuuaauauuaauguuaauccacaaucuuugggugcaaugugucacaucuguuuuguauuccucuguuuaaaagaaauggcaguaugguauuuggaggaauauuuauuaucugaguguuuuucuuugcaauaguuucccucagucuauugaaaauuauaaccuccaaaagcccagcaaauucucagguacccaguugcuaacaaccacaguuaauuggaauuuuuauuuaccauuuaaguuccuuuuauuuaaauaguuguaacuuuggaggcuucuggaaaugauagaaaauaaaucuguggugagauuuacaaaaauauucuuuucucuuaauaauaggucuagccuguacuucauggauacucugucuuuuuagaaaagacuuuguuagauugaauguugauuuguauuuaaaaaugaauuuuccauaggugguggcuaaauauucuuauccuguaguaguguuucuuaaccuuuuugggggucacgaauuuaaguaaucaaugaaugcuagaaccagcuuuccuugggggaaaauuuauauaaacacaaacauuuuacaugcaguucugauuaauccugccucuuccugcccaauaguccaagggccccugguuaggaaaugccacuauaauggaacugaaaaaaucacuucuuaauuuaguuuuaacaucacauuauuauguaacacuacauuuucuucacuacaagcuuuauuuaacauuacauuuucuccuugaucauuauauuauuagaagauaagcguaauguaaauguuauuuuggagaaaaugcaguauuaccuuuuaauuuugaagcuggucucugaaguuauggaacguauuugacuccuguauguccucaaguucugcuuuagauaaguaaacaauucacuuuaccuuuugaucaaagaaaaaggcaaaggaagagagauacgaguucuucuagaucuuuuguuugagaaaguagcucuuccuuagaaaaauauguugcguugguuguuuggcacaaaaauaugaguucucauuuuauugagaguuugagaaacuauuuaaggguuaccugguugugcugguuaagggcucagacuuggaaaucaagcagguuaggguccaaaucuaacucaguuccuuuccagcuauaugaucuugggcauacuacuuauccccaaaauggaaccuacuccauuaaaugagauaaugucuguaaaguguuuuuuugcuuuguguauaauaugcacucagcuguuauuguaucaugaugauggugaugaugaaaaacaggauaagcagccuugcuuuucaguuguaguguuuauuuuuuucuauuuaaauuuaagagaguagaucuugguugcagaaagagaaguugucacauuccccagaauaaucuucucaaguugugguggcuuacauuugucauaaaaauuuauucaagaauucuccaaagauggggauagcaaacuaacuuuuccacauuuuacuucucaauguucaguuguuacaguggggcaguacguuacaugucauccauuaaauuugccucaugcaauugaaguaaauacugaggagcagagaaagggagagguugcuaagagugaauuaaaaagugagcccuaacauguuucugguuuugaauauugacaccuacauggucacaugguauagagccacauguauuguguauacuuagaguagaugauguuucuuugccugucaugucauaaaggagaacucuaauguaaaaauuuuucauaagcuguacaaaauggcaauccccauacaaaugucagcuguaagacaguauucucauuguggguuguaugguauuuggagccaaagaagaaaggaagagaaugaaagagaaugauuugugugacuauuugauuaaauaaaugaugaaaggaauuaacaccugccugaguggaagacuuuaaguucacugaaaggaugaugauuuucagacccuccugaaaagaagucggaugacauccugucugaucccuuuuuuuuuuucauguugugguuguuaauuauaaccagguaauaacaauaacagugcuuaugauggugguuuuuuuguaugucugcaugugcacauauccacacauauguccauaugcuuuucaaggugccuuagaaugauucauucagguaagaaucauaaaugucagucaauaaugaauuauaaauacaggagaggcuaugugcauucugaauauuuugaaguuggcaucaugggagaguauucauuguauuaaucuauaaaccaucuauuguuaccagugacagagaaagcaacugauuucucugauugaauucauuauggauuuaagucuguguauuucauaugugaaaaaaacaaacacugcauaaucauuuuauauuaaugaaauauuagaugcugucaguaucauugagauaugaagagaacaguuugcccuguuauuuuuuuuuuucugguaaugccugguuucauucauuuauuuucuuugaccaggcaggaaguuaggaaagugauauuccccuuuuucugucuucucaguaucgucagugaagcaggagcaucaaucuacagugucagcccugaagcuaacaaagagaugccagggcuggacccuaauuugagaagugcagguaagaaacuauggaccaucacaaaaacaugugauuuugauauuuugggcagcauguguggcaugcuaaauauucuaaauaucaaagaaaauuuaaaaguuauacuacaugcauaagaauuggcauauuagaaagaaagugguuaauuggacuaauaauugaaauuauggaaaagaagaggaagaauauuguacuuuuuaaaagaacacuacuguucuauaguggaaagcuaacccacaaagucuuuagcaaaauuaaaugcuagagaguucaguaauaaaaauaauaggccgggugcgguggcucaaaccuguaaucccagcacuuugggaggcugaggcagguggaucacgaggucaggaguucaagaccagccuggccaagauggugaaacuccgucucuacuaaaaauacaaaaauuaguugggcaugguggcaggugccuguaaucccagcuacucgggaggcugagacagggaauugcuugaacccaggaggcagagguucuagugagccaagauugugccacugcacuccagccugggugacagagcaagacucucucaaauaauaauacuaguaauaauaauauuaauaauaaaagauccuaagaucuuuuauuauuguuacaaaauauuauugaagcuuuuuauuggcaaaaaguaauacaguaacauaaaaauauuuguaauacaaauuuaugaaaguacacagacuuucaguuuauugccaaauauuugucaaaugaccagucucucaucuugcuaauagaguugucauuugaucauguuuugcuuaaaacagcuugcuuugauuuuaguuguauuugauugcuuugauuucuauaauguggaagagucaaaaucuuguguguaaagaaauuaagauacuaugaugcaucuaaugaaagcaguugguaucauaagcaauauguuagaucaggucagugcauuuuucuguauaauaagugaauauuuagaccacuugguuaguaauggaccuuuuauuuaauuuuuuccuuaaauauucucaucagauuucaucggcuguucuugaaaucuauaccuggagagauauauaugaaauuuuuacaguaaucuaaagcuaaaagcguucuuacguccaaaagagcuuguaguuucccuuuaguuguuucaugacauaauucccucucuaaaaugaucaucuucuuaaaucugagcuaaaaaucuugcuucuccugggaagcugcuucuuagcacagcagcucagcgugaucucugucuccuuaccauguacucuuuuggugguugccuuauaauaauaauggcagaaggaauagaaauaguagucauacugggagcugcuaauaguaauuuuuuaagcacuuaguauaugugaaacauugugguaaguauguuaccaagauuauuuuauccuuucuauuccccugugagguauuuauuauuauccccacuuuuuaaaauuuauuuauuuauuuauuuuauuuuauuuuauuuuauuuuuuuugagauggggucucgcugucacccaggcuggaguacaguggugcgaacucggcucacugcaagcucucccuccgggguucaugccauucucuugccucagcaucccaaguagcugggacuacaggcgccugccaccacgccuggcuaauuuauuuuuuuguauuuuuuaguagagacgagguuucaccauguuaaccaggauggucucgaucuccugaccucaugauccacccaccucggccucccaaagugcugggauuacaggcgugagccaccgcacccagccuauccccacuucuaaaauaggaaacugaggcuuaaaaaggccacauagccaguaaaugugcacauaauauuuguguaccuaauuucuaugauaaaaggguacuuucauuuauaaaaaaauaaaauccagaauuucucaaguugcuauugagaagguaucucccaauaguguguuggaaaaaauauuuagaccauauuuucugagagguaacaaucccucaggccucccgcugcugaagauacugcuguuucuucuuaaccacuggcccauguguguaaauaauugucacaguauuauaggugagacagaauuacaacauuccaacaagauucuaugaaaauagaagauaauaaaauggagaaucauucuaugauucuaauuacucuaauuucaaagucuagcugugucaucagugugugauucauuuuaaguaucugugucuuccuucugugucuuagcucacuucuauguggcaaugaccauguuuaauauauaccuagaaacuuugagucuuuaaaaucugguccuggagucaaauauucaaagagcuuggagucucuacucuugguuuuccagaguccacuuucuuuucaauuccuauuucucauugggagucuuucuuuuuccuggugauugaugccaggggugacuuuuuacguuaugugagaucugagcuaccuacgaguguggauuuuuuaccuuuaaguccucuaaaaguuugcuguauaagaauauaacagaacuucaaaauuuauauguguguuaagcauauguaagaaaauaacccucauuacuacaucucacuggccaguuuaucagcuuauugaaaacagaaguugucuucuauauauaugcuuauauucccccacaaugcaugguacauggccucuaaauuggauggauauaguagauggaugauauuaaacugucuauuauggauuuaaaguggaagauugaguguauguuuuauuccuucucuccuucugaaauugauuaaaaugacaugauagaaugaaagcauaaaccuacuaagauaaaaccuacuaagauaaaaggaaugggaaaggagauagcaacaacaacaacaagauuugaagcuuaaagcagauagaugagcaauaagucaccuagucaacuugagaacauugaauucuaagacagcauuguagaaaauacagaacuaaccugggauggaucacgaaaccccuauagguucaggaaauggugccaaguacuuuggaaguauggugagagcguugaggcuagguugaaaaugaaaguauugguugaaagucuguuuaaaaagcaacgagaccaaauuaaacauaggcccagcaauuucacuccuaggcaugucuccagaaaaauugaaaacagguacucaaccaaaauacuuguacacaagugcuuauagcagcauuauuuauaauagcuaaaaguuggaaacaacucacaugaugaaagaaugaacaaaaugugguauagccauacaauagaauaucauucagccguaaaaagaaugaaguacugguacaugcuacaacaccauaugaaccucaaaaaugucaugccaacauaaguaaaagaagccaaucccaaaagacuacauauuguaugguuauaugaaaugugcagaacagacaaaucuguagagauugaaaacugacuguagguugucagggacuggggagagacaggaauggacagugacugcuuaauggguacagguuuuucuuuuggcauaaugaaaauguuuuggaacuugauaggagaugguggggcacaauauugcaaguaugcuaaguagcacugacuucuguacuuuaaaauaguuaauuauauguuaugggaauuucaccucaauaaaauaacaauaacaauuaacauccccuuccacacaauugaggaacuaucuuuuuacuaccuuugcagaagacuggggauuuguucucuggagaggguuaaacagaagguuucuacgauagagggcacagcuuacaaaugagaguggggaugcuacugaaguaaaggguaguugaguaaauauuuacaugcuguuuuagagauguuaggaauaaaccugugcagauaagaggauucugccaauacaagagacaacauugaagaaacuugggauuagagguaccacaaagaaauggccagagcacccaaaguaagccauaguugacaagccuuaccacugggcaaaacacuuaaagucauuguuuuagcauccugccccugguggacagucagaggucaccuaacauguaaugaaaacuucuacuauuaauauuaaaaacagaugccagaauacacuagggaagaaaaaaagcuacuuggaggaaauagagaugaugaagacagaagaaaaaguuuaacauucucagagaaauaaaaaaaaaauuauuuauuuggagauauauuuacauaaaguaaaagucacccuuuuuagguacaucaucuaugaauuuugaaaaguuuauacuaguuggguaaccuucagucuaccuccauuaugucaggauacagaaaauuuuuuucaguucaacaucuuucucagcuucuuguucaaaaauguaauuauuacuuagagggucaggauuacaguagauuugcaucgacuucuaaaacuacauuuuaauaagcauuauagugaaaaaauucuaauuuagaguuguugacugaaaaagacaacaugggggaauuuuacuuauuuuccucuguuccugucugaugucaaggagaaggauaaaaugagaugaauauuggacuuuaaaaauacagauaucuaauauugcuagauaacaggaugagacaaauuuuaaagagaguacaguucaguauagucuuuuaagcaaauaaacugauuugcuccagaagcuuuaggauucuagauauuucauagaacugaaaggccaaaacccaugacauucuuuuuauucuuuggauauaagacauauuaugagugaggagaaauguugcuuucaaggcuacugcauguggucaugcaaguuauauacucaaucacuuuaccauaggaaguagcucugguugcauaucuuuuaggaugguaaucuuuacucagucugggaucccuucccaacuuuuggugugucaaauguaauuuuuuucucuaaugcuuaacuuuuucuauuaauaucccauauuaauugucuuccucuauacauugaccuauguuaccauuuaauaaauuagcauuuauuaaaaaaccuaaaaucccuauguguacuuuauguucuuguuucaguggucugucuagacuaccacaaugcaacucucucaauuucuguggcuuauaauaugccuugcuuuaauuuuuuaaaauugcauuuuucauagcauuucuuuuguguuuugcaaaugaacuuuaaagccuuuuaauaaauacaguugacccugugcacgugcccacggauucaacaguggauugaaaauauuuuuaaaaaacaacacagcaauaaaaguaauauagauuugaaaauauaguauaacaauuauuuacauagcauuuacauuguauuagguauuaaauguaaccuauaggugauuuaaaguaaauggcaggguauguguagguucuaugcaaaugguacuccauuuuauauaaaggacuugagcauccgcagauuuuggugucugcagggguccuggaaccaaucacccaaggauacaggaugacuguacuuuuaaaagucuauaguauauagagugaaauucugugaaauuuccacuuucauccuuguucugcauguuuuauuuuuauuauucauggguuuguguguguguguguguguguguguguguguguuuaacguugugaauagguuuuucuccaugauuugauguuuuuauuguuuuuauuacauuuuaauuucaccauacuguacguaaaaucucuguaauuuauuaacuuauaacuacaauuauguacccuuucaccagcaucuccccauucucuccacuccccaacuccuguguuauugguucgauagcauaugguagaagcaucaauuuuuguuugugugucuugaaacuacccaacuaauuggaaccuuauuaguucuguuauuuuuucauuugacuugcuuagguuuucuagguagacaaucaucauacauaaauaaugucauuucaauauuuauaucuucccuuuuugucaaguugcaucaacuagaguuuucugaacaauggugaauaguagugauacagcaaacuguugucauucauuauaugugggcaaaauaguauuuggcauacauuuggacauacuacauuuuaaaaaauaauagcuucauugagauauaauuuacauaacauaaaauuuacccuuuuaaaguguacaagucaguguuuucuaguauagucagaguugcacaacuaucaccaccgucuaguuuuauaacuucauccuaaaaagaaacccaugcccauuagcaaucacuuccuuuacugucuucacucaccacccaaacuccuggcaaacaugaaucuacuuucucucuguauggauuuuccuguucuggacaguucauauaaaugaaaucauacaauauguggucuuugugacuggcuucuuucacuuaagcauaauguuuucaagauucaaccaugcuguagcauguaucagcacuucauuucuuuuuauuggcaaauaacauucuauuguauggguauacaacauuuuguuuagucaucaguugauagauuuuuuuuuuaacauuuuuggcuacuaugaauaaggcugcuaugaaaauucaugaauaagauuuuauauggacauauguuuccauuucuccugaguguaugccugagaauaaaaauuggggcacauguaacuauguuuaacauuuuccagaaaucuuuuugacuucuauuacuuugcuguccucgucauuuauucucugccucuuucauuacuuccuccuuuucuucucugucucaaaauguacacguucccuaaguuuugggccauaacucuuccucucucuuaauucucuuuaucagcaauucauuagacucccuuuuccugagcuaccucccucuuacuuucaagaaucuuuugucagccugaucauucucaaccucgagcucugcauuauuacuguccacuaaauaacgcauucuugauuaucuugccggcaggaaaguagcaccaucucucucuaaagccuggacauaggaguuauaaaaaugucgcaugacauuuuuguuuucucagugcauacaaaaguuauguuuauacuauaguguguuaagaaucuaauggcauuauaucucaaaaaauauguacacaucuuacuuagaaaauauuguuuaaaaugcuaaugaucaucugagccuucagcaguucacagucuuuuugcugguggagagucucgccuugauguucaugguugcugaccagaguggugguuacuaaaggcugagaugugguggcaguuucuuaaaauaagacaacaaugaaguagucugcuguaucaauggacucuccucucacaaaagguuucucuguagcaugugaugcuguuugguagccuuuuacauucaguagaacuuuauuuaaaauugaaguccauauuauccauuccugcugcugcugcuuuaucagugaagguuucucuguagcaugugaugcuguuugguagccuuuuacauucaguagaacuuuauuuaaaauugaaguccauacuauccauuccugcugcugcugcuuuaucaaugaaguuuauguaauauuugauaucuuuuaucauuuccacaacguucauagcaucuucaccaggaguagauuccaucucaagaaaacacuuuauuugcuugucccuaagaaagcagcucuucauuaugucaaguuugaucaugagauuacagcaauucagucacaucuucaggcuccacuucuaauucuaguuuucuuccuauuuccacgacaucugaagugacuuucuccaccaaaauauugaaucccucaaagucauccaugagaguugaaaucacuguccuccaaacucuggcuaauguugacauuugcccuccucccaugaauuaugaauguuauuaauagcaucuagaaugguaaauccuuuuccaaagauuuucaacguacuuugcccagauccucagagaaaucaccaucuauggcagcuauagccuuacaaaaugcauuucuuaaaaaauaagacuugaaagucaaaauuacuccuugauacaugguaugcagaauggauguuguuuuaguaggcaugaaaacaguauuaaucuuguacaucuccaucagagcucuuggaugacaggugcauugucaaugagcacuaauauuuugaagggaaucuuuuuuucugagcaguaggucuccacagugagcuuaaaauauucaguaaaccaugcuauaaacauaugugccaucgugcaggcuuuguuguuucauugauagagcacaagcagaguagaucuagcauaauucuuaagaacccaaggauuuucagaauggcaaaugagccuugacuucagcuuaaagucaccagcugcauuccccucuaauaaaaugagucaggcugucuuuugaaucuuugaagccaggcauugacuucuccucucuagcuaugaaaguccuaaauagcaucuucuuccaagagaaggcuauuuuguuuacauugacaaucugcuguuuauuguagccaccuucauuaugaucuuaacuagaucuucuggacaacuugcuacagcuucuacaucagcaauugcuguuucaccuuguacuuuuauguuaggaagauggcuucuuuccuuaacccucacaaaccagccuuugcuguuuucagacuuuucuucugcaguuuccucaccucucucagcuuucauggaauugaagagaguuaggaccuugcucaggauuacacuuuggcuuaagggaauguuguggcugguuuaaucacucagacuuucuccauaucagcaaaaagcuguuuugcuuucuuaucauuuguguguccacuggagucacacuuuuaauuuccuucaagaacucuuccuuugcauucacaacuuggcuaacugacccaagaggccuaccuuucagccuuucuuggcuuucaacaugucuuuugaauaagcuucauuauuucuagcuuuugauuuaaagugagagacgugcgacucuuccuuuuacuugaacacuuaagaggccauuguaggguuauuuauuggccugauuucaauaccguugugugucggggaauagggaggccccaggagagggagggaggggaauagccaguugguggagcagucaggacacagacaucauuuauugauuaaguuuguuaccuuauaggugugguucgugguguucuaaagcaauuacaauagugauaucaaagaucauuggucacagauuaucauaacaaauauaauuaaauuuugaaauauuucugagaguuaccaaaauguaacacagugaccagaagugugcccaugcuauuggaaaaauggcaccaauagacuugcccaacucaggguugccgcaaauuuccaacuuggaagaaauguggugucugagaagcacaauaaagcaaaaugcaauacaaugagguaucccuguauucuuaaauucuugacuugguuuacuguuguggggguuuuuguuguuguuuuuacucagaguauuuuggcaauguauauguguugaaaaucauucuuauugcauuacacauuuaaauguuaggcuaaagaaauaauauuugcuuuagagaaauucaaguauaucucuacuuuaaaucuguaauuauaaaugugguuauuagaagaaagcauuucuccuaucaccugcaaugcuugcacuaacuaaccuuuugugauugauuucuuuaaauaauaaagguuuaugugaaggccuuggaauccccgucucuucugggagaaaaauagauuguguaacgccagcucagcguucucuaagcuugcuuugcaaggagcuauugucacuauauauuagauguaguaauaaaggaugugaaaaagacuugaaugaucauguguugaacuugauguucacaguagauaaguagaucuuaugucugauuagagaagugguacaaaucagcgacuggagaaucugagagucacuugcaagagaugacuuuuguuuccagaccuugaacagcuuaacauggaaacaggcauaggauuuucuuugauggucuuaauauuuucacuuaaugaauuuauauuucaucuaaccuguaugagaaggugacacugauuagcuuccauguguuuugaaaauggaagcaguucauauauauauaaagacucaguguaaauaugcuacuggagagggaggcugccuuuagaacuauucauaagaguuguaauaguuaucuuuuuuuucuagcuaaaucuaucuuauaaacgaaauuagaugugaauuuuuauugauauuugguaaaaaaaaaaaggacaauaaaugacgaacaaguaaaaucaugacacaguuaaaggaauguuugaaauuaacucuaaaguuucuugagcauggauuguaauggucaagaaagggauguaauuagaacuaugguguguuaagagacaagcaguugggacagaaggaggaucacuugccagggcaaucuugcagucauauucaaggccacaugaguauauucauuagccaaguaacuugaucucugguugcauuaagauaugauucugcugggcgcaguagcucaugccucuaaucccaacacuuuggaggggugaggcaagaggauugcuugagcccaggaguucaaagcugcagugaacugagauggcaccacugcacucuauccaggguaacagagugagacccuaucucuaaaaaaaaggaacuuuaaaaaaggagguaauuccgucacuuguucauuauuugggggaucgaguucuaauaagcauauuugacauauaaauauauuuguaauaaugcagaauuauuuaaaacaagguuuugcuuccucugugaagcaugagguauccuauuaugcuuuacguaaagaaugaagaaugaauagguaaucauguaaguauagggaguaaacguuuuauuuguuuuuccaaaucuauaauccugucaaacuacuuuguguucaagaaugccuaggaguucugaugacauaauucaugaaauuuugcauuuacuuuuuguguggggaaaaaagagaacuuugaaauuuaaauuguuggccuuuuuuagagggaugaugaggagggacaggauuaaguacuuacauuaugagaaacuaauguaaguaauuauuagguacugcuuuucacauuaagucauacuuguuuucugauucuguuuuuucaguuuccauagcaaggcguguacaagauccauuagcugagcuagugaaaauugagccaaagcacauuggaguuggaauguaucagguaaagcuauguggaucauuuaauuuaugaaauccaucaauacaaggagcaguacucaaaccugggauaguaauuaagugucugugggaguagauucccauuuucaagguuauacaguuuguggaaaguaggaguuuuaagucaucagggaaggagggaauuauuuuugucauuguuguucucguguuaaugauuuugauuaagacuuagaauugacuguggucagauugaaagacuaugaaaacacuagaugaaacuaauaacuaauuuggagagagagccucuucuuuuaacauuauuauaaaaaugguggugcuaucuaaaauaauuacaauagugauaucaugcauugaacuugaucuucacaguagauaaguagaucuuaugugugauuagagaagugguagguaauaauaguacucguuuuuguuguuacuguauuuuuaauucuugagguuguauguguucauugggcaauucaagacagcacuaaaccuuggcagagugaauuuauggugauagcaaaaugguauguggggaaguugucuccagaaggcuugggucacauuguuuuccuccuugucaaaagcuauuaaaugugaaauagaguauuuccuucuguauaauuuuuaugggauuugaaugauagguacuauacuacacuuuuucuaaagaaauauauuaugucauggaaucugugacuacuagauauggaagacaccuuagaauucauguaacccuaccccccucauuugauagaaaaagaggcaguguccuggaguacuuaagacauuuacccaagaucucaugguagcaaagcuuagauuaaccugucauauauugagauucaacugggaauauuuccauuuuauagcaaguuggacuaaggcauucagaccuuuaacuggacuuacucauuucagaaagauaguugcuaaagggacugaucuagcuacaaguagauagaaaugacugguaucuaaagaguacaacuggcuaggugcaguggcucaugccuguaaucccagcacuuugggaggccaaggcagguggaucacuugaggucaagaguuugagaccagccuggccaacaugacaaaacucugucucuacuaagaauacaaaaauuagccggguaugguggcgcgcaccuguagucccaacuacguggaaggcugaggcaggacaaucgcuugaacccaggaggcagagguugcagugagccaagauugugccacugcacucuagccugggugacagagcgagacuccaucucgagaaagaaaaaguacagcuauaacaguuuugugauauaggcauuauagugaagaggaauuauauucauucaagauaaaguuauggagcaucuuggcaagauaguggaauaaagagaagauuccaaauuuaugaaaccugggcaggcuaauaagcuauugacuucaaagagaucuuuaaguaaauaguggagaccuaaccuccagauugggauucagagauaacguuuaaugugaaagacuuugggauucauuuuaacaacagugagaaguaauagaagagguuuaagcaaggggggguggcacaaucugauuuauauuuuuaagcauuggcucuggcugaucugggaagagugacuuaggaagaagagaagcaauagaacagcuaggaggcucuuguacuagcccaggugagaaauaauagugcuuggacaaaguuaauggcaguaaagauggaaagaagucaagucuguuuugcaggguuuguguggugauaagugagggaaaggaauuaugaagaacuugcuccaaggguucugauauguggaugaugcuugaguagagcagguuugguggguuaagaucaguaauucaguuuuagacauguuaaguuugagaugccuauaagaaauccaaggaaagaugucaaguaggaguuggauauaugagucugagauuuaaaaaaauagccauauuaacauuggacuacucacuguucagcaaauaaugaaacuaagaacgucaucaagauggugggcugaauuaaugauauucuuuaauuacacuaccaucaucagcugcauauucagaacuccuaauuccaugaguugacagaaaagguguacauguguaccuauauaaauacauauuuauuugaauaaauugauaacagcaugggaaaacaagaaagggucccucccauuaguggauggaaaucucaggaauuccugacagauacuaagcauggggaaucacacucauggagaaauaaaaccugguggagucacaguucaaaacauauacagaucauuguguaucauuauguucuugagguaggugcaguucccgguagagccaaacuagucagauucaaauaguagggagagggucugaaguauuagauaagaagauacauauagcaaagcuaggccuguacugaccuccuccuccaguauacugugaauccaagcugaagcacugaccuuaacauaggccagagaggcugggagauagcucaagagaccuucgaaugucaggaagcucaaggagccucauccugagaagauaaauuccugccauguacaugacaccuggcaugaugucccacauuucccacauuaucaccggagguggggaauaguaaacagaaacagcauacacagacagacaguuagggacucugaaacgaucucacuaccaagaaugauuaaacauuugaggaaaaccuaugguagacaaaugaggcaccaaacuuaauaaacaaaaaguaauagcgagugagacaaugaauaaguaacagagacuuugaaauaaguaaaaguaagauucauagagagaaaagagauuauugcauuuauaaagaaauauguauuaaaaugaauucaaaccaaucaaauaucuuagaauuuaagaauguaauuaucaggauuaaaaugcauaauuggacuaaauagaguggacacgguuaaaagcaaauuaaugaauuggaagguugaauuccuucagaaugcaguuuugaacugaaaaagguggaaagcaugaacaaaaagucacaugauacagaggacguucuaaaccuucagcguucaucugauguaaaauugaaauaguauggaguuauaaucacagaaguaauaggaaauuuuccugaacugaagacagacaagucuucugaaaacaccuuaugaaugcagaaguaaagaauaacaaaaggccaacacuaaauuccugcuuaugaaauuucagaauacgugauaaagaggaacugacuaaaaguauucagagagcaaacaguuuaucugcaaaggaaagaaugagauugacaacaguccuauuauugauaaaaaauaaaugauagaagauagaaugcaguaguuguggaguugugggaaaaaacauuuugaacucauaauucuaaaucaggcaaaccaucaauuuagugugaguggaaaauaaaaacaauuuugaaccuucucugauuguuucacaccuucuuugaaagaauugauggaaguacucccuuccaaaaagcaggggaguguccaaagaagggaaagacauaacaugggaaacauguacacacaguaaaauguauaguugagccugauaguuuuuaaaaucuauaauguuaaucuuuaaauauuuaagucuagaucagaucaguucaacaugggagaguagaagaaaaagaaaugauaaaaaguauuaagauucuuuuucaggaaaaagauucagauauaaauuaacucuagaauuugauuaaaaauauaaccugaaacauaugaagaacaaccaccaauaagauauuuaauauaaaucaugagaguaaaauguaaaaaguuuauaauuucauccaaagguagagaaaagaaaauaagaaaguauaggaaauaaacaacaaaauauaaggagauaggaauaaguaauagguauuuaaaagugaaugggcuaacuuccccuauuaauagaacuuaagacuuuaaaaaauaaaguacagcucuaacuuacauaugugcaagagacacuccuaaagaaaaaaaaaacaaccuugauauuaaagauuuggauuaaaauauuccacauaaaugaaaaagacagccauagcaauguugaccuuagacaaaauagaacuuaaggcaaaaucaugaaauaggaaaaagaaagauauuucauguuaauaacagucuuccaagaaaguaugauugcccugagcaaucuguuaccuaacagcauagcuucaagaaauaugcauauuacaaacuuuucuaaaaauuagaugagacaaauucacuguuuuugcaggagucuuaguagaccauaccauauuaauauauacauuuuaaaaacagcuugaagcuaggcauggugacacgcaccuggccucagcuacucagaacacugaggcaggagaucauuugagcccaggaguuuaaggcuauagugagcaaugaucaugccuuugcauagccacugcacuccagccuggaugacauagugagacccccccaucucuuaaaaagacaaacccagcuuuauugguucauaauugcacaucauacaauucauugauuuaaaauguacaagucagugauuuuuuuaguauagucauggaguugugaaaauagaacauuuuuaucaccccaaaaagaaacgcauucauuagcagucauucuccguuguccuuucuuuaccagccccagacaacacuaaucuauuuuccucuagauacuucauauacauggaaucauacaauauguggguuuuuaugauugaccucuuucacuuauaauguuuucagagguggucugcauugcagcauguaucaguacuucauucuucuuuauggcuaaguaguauuccaguguguguaugugugggugugggugugugagauauuuuguucauucaucaguugguaggcuuuuggauuauuuauaccuuucaaguauuauaaauaaugcugcugugaacauuuuuguucaaguuuuuauguauguuuucauuucucuuggauguauaccucagaauggauuugcugggucauuuauuaacacauaauuuuaaagccaugucaugaauuaggaaaauuauuugccacaaauauauauguauaugugauaacugcauauuauuaagguuuuguuuuauucuugauuuauauacauuuauaguugguuuauauaaaacauuuacauaaaauauguaaagagccacuacauaccauuuacuguggaagaaacaaauuucucucuaucaaagaaacccaaauuuuagaggguguuauuauuucaaccuaacaauuaaguaaaguuguaauaagaugaaaauaucugugcaagucagaaggauacagugaggugaacauuuuauauacacugcugguagaagucuaaauuacuauuucuagcaaauaguuaauaccuauuaaaaugcacuuguaaaaaugcauuucuuuuaguucucccuuuagcuaguucuaagacaauaagaacugcuguuaagauucauacacaaguuuacuguaauagcaaaauauuagaagcaacuacaauagcaaaauaguuuuuaaaauuauaguaugaguugaaauauacaacuauuuaaacaggcuuucaaggaagauuuaauaaugugagaaauuguucuuguaguauuuuaaaauuucaacaaaguuguugcucuagaauaaaaacaauuuguguuuuaaaaauguaggcauguguuuacauugaagaaaaaaaacuaagcaggugacugauacuuguugaugugauuuuuuuucacuuuuugauuuucaaacucccuauagugaauauguauuaggaaaaauuuguuguaaaauguauagccauuaauagauuucccuuacaaucagagugggacugaauuuauuuuuagucuggacuucuaagugcuuucaguauaaacuuaauacuuauuuucauuuugauuuaagauaugaguagauggacaaacauugcuguuuaaaaaaugaaagcuguucaaagagagaauguuaaauagaugaaauaauagaagcuauaauauuauuucaauagaaacuaaaauacuuuugguuuaauaacagcuaaaaugcuaaaggcagcguuccaauccuugucuuaggagauggggagaggugauuuuaaaaacacaugccugucauuauuucuggagagagaggcagccaguguggucaaaugacaacauaucccuaacugaccccuaaagacuuugcuggaaagugacuugauguuacucccaagaaaacacuccagagugagagcaggaugaugcagguuuggcucuguugaguucacugggacguggggaauggugguuuagcuuggccuugucauauccugaaagcucaacuuaaauacauuggauuuacuugauaauuuuuucuucuuuggacuguguuuucgguacuuucaugcucauuaacaccuccauuugguaaugaacacacacaguaaaguaggaaagacucagaacagugcucuuuccuccuuugugccucucuguuagaucauuuggugaugauagagaaugaaaugguuggccaaaauaaguuuuuggaacuguuauuggauucuauauccaggccaucuuuauucuucauuauuguggauaaugaauaauuacuguaaaaggaaaaucaucuucccagcggaaauuuuucacaguaaaaccucaaaggugggaauuugcauuuucuuucauuccugcucuguggaaucaauucuauguaaaaacaaaucaaaaaaauaaaaaacaaacuguuuuauagucaacauguagagauuauuaaauggaguuuuaguuuaggucuaaauaaaguaagguuucuugccuguucuacaguguuugcucaaaucuuuuaaaacauuuuaauuccuuaauuaucauaguaaagugggauacagaaaagagucugucccaugcccggucaccuaggugacuuuuguuuggauuuuugccccauacacaaaagcaguauuuugaaauagagaaaacacaaaggugaaacagaggaaauuguucuaaaacugagacauuauuuacacaggugaauucucugccaaaaugguuuugcaauguugucccuugacucuaaggcccaggauaugggcuguacugaaucuuugcuuuacaggguauuaugagugaaauucagacuuagccuugcaauucagauauuucauucacuugugacaaagcagagaccuaacugaaggaaaacaaguaauugaccuugacuagguguaugaacccaacucauguguuagaauuugcuauuuauuccuuaaauuucaaguuuuaaaauuucuuuucuggguauuuuucccuucaggaugaauuaugcuuccuauguugaaauacuagcuuuaguuuucucaaguuccuggaaaucaccaacaauguaauaagccauguauacacacacauaaccuaguguaacaccauuacuuaucuuuaaaagaaaugugaaaugauagcaugauuugaagaaccuuuuaccaauaaugccuuaaauuaaaaugacauaucuaauuuccuuuaucuuuuguuugcuuacucuguguaugucauugaccuuggcagugaaacuagauccauuucaguuucaaguucaccuucuaguuuucguguuagcacagaaaucacuguuacaguuucuaaaacuuuaaguuacuuucaguguuuaaaacuaauaauuauaugaucauuuaaaaaauuauauauaacauuaaaaauacuaucaugaaagaaaagauuaguaaauucuacugcauuagaaucuaaaacaucucucagucagaaaacaauauauagaccauccauagacagggagaagguauuauauuuacaacacauaaacuauaaaugauacagaauauguaaaggucucuugcaaaucaagacaugaaaagacaauuccagagaaaaacaggcaaaggcuaugaacaggcaguucacagaagaggagauacaaaagaauaauaaagcuaugaaaaaauuucucucucuuaccaugaauggaggaaaugcaugcuaaagccauaaacccuucaggcugucaaaaauuagucugauaauucagauguuagcaagcauguggaacacuuggaaucuuguacauuauuuauagcaguauaaauugguaccaccacuuuggagagcacuggaaguuaacagagcuggagaugagaauucucuucaacucagcaauucuguugcagaauguauauagccuagaaaaauucucuaaaaugaaccuaagaagacaugcacaauaaauucauugagacugggcacgguggcucacaccuguaaucccaacacuuugggaggccgagguaggaggauugcuugagcccaggaguuugagacagccugagugacauagugagacgucaucucuacaaaaaaguaaaacaauuagcugagcaugguggugcacacauguagucccagcuacuggggaggcugaggugaaaggaucacuugggcccggaagauaaaggcugcauuguguugugauuaugccacugcacuccagccagggcaacagagugagacccugugucaaaaaaaaaaaaaaaaaguucauugaagcaauauuuauaguagugaaaauuuggaaauacugugcucaucaucuggaaacuggaaagauacacuaguaaagucaagacugugaaagaacagauagagcagugaaaaugacucagaaaugcuagauuaauauggagaaaccucauaagauguaauguuaagcgagaaaguaaguugcagaauauguacaguauuauagggcugauauaaaauuuaaaaauaugaaauauauaggauuuaugaauaccuauauauaguaagauuauaaaaauaagcgcagaauuuaagaugauaguuuggauggggcauggaacgagagaaaaaugggaacugggagagguacaccaggaguuucaaucauauuuauaauaucuuauuucuuaaacugguugguguugcuuauacucuguaacuuuuguuaaauauuucauaauuuuuuaacaagaugcaggaaagcuuggucaaaugcuacagaugcuuuaacucgggaacuuuggcuuucaguugguuuuagugucuucccuauauauugaugaguguguguguacauguguguuuuacaaugagaauuuacuuauaaucagaaaaagguaagcuauuuucauuguuagugaaaauuuaaauauacauuucauauuauauguuaccuuucccuucauaauauucuuagaaaucuuucucaagccccuaauguugcacgaagucaaaugcuuuguaaggcacaguuuugacacuaucuuaaaaaauaucuuaucucauaaaugcagguuuuucuucugugaauuuuaggaauuaaauaauuauuuuucccccauggucauuuuagacagauguggccuacgacaaaccuguagacugccaaauuucuagugcuuauauacagggcagaguuggguagagcagauguuuaaggaauuaugguaucauauguuacaguaaugguacugucauuuaacuagcauuuaucguauacuauuuucuuuucgccacuaccugcuucccucacucuuaaauuauuuaaaugagaaaccuuaagauuaugcaggggaguuuuuaaaaauaccuaggcuacaucuccagaguuuguaguuuaauuggucugggggugggccccacaugccaacaagcuucuuaaaauucacauguaauucaaauguacaaccagggcggagaaucacuaguucugaaaauacagucaguagacuagcagcaucaauaucaucugacaauaugcuagaaaugugcauucuuucacuugcuucccagaccuguaggaucagaaauucagggggauuggacccuguagucuguguuuuauuggccuggguuugagaaccacuggucucuaaugcuccucaaacuugacuaugcauauaaaaucccuuuguuaaagaugcaaacucugauucaguuaaccuggagugagcaaugacagucuguguuucuaggaagcacucaggugauaacugugcugcuggucuguuuugauuaacaagagacccugcugaaagucuccugggcccucccucaggccuguugaaucagaaucugauuuuaacaagauuucuagguguuuugaaugcacauugcaguguauguaauguaggaggaaaauuaggacaugccaguaucuaagggugagaguuugaagaagcaaaaaucaguauugugaaacacaaccaagaugaaauaggaacagaacugaaaaugugucuuuuguguuuaauuuuaaauguuuccuuuaaagaaauuuuccuuuaaagugaacguacucauuuaaaauauugaugauuaccauaaaaauaauuucacuggagugguggaggcagaagucugaaagaauuaaauccaggacugaaugaaguguaagcauuugagagacaaguguauacaaauguuuaaggaagagaguuauuuaaggaggucaggauuugaauguguugaaugucacugggaggagggagaaguggagagugagaaguugaauaugcugaagagggaggcagcugguugccugaggagauggcauccacaggaugccuccaggaauagccuaaggaagaaaauggagaggagcuccagagagacuccugugggguaguaggugcccggcaagagauggaagauagcaggacugugaggaguuguuccccuacauuucuuaucuucucugugaagcaggaaccuacucccugcuaacugcucccucaacacacacaaaagaacagcuaguguuaagugucugaaaucacaguauuuauuugcuuacuguguuccucuucuagugcaauaaaagcccuuacaugaggguaggcuguuuccacuucuuguaucuucagcucccaggaccuggcacaugguagauauucaguauuucugaaugaaugcaugguagauuauugguauaguugaccauuuauuguauuuuuuaaacuuuauuauaaacacaccauaaaauuuugcagccucuccaaauuuuuguugaagugggaucagaacugaaaaugugucuuuuguguuuaauuuuaaaacaauucuuguucauuuaaaaucaagaaaauguagccuggucacaaaugcuucuuagauccagguguuuugaaugcacuguaauguaaugcacuguaacaugcauucagaacaccuggaaaucuuguaaaaaucaagguuacauuaaaaaguguagccuuucacuuaaaauuuuaaaccugaacuguuaaauaauauuuuuaaaaugaaacuccuuugaagaaaauauguugaaaaucauugucuuccuuucuaguuuucuuccagucuuauacuuugaucauuaaaaguguuaaguccuuuauguucaagguaagaaucuguucaguuuuuuguccagacagggaccaugguguuuucuugcagucuggaucauuucccaucagaauuuugacugucacauucgugugucugugugugcauuuauauauauauacacacauauauguauauguguguauauagucagcccuccauaucuggggcuuccaaauucaacuaauuauggauugaaaauauugagaggaaaaaaaggauaguugcaucuguacugaacauguacagacuuuuuuuccgugucauuguugccuaaaccauacaguuuaacaacuauuuaaauagccuuuacaccguauuagguauuauaaguaaucuagagaugauuuaaaguacacaggagguugugcagcauagguuaaaugcaaauacuacaccguuuuauaucagggccuugaguaccuauggauuuggguaucugcagggaguccuagaaaaaaucccccauaccaggggaugacucuguguguguguguguguguguguguguguguguguguguguguguguguacaaucucaaccaugacaguuucuuuuuaacagaguauugguacucaauuaauugagaauaguuaugacaaauguuuaaagaugucgguaaaaccacuucauuauuucauaaauagccuuuuuuucuuauuuuauuagguuguauuuggcauacaacuuacuuuuuauacuuuuguauacauuuuuagagcuuuaauguucagacuucaguuaccugaaaauauucugucucauuuacacauucugugaucuggaacacugauccagucuccaauuuugugucucaguguuuuauaccugugugaauuucaagcccuuggguuuaguugauagugaauggcuggccuugugaaggccucguuaacauauucaaaauguaaucugucucaaagcugagguagugaccagaauaaccaaugccacauucuuucccuucuuugugauagaaugcuuuguguaauucaguguauggaggugacacuuacagcucuuuauuaauugaccuuuuaugagggcuguuacuuguuuauuauauuugccaucuaaccaaugaucugaggacgugaaaugucuuuucaaaagguacccuagaacaucguuuuucugugaauuggcgagcaaaaguuucuugaaaccuaauaggauaggagagagcuaucuugcauaccucaucucuuuucuguucucuuuugacuuggaucuuucugugggaguucuguaugugagcaccugcuugaaagguguuugguaguuuagggccagagagcauuagaauggccauguaguugaagugagaauggcuaaggaaagugaagaaggagugcuauggaugaaagaacuggaguucuuuaauuuagcauacaucuccauuucuuuacccccucugcaaggcauauucuguucucgguggaaauaauccuuaccaggacagaucagagguagcacuuauaaaggaauguucuuugauuaugacuaaaucaguaauuaggacuuacaauguaaaguguaauaucuuuauccaagaaaaacuuuguugcgaugggauucauuggaauagaauuuuuccuuuaaagugaacuuauucaucaaaauguaaguuauggaaguucuuaguaauuuuaucuuuguuugauacagagcccuaagggaguuuuuaguguacugguuauguguggaugcauauauugguuguguguggaugcauaguuuguagacuaaaaauaguagaauaagauuacuccaaaaauguuuaauccuucauaaagguauuacugcuuugcuaaauuuugggauauaauuauauguggauaaccauuuggcacacuaacaaucuuggauguaauguuuaacuuuacucauggaaaaaaccauguaauauaauaauguucacauuagaaaaaauguugagaacccaaauauaagauugugcuaggugauuauagcaauugagaagagaaauaaaauguggaagcacuauggggggccacuuaugagaauuucaaaacuguauccugaauaucugauacuugcuauuuuucaggaauguugauuaacucauuccuuuauauauguguguuggagugugaguugaucaugaucuuuaagaauagcacaggcaaauguaauuacuuguaagauuauguuacauuuuaaauuuaaggggaagacaucaucauuauuauagggacaguaugcauuaaaugcauaauccugcaggaaggccuaagguauaagaguugaagugggaaauaaacccugccugcaaagugauuuuauaaugugguacagagacaggaaggguggccucguugaauuaugguauggguucacucauggcaaaguucuccguccaaucuaucuuaugcuauagacaguuguguuacauugucuuucuuucuggugaucauggaaaggaauucuaaugauaaaagucuguagugagggaaaauuauauugacaagagagauuuccccccccccccccggguuauucucaacaauuaaauaucauuaccauguaagaaaaguuacuuauccuggauucguguagaaugaaaauuguuuuucaguccacagaaaugcauguguugucguuuugaacaacuaaccuuaaaaaaucuauuuuugggugggauaguaggcagguuagcagccuucuuaguguacuuuuuuuuuugagaugcagucucgcucuguugcccaggcuggagugcaguggcgcgaucucagcucacugcaagcucugccucccagguucacgccauucuccugccucagccucccaaguagcugggacuacaggugcccgacaccacgccuggcuaauuuuuuuuuuuguauuuuuuuuuuuuuaguacagacgggguuucaccauguuggccaggaugguuucgaucuccucuuaguguacuuuuaacucugcugauguguugucuuuaauaaucuagagcagggcacccaaucuguuuauuguacuguauuauuaaaaaguguauauucuuuucaaaugcuuaauggaaagggauaauuuucugacauauacaaggcuuuuguuucauuauuuauuuugaauacauggggccagaggguaugaaugcaguuagguuuuguuggaagggaacuugcaaagacuuuuugaggcaugaugugcaagugaguguuuuuaagucucagaggugugauuaugucauaacagccauaaccucugggcuugcuuuauuacuuuuauuaaaacaaaucuguaugagggcgcuauguauauuuuggugaugaaggaaaugaggugguuaauuuauuaugugaacagcacuuucaacuaaccacagcgugauucgcugcgagugcagugaaaaagccuagcucuguagaaaugacugcauuuugauuuguggaccuuaacuuucaacaccacaacaugaaguuuaucuacaaaaugauuccuuuuuuuuuccuguaauguuuuuguacaauuuuuaaucucuguuucuuuucuucauuuuauugugggaaaauaaaaacuuaguaaaugaacuaaacagcucucaucagcaaacugaagagaaaaaagggaggaggaucgacacguuagggcauuagggaacugaguagcaucuuuuuagcuuccaaguaucucccacaucuaucucagaagaggacuccacagaauaagucaauauucuaagcucucaaugaaugacgauaacuaucugaagucaaauaagagucaaggaaaaugaggcaccuguucuucccuuuuguaggaugcauuuuuaagcagauccauaguggaaaagaaaauuaauaucuuguaagagaaucucugagauuuaaaaguuggggggggcaguugaaucucugagguuuaaaaguaggggcggcgucaguuaugggagaagguggggauguguaccacacagaagcauaugcacuguagagugggauugacagagggacuugucugucuaacgaguuugcaguauauagaaagcacuuguuguauacucauaaacagccauugaaagaccaagaaaagguuguuuuccuuggaguggagccauauccagcaucaucuggugaugugaaccugccuagagagagagugaaaacaggucaucuucccagcaguauuuuugaaagacuccgucauuuuccagaugugccaaguaccaaccauuaacagacaggaagacuuggaaaucaguaagccauuuaacugccaacaauuaagguauuuuauaucuggaacauuacaagucuccaugaaaggaaggauaacaauccguuuuauauuuuaucucugcuucuuuggaguggcacaccacauuucucuucagaucccuacauuuacucuaaaaauugugucauuccuucauaacacuuccccaggagaguugacaaaguccaggagauacauuauuuguguaguuuaaagacaggcuauagaggagagagguccacgccugugguuucuguaaacaggguagacugggagggagcgcuggcacgccugguuggguuguuauucggucaucaugaccagucauuccuggugacuuuguaucuacuuugaaacugcuuccauaguggugauuaguaaugaucauggacagucccagauugagguagaaauuucauuuuaaaauuggauuguaggcauaacuucguuuuaauggcauugguugggccucucaaacuuucagaugucuucacuaguagaauuaaacuauguccuggacauuucaagagaguuaucuuugauacuauguaagccagcauuuaaauuuuuaaaagagaauuuguguucauaaugguuuugcuacuuuuuauaaaguugagauuuaagaaguuauucuugggaguugguuuugaaaagucuguuacucuuccuuucucucuucuaaaugcccaccacaaaccaaugcagaacauaaguuauuuuuaaaacauagauaauagagaagccauaauuucaaguguauccuugcucuucccugccuuccucagcauuuccuucugugccugcuugcuaugugccuguuuccucgacucccuuccaaccuucugugagcugccuuuugaagaggugguuuguucccuaguuccucauucagaaccccccucauauggugugaaauacaaccagccuuuuaaaaaagugauccaaaccucuuuuacgauuugaaaccuagucggauauguguugacaaauuuaagcaacuuuuuuuaguuuuucaaaauacaaauuuacgggcaugcuaccagaauuagcauuaacugaacacugacccagugauggcagcagaaugcagaagacauccagcccagucagcuagaugaucagggcaugauugugaauaaaauggaacauggaaguuggcagugagccaggacguguuuucuuguggauaaauuuacaaacuuaauguuuaucauuaaguuuguaaaaggaaauuuggacucuagauuagaauacuugguuagucauaccuugggcacauaacuaugcucauugaccuaugcccauccuugccguuggguuauucaggguguguuuagugaaaauuucccugagagauaaagaucuuacauagacaggagccugcuuuaaacuaaaauuucagaaacauuuucacuggcaccauccuuguucagugugguuuaguggaaagaacacagagcccuggaccccaaagugagcuauggaccuugguuuagcuacucaugugucaugucaccuugggaaaguaauuuuaccuucuuggaaaauaagauaaggauaccgauauguuuucugaaggaguguuaaagggaaaaaaauuagacauggaagugccucaaggugcauaugugaaaguguuuucacuucaugaaaucaaaaaaauuucauucacuuuaguaguucuuuguuuaaaccuuugauguuaagguccuguuuauuccuguuguuuauucauaugcuaaccuuaucaaauauucacugaaucauuuaauuucagguuacaagggacccucaaggucauuuaguucacaccugucagguauaagcauguucauuccuuucugcugaaaggaaggacagaagcagccaauggggaaagcuuccaaaacaaaggaucagagagaguggcagcguugcuguggucauaauccaggaaugaggaagugaaggcccauugccugccucuuauaaauaguaaugacaggacguguugcacagggaaagauaggcauuuaaaguugaauuggaaaguacacuuuaaacuucuguuaguuauuaccuacagaauuuuuuguaagucuauaguguuuuacuuguuauccuuguguaucugauucuucuguugugguucacaucuaaauugacucaguauuuuggaggugggaguggaagaggguagaaugcuuaaaaacaaacacagcagcaacaacagaaacaaacucuguaguuuguugggaugcaugaucugguuaucgguuggcaauaagaaacagcuguuuguuuguugacagccugccuuuccucuccccuaaucaagcuguuucucaucauguaauuaccaacucuuuaguauuugagacuuguggauuuauaguuggucauauaauauuugccaaaacgucauaguuuacauaaaaaauuagugauuccccuguagucauucuacugaaauaugaaugugaguuguaauaaaauaccugaagagacuucugaaauucauuucagacuuaagggaauguagaggguguuuuguguguguucuaaaaaggaaguauugguguaacucuucccucucuuguagacuccacugccaaucugaaaagcauucuguuuucaaaaauguaguaaggcagcacugauguggauaacaggacagauuuuguucugaugaagaaggauaugguugcuuguuucugucuuugucuuuuuucuuaaaacacuguucuaauuuugaagccaagugugaaaggaaauaaaguugucagaggguccaagaugauguuucagucuucuggguagcuuuaguagcagaaaaauagcugaauguaccuccuacucuaaagagacuuaauuuaggccauuuuguaaacagacuacuuucagucuggcuuaugcugagugaagcccauuuugaaauaaagguaauccuguguuuuaggaaaacaagccagaaagggugaggcuucuguuguuucauuuaguuuuacccuucaaaauaaaacaaauguuuucuaaucacgcucaggucacagcuucucucagaauggaaaaguuucucucuucaauuaaucuuuugacauugcagagauaguucagaaaaauccccuuaaaagcuacagugccaaaauuuuuuauuuucauaaacuccaaaguaacaucacaaguucuccuugguuugauagguuuaaaauuauaauggauuuuagaauauauuauuuucucuuugaucucaaagacauuacauaaauuaauuuuuauuuuaaaagagaauaugugaauaguaagugcuuuuugagauaugagcuguaacuaggaaagggaauaauuuaguuuaaaauuuguaaaaagucaaauuuugaaaagcauauuuuguaugaguauaguuucuauucucauuugcauuguguuuguacuguuuuucaucugaaguuuacaccuacauuuuuuucuaaaagcauaaguccuugaaaauauuuuaguuuaaaugcacgugucaaauuucuuggucucuugaagucaacagcucccaaauguuagcugaauuagacuaucagugauuucaccagguggcuagugacaguuaauauuuagguuuuuaccagaacaugaaguguuugucgggguauuuuuuuaacauacgccgugagaaugacauuucuuauauuacuuuaaacuauuuaauugcaguuaguaucaaggcaagauuuguuucuuuaucuuaaaauauuagcuauaccaugaaguugagauuugaaauaaaaagauuacuucuagcuuaauuggagcagguaggaagugguggcauauaaaaggugaauauuuucauaugcacagcugugcauguauucuuagggcucuguuggccaaaaucuguuguccuaguagugcucaggugcauaauucagucaguugaaucacagaugauccauuuucaaagcacuuuaguaguugggugucaagggaaaaaaguuguaauuuuaagaacuucauccgcaaaucauguaaugguauuuuuaauuuuagcuucccaaaucuguguggacaaaaauuauucaguuauaaauaaaagauguguaaauccuuauuccaguggccuucuuuggggugacagggaggaguauuaggcgauguuacaggauauuguuacaguuuuauauuuuguuucucuguguuagacuuuucuauuugauaauacuuuuucaaaaaugaugcuauaaaaacccauuauuauagagccauuaaaaauacaggucuauuauccagugauuaauauccaugaccuuuauuuuuggaucggcuucauaaauauauacauuuucuaugucagccauugucuggaauuucauuuuuguucugcuuuccauuacauaccaugaauuaaaugaaauuaauuuaaucgcuacuacaaacagaaauuaaacgugcccuaauccagaguuacguuguuugcuuuuacaacuguaagucauaaguaauuaauuuuccuuggaaaauuaauucacuuagcauucccaguagcaucauauguugacacaggguuauagauaguuuaauauuuuucuucagcaugcuggccucaacuuuagaagaccuuaaaugaaaacaaauuaaaauuuacucaacuguauguaauuuggggcuauuuaaaauaaguguuguuguuauugauagcauccaggugaugacucgaaaauuauacucaaacuuuacaaaaugcccauuauguauuagcaagucugaaacaauauauuuuuuaacauugguuauaugacaguagccauuaauauuuucugucccucaauucugaauaaacauuugacaugagaaccaucuaacagcaguagcauggaaaguuuuuuuuaccaucacuuaacugucaagaaaacaaaaggguuaacuuacuugcuggacauuugaccaccugggauagcaggccauccugucugauucuuacagagcuuauuuucagucucucaccucggucagcagaaaaauuucuaucaaggucaucuuaaaacauagaauauauugauugccguuuucuaauuguuucauucuuuccuguuuaauacuuuuuuuccccuuacuuuccagaaaggccaguguggaaaaugaaauaagcagaagucuuucaguuaaacaagcuuucccccacugcuuuuuauauucuggggacucagaaaauaugagcaaaccaaauuuagcuuuucuuuugcauuugccaggagguuauuuaguaaggugauuuuuuuuuucugguucacagaacucuauaaaacauauaguguuuauuacuuuauguauauuuauuuaagucacuaaggugaaacuguagugaugguggcaauguuacaguuuuaacaaguggggcuuauuuuauaaaugugucuuuguggcaauagcuuucaaaaaugcacaggguuagcagugacaugcucuuuuggaaagaaaauuugcuguuuaauuccaggguaaaaguacuacuagaacacaaaaucaccacuguuauuuuuuuauuuuuuauuuuuugguuacuauuuauuguuaaagucaacuuuaaaaaaaucuguacucgcaggauuuaacuaacuacauacauugcaaaguugugucagggagaaaauguuugcuuguuaucccuaucagaaggggggugacagggaaguccccuucccuaugcuucagaggguuucccucugaguggccuucagaguuaggauaauggcuuuccucuuuaucaucaucagacaaaaugaaaagauuacacaugucaaguuacgcacauuuauguuuuugcucugaccuaaauauagauuguuguacagucagguuuaagggaaagcagucuuucaaaaauaauuuaggcagcccaggugaugauuauucuaaaaacucuauuccuaaaucuacuaucacauaccugcaauacgauuacauauaaauacguaugauaaugcugcauacauucuuacacaguuuuuaaaaaaugcuucugccuucuuucugaaaugaacugguuuacuuuauucugguuuugaaguggaaaaguaaauucacccuuauagaaauuuacuaauauuaaucugcauuuaauuucagaauauauucucuuaaaaauuaaauuuaaaugaaaagaguuugucauguccuucauuaacuuuugugucaaaaugaauaucuuagaaaaacauuuuauagcaaacuaagaaguguagaggaauugugugugugguggguguacacaaggagauuuuaagaguguggagaaaagagaugcuaaauuugagcuacauaauauuuacccaaaacuggcaaaggaaaacuuuguuaaaauauauaaaaauuauggauucaagaaacaaagcuuggagaaguaaaauuuuuuacuucuuacuuucugugauuauucuguugauucaaauuagaauagaaacaagauuuugugauagaaauaugaaugugcuuuuuaaaaauuuauaauguuaagauauaacaauguucauaauuugcugaaugauugugacacaugaaaaaccgugcuguuugugagaaguagacaaacaaauguucgugcauuguaagaacucugaggaacuuagagcagacuaucgcuugaguuuggucaauaagacuuuauuuuuuaccugcaagcagaguguaaguaaucauaauuauuccuaaauugcucccuaaagugugguaaaagugggguuugcaaacugcugauauuuguuggacaauuagauugauguuuuauaacauguuacuauucaauggaguccuucacagugccguuggguggaaaaguaaauuuguaccuaaagaaauguacaacuauuaauuuguauuauauuccacacuguucuuucaaaacacuaaauuuaaauaaguuuacacuucuacucacaaagggaauaauuaaauuaaggugauauauagaaagauaaaauggcaauuuaccaccaccugagauugacaaaacucucccaggucuuucaaagugaaucaugcucccagucauuaucucacaguaccacgaucuuacacauugacaaugggguaaauuggauuacauuuuugcuuuuacuagaaauucaaauaaaaucuuaggcaagauagggaauaccacauuguaauauccugcuuuuaugcuucuguuagggcuguacauuagucuuuggcuaauagauccugcuagauaacgcuuuuuccuuuuguagcaccauucauaguuugaggcugucuucaaucugaccuguaagaacucugcuucgaaagacuguguauauaagaauguuggaauaauuuaauacucacauuuugauagguuuaaaaugaacuggagauuuauguuaauugcaguggacgaauugccacauuuguccuacuaaaguugcuuaucagaagaggaaaaugagcagaagaaucuuuaaaaagaauguuuugucuccaaauuauuuuauauuuguauguuaacccagaacuuuuucucuagucucucucuguauauauuagaggaguaauuucugaguuuuguuuuucaucagauuugcagugaagauuaaaaacaaaaacagaaagaaccucuuugcaauaaacaucacuaccacauuuaaguuuguaauuuuuauaagaaaggaacacuaguuagaagcuauuuuuuuuugaguuuuaauauuuaccaaauuuauaggaacucucaacauguuuuacauuuuuucucuccauguauguaaacagaaugaaguuaaauuuagugauuucuucccuggagugauuaaaaguaauguaauuuguuuguuaauaacaaacuuaaauuuauuuugacauuauuguauuuucuguauacuauaauguggaaaaaaguacuuaaggaauggagagaaauagacuguucuagcuaauaaaagugcuuaacucuggaggggccaccaaggagucugucaugauugacaagcauucuaguggagucuuucuuuccuuuuucuuuucuuuucuuucuuuuuuuuuuuuuuccuuauagcaguguugaagucagucaaaguauauauacaaagcucggugaauaccaguuuccccaguacaggggcuauuuuuucaggaagucuaacucaaaccagauguuuugccuagaccuagaguuuguugcugccaagcaucucaucagaggucagaguucugggcucugggcccugcuagaauucuuucacaaauugcuauucggugagguuuuaauccuaauggaaagaauaaugugcuuguaaaaucugcaguuauuacaaacacaguauacauauuguggacuucaaaugacuacguauuucauccccauaaacagggaaugcagaugaaugccuugugugauagcuucagacauucuaacgaaaaccuaguauacaguuuauuccacauuaaccauuugcauuuguaauacccuaauaaaagaaacuguuauuuuugggugacaacugguaaccaacuuacgcccccccaccacaaccaauuuuuuuaacaagcucuacaaccccauacagcuguuugaacacaagaauuaaaaacauucagaaccaaauauuggauauucucauaggaagaucuaugaaugcuauaguacuaggugaaaaguucuuaaagcaaaagacaccaguaugccaagacuuagcuaucuuauauuuagaaacacauauaaauguauuaaaaccaaauucauuuauucaaauuaggaugaagaguauuuuucuuuguaauggagaaugugauugguauuuaacuaaacaugaguuauagcucuuugggaaagguuaaagacguguacugagauugauuauaucucugcauaauuaauuuuauauacaaauauuauggauauuauuagaugcuuacuugggggcacugcugcugcugauuauaagccugagagaaauucucagguaaaaguaggcgugugaaaccagagaaucacaauuuggcuuagaaauaagaagguuaauuaaacuauccugcagcaauuaaauaaaucugcaguuaaguuagauguggcaaauuuuuaucaaaacagugaaagcccaaauuucugaaaaugagaaauugaacuguaaaauaaaaauuuuaaagacagauucuaaugucccugaauuacuccuuaacauaugaaagcaguuuuugguuugaacaguuuguagcauuuauuugggagugggagucuaauuucuaaauaccuuuuuguuuuuauauuuaaguaacaauacggaguauaauaaauauguaaacaaaacuuagucuucaagcaaauaaaaauugguuaacugugggaucccccaaaauuuuaaugaaacauuaaaauuuuuuaaccacaauuuuuauuuuuaccucucauuuuauuuuuaccucucauuuauguaaaagaaaaucaguuuuuauuuuuaccucucauuuauauaaaagaaaaucaaaauugauaucucuacugcccagacagacaauugcauugguguugagaggagccaucauuuacaugaacuuaaagucucuucguugcugccagcaaauggaaaaaaaagaaaagacuuguugaaguauguaauguuaaaaaaaaaaaaaaguuuggaggauauuugugcuuuaccacuuucuaaguuguggaacaauuuuaaaauucuauuuucugauuaaucuuuuugcuguugugugucucugaagauacuguaugccggcagaucuucugcagaguauuuucucaaagaaaagugauguguaucucaugaaugcuaucucucuuccacaaaaucucugauaguaugucauaccuaguacucugucauuuaauaucaguuuauuguauaauugccaauaagggacuuuuucuuggaagaaaggugcaauauuaaugcacaguauuuuuauuaccuuugguauucugaaaagcgaaauaauauuuuucauauguucaauaauuucacccccguaaaguuaggggauaccaucaucuaugucuguaaagacggugagaauaaaugccaaaacuugaggcuacauuucauucuguauggcauaauccauucaagugcaauuaaaaaaaauaguccaagacuaugaucacuuaaugagaaacaaacaauuucauauuaaugaguucccauuugccaauaauucugucauuuguagcuugaaucagucaucacccugcaaauagcccuuucaagacauuauuugcaauuuuguccuuuguuuucuguccuugauguugugaaaauggccgucuacuguuacaggaaugaaaagagaucccguucaaacaucuuuuguguuuccacuuucagugaaaaauguuuuucaaaccugcagcugguuauuucugcaggaguucccacuuaugcucagauuugauugacauuuugaaauggcagcuuuucaugaaaagcuguuaacuuguagaauucaguuauggcacuaagacagacugacuuuguucuguggcugggaccuguccaaacuaaauagaacccugcaucugaauuuaauagugcuacucagccaagauagggcacuuuugccuuuuuucccuucaaaacucugaugcuucuuauauguucuaaaacuaacuugauggguauucaucccaacaucuuucuguucuguaauugcuuuaauugacguauauagucauucucuuguucccucccuugaacaucuaauggacuaggacagugcuuuaagauauaaugcuaauugagaagaacuucuuaauugauaacuaauguuacagagcacagaaaauuuaaaaauauuguaacucuuccaguauagaagaucuaaaauuuuuggaaacauguuacuacuaaagcuguagauucauuaugugaaaaauaguuugcauuugguacuauacaaauauauaguuuauuaacauuuuucauucauuuacucaauuauaccuacaauuucaagggaaaucugcuauaaaccccacaaaucacaaaguucaugaucccugcccuuaaggaacuuugaauucgcuaucuucucauuauacuuaacagagaauuaaugcuuccaagugugccaauuuauaaaauuauuuagugauaaucuuuaauuuuucaaauggccaacuuuucuuguauuugauuuccauauaacacucucacgagaugaauggaaaauuuaguaucguaggccuccugugcuucuuuuuguggucuuaugucaucuguuaagaaagguuaaaaaccugguuucacuuccaaguguuugggcauuauugguguuauauggagccauuaacccugaacagcuguaugugauaccugguuucaccugccuuaagagagagggcugugacauacaaugacuauagacccagaucacccuuaugaagcccugaucacccuuaugaagcacuggucuucgccuucucagcucauacaccugaaguugaauugaaguaguugacucaagaugacucuaguucguguuaacuguagcucgcuuauuucugcggcuuuacucuuagauagcuaauuuccacagcauauccauaagagcacaagcuagugcuacacaguaugcccucugagaauguugguguaaaaauacaguguuuuaauuuguauagcucugaaaaaaacuucgggguugaagugguugaaauauuggccaaaauuauaguccuaauauuauuccuggauuuuaguaucacacccuuguuaucauacagcuuagauacuugaaauaaaaccauacauauccaggauuucagaggaucgguaaaacuuuacaaugcacuguuaguaaaaguaauauaacuuugaagucauauggcgauuucagaaucaaaauuacuuuuaaauaaguguuuaaaaucacuuauuuuaugaagcgauuuuagaaucuuaauaugacauuuauuaggaauauccguggacucacagucgguaaacagguagccaaaagggcauuccucuguccuucugagggaguguaaacugauuuaacuguuucagugugcagacugacaguguguaucaagguccucaaaauguccugcuuuguuuugacuaguucucuuuugagcauuaugucuuaagcaaguaaauuguuaugcauaaacauguuuuuauaguguuaccuauaaucauugaaaacuggaaaaguaaagaaaauguucaauaaaaaagacauuaaaauuuguucauauaauugaauaaucugcaaucguuuaaaauuaaacuuccaaagaauuuuuaauaaaaugugaaaauaaaauguucaaauaguuaaaagcuggguucacauuuguauuacagaagaaaaauaugccuaggaaaaccugaaggaaauauccguaaaaguuaagaugaguugccccaggugauaaaauuguauuaguuucuucuucucuuugugcauuugugcacugcucuaauuugcuguaauuaaaacauguaacuuuuuuuccccuaaggagaaaaaaguauuuauuaaaugagaaauccagagaaaaauaaugacacauuggaauguaggaauccuguuuucuaauuucuuucaggguagcuucaguucuugaauaauggcccuaguucaagaggugaaaaauaguuaucugcaggucuauuccacuagcagaguauuuuugcuugucuagcacuaaaauuuuuaaauaauguaaauuugaaggucguuagggcacaagccuuuccaguuuacccuaagccuugacaucuuucucuugugccugugugauuucgacauuuguguaaccucccaggccucugagaugcaaauguugcauuuuuccagcucugugccuaaugcugaauaccuuugucauaauaguagaaugguccacuccaaguuugggauuuuggguuuuuuuccuuacucagcauaugguaauggucauggugaucauaauguuuuuuuguugagccuuuuuguaguacccaguuuauaauaaaauauauuauucuaucuaguucuaauaauucuguauggcuaggugcuguuauuuuccccauuucguagauaaaacaacuugaagcacaaagagauuaagaaucuguuaauaguagaggcaagauuugaaacuaagucuaccuggauucaaaaucugugcucuuaauauugauaacuaaguuauaugcagaaugauuauauuuuagcaucucuggaagucuuuaaccaguaauaaucuuaucuuauugaagagaggacucaguaacaauugcuuuuccuguuucuguaugucauaaacgacaugguauuauuuaauacucucauuaaacaacaaauuauuaaaaaugcauccuuuaauacucuuauuaaacaauaagccauguuauuuuaaauguauaguaguuguauguuguauguuaagauauggagagaaaauacuguuuacuauggaaacuugauguaaauauucucugccccaaggaaugguacacuuauauaaaauuauauuagcuuaaaauguguaauucugauauacucagcuuuuguuacguaacauauucaggaauauaaccccuacaauaacuaucuaaguguauaaaaagaaagcugucuguuaaauaauuugauauucaacuuucaugguuuuauaugccuaauggcuauucuucaaauauauguuuugguuuaccuuuugguucuauuuuggcaaaagaaaccaauuugggagauucugauuagaggcagaaaauugccuucuauauggaacagaaaauaauguguuccaaaauuuuuaauacccuuaugaggguuaaaucacuuaacucuuuguaucugacccauuuaggaaaugugacaugccuuuucuuuuuuuuuuguuuuugagauagagccucgcucugucgccaggcuggaaugcaguggcgcaaucucgacucacugcaaccucugcuucccugaguucaagcaguucuccugccucagccucccaaguagcugggacuacaggcgcccgccaccacgccuagaauuuuuguauucuuauuagagucgggguuucaccguguuggccaggaugaucuugaucucuugaccucgugauccaccugccucagccucccaaagugcugggauuacaggcgugagccacugcgcccgaccucaacaugccauuuuaaagguaauuuuuuacaagugaugggaaaaggaagaaagucacagaaguaauuucugcuuuaaacucuuuaaggagaaaguauucauuaugcagauagaaaacauuuauuacacuaguaguacauagaaaauuagaaaagaauaaggacguaaaacccugccacugauggaugacuguuuggagguguauaggaaguaaauguucuaaguucaugcauguugaaaaagguauuuugcccuccugcuugaauaauaguuucaguggauguagaauuuuagguugcaaauauuuuuuccuuaaugauuucuuugcauccauucuuuugccuucuaccacccagugguauugauggcagucugaugcucauuccuuugagagcgaccuauguuuuuaauuuuuggaaguuugggguguuuuuguuuuuuuguagguguucugugggguuuuuuuuuuuccaucuugauaugccuagaugcucaugucuuuuuauuaauuggguugaacacuucuuguaccuuuuguaaucuaaagauguccuucacuucugggaaauuaucuuuugcuauauauuugauuucuuauucaauauuggacuguuaggaccagacuucacacuugaaaacucagacuugggaaaaggauccccaauccuuaagaugugagaauuaaugauuugggaggauccuuaaggauuaaggagauucaauugugguaggguauggcagaauuuuugccucuucucuuguucuccuaccucaguauacaugguuaggggacucccugcucucccccaggcaugauaauggggacuuagggucucaagacuugcaguuccagcauuaaagacauuaugaagcagggaccugauucagcaccucagcuuucuaucaggauugauuagcuuaugcugucguucccauggcauacugugcagaaggccaacaucugugugaagccaaccugcugggaaucagucuuuggcaugucaauucguucuuaggaggcaacuguuuuauauucugacuuugaguuaaugcccuagauccuguccaauauggucucugacauaucccaagucagaccucucuagagggucugccugacaggagccacuuaacuguguccccaucauguaugugucagccuacaacuucuuccuucugacuuuucuuacucaagacaccuaauacugaaguuuugaggcaaacgucuguuccuagccauugaacuuucucuaguagcagguacaucauagaggauuuggcaagggaaaacacccuggccuuuacuuuuuaaaccauguuuccauuuuuguugaacuuuacuggggaaaaauuguagaacuugagccuuuaaauuuaaugucuguugagaugaaaacguuucauaggugaguuaucaguaguugaaaaguauauaugacucuuaguaauagcuauuauuaaaacaaugauggacucuggcaugguuuaagucacugacaacaugguuuuucuaugcugucuaacauugguuucuuuaauauguuucugacuuuguuccguggcuugacuaacacuaauuccuuuucuacuuuuuuuuuuuuuuuuuuuuuuuuuuuuuaccucugggaagauauugcuucugugcauuucacacuauagagagaaacuugccucauugugaccccuaaccuauguaguaaauccucuaaaauuaauuuugguuccuucugaucugugcccccaugugacuccccccaagauuucauuauuagauuuugacagccuuuuaaauuuguaaaugccacaaauuugucacuagagaugaauggguaaaaagaaaauuccuugcaguggaggauauggguaaaauauuucaagugacagaucugcaucaauaauguuaauguuuauggggugaugaaaaccauguaagucuuaagccagaaucuuuuuucagcugagucccagaaauuuugaccacagaagccaaggcacauuccguuuauuccaacaaguguuuuuucacauccuuuccaacugucugaaagacaauugucacucuuaaaugccugaaacuuuagaugcuuuuucuacuggauuaguuaaaagcaauggaaacauugucuacuguggucgggaugacuuuugucuugccuugaguuccuaaaauggagagcaaauuugacaauguuauuuugcccucuacuuuuuauguucaucaucuggcaaaguuuucaagaaauuuugcaucauucuuucugacugacuucugaaggcuuacuuucaugccagaagguugccuuugcugaaugaacguugaguggucacagggccagaggcuuugucucuuacugauaccaaaggaguuccccaacuugaguggcuucugaugccagugcagaagagcauuaguauuugagcaguugagaaguacauucagaggaaauuuagagaaaaagauuauugaaauuaucccaauuaugaugccaacuaacauauguaugugauuauuuuuaacuaaagaagaaggauaaagaacuuugaaccaguauagugugguccuuugucuauuuauuugcauauuuugauuuuuaaauaaugaacaaaaaggauucauucaaagcaaagcuauuuuaaacuuacccugaaaaguuaaaagugauucuuugggaaaagaaggaaaaaagauuuaaaaaaaauuaccacugucccaccuucacccaaguguauacaggagguuuccaugucuuuacauauuaacaagcuuauuucuuuacuaaaguuauguggauauuuugguaaagaaaugauaagcuuguuauuguuaucucuaacuucuaggcucaagugacucucccaccucagucuccugaguagcuaggacuacaggugcaccaccacacccagguaauuuuuaauuuuuuuuguaaaguuagggucucacuauguugcccaggcuggucucaagcuccugaccucaagagauccucacgccuuguccuuccaaaguuaugguauuauaggugugagccacugcuccuggccaguauaaauauuaauauguucugguguuaguacuguaaaauggauuuucuuauguagagcuguugaagaacuuuaaaacuuccuguagauucucuguaacauuuuguauuuugccccuuagaauaaaaaacagcugcaccagauuaugaauauuucucuggaaauucagcccuguaauagacauuuauggaguaccugucauuaaagauuaagcgccuggucugaugaaaauuacuagauaugcguaagaaaaaaucuggaagcaacacucuuuguaaaacuaguggguaguuaucaccucuuuuuuuuuuuuuuuuucaaaauaacuucagaacuauuugcauauaaccacugcaaaagaguuguuuuguuuuucuuuguuuacuuagcugcuuacaguauacacauuuccacuuuauucccugauguuacugguucuucucccuaccacacccugccugucugccaaaguuuuagauguuuacaguguucuucccaucugcaugcuagacaguuucuaccuuaaacaccauugaucucgucccugaacuccaaacuccauauguccaccugccaucuuaaccuuucaauuuggaagucuaauaggcuucucaaacuuaacaugucuagaaaaaaacuguugacgucccuccacuaaucccccccaccaaaauuuuaaaauuaaaaccgcaguacugucuuauccuucccuguuucuauuaauggcaucaucaucugcccaauuaguaaaacugcaaaccuguugucauuaaaaacuucuuguuauuaagauucuuuauucuuccuuuugcuucaucauucucuacuauuaacuccaucugcuucuuucccucuuuuuccuccagcuaccugacucuaggcagccaucaucucccucuugauauacugagaaagucucuuaccaggacuuccuguuuucacuuuugucuuuuuaaaauccauuuucuacagcauaauuuuuaaaaaguaugucagaucccaucucuguucccguugucucuggaauaaaauucaaacuccuugccauggagacuuacaagagcuugucuacucuccagccuuauuucuuaguacuuuccccuuuuuuugguuaugucucagccagauugcccuccuuucaauuucagcacuguagcuuguuacuacguguggccauucaaaacaguagauauuuauuacaaacuuacuuuuagggacgagacacuacugccuccagagaaggaaagaaauuuuguuagaauauuauaaaaggguggcauguaaagguagcuagacugccuuaucuccauuucuucucagugucagaaaacucucaaacuaaaauggaaauaaguugcugauucacuuuaaaacccaaacuuacuuaaaauaaacugucaguucuaagcugagauuuacuccaauagaauauucccuugauggguugagaaugaauaagaugaauuaucugaguccugaucuugcucauauagcuguuucuuuaaggaccaacauuugguuccuauaccguaggauucucucccugguaaagaggaguuaguaauauccauaucucuuuucuaaauuccagaauucuucaauuuguauuuucuuuaacucugugaccuagccguuguccacggcacaguuagucugugggucaaaugggugugguuucaccuaauucucccagaacgggagauauugcaggaaaaugaguccuacuacaaugaacauuaaagaaaagauuaugucuaaaggcaacauuuucauauaaguuuuuucccauaucuauuaauugcaucaagguaugugucuguaccaacguaugcuguuggaccuuucuguuagaggugcuuaauugguuucugaccaugucaguuauaagauagagaaucugucugugguaaaugacaucccauaaaugaguuucauaaggcuugaccugggagcugacaugucaggacuuccuagugugucuuugcauaccgguucuaaaucucccagcuucuuugguaucuuuuuauuguaugacaagaugcuguacuuuaguucauguuugaagcgacagaagcuuaaguuuugaguucccaggaaaagaaagacuuaaacauuuccaauuaaagcaucagagauuagucugacuagggugugaguuaacaggaacucuuuauugaccuaaaaaccuacccagaaaguauuggcaugagaauuuggcagcuuggagugggagggccuauggcuauggucagucuuaacauguuaggacaucuuaaauuucacuuuaaaauuucugaguuugcuguugauugaugccugcuaagaaagcguuucuauaauaggaauugagauugugcugcuguaaugcccucaagcaaugccacgucaccaguaucuccuccuauuuuagggcaauucuuuuucuuaaaccaaauucccagcuucagcaagaagaauccaaaagccgaacuguuagaaauuugucccugguuuuuccuuccuuuacccaauuuauugaguagcuacuauguacuaagaagcaugguguuaagaagugggaauacaaagaaaagucuaaauggccagcaaaugaacaaagagaucuucaacuaaaccaguacuuaaggaaauaaaauuaaagcagcaguuagagugaguacguacuauguaccaggauacaauaacaaaucauauuuauuuacuuacacacauacacaccugugugcaucaggugauaauaaauacuauggauaaaauaggaaauggggauaggaacaguaugggaggcagaguuuugcagccuggucuucacugccaccagugcaugaggcuagguguggaggaucauugcagaucacauggagugccugggcucugucgccaugguuauguagagaugggacauggaagcgaaaggaaaccuuuccuuuccauauuaacucucugacuccacauuaauguggauccuguccuggcagugucagccucaggucuaauuugaaagguuuacugucuauaauaauaaugggcuggaagccaguucacaucugacuacauguguggccacauacauguauguguauuugggaagagaaaauguaucuuuagaacuuacuacuggaaacauuaggaaagagccuuuuuucuacauguggagaagaaaagccuuuuuuuauuauuaugcguuaauacucuuuuuuucuccaaccucugucuccucaaacagacaaauaauuuaaacauggcugucaaaauuucugaacaccaggaggaugccucccugccuucccucccuccuucccucuauuucugucucucucuuucugucucucucacacagaaccauaguuucagaucagauuuucuacacacuguuuuaauuuauuagaagggaaaaauucuuucuuauggcuaaaaguuugcacucuugauuuuucuaaaguccacuuuuaugacuaagcuauaaaucucuaaaaauagagauuuacaguggaaaugucaacuccuuuguauuaugucaggucaaaauguguagcuaauuggugugcauuuguucaugcauaugucaugagccagaacuauguuuuagcccagugaccacacaugggggcagauaggugugguccaguucagauauacuaauguuuucuuuguuuaugguaaauuagaauagugcaagguacugguuuggaaaaauaugugggcaaggcagacauuuaggauuuaugaaccuuuacuuagccaguauugcccuaucauucguccaccauaucgaccuguauccacuaggggacauaagaacaccuacuggaggaaagaaugaaaguuugucugcauuaaaauuuaaacacaggacucuuagauaacauacaaaaagacucauuuuuuuaguuucaugauucauaaagaaguuauauauuuuguuuaaauuuuaaucaucaccagaaacuuuuaaaggcaggaucaguaucuuaacgucuauuuauggaaugagaaccaaacaagcagcuaacuagcaagcuugugucauuaacugacuaccuauguggucuacagaagcuaugcugagaaugauucuggcuuuacaaaauacuuuauauagaaaaggauuaccuuuuagagucaggaggugagacaucuggggaggacaucugcuaucagauugcaguggacaaaaaccagaaguguucuauauuuugcaccccggccacuagcuaugaaacccgagagacagauguuaagggcacugcuguugucuucuaaacugauuaucuggccuaccagguuagaaacuuagguuguauuuuuuacuuaugguucuuuuuuuuuuucgguaugaucuaccugcagaaaaaaaugcaaagauuuuaagugauacagucuuuauagacaauuuuugcuuuuuaguuggaguuuuuacuaacauuuaauauaaguauuaauauaacugaauuaaggucuacaguuuugcuguuugcuuuguuugucccaucugcuuuuugaucauuucuuguuccuuuucugccuuauuuuggcagaaaaucaaaucauuuuuaguuuuucauuuuaauucuguugacuuuucagcuauacuucuuugcauuuuuuuuaaagugguuacucuagggauuauaauacacagucauaucuucucagucaacagugguuaauauuuuaccaccucaccuccuucuuugugcuauauauauaugcauauauauauauaugcauucaucaauuguuuuauauauauauauauauauguccuagaauaccauguuuuacuuuuugcuuucugguuuuaugucuuuuaaguaaaauuagaauaaacacgcacaauuuuauauuuacccauauauuuuccagcuggugucaauuuccuuuagucugcaaaauucccuuuaaaauuuuuuuguaguguaggucugcuggcaaugagaucucauuuaucuaaaaaucccuuuuccguuaucuuuaaagauauagaauuugagguugacaagugguugugguguguguaugugugugugcagcacuuuaaagauaccguuucauugucuccuggccucuguuguuucugauaaaaaguuaaccauuacucauauuguuguuccuccauauauaacauguacauucucucuggcuacuuugacaauuuucccuuuaucuuuguuuuccagcaguuugaccauaaaguuucuagguauaguuuucuuuguuuuuguccuucuuaggguucacugagcuucuugcaucuuuacauuauguuauguuuuugaaaaaauuggggaaaguuuuguuacuacuucaaauauuuaucugcccuauucucucuuucccucucaggacuccaguuacauauaguugugcauugugaucuugucccacaguucauuaagguucuuuuauaccccccauccucgccucuccuucuuuuuuuauuucuggucuucagauaggauaauuucugcauaucucucuucguguucacugauuuauuuauuuuucuacuccaaucugcuguuaagcccauucaauaauuuuauuucagaugcuguauuucuuuauucuuuguuuauuaaagcuuuaauuccuuuacugcuguuuaccaucuauucauugauuugggaccauauuugccuuuaaguccuggagccacuuuaaaguucuugucugcuguuuccaacaucugggucauccuaguuugguuucugcuggauaaguugacccauuauucuguuauuggucacaugugccugcauuuuuguaugucuagcuaguuuuauuacaugguggauauuguggaugcucuguguuguugaaaauacaaauuuuguugucuuccuuuaaagaguauugaauuuucuucugguaaucagauaauuaacucucagaucagacuaucagaucagaaugaaucauauagggauuuuuuucaagacuuauuuuuaaagcaguuuuagguucgcaacagagcaaaaacuacagagaguuaccauauaaaucuuccugccacauaugcacagcccccuccagucucaacauucugcaccagaauggcacauuuguuacaauugaugaaugcauaucauuaucagucaaaguuaauaguuuacauuaugguauaauguuacacauuauggguuuagacaaacagauaauaaccuauauucacuauuuauaguaucauaaagacacuaaauuuuaacaaaauccauaucaauuauuucuauuaugaauugugccuuuauuguuguaucuaaaaaagucauugccauauccaaguuuaguuagauuuucuccuauguuauugccuaguuuuaugguuucauguuuuacauuuaggucuaugauucauuuugaugugaguuuguuucauuuuuugucuuuguuuuugagacagagucuuagucuaucgcccagauuguagugcaguggcacgaucuugguucacugcaaccuccgccuccugagcucaggugaucuucccaucucaggcuccugaguagcugggaauaucaacauguaccaccaugucugucuuaugauucauuuugauuuacuuuuguuaaggguguaagaucugugucuacauucauuauuuugcaaguugauguccaguuguuccagcaccaccuguugcaaagauaccuuuucuccauuguauugccuuugcucuuuugucaaagaucaguugacucuauguauaugggucuuuuggugcuuucuauuccauugaucuauuugucuuuuuuuuuuuuuuuuuaaaccaauacugcagugucuugauuacuaugcuuaguguaguaugucuuaaaaguuagauagugucaguucuuugacuucauucucuuuuaauacuguguuggcuguucugggucuaauuagcucucuauauaaacuuuagaauuuuaauugggauuguguugaaucuauagaugggaagaacugacaucuugacaguauugagucauccuacccacauacaugaaauaucucuccucuuaguucuuugauuucuaucaauagaguauuguaguuuucuucuuauagaucuuauacauaucuuauuagauuuauacuuuaagcuuuuggagggugcuaauguaaauguacuguguuuuuaauuuuaaauaccacuuauuuauugcuggcauauaggaaaacaguuuacuuuuguauauuaaccuuguguccuacaaccuugcugugaucacguauuaguuccaggaguuuuuuaaucaauucuuuugaauuuucuacauagacgaucauauuaucugugaacaaagaguuuucuuucuuuccucaugauaagguuaggccuuguguccccacccaaaucucaucaugaauuguaaucaucaggucuugagggagagaccuggugagaggugauuggaucaugggggugguuuccccuaugcuguucuccucauagugaguaaauucuaacaagaucugaugguuuuauaaaugguaguuuuuccugcacuuagacacacacucucucucaccugccaccauguaagucaugccugcuuccccuucuaucaugauuguaaguuuccugaggccuccccagccauguggaacugugagucaguuaaaccucuuuccuucauaaauuacccagucauaggaaguucuuuauagcggugugaaaauggacuaauacaccucacaaucuuauauaacuuuucuuuucuuacugcauuaggugguacuuccaguaugauguugaguggugguaagaagggacauccuugucuuguuucugaucuuagugggaaauauucugguuucuuaccauuaaauguuauguuagcuguaggguuuuuguagauguuuuuaaucaccuugaggauguuucccguuuguucuuaguuuauugagaauuuuuaucaugaaugaguguuaguuagauuuugucaagugcuuuuucugcagcuaggacuaugugauuuuuuuuuucuuuuuuagcuuguugaugugauagauuccauuaauugauuuuuugaauguugaaccagacuugcauaccugagauauauuauauuuggcuaugguguauaauucuucuuauagauuguuagacuugauuuccuagcuuuuuugagaauuuuugcaucuguguucaugagaaauacugaucugucauuuucuuguaaugucuuugucugguuuuggaauuaagguuaugcugguuucauagaauuauuuaggaaguauucccuccgcuucuauuuucuggaaaagauuauagagaauugguauaauuucuuccuuaaauguuugauagaauucaucagugaacccaucugaguaaggauuauuuuuuaaaauuuuguuaggguggggguaguguaauccuuucuccaggacuagaauagcucacuucuaccccuuucuggguaucagcagaguauccgggguguucaacgaggucucuucaguaugauugguaggacguccuaugucucccagcuuuguguaaucucaggaaucucuggguagcugccaacucacaggcagcuguuuuuuuuuuuuguuuuuuuuuuuuccccuggccuuguguugucuugucuuggugcccuggguaugugcagcuuaguauuuagcuaaaugcuuaagaugucacuuauaugaguaacuggaauacugcucuucagagcuucauucucucugauaucauacucuuaaaaccuucaggaaucccaaccuccagucuguuucuccagcucaguaagauuacuauguccugcuuggguuaccuccuggugccacagucuagaaaguguucucagacagaaagcuggggcaauuuugaggcuuauucuauguaguuucccucucccuggaaucauaguccugcagcugucuaaaauugguugccauauauucacuauucacaauagcaaagacuuggaaccaacccagauguccaucagugauagacuggauaaagaaaauguggcacauauacgccauggaauacuaagcauccauaaaaaaggaugaguucauguccuuuguagggacauggaugaagcuggaaaccaucauucugagcaaaccuaucgcaaggacagaaaaccaaacacugcacauguucucagucauaggugggaauugaacgaugagaacacguggacacagggcggggaacaucacacaccggggccugucgugggguggggggagcggggagggauagcauuaggagaaauaccuaauguaaaugacgagugaaugggugcagcaaaccaacaugacacauguauacauguguaacaaaccugcacauugugcacaugugcccaagaacuuaaaguauaauuaaaaaaaaaaagaaaaaaaaugcaaauaggcaagaaaggcuugauucuggagcauaucagauuucagaucuugcugacauaaacaccucugggccaaaaguuuaagucaacuggagacccuugacauucuaauugagaguuagcccugcaaaggaggugauugauuaaauugauucuaacacauaauugauuguauaggaaaucugagaacauugacccuuuaaaaauuuaugaaauuauuaucuguuuuuagagguaggagauccuugacagaauaaacugacuuuauuucucugcaaaaaaaaauuguuugccaaauguuaaggugcacauauguaagccaagauccaaugagggcugggacagaaaagcugcuaaagauuugugaggugaauggagauuccagggguuacacagugucuugggaacauaagaauugaggccauccagaauggggagaccucacugaacaacaugggcacucauuugauacccgagaagguccaugacuugaguaaggcuauugaagcccuggaauguuggguuuuaaaaauuaguuuacauuugucuugugcagaacaaauaagacaaucauugucccaaggauccuucugucaaguuggcuugauaauugauaauagguucaugcaaaucugaugcuuaaauacugaguuagcaguaaaggaaucuucagcguaccuuccauaugcuuuaucagaggaggaggauuugcaaagagaaugucuuccuguuuauuuuuuucccucuuaugaccacuggccaugcuucaaucuguguuucuggaucuggaaaaaauccuuccagugcugaugcccuuugccaucuuaaucccagagccuuauaggcacaaugaauuauuuauuuuacaaguuuaugcaucuacaaaauaaaaaucuucugauguuugaaguauguauuuuuaaaagaaugugcuuaugaaaauaucuuuuucaaagucuucuuccaauauuauuuguucuauguacuugucugugaucaggagcuagaacacauagguuuuuaaauagcuaacuaaagcauuucuuuagugcugaacauugucuuuaacgggaguauauaaagaccucuuguuuaccggauuugauuaauuggaggaggagcuuucuuaagcacacacuguuuucucaaauguuucccagccuccugucaguucugucugucaugggucauucagcacacacucguuuggaugacucuuaaaaacugucacaugucaaucaaaggaaaggagaugcaaaaugaagaaguaaacuugcuucauuugaaauugaauagacuguuccuguaaagcuuuuuuuuuccuggguuaagcuuaaauuuauuuuuuuuaauuugacaaauaacauuguauauguuugucacauacagcaugacguuuugaggugcacauacauugugaaaugauuaacucuugcuaauuaacaaauguauuaccucacacaguuauuuuugugaugggugcacucagcauccacucucuuuguauuuuuaaggaauucaguauauccucauuuacccuagugaccgagcaccuguaaagcuuuuuugcaucuuugguuuucuagcuacauuuuguauuuuggcaguacuaaggggcaggaagagacaugaguggaugauggucgcugaguaaaauaaagacuuaagaauauugcacuaggaauccacuuugggaaaaacuucaaguuuaguauggggaauguaaagugaaauuuuguuguucuagaaacuguaguccacaguguuucaucuggaaggacuuuaaaaaaauaauaguuguuagauacuuuucguccuucagggcaaaauaaaacacagcaguuugaggagguuuuucagaaguuugugguagaguaauaaaguuuuauuuuuugagaauucugaccuuagaacaaaagcugacuagcauaaaugaucacuuauauuccuuuguaaaaaucucauaaauuuuaauaaaaauauaaugucccaggauuuccuugaauucgaaagagagacuguuuaaguaacuugccccaaaaauucagaguuggguaacuucuauuuaaaaauggaacaguccauuuuuccuggcaugaaguccuuagggauuauuggcacuguuagcccucaggcccucuugcuucuuguaccaguuacugccaguagagugaugugucacaacucagcuuucagcaaaucuaaauggagcuucuuaaagacauggaauacauaugauuuuuucuauacuuucaacacauagcccaacuugcacagugucugguacaaaauaguugcuuagaaauguucuuagaauagcaaaugaaugccucugcuuuaaugucaaagacauuauuauggaaacaguaugggauuuuguucaguauuccuuccaccaaauagauaugauuuuuaguuuuagaaaauaguguuggccaggcgcaguggcucacaccuguaaucccagcacuuugggaggcugaggugggcggaucaccugaggucgggaguucaagaccagccugaccaauauggagaaaccacgucuguacuaaaaauacaacauuagcugcgcgugguggcacaugccuguaaucccagcuacucaggaggcugaggcgggagaaccacuugaaccugggaggcggagguuguugugagccaagaucgugccguugcacuccagccugggcgacagggugagacaccaucucaauaaauaaauaaauaaauaaauaaauaaauaaauaaauaaauacuuuuaacucuuuaguacuuuccuaagcaaaaaauuggggaagaauguaagcaaaguuuauauuuacagcugaccugacggcagcguuuacagaaguuucuauuacauaaauagcugcuagaagaguuuuuaaaacuucuaaauucagugaguuaacuuggaccuuuuuucuuguaggauguuuuggugaaauaacuggucuacugguuuguuuuuguuuuuuuucuauuauacuuuaaguucugggauacauguacagcacaugcagguuugauacauagguauacacgugccauagugguucgcugcacccaucaacccaucauccacauuagguauuucuccuaaugcuaucccuccccuagccuuccacccccugacaggccccagugugugugauguuccccucccuuuguccauguguucucauuguucaacucccauuuaugagugagaacaugugguguuugguuuucuguuccuuuguuaguuugcugagaaugauggcuuccagcuucauaucccugcaaaggacaugaacucauucuuuuuuauggcagcauaauauuccauggugccacauuuucuuuauccagucuaucauugaugggcauuuggguugguuccaagucuuugcuauugugaauagugcugcaauaaacauacgugugcaugugucuuuauaguagucucugaguauauacccaguaaugggauugcugggucaaaugguguuucugguucuagauccuugaggaaucaccacacugucuuccacaaugguugaacuaauuuacacucccaccaacagcguuaaaguguuccaaaaaguguuccaguuucuccacauccucuccagcaucuguuguuuccugacuuuuuaaugaucgccauucuaacuagcgugagauuguaucucauugugguuuugauuguguuucucuaaugaccagugaugaugagcuuuuuuucauguuuguuggccgcauaaaugucuucuuuugagaagugucuguuuauauccuucacccacuuuuugauggggugguuuuuuucuuguaaauuuguuuaaguucguuguagauucuggauauuagcccuuugucagauggauagauugcaaaauuuuucucccauucuauagguugccuguuaagucuaaugauaguuucuuuuccugugcagaagcucuuuaguuuaguuagaucccauuugccaauuuuugcuuuuguugccauugcuuuugguguuuuagucaugaagucuuugcccaugccuauguccugaaugguaucgccuagguuuucuuuuaggguuguuaugguuuuaggucuuauguuuaagucuuuaauccaucuugaguuaauuuuuguauaagauguaaggaagggguccaguuucaguuuucugcauauggcuagccaguuuucccaacaccauuuauuaaauaggaaauccuuuccccauugcuuguuuuugucagauuugucaaagaacagaugguuguagaugugugacguuauugcugaggguucuuuuuuguuccauuggucuauauauuuguuuugguaccaguaccaugcuguuuugguuacuauagucuuguaguauaguuugaagucagguagcgugaugccuccagcuuuguucuuuuugcuuaggauuauuuuggccauaugggcucuuuuuugguuccauaugaaauuuaaaguaguuuuuuucuaauuuugugaagaaagucagugguagcuugaugggggggauagcauugaaucuauaaauuacuuagggcaguauggccauuuucacaauauugauuccuccuauccaugagcauggaauguuuuuuucuguuuguuuguguccugucuuuuuuccuugcgcagugguuuguaguucuccuugaagagguccuucacaucccuuguaaguuguauuucuagguauuuuaaucucuuuguagcaauugugaaugggaguucacucauaauuuggcucucugucuauuauugguguauaggagugccugugauuuuugcacauugauuuuguguccugagacuuugcugaaguugcuuaucagcuuaaggagauuuugggcugagacgaugggguguucuaaauauacagucaugucaucugcaaacagagacaauuugauuuccucucuuccuauuugaauacccuuuauuucuuucucuugccugauugccguggccagaacuuccaauacuauguugaauaggaguggugagagagggcauccuugucuugugcugguuuucaaagggaacguuuccagguuuugcccauucaguaugauauuggcugugugucauaaacagcucuuauuauuuugagauacguugcauaaauaccuaguuuauuaagaguuuuuagcaugaagggguguugaauuuuaucaaaggccuuuucugcaucuauugagauaaucauguaguuuuuguuauugguucuguuuaugugauggauuacguuuaguaauuuguguauguugaaucagccuugcaucccagagaugaagccaacuugaucucgguggauaagcuuuuugauguacuguuggaaucaguuugccaguauuuuauucaggauuuuugcaucgauguucaucaggaauauuggccugaaauuuucuuuuuuuguuguuucugccagguuuugguaucaggaugaugcuggccucauuaaaugaguuagggaggaguccgucuuuuucuguuguuuggaaugguuucagaaggaaugguacugccuccucuuuguaccucugguggaauucaacugcaaauucuucagguccugggcuuuuuugguugguaggcuauuaauuacuagcucaauuucagaacuuguuauuggucuauucagggauucgacuuuuuccugguguagucuuggguggguauauguguccagcaauuuauccauuucuucuggauuuucuaguuuauuugcguaaagguguuuauaguauucucugaugauaguuuguauuucugugggaucaguggugauauccccuuuaucauuuuuuauuaugucuguuugauucuucucucuguucuucuuuauuagcagucuauuuuguuaaucuuuucagaaaaccagcuccuggauucuuuuggagaguuuuuuguaucuguaucuccuucaguucuggucugaucuuaaguuauuucuugucuucugcuagcuuuugaauuuguuugcucuugcuucucuaguucuuuuaauugugauauuagagugucaauuuuagaucuuucccacuuuccccugugggcauuuagugcuguaaauuuccuuuuaaaugcugcuuuagcugugucccagagauucugguacauugugucuuuguucuuauugguuucaaagaacuuauuuauuuauuuauguauuuauuuauuuauuuauuuauuuauuuuuuugagacggagucucguucugucgccgaggcuggaggugcaguggcgcagucucggcucacugcaagcuccgccucccggguucacgccauucuccuaccucagccucccgaguagcugggacuacaggcgcuugccaccacgcccagcuaacuuuuuugucuuuuuaguagagacaggguuucacuguguuagccaggguggucuggaucuccugaccucgugauccgcccgccucggccucccaaagugcugggauuacaggcgugaguuuauuucugccuuaauuucguuauuuauccaguagucauucaggagcggguuguucaguuuccauguaguugugugguuuugagugaguuucuuaauccugaguucuaauuuuauugcacuguagucugagagacuguuuguuaugauuucuguucuuuaguauuugcugaggagcguuuuacuuccaacuauguggucaauuuuagaauaagugcgauguggugcugagaagaauguauauucuguugauuuguaguggagaguucuguagaugucuauuaggucugcuugguccagagcugaguucaaguccugaauacccuuguuaauuuucugucucauucaucugucugauauugacagugggguuuuaaagucuuccgcuauuauugugugggagucuaaguuucuuuguaggucucuaagaacuugcuuuaugaaucugggugcagcuguauuggguauuguguauguugaaccaggcuugcaucccagagaugaagccaacuugaucucaguggauaaucuuuuugauguacugcuggaaucgguuugccaguauuuuauucaggauuuucgcauugauguucaucagggauauuggccugaaauuuucuuuuuuuguuguguuucugccagguuuugguaucaggaugaugcuggccucauuaaaugaauuagggaggagucccucuauuuaggauaguuagcucuucuuguugcaaugaucccuuuaccauuuuguaauucccuucuuugucuuuuuuuaucuuuguugguuuaaagucuguuuuauuagagacuaggauugcaaccccugcuuauuuuuccuuuccauuugcuugauaaauauuccuccaucccuuuauuuugagccugugugugucuuugcacaugguaugggucuccugaauacagcacacugaugggucuugacucuauccaauuugccagucugugucuuuuauuuggggcauuuagcacauuuacauuuaagguuaauauccuuucuuccaccugaucgauucggcuauugauacuguguacacuucaugaaguucuugugcgguguuuuucagcuucaucaggucauuuauguucuucucuaaacugguuagagacuaggauugcaaccccugcuuauuuuuccuuuaguuagcaauuccucuaaccuuuuuucaggguucuuaguuuccuuguauuggguuagaacaugccucuuuagcucggaguaguuuguuauuacccacuuucugaagccuacuucugucaauuucaucaaauuaauucuccauccaguuuuauucccuugcuggcgaggaguugugauccuuuagaggagaagaggcauucugguuuuuggaauuuucagccuuuuugugcugguuuuuccucaucuuuguggauuuaucuaccuuuggucuuugauguuggugaccuucggauggggauuuuguguggacguccuuuuuguugauguugaugcuauuccuuucuguuuguuaguuuuccuucuaauaggccccucugcugcaggucuucuggaguuugcuggggguccacuccagacccuguuugccuggguaucaccaguggaggcugcagaacagcaaagauugcugccuuuuccuuccucuggaagcuuuguccuagaggggcacccgccagaugccagcuggagcucuccuguaugagaugucuaucgacuccugcugggaggugucucccagucaggaggcaugggggucaggaacccacuugaggaggcagucugucccuuagcagagcucuagugcugugcugggagauccacugcuuucuucagauccagcaggcaagaacguuuaagucugcugaagcugcgcccacagccacgccuuccgccaggugcucugucccagggagaugggaguuuuaucuauaagccccugacugggccugcugccuuucuuucagagaugcccugcccagaggggaggaaucuagagaggcagucuggcuacaguggcuuugcagagcugcugugggcuccaucuaguucaaacuucacugcagcuuuauuuacacugugaagggaaaaccgccuacucaagccucaguaaugaugggugccucuccccccaccaagcucuagcaucccagguugacuucagacugcugugcuggcagugagaauuucaauccaguggaucuuagcuugcugagcuccaugggguugggaucugcugagcuagaccacuuggcucccuggcuccagcccccuuuccaggagagugaaugguucugucucacuggcauuccagacaccacugagguaugaaaaaaaaaacuccugcagcuagcucaguguugcccaaauggccgcccaguuuugugcuugaaacccagggcccugaugguguaggcacccaagggaaucuccuggucugcggguugcaaagaccacgggaaaagcguaguauuuggggcagaguguaccauuccucacagcacagucccucacagcacggucccucacagcuucccuuggcuaggggagggagggaguucccugacuccuugugcuuucugagugaguucccugacuccuugcgcuuuccacccugcuucugcuugcccuccgugggcuguacccacugucuaaccagucccaaugagaugagccagguaccucaguuggaaaugcagaaucacccaccuucugcauugaucucgcuggaagcugcagacuggaguuguuccuauucggccaucuugccagccacccccuacugugugauuuuuaauggcaucagaauaguucauuguagggcuguuccauaauuuauuuguacaagucaccucuauguggauauuuagauuguacacauauacacaccccuuugugcaagugucuugcuauuuccuuagaaaaaaucuuauauaugaagauacugcauaaagucauauguacauguuuuagaauuguugugaggauucaguuacgugcuauuauaaagcuuuacaacaaugccugacaguaaaaucucaaggaguuuugauaguauggugauaguuuucauugucucagucuugccgcuugacuuugagccccuaaauaaggugacugcuucaauuggaaaaacaucagagauccuuacucaaaguggccugaacaauaaggaaauuucugauucuugauuaaaugauaaagagauuuuauuacaggaugcucaggggggcuaaguacagaacucguuaauucagaagcucaagaguaucaaugaagaaacagucucucaauguauguuaccugccauucucgcuaaguuagcuuuucuucaagcuagugccaucccaugauacagugcuuacugagagucauacuugaaucaaaagaagaaaaggcuaguucucucucacucuauuuaagggcagugaagucuuuuucugaaguaccuagcagauuuacccucacauuucauuugccauuauugaauaaauagaaugggaccaccaugauuagcuuagaccauuguuuuucauaccuuuugauuuugacacacuaggaaauacauuuuacuucgucaugacgagggcacuuaucacacaucacuucuguuuggguauauguaugucugucuuauacaauuaaauguaauucaaaauaaguuucucaaaauaaugcuuaucuuuacuacugauuguaaguuaaaugcuauuuuacuuauguuuaaauagguuuuuaauaccuaaauacaaaaauuuagaacagauuuaacuuaauguauagauaugggcuguucaugaauuuuuuucagucuggaauacaugaggacaaugcuaugagcauauauaguacaugguugagccguuuuuucaaauuuugggucaagauuaaaaauaccuuuuuacacaaacaggucauugugaguagcaaaauaaucuuaauaauaauuuauucagaugagauucaucaaugaauucuguacuuaguaggaggggauuacacaaguguaucaauaccaggauuugaggaucauugggaaccaucuuggaagcugccuagcacaaaguaugaggcaacuaaaugcaguaugucauccuagguugaauuauggauugggaagaaaaugcugugaagaaaaauugagaaaauugaugauuugagcauggguugaauguuagguaauauuauuacaucaguauguuuucuaauuuuaauaauuguauuauggauauguaagucaauguuuuuguuauuuggaacuauacgcugaaguauuuaugugaaggaaggguaauaaaguuuuaguacuauucuugcaugccuucucuaaauuugaaauuauuucaaaguuaaaauuuaaaaaugucaagagagauuguuuuaaaaugaaaacaaugugagucugguucuuaaguucauacauacugaauacauuauauguaugucguguaugucaauccuuuuaauaggcuguuggauuuaguuuauuaguauuuuguugaggauuuuugaacugguauucauaggaaaucaguucaaauguagguuucuuucuucuugagguaucuuuggcuuugguaucaggguaaugcuggccucauagaauagguaagaaguauuggcuccucuucuguuuuuuuaaagaguuugagaaggauugguguucuucaaauguuugguagaauucaccaaugaaacuguaugguucugaacuuuuuuuuguugggagaguuuugauuacuuauugacuguacuuauagguuuguucagauuuuauauuucuucuugagucaguuuuggcaauguugguguucuuaguaauuuguccauuuuuuauucuccuaccauguaucugguuuaauguauauggaacaauaauguguuuuugcauuguguaaacacaucugauuuaauuuuaugugaaguuacauuuaaaccauauaaaauaaauccuccauuaaacugccuugccuugcauaucuaaccuaaaaugcauuuaucacuugagcauuccauuugcuucacauucacaucaauauuuguuauuuuccauuguuuucauuuuagcccugugguagggguguuccaagugauuuuguuuuuuaaguuugaaguuuuauuucaacacugucaucuacaagaauaucauuaccaacaacacaucugggguccgucauuuuuauuguuuugcacauuuauaaaaccauguuuuaaaucaagcuuauuuuaaagucguaugguuauuauuuucuauauaaaauguggcucaagucaagucagagauuacugauuggagucaacauuuucucucaauuuugucacuaucaacacuuccaaaucugguaguugggcuugccucuguagguuuuacuucacugucuuuuuuucuucugaguauagagugauucauuuuaaggacugcuuauacuaaaucaguuaaaauauuacaguugcugagaauuugaaaaauuuuauacucaauaacauucuuucugaaaaauacacugaaaguuuuuaacuaaacuugguugaaagaaucagcucuuugccgauagauaaacuucucacaugcuuugcuuuuaacucugcagaguuacucuuuaaccucuucauuaucgucaaauugaccauccaugucagaagaucaaaugaguuaucagugaaccaaauaccuauuccugaccaauuuauguuguauuccucucacaugauagucucaauuggcugcauuguucauucuauuguucauucgauguuaaggguauauacaauaugcuguaugugguuuauucuauuccuuuauuuuuuuaugccgguggcaaaucacugauuuaauuuuaugauccacuaauugaucauaacccucaguuugaaaaacauggauuuuaaccagucaccauugucugugggaggugggaccagcuuuuccaaagcauauggccuugcagaaaugggauaaaugcuagacacacggucaggcuucuguuugaaaggaggagaagggguugacaacuagagguuaggauaggcaaccaaaauaaucugcugcagagacugucgcuuacucauuuagcuguccuaagcaucugaugugcuaggaaguacuguaucaacuuguuucccuuauucuaauggcucuuaacgauuauucuuccuuuuuccgguuuguuuguaguuuuguguuccucagauauuuuuucuuguugcuaucauugugcuugccuuuacauugccauacuaucuccuacccacccauuuuaaaaaguucccuuuucauuuugcugcuuuucaucugcuuagacaaaagacuagcuucuuaaaagcuguggcucagaguaaccaaguucucaguaagaucuaagguuuuacuuuacgaucuuuuucauggugauauuugcuuauuagauuuuuaaaaugacauccaaaauuuuuagcugcggccuggcuaguuaccaauaaguuaucucugaaauacagaagugcuccuguacccuucagucuuccagaacaaaagcuucugcuguuauuaaaugguaauaauguaaucacaauacuuggggacucuacuagauuauauuccuuguuuuccuugauguuggguaaagagaagucuccugucccacagaucauuaauuuuagaauuaugaguaauagcgaauguauucauuguuguaaccuagcuucaguuagucaacaaauacuuuaaaauauugcauuucaucaauuguaagaugcucauuuucugacuuuuuuuuuuuuuuuuuuuuuuuuuuuuuuuuuuuguuugagacggagucucacaccgucacccaggcuggagugcaguggcacgaucuacgcucacugcaagcuccaccuccuggguucaugccauucuccugccucagcuucuggaguagcugggacuacagguguccgccacggcgcacggcuaauuuuuuguauuuuuaguagagacaggguuucaccguguuagccagaauggugucgaucuucugagcucgugauccgcccaccucggccucccaaagugcugagauuacaggcgugagccaccacgccuggccauuuucugacauuuuaauaccucugaaaucagaaugcagcuuacauuuaaugguguccuacaguugcuguugucccugugguaaaucaugguguaguuuccacaugaacuugguugcuaauccuagagacaugacugaacugcacaccuuucacuguuuuaguuaacaaaccauugaauaauaaaccauuuaaggaccuuucagaaaaggaguuuugucacuguccaaaaugucuucuguuaauaaccucuguuaagauucagauagugcuaccaccaacauggcacauguauacauauguaacaaaccugcacguugugcacauguacccuagaacaacuuaaaguauaauaauaagaauaaaauaaaauaaaaagauuaagauagugcuacuaucaucaaagcuucuaagaaugugcaucugaagcuugaaagucccagagacaacagaggauuacucuuuuaagaaaugcugcguuaucaaggaucuuguuaguauaaaaaacaauacugcauggaaaaccuugacaccuaugauuuugaauauaaaagugaucagaagaguugaacacugaaugugaagaaauuuuaggaauagcuuagccaguuuagauugcuuauauuuucuuauuuguacaugauauaugguucuuacgguuucuaaauaagucuaaagagcucuuucaauauuuaacaaauaaauaaaaaauguaagcaguaagaaagcaugugucaugguuuaauugacuauuuucuuccuuagugguauauaaaauggugcuucauauaaacaguacugucuucaauuugaugaaacgaguuugauuuacugucuuacuguuauuuuacugcuuccuauuauaacauguuuucuucuccauaacacuauaaggccgugcaugaauguuagagacuaugucucauugugaucuagcagccacaguaucauccgggaacuuguuagaaugcaaauucuuagaccccacccuagaccuacugaaucaggaaucuggauguggguguguuaccaagccauacaggugauuuuaaugcaagcuuaaguuugagaaccacugcucugggcacaauuucaggcaagggaaaaauacugguacuguuauauucaaauuagguauauaugcauagcuuaaaagaguaagaagccacagaugccuugacuuuagcuuaauucugcuaacagugugucuaagaggaaugaagaaauuuaccaugguguguguuagcuaaccaccaguaauauaggcagaguaauggaauaguccaagaacuacaucuccuucacuguuaauauuugaucuuugucuuuucagcaugacguaucccagacuuuacucaaggcaacacuggacaguguuguagaagaaugugucagcuuugugggaguggauauuaacaucuguucagaaguuuuguuaaggugagacaaauauguggcugaagaucacagaaucuugaguuuaacuggcuguccaguccaaacucggcuagaagaagggaacacguguauaaaguugucaaguagagaacgucuauggguuuauacauugcuuuaaguaaucagaggggaagacaucauuuaagaaaagaauuauaacaauucacauuaucauuuuuaauauugcaggucuaaagugaagagcauaugguaaccauugaguguauuaguguugcuaauagaauuuaaauaagguuaacauggaaaagagcuguuucccaccacgugagaguagagauuuuucacuaguuaagccucuugcaugcaucugucaaaccuggcaguaaccaaaagauaaauucugaggguucaagguaugguuaccauauuuuuacccugauuccacaagaaaccugucaaaauuuuuaucauacuauaaucgcauguuauauaaucuucuuuucccccaugguuuuagaagagcugcuuuuuuguucacaguuuugcauuuauuacacaagucugcuaaugcagcaugaaauucccugaucuggaccguuuucacugaaacagguauagcagaaacugucccuuacauuuuaaguuguugauuuucuaacacaucuacaaacauuucauaauuucauauauggaauuuuauaauagaguugagauucucugaaauaaucuuuugacaccaagcaaacuaccuaaugauauagucuuuguauauaauuuauacuaaccaugacaauuauagauaagggccuuucuguaguucagcucuauauuacugagaacaggcuaacacacaaaaaagguaguacaacacaguuguagcuauuauaacuucuucuaacucacuuuguauguaugcugaaaaaaauaggcaaaauuauuacuuuauccagaaacauaaggaaugugaauaguauagaaaaacuaaggaacauuuuuuucuugcaucaguguuagccuucuuaccagcaucuuuaugacagcuguugguuuugucauuauuuuuuuauucuguuguccuucuuuccucuugcacaacucuuuuuuucuccguuuuuuuuuuguuuuuuuuuuuaaacucccuuuuggauuaacuuaacuuagccguaugaggauaugucauugcagucguuuuuaugauccaaauguuuuauaucauugucuuuucagaugagaucuuuuuuucaguuugcuuauuuuuuuuuucuaggcauauugcaggacucaaugccaacagggccaaaaauauuauugaauggcgagagaaaaauggacccuuuaucaaccgagaacagcugaagaaagugaaagggcugggcccaaaauccuuccaacagugugcuggcuucaucagaaucaaccaggauuauauccgaacguuuugcaggugaguauaaguauacacuuugauucuauugucaaccuccucucuuguuacuguuaccuauccuaccacugauuaguguaaaauuuucuaaguguccauuguucaugccuucauucaguuaaguguugagugacuguccuuugguaggcauugggaauacaacagugagcaagucagcaaauuccggauucucauggaguuauauuuuaacaugugacacagacaauaagcaaacuaguaaaauuaguacuuucagauggcaagaagugcuauaaaaauuaaagcagggauaugugacacugucuuaggagaguaauacaacuacuuuagauucguuauuuuuugaaaacuuauuugagcagaguuuugaaugaaaugccauccaaggaucagaaagagagcauuccaggcaaagugaacacuaagugugcacaguccuaaggcaggaccaacuuugguguauucaggaaaugaggcaaaggcccacacaauuagggcauagcaaaugggaaggacugguacaagaugaggugacaauggugacuucaaaaugaccacuuuauacugacauagcuguucccuaagcauagauauguuuccccacucccuccucacugaaaauggaccaaagcauugauuaucaguuguguggaucaagagcuaaauuucuuuauuuucuaauccugaaagcacaaaagcuuguuagauaaacuucuuagcaugauauaaucaugaaagaagaacauuuacguaucugcuacuuugggacuacgugguuaauucauauggacuuuauaauuuugacaaaauuauaauagaggucauauggaagauaaccuuucuucuggaaaagacugauuaagccucacuagaauacauuauaaagcuguggaaauuaaacaguuugcuuuugauguaggaauagcacagaauaaggucugaaauccaccaaaacaugguuagaauuuaguuugugguaaaggugacauuucaaaugguaggguaaaauugauuaauuaucuaacaaaugauauuaugacaacugccaguaauucaauaugugugaaggaagcuguagucccacuucucacuccuauacccagauaaauuacagauuuaucauagacuuaaaugucaaaaaaaguaaaaaacuguaaaagcaccagaagaaaacauggggaaaucuugcagagcauuagagugauggaaauucuuucuaaauagaucaugaaaccuagaagucacaauugaaaaaaauugaagauaaaaugauucuguuuuuguuaguuuauauguucuuugaacacuugguuagaaaacucacagcauaggccaggagccgucguucaccugaggccaggaguuugugaccagccuggcuaacauggugaaaccccgucucuacuaaaaauacaaaaauuagcugagcaugguggugcucaccuguaaucccagcuacccaggaggcugagacaggagaauugccugaacccaggagguggagguugcagugagccgagaucaugccgcugcacuccagccugggcgacagaacaagauccuaucugucucaaaaacaagcaaaccaaaaaaacaccaaaaaacucacaguauaaaaaaagaacaaaaaguaaaagaugccucucaagucucacuugaaaaaguuucuuauauguugcuuccagaaaguaaauuuacaguuaugucaccuuguauguauauguuuauuauuuuaaaaauguauacacaagggaucaggcucugcaacuauuugaaacuugcuuuauuuguuucagucuucuggaucucuuuccaaauuauuacauauagauuucuaauuuuuuauucuuuauauugucugcauaaaauuuaauuguauggaugggcuguaauuuagucuaaucagugucuuauugaugaagcuuauuuuaaagccuuguacuuuuccagcugauaauuagguacuugaagauuugugacuguuacaucucaugaacuauagguuuauucagaauggaauauugcuaccacauuuaauguuuuuugcuuugaaauuuauuugcuagcaauguuacuguauaugccuguuuuuuuuaauuuuuauacuuucuaugacauuuaauuuuugauauggcucuuagaaacacauagcuagauuuugugguuuuacucaaucuguuauuaauacauucauauuuguuguauuuauuuauauguuugggcuuauucuuccuacguauuuugccccuccaucaugcuuucugauucuucuuuuccuuuuacgcuauuuauuagauuuaucaguuaauaaguuuucuguuucucuccuuguuuucccaucucaucuuuaucucuccuuagugauuucaaaguuguacaucuucuauucuuaugaucauccuuaaauugguuuuggacugaccucuggaguuaauaggugucuguccucuuagagaagacuagaaacaggauccuucccaaucuuucucucuucaacucucucugccucccaugauaagaugaucugggauuuuaguuucagacuccucuccucuccucuccucuccucuccucuccucuccucuccucuccucuccucuccucuccucuccucucgucuccucucgucuccucuccucuccucuccucuccucuccucuccucuccucuccucucccguccccuccccuccccuccccuccccuccccuccccuccccuccuuuucucucacucucucuauauauuuuauacauauauaaaaauauuuuauguauauuuuuguuuuuuaaccuauauauacguauacagacuauaugcauguguauauacguguguauauacauauacacauacacacuauauauacacacuccuccauauauauaaaauauauucuuauagauguauauuuuuguuuuuuaaauguguguauauacacauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguauauacauacuauauacacacuauauguguguguauguacauacuauauaacacuguguguguacauacuauauacacacuauauguguguguacauacuauauacacacuauauuguguguacauacuauauacacacuauauguguguguacauacuauauacacacuauauguguguguacauacuauauacacacuauguguguguguacauacuauauacacacuguguguguguacauacuauauacacacuguguguguguauauacauacuauauacacacuauguguguguguauauacauacuauauacacuauguguguaugugcauacuauauacacacuauauacacacuauguguguacacacacuauacacacuauguguacacacacacuauauacacacuauguguguacacacacuacagacacuauguguguacacacacuauauacacacuauguguguacacacacacuauauacacacuguacacacacacuauauacacacuauacauacuacauauauacuauauaguguauauguauauauguguauauacacauaauguauauauauuuacaucauucaugagcacuuauuuaauuuaaucaguuuuugugguuucugcacuguuucuuguaguucauaucaucauuuuucuuugauuuauugguuuuugcuagaauuaauccuuaagaaauucuuuuagagcuugguauggguuauacuuaaguccuuacauaccugcaaaugauuucaauuugcccuccuacuugaaugcuaauuugacuagguaugcgauucuaaauucaaaaucauuuucucucagaaacuuuaagauauuguuccacuauguucugacaucugauguuugccagugagaaaucugaugcuagucugauuccagauccuuuuaaaguaauguuuuaauuuucucucuugaaagccuuuuagaauuuuaaagauuauuuauauuguaaaguuuauccaugauaugucaaguaugagucuuuugcuuuucuuuucuuucuuuuuuuuugagacagucucucccucuguugcccaaacuggagugcaguggcaggaucucagcucacugcaaccgccgccugccagguuuaagugauucuccugccucagccucccaaguagcugggacuacaggcaggcaugcaccaccacacccagcuaauuuuuuuauuuuugguacagacaggguuucaucauguuggccaggcuggucucgaacuccugaccucaggugaucugccugccucggccucccaaaguguugggauuacaggugugagccacugcgcgaagccaaguaugagucuuuuucuauucauccuguucuacacucaauagauucuuuugagagcuuguuuuucuuagcucugggaaauauuauuauuuuguuucccuacauuuuccucuuuucucucuuagaauggcaauuauacaaucaguuaagaauguuuuuggcuuuaaguaacagaaagcccuuuucccagugauuuaaacaaauaagugguaguuucuaugaaguaaaaggucaaaaucugguugcuguuuucgcauauuuguaugacagagaaguaagcacauuuuaauuugaagacuuuucugcccaaccuuccccuuuucauaaaugugguuuuuucugguuuuauauagucagcaaacugaaacuucaggccaaauucaaggaguugcugugacaucuucagcagacguugaggucacaaaugagaagcagggcaaaaagaagagcaaaacugcagugaauguuuuacugaagccaaauccuuuggaccaaacuuguauucauccagaaucauaugacauagcaaugagguaagucugaggcccaugugggaauucuccauaugcagagugaguucuuuacagcaaauggccuuuguuuuggcauaauggaaacugaaaaauaugaccguuuaaugugacaacauuuuucagaaguucugcauugcugaguuauguggcacauuauuucauuucacugaggaaugaaaccauuacuccuggagcauugucaagcuaauaaacccugauacuaauggugaaguguguguaauggaaauugcauggcacuccccucuguuuguuuuggaaauuaacaagacacaauugacuagcaccuggcauaaaacuugugcuuuucuaaagauaaaacccuuuugaaaguaaacaaccaacucagcuuucuuaauauuaucuuuauugguuauuaaaaucuuaaaaucuaagaaaugauguacuuuuagugaguauacauuaacagaaugacaugggggaaguuuuugaguagaagggaaguuuacgguauaaaaagaaaaaucuuuuuaacagcauauuuaauuagcuuuaaauuuuuuuaauuaguucaaaaacagugacuugcuacauaacgacauuuuuuaaagauucuuacugaauuguaugacaguguaacaaauauagugaauauuuuaacuuuuauugaaucuaaaaugagauuuuuguuuuaaaaucacuuauauuugauuauuuuaguaaaugucauuaauuugcuuucuuuuaaaaauauuuaaaaagacuauaguauauuauagaaaacuuagaaaaaagaaguaaaaaauaauauucugugaacauccaacuaguuccugguuucccccaacaguuuuaugaugaaaaaauuuagccauacagaaaaauuggaaaaaaaauuuuuacagugaauuccuauauagccacaccuagauguuaucauuaacauuuuauucuaucuguuuuuccacauauccaucuacuuauccauccaucuuauuuuuuuuugucuuguuuuguuuuguuuuguuuuugagacaagaucucucugucacccagacuggagugcaguggugugaucucggcaaccucugccuccuggguucaagugauucuugcgcgucaaccuccuaaguagcugggguuacaggugugcagcaccacggucuggcuaauuuuuuguauuuuuaguagagauagaguuucgcuguauuguccaggcugguuucaaacuccuggacucaagugauccacccaccuuggccucccaaagagcugggauuacaggcgugagccacugcaccuggcccaucuuauguuuuugaugcauuccaaagaagauugcagacagacauugguacacuuugcacuaaauacuuaagcauucauauaauuaacuacaauuugauaauucuuuacgauuuuuuucuuuugaggucacauuuacguaacaauuaaauuuuaaguuuauauuagcugaauuuugacaaauaccuacuucuguguaaccaaacugcuguugagaucaggaacauuucuauuaucugaaaacguucccuuauaccucuuccgaucaguuacugccccaaccucccagagguaacuacuuguuuugauuuuuuucuaccaaagguuaguuuucucccucuaccauacaauuguacucaucuguguaaggcuucuuucagcaucguauuuagagauuuauccauguuguagcaaguaccaguagcuuauuuuuuauugcucaguaauauuccauugugugaauauaccacagcuuaucuauuuuccuguuaaugaaauuuaagagauauaggaaauaccaaacuuuuuuauacugucuacucucaguacaacauagaacacuuucguggccucuggucaccaaaauauguagggauuucuccccuccaaccagucaauucugcagcagauuauccagcagacgucaccuggguguccucuaauuuaguuaauuucugacacuaucuaccuggagauagugucagaucccacagguugagggcucagaacuacaagauugcucccaacuugagaggucugguugugaccuguaacuucaggauuccuaugacccuggaguucaauuaauuugccaguuugcagaacucagggaaacaucuacuuaauguucauccacuuauuauaaaggauauuacaaaggauacagaugaacagccagaugaagaagauguauagggaaagguauagggggaagguauaugggggaaaggauauggaacuucuacaugggcauacuacccucuaggaaccuccagguguugagcuaucuagaagcucauuggaacccaggccuuuuggguuuuuaguagguuucauuacauaggcaugauugaaucauuggccauuagugaucaacucgaccuucagcccuucuccccucccuggagguugggggucuggagcugaaggugacaaccccucuagucacuuguuugguuuuucuggugaccauccccuauccugaagguaucuaggggaccccagcuaccagucgugucauacaaaagacacucuuaucuaucacucuggagauuccaaagguuuuaggagcuuuuugcagggaaacaggaggaaagccagauauguacuucccaauaucacaugaaccuugcuuauuuccaguuuuuggccauugugaguaaaacugcugugaauauucuugcgcaguuuuuuuguugucuuugaccuuuguuuucauuuaucuuagaaaaauacauacgagaggaauugauaagucaugagguagaugaaaguucaguuuucuuggaacuccucuggucguaccauuucacauuuuacacuuucaccaugagaauucugguuaccuugcauuuuugucaugugacauuagguggugaugguuguuuuuagccauucuaauguguguggaaagaucuaugugguuuuaauuugcauuucccuggcaacacugaacacuuucuaaugugcuuacuagccauuuuuauaucuucuuugugaaauauuuguucauauuauuuggccauuuucuaauugaauuauuugcccuuuuauuauugaguuuuggggguuuuaauauauucugcagauauaaaaauguacuuugucaaauauaugauuuaugaauauuuuuucccaguuugugguuuaccucuauuuuuuuagagacaaaaaaaaugucauauugcugucuuaauaauauuuaucaagucuuuuaguccaugaacuuauuaugucagcauuuauuuaggucaucuuuuauuucucuaagcugugucuuuuagcuuucaguguacagguuuuacauguguuuuauuaaagguguuauauguuuuucaacacuauuguaaauggaguuuuuaaaauuugcugcuacuuguuuguugcuaauauauaaaaauacgaguuuuguauaauaaccuuauaugcugcagacuuguuaaauuaacuuacuaguucuacuagguauuuguacguuccuuaaguucuccuauauaaguaguuaugucaucaguaacuauauuaaacuuuacuuccuccauuuuaaucuucaugcuucuuuuuuuucuuuucuuuauucuuuuuuuuuuuuuuugccuauugcaauggccgggaccuucaguacaguguugaacaggaauggugagaguagauauccuugucuuguucucaacuuugggccaugguucagauuuuuuuaauauaaaaaaaauugugguuccauaauaauuguauuuuuaguguuugaugagaaggugcauaugugcacagggauucauagacuucuugcaauaauucugaggaguacguggagacuaaauuaucauuuuguucugugcaaaucacuaucuuuuuuuggggggagggggagaaucaaucggaggggauguggacagggucucacuuugucacccaggcaggagugcaguagugugaucuuggcucacugcagccucaaccuccugagcucaagcaauccucccaccucagccccaaguagcugggacuacaggcaugugcugugccaccaugcccggcuaauuuuuguauuuuuaguagaaacggggcuucaccauguuguccaggcuggucuugaacuccuucgcucaggcaguccuacucggccucccaaagugcugggauuauaggcgugagccacugcacccggccaguaucuuuuauaauguauguuuuuguuuguuuccauaaucuaguuauaauaugguuuagaaguuuuucaauuuuuguuaauuugcuuucuauuguaaacacauuuuuuuuguuucugcauaccccucucauuaaaagcuagauaauguuucaucaacugauugaacuguaacuuauuuuaguuauaguagugcuaauagugguucguuaugauggauuccuagaaguagaauuacucuaccaaagggcuuaaaagucuuuguggcucuugaaauacaucaccaaguaacacacugauuuauaaugucaucagcaauguucaaaccugaaaaaucuugaauuucuccuguaaacaggacuuuuuuuugccagcuuugaugugguccaguuucugcaugugaaauauaaaugcccugcuagugacuucaccuuucugucuguuuccuuugggacuaagcuugucucucaggaggaggguauuugugaaguauuuagugggaaauuucuucuguugcaguccaacuccugaccuucaaaaccuagagaugaucgcuucucggccuuuuggcuaagaucaaguguaaaaccuagagaugaaauuagcaauuuaucuuaccauccccauuauccaguuuggaacugugauaguaauuucugucuaucaaguacgcuuaguuuaaacaucacucagcauagguaguucauacucuauauauucucacacaagugucuucccagggaagaaaaaagcccauuuaagaugugauuaggucaucauugguuugauuucaguucuauuaaaagaauuuuuguugcaguacauuucauguuuuaauuaugucagaaaacuauuggaaauaaauggcuuuaaugucacccuuccauaauaucacccacauaaauacaucaaaauguaacaugauuaugucuuucuuuucauguuuaugauagucugucucauauuuguuuuuaggaaaauugagauuaugauauuuuauagccugaguuauuuagugguuuaaagaaagucaacuuuuuuguuuauauuuauuauuuauauaauuuuuuaaaggccuuauuuauguaugaguucuuugaauauuaaagcccuuuguuauauggacuggcauuuuuuucuacuuguuuaccuuuuauaucugcuuauaauguuauguuuuugaaguaugaaugucuaguuguuaugaacuaaaacuuuuucugguuuuuaugcaaguugugucuugagaucccucaucucuaagaugaguucaguguuccccauauucuuuguguucuuuacuuuaauaauuacucugaauuuuguuggugaugacuuuauucaucacuuagaauguacagaacacugugauaggggcugaaguauauaaaaaugaauagaggugauuaugcucucaaggagccuaauaacuccuuggggaggauaaaacuuacauucacagguaucacaguagugcugaacaauuagaaaguacccuuugugaagcacaaagguuguucccaggaaaaagaacucauuuccaaauaggggaaucuuguaaaguuuuaugcagaagguuacauuuaggguagguuuuuaaaaaugucauucuguagaaagaggcauuuagaaaauuggagacagaaaaauauagcucaggcuagcuuuggaauaguuaaugguccaguacaaacaaccuucauugacuacuuccucauuaccaagcauguuagaagcaucaucauguuuaaaccucacacagcaacccugugagguugguacuauuauuauucccacuucuucagguauacagagucucugauagguaaguaaauugccuaagcugacuuagcuaguagaaccaagauuugaacuagaucuaucucacuuuaaagcuugagcuuuuaacuaggcuacaaugaaaaagcuagcuugcagccagauuuuaaugaaaucauaauggucuuuccaauuaaagguauuguacccuaaagacucuauguauuauucugcacagaaaaguaacagggcuuguguuacaugugcuucuuaagaagaaaaaaaaaaaaguaucuggaauaugcugucuuugaguguuacucuaucaucacguggcugaaauuugacacugccuuuucuuucaaggaaacauuacccuguccaauaaaugaaacugugccgauuuauuuuauuaagggguauguaggaaauggauucuucucuagaguauguagaauuuuaugcuguucugcugcagauaugcuauuuccugaagaauauuccacuaaaaauaauucccuuccaucauguuuuuuauaugaggcauguguuugcugucuuauuuuaggagaggaguaugguacagagcaggaguagcguguucauccuagagccagagcaggguuuucagcaagaggauggagguagaaugucaauuaaauauggcaagagaacccauguuauagaauauauaaggggaacaugggauuuagaguauugcucuacacuguugccacaaauagauuuucccucaauaguucuuugaagccauucuauucuaaauuccuuuuacuuguuucagugucuucugacauucaccuggugacaguucuuaccucacugaaaaaacucaaaacuaccuuacaauccugucuucagauugucucuguauuuuuacuccuucugccccauccuucccuacacugcuccuccaugucuugauucucuuuccuuccccacccugacuucugccagguugcugcugaggacuccugaccuugcccauuguauugaucucugugucuuaauugccucaccucuaaaugugaggggugggggaguggcagccgaaugaauaagguuuuuuauaauagcuuuauaaagcuuuauaacuaacugucucuuguaucuuuaaugucuucacuucuucucaucauuuuuggccaaagauguauuauugcuggggucucccuauuccucacuuccgaaaagcuagaagcuguggccaccuuuuaucuuacuuucccuuagaccuucuaacccaucacuccuucuuuucauugcuuacccucucagaacuaucugccucuaauucuuucuuccugcuuucucccaguccuuuacaauuggcuucuauccuuaccccucuucugaaauuauucucucaacuaaugaccagucgucucuuuuacccauucugccacauuugacacuaucaacuuaccaaccuucuaccaugacuuuuauguugucucugguuucucuuucuccucuggcccuguagauguauauauucuucaagcuuuugaccuucaucauuuuuucuacuuguucuacuugcuuccuuggaugauucuacccauacacaugaccaucuguaucucuuaccugacuauauaauucaaauccuaugucuuaacaucccuaguucaggccuuucuaagcucuagcccaaccuuuccauuugucugugagagauuuucucaugaauaucuuagcaauggaaacucuauguuucuaaaauugaaacuuguaccaccccccuuugucccuccuuuuacaacuccaucuucuuuuaucaucaguccucacuagccccacacaaaaacaagacaaacaaaaaaggcucaguaaugaauaguuaauggcaugaaucucuuuccauuaacuuaggcuagaacugacagaaucuuucauuuaaaaaagucuuuugagugauugccauauuccaaguacuguuaugcaaucuuggaauacauucaaagaucccugcucucaaagagacacaguauacaaccagcauaauaaauaaauuauacagugugauaaaauguugugggaaacagggaaagagcagaguaauggaauagggauugccaggauuguggguaaggguuugaaaauuuaaguaggguagucaucgcaggccucauugacuuggugacauuuaagaaaagucuugacggaggaaagaguuagcugugcagauaucuagagaaagaguuccaggaagaggagccagacagugugaagguucgaaugugggagcaggcaugacauguucaaggaauaacaaggcagccaguguggccagagcagagugagcaagggagagaaaaauaggagauugagucaaaagggcauugggaggcuacuauagggguuugacuguaguucugaaagagugauaugaucugauuuacauguuaaaaggauccccuugucugcuguuuuaaguccacuguaaggggcagugguagaagcagggagaccaguuaaacuaauugcuguaauccaagagaaagaugaugacugagauccagaugauacagcagaagacauggugagaaguguucagauucuggauauacuuuaaaaguagacucaauaggauuuacugaaagauuggaugaaggauaugaaaauuaguaacugguuacaaauggcaaaaauaauaugaauacuagagacacuguggaggaugaaguggaaacucacuguauuggaggggaguggaaaagggaaaaguuaaagaacuaaacagugauuacucccauagugaucucaucuggucccauggcucuaaggacugucauaagcacauuacuuccaaauuuauauucuuaguccaaaacacucuuccaaacuguaucugccuacuuaagaucucaaaccuaauaugccuaaaucugaacccgucucuccccaaaaucuucaacuauaaucuuuuucaucucauauuauuucaguucauccuuucagcuucucaguucagagccuugaaaucaucuuugaucugacgagauauccuuagcuggaaaugagaucuuucuccuugaacaaccuuuaugcuucacuaagggcauuuacuaauuucuuaccucuguuaugguaucugugaguauaaguuauauccuuccuacuuugggaggcuccuggagggcguaaaucaccucuauucauuuuuacauucuucagccccugccacagugcucugcacguucuaaaugaugcauaaaaucaucaacaaaauucagaguaaauauuaaaauaagaguacaaagaauauggggaacacugaacugaucuuagagaucaggaaucuuaagacacaucugggauaaaagcaagaaaaauaauguuaauuuuuuuucauuaaaaagcugcuuuugauguaccccuugguuacuccaccauaccccacuuacucauaauaggcucagauggucaaaaaggaguagaacauaguagaauaucauaguaaagccaugagcuccuucaauuguccuugucucugcaaaauaaauaaugcaucugaaaauuuggcaccagauuuacuaagcuagugacaauuaaauuucagguuaguuuauaauuauuggcuguaagcuccaauaggacauggaucauaagagccuguuuuaccucucuaucccuugcaccugacaaauacugauacggcaauguuugaugaaaaaauaaaugauaggaauuaauaaugaaagaugacuacauaaaagaacacugaggaagggaacuacucaggaacugauaacuucaguagaacaaaaugaaauguuuagcuuuacuuuaauucauguauuuuuuuuuuguauaaucuaaacuggcuguggucaaugcaguuguauaaacaaaauuguugguagaacacauagaucauccuuuccuaauguugccuuuccuaaauauuguguaaguacuucuuccagaaucucuuguggauugaaaaaauuucaagaccuccccaaacugaaucccauuugccuucacagagcauuguauccagggccaaggcccuccuagauuuugcagacuaaaagucuagagaccaugaaagaggauuucuuacuguuuucugucaucauccagaaacugucaugucugugugugugagugaguuuguuguguuguguaccauaaaccauaaguaaaauugcugcuauauuaguagaaugagacccagaaacagccuauuuagggguuauucuccccacuacuacccccucuguuuuuguccuaccauuuggguugauccagagagcuaaggcagguauccgauuuccucuuuuucuugaauaaggugccaggaguagugcuuggugcugcagaugaugcugauuuguaugugccacagugagaccuggcacucucccagagaaucugcuguauuaagaauuugauucacuccagauaguuaagcuugaaagugguugugcucuugauuuaacuugaaaaauaucaggaaauuuauugucaagacugucacuuggcacucauuuugauaaagcauuagcuaguauuuguuauuucaauuuuucccauuagggaggaauucuaauacuaguuucuauaagugguuaacagccuguguagcaggaauaucacaugcaguagcauuggaauggaccagguaaauguaugucaaggaaugauuuguaucaauaccuguuugugauauuuguacuauaggauuuccuuuguuucugcugaugugcuuauuugugacccuuacaaucaauguugaaaaguaucagagaguagacagccgucaauguaaaauucaggucugggacaggaauaaucacauagcaaaauauuuauuuggggagggaagaaacuucuguacaaaagccaaacaguguuuuucuuuaauuuacuaaaaacuugugucagguuuuuagaaccaaaaguagauuaacccaacagauacacaaggauuccgucaugagauaaaugaauauaaagauuccuaacuggugcccugagcuaaaaaguaguugagauugggggagggccuuaaaagguucugccuagcucccugccguggagcuaaaauaagucaagccagauagugaagaauggccucuacugaagacccuuaaugagugggcauaucucagucucugucucuuucccauuccuguucaaggauuuagcaucucugaacugcuccuugagaauugccuucagagucuucauugccuucccuccaaccggagcuuacugccgagcaaagaagucuucuaacuaauaagugacuguaaugcaaagaguuuacauugguuuuauuuaaaaaacaaacagcaaccauugacucuucacagauuugauauucagaguuuucacuaugagcaaccagaaggcccaugaguuguaauuugcaauuuuucuuacaggugagucagccuacugaauaugucuaacacaccucccuacaucuaaaauucaccacagcuucguucugcauuggcaugccagcuaacuccugcaaugauaaaaacacguuccuuugugggaaacuugccugaaaagaaauccaacugcaaaugcuguacaauaaaugaugauuagguaaacagaccuaagagauuauuugcaaauuugaaaaagcccgaaguuuucugaacuuggacuugccuuauaagaauuggcagcagggcagaaagacucguuccuggcuuuugauaaaugauaauguaagauguguaucaauuaguuauccuacauuaauuucuaauagaccuauggcuagacaauauuagauugccuuauaaaaagacauagcaucauaaaagagaggccaaaccuaaaauauaaaaauguuaaguggacagauugcuaaaaguuaauuuuguuuuuaaagauacagcagucucucuauguugcccaggcuguacucaaacuccugggcuuaaugacccuacuccucacccucccuaguggcugggacuacaugugugugccacugggcccaguuuuguguguuguuguuaguaguuaaaaccuaagcaucuuacucuaguucccaagaaguaacauucauauuuucaaaagugcccuuacaaaugagaaaagugaaaaaaauucacccacuugagaauuagaugaucaggcuauggauugauugucauauccaaugucuuacacacuguuccaaaacacagcccacaugacguuucuggcaaagcugguagaggaaacuaggaagaucaagaaccugagacuugacauaacuuuccccuaacucagucuggaggcagugaaaugucagacugccuggauucaaaucauggcuguuugaacugggaauguuauuuaaccucucuauaccucaguuuucuugucuguuaaaugugcguaauaauaguaccauaucucaugggguuauauuaauuaauauauguagaauacuuagcaccuggacagaguaagcuaguguuaauaugauuauuauugcuguuauuuuuguugugauugaggaggggcuaagcuaagccauaaaagaaauggggguaguuggagggagugggggagaguuacaaugguugguccccaagaaaaaaaguuguuuuuucaugugaucuggauguaauuugagacauuuaacauuguuaaugaauauuaauauuggguuuugagacuggagaaaaugcugguuucucuccuguguuucuggagcaaccuauuaguacccaaugaaggaggagugugagggaguugcuggccaaucauaaaguugugcuugcuucagccucuuccaucuucaaaauauuugccuguccuucuccuuuuuuucuuuucaucaaguuuagaccacucagucuggagccugaaacucaguagguuauugauuuaguuucccauuaucucccuccugcccuuccugcccccagccuagcuauggauuuuaaucuuagcuugucuucugauucucagugucaccauaagcgaguuacuuugaccucaguugcauacucuuuaaauggaauaacguuuuugcccauucagaggacaacuagggauuuauugaaauggcagauguuaagcauuuucaaauuuuuugauaggaggauuccuugacaggauggcauuuauaguaaaaaggcuguuucccaaggaagaguccucuaccucugauacauagguuuuauucccuagugguacaaggucuguuuaauuucagcuuuuccaccaugagccuguauguuuuuaaauacuacuuuuuuaauuugcccucuucuuucaaacauucacaggcacuaauccacauuauggcuuuacaggcaguaaauuaaauuauauuaauucuaaacacaguguuuuugagcuguagagagucuguagccuuugaaaccacuaacuuaauuuuguccaacucuuauucagaaauucaaaaagagccaaagcuuuuuccuuuugaauuugguuuaaaaaauaguaagaaauuucucccaggcagugguccugggugccaagguuuaucagagaucuaaaucugucugcaugaaaaucuccgaaaguaaaaggguaggccugcuaaugaagauguaaucuguuauaacuuuuaccuucacuacuacuaccuuauguugucaggugugggcaagucucuuaaucucucugagauuuuguuuucuuaucagcaaaucuacauucacaauaaauauuugagauaauuaaaugaaauaaucuguacugcgcacuuucaaaaguaucuguuuaucugcacauaaaguccugccucuaaaagagcagauacaagcggaagacuauuuuauacugucauuacuuaaaauuagauuguaagcucauucaaggcaaaggcucuauuaucuuucauagagccuuccuccacaguaaauaaauguuuauugaauaaagcugaguaugcuuuucuaaauuauucuuuguugguuucagcauuuugucacauuccuuugaagagccuugauuuuagcaaaucuuuaucauuugggcaggggaauggcagggugugugaaacaaccauacucacaggaaaagggugaucaggcugcauaauacuggguuguugauuuuuuuuuuucugguucucuuuugggaggguaaugguuuguuauuuuucaaaaugugagaagacugauauuuuaaugucacuuguaaauuuauuucuaagacaguuccuacaacaguuuagaugucuuuggagcaauaauagcaacauuucaguacacaacaccuuuccuauuuuuauauacucauacucauuuagagguauacguacaguuguuuaaauuauaugauaauuacacaguauaaagcgagugguucugaaauagggaaaguugcauaaucacugugguuguguauggcauugguuauuauuucacugaucuuagauacuuugagguaacuauaugagcacuguucaacuauuucugaaaagaugaucauccuaaaucuuuuagaagauuucuaucucgggacuuuuuaaauggcacuuuaaaaaauuuuuacucuuauucaguaaugcuaaauugcuaaguaauagaaauuuuaaaauaaaacagcuuucuaaggauauauucuccuacauacaaugaaugcaacaugcaaugaguauccaguuucuguacauguauaacagaucuuugaaaaagcaggaaacauuuaguaaguucuucagaagucagaagcagguaacagucugaugcuuauaauaccaaguccuuuggaagacaaacugcauuccuucaucuaugacaggaaaucuuucucuugucauuucuuuuuuuuuucuucuacucauauaugcaggaggugcuccaaaugguaccaagaaauaacauuuaaaacgcccccacccaugcccagauagcugcaugcauuuuaaaacuauauucucucaucagagucuggaagagcuuucagaacaacuucaugacuuucugaagggguuacauuuuuaaaauguuuaucuuaguauguuaauuuacuguaaaaaaacggucucagcuguaaguucuacuggauaauucuuugcccuuucugugguugauuauuaugcuaagaaaugccauuuaaauauuauuuucacuagauaucuguuagcuucuguaguacaacagguaguucugugggccucucuauaaaugaaugauacuugaauuuauaauuacuuguauauuuugcaccagcauagauuguuaaggauucuggccuauuucaguaucuugguuuaacaaggagguaagacauuugaaaaugccaggugcaguggcucacaccuguuaucccagcacuuugggaggccaagguggguggaucucuugagcccagaaguuugaaaccagccugggcaacauauugagaccucaccucuacaaaacauuuuuaaaaaauaaaaauuagcugggcuugugguuccagcuacuugggaggccaagggaggaggaucgcuucagccuggaaguccaaggcuacagugagcugugauugcaccacugcuacagccccugggugaaacagcaagacccugucuuaaaaaaaguuugaaaagauuccucagugaugauuaaaaugcaguucacauugcugucccuuugauuugacugcuagaacagccccuauggugaagccagcacuccuucuguaagcuaaucuaaauagguacugugauauucucagcuguguaaauucagcuccucuguagauagcauaaaggagcagcagguuuuccucguuugccacacuugaauuuauauucaauuuuuaauauuaagagcaguaaauuugaaaauaguaauaaauuuuaaagaaauguauacauagaguaacauauauauguuauauagagagaaaauauagaaacaguaacagauuuuuagaguaacaaauuacuacugaacuugcauuuaugucccacaguuuacauaguuuuuuagaaggccagauuuucuuagaguauaagcuuucuuuuuaaauuauugaauauuuaaccuguauuacagauuaagaccugcucugucuaccuguaccuauucauuucuaaaaugauguguucuugcauuuaauuuugugcuuguugcguuacuccauuaaaacugaguaaagcuaauggguaaaaauagacaaguaggaaagucucuugaaaguguugagaguggguagacuauuagauguacuuugcccuuauagcaugguucuugguggaguuguaaaucauauguuuugcccacaaagcacguacuaauauuaaguuguuuuuaaagugauuguguugcaucaccaugguucuucuaugcucugugggguaucauguugcuuuaauguaaugaaccaaguccucagcuccuaaaucuccaugcuggaaaugaugacauaaaacugaauggccaugucugaagucaugaaucuugagaauuucuuauucuuugggaaaagccuuacaagacuuuucuuauucuuugaagggaaaagcccugcacuuauaacaaguuucuguugaaaauauuagccauuuuagguuauauagcauucuguuugaaaaauaagcauuaacucugcugcaaggucuguauuuuaacuuugugcagaugugugcuuaaagaacaugaugugcuuauuuguugcauuuaugguacuuucuuacuuuaaguaagauggaugaaauuacacauuaaauaaaaacagcaguccuuaccaaccugaaaaagccuuccaaaaacaguggagaaaaugagaauaugacuuuaauaauucauugacuuuugaaagaauugucuauuuaaaagcauguauauaauuucuuugcagguuuccucaguguuuuuaauguuaaaaguaaucugccaguaaauuauuuguaaaauauuacuaaaaguauuauuuucuuuccuaaccaaauauagcacuuuaaauuuuacauaucuuguuauacacagacauauauauuguguguggcauaaaacuccaguuagaauaacaucauggccuuggacaaguuauuuaaacucccugaaccucauuuuuuuuuucuguaugauaugauaccuaccuuuuaggaucauugucaugauuaaacgagaaaaaucuauuuagaacaaugucugacagauauuuaucacuaccuguucacuucuguaugccaagcuucauaaagcaguguguuuuuauuugguacuuuugagccagaaaguacuuuguauugaguauuacuuaccacacucaauucuaaagugaaacuuuguauuggauauuacuuaucacacuuaauucugaagugaaauuuagaauauguagaauaaauuuuucuuaggauauuuaaggaacauauguuuauugaauggcuacuaagcauaaaacauuguuuccuaucauguacaguugacuauauuuaaaauucauuaagguagaggucagucuaaaugcuauucccaguucguuuuacaguuccucugucuguuguuggcucuuugugugugugugcgugaccuuguuaacuuuaagaaaguuuucaaaauaaaaaagcacuugacuuuguaguaauuuaaaaauagguugaucaauaugaagcauuagcuaggagcacaaguuggugcuuuuuuauugauuucaguuacuaaugcccucaggcuuauaugugugagaaugaaaaugauauaugaaauacgcacccagguuaaacagacaaauguucuuguuacaucugcaaccacuauaggcagaauucuuuauuuggaagugacuuugguaguaguuaguuccucucucccucucucucugucucacacacacacauacacaugugcaagcaaccuuaagauagacucauacagugcuuugggaaguuucugccauuuaguuacuuuuauuaauuauaaaaugcuauucaagauucuagacuuacagcgcauuaguauacauucugucauuuuuaacagaugguuagaagccagaaucuugaggauuugaaagauacuccgcuaaguagccaguugcagaccaauaaaaccaagaaggugaauaccagggaagccugcucagcagggcacgcauuauuuagaaaguuguauaaggaaguuggauuucggcagagguugucaugugucauccgccccaucagucagagcuccagcagcuguuccuugucaccgggacccuuguaugcuacuguucguccaucagcacuaagagauaccggcugccuuuccaccaugcuguggaagccacagacauacagacuuacaguguuaucucacuggacaccaguuuggaugaaagcucauuuucaaagagggagaccaaacaccaacguuuugguauuuuauuagacuauuaaccaaaauacauucucaagagaauuagucggauaccauaaagugugucuauuuuuggccauauauauggcuguaauaauguaggaguguugcacauuugaauucaaagagaugcccuacuuaagugagagaugggagaacuuucuccacuagaugccagauuauuauuaucagaguaucacugugaagagaccuuucugguugaacacaacaaugcaaaaaagacuuaaaaucacaagcauucuuuuuuugauagugcagcaaccugccaaauaggauauauccccauucugauuauagacaaaccuccaacaauucccuuuuucucuuuuuguauuccagagguaucccuagaggaaaggauuugagggcauuaguaucacuaucugccugauuacuguguugacauuuuuaaagugccauuaaucauaggaaauggaacuuaaugguguagaaaaauacccagccaaggaaugucaagaaaguaagcuacagcccaguauucacaugaaauuaaagggaaaugcaucuuaacccuucaauucuuuuuuucuucuuacugaauuauaaaggaaaguaauugagagguagcuuugcaaucaaagguaaugguaaacauaguaaaagaaaauuauaaaaggcagauguuuuuauuuuacaaauauuacaguuacauaauguauaaagaauauaaagauaauauucaucuuuagauaguauaauggaaguuuuaccugcuuccauuuuggaagaaaguuacuuuuucuuuuugauauccccuccuauauuuuuucuguugacucugaauacugaauagacuugauauaauuuaguuuauaugaggcucaacuguuacggaauuugagaguuauuaagcugaugguaugcugcacagguaauacugccaucaaggguauacagaaguaaaaagcagugauaggacacaugaauagaguaauucauuuuucaaaagcuggcaauauguaaugcacauuuuguuagaguuugguaucauuucaucguuugccuauuagcuaauuuaaauaaaauguuuuccuaauugaaauuguagggaacagauagccucauuuuuaaaauauaugugacacuaaacuuauaaugaauauuauaguguaaaauauuuuuggcuggacgcaguggcuuacgccuguaaucccagcacuuugggaggccaaggcaggcagaucacgaggucaggagaucgagaccauccuggcuaacacagugaaaccccgucucuacuaaaaauacaaaaaauuagcugggcgugguggcgggugccuguagucccagcuacucgggaggcugaggcaggagaauggcgugaacccaggaggcggagcuuguggugagcugagaucuugucacugcacuccagccuaggugacagugcaagacugucucaacaacaacaaaaaaauguuuuuggugcugacucugagcaggugcuucauuugauaaauagcacaaaaaucuuuaauccacuuucucccucucccucagccuuuucuuuuucaggacaguuuacagcacaggacacauaauagauucucaauaaagacugauugauugaccuaugggucuaagaugaaugaauuuuagggugaucuguauaaggagauugcaaaaggaguaauauuguuaaguguugcgcuuuuuauuuuuuccacugcagguuuuugucauccauuggagggacacuguaugagguuggaaagccugaaaugcaacaaaaaauaaauucauuccuugaaaaggaaggaauggagaaaauugcagaaagauugcaaacaacaguacacaccuuacaggucaucauagauggucucagccagccugaaagcuuugacuuucgaacagguaaacaguugaacuugaauuauagcaccuugcauuugcauagcucccauuaucuccuuugauccucacagcaauccuaugccauaagcagaauggauauuauucucccauuuuauacaugagaaaaauaaagcauggugaucuuccuucaaagucauuauaauuaauauccagagccaaagcuagaagccagguggucucccuggaccccuuguucacuguguauuucccauuuacuaaacgaaaugcaucaugcauguacugcuguaugcauggagacacacauuuuuuuaugguccuuuuguaaguugucuuuaucucuugggagccagaagugcaagguaaagcagucccuucacaagcuaaaaggugaaucuucuuccuaaauuauagcuuuccaaguucuuggauucugugucaaugaacccauugaacaaauaagauaauaucucuguugauuuuccuucuaauuaaaagugcucucagcuuucagcacagguagauggugagggaauuauacuuccauguaacaaccauaguuguugagagcagugacccagugaaaaagaauuacaguaucaaaugaccuacuucccaaggaaguuugaauaggaaccccugagauuuaaaugaauccgcucacuggucuuauaaccaguuuugaugauuccguguuuagggcuuggcucuuuuuauucugguuuaggcugcauugagaugguuagacauacuucuuugaaaagguuuaaaggaguuuugaaauacauccagcaaguucauuguacuauuccuucuucuguaggguuguuuuguuuuuuuuuaaguuaaagaaaaauaaaaugacacccaguaagaacuaugccaaaaaugugggaguagaagccuccuaguaguccuccacacaauguggauguuucagcagacaaauccaucuccauuuggaggcccaguauccuuuuaugggaauuucugggcugguuuuuagcaggaguacuagguggagcagugguucucaaaaauacuggauuuggaggugguauggcugcacccuuugcauuagaggguuggcaaaaaaugcuguaacugcagguauccuguacuggauuuuucacauccaucuucauuuuucugucauagugucgauuguuccauuaucccaguugcauuguagacucagagcaaagaucaacacucaaauuauaugguccaauuaaacuaccaaguuguugagcaaaaagacagaugcaucugggcucuggacugagcuuuccacuuacugcaguguucuaucaguguggcaagugaaguuuuaaauaggucucuuuaaaaaaacuuuggaacugaccuuugcucuaauguaagucacaauuuucaaaaugucugagaacuuucaucuuacuacuaaacacauacccaaggugaggaaggcuuacaaacuauacuuucgagggggcagauaguauuuugggcauuuccacgugaugauauuuuauguuacaucucuuuucuccauuuucucaaaaguauuuccuuucuuaaugccucauucuuuacucauaauaauucugucuuuuguuuugucaaugguguaauuaauuucauguguauuaacacuauggugacuaguuaauuucccuaacuggguuuauuagaagcaguccagacacaggggcugaaaaugcuuggcuaugaaaguguuaaaguuugcaugguacacagaggauuuucugauuucucaguguccccaacugucuucaggaauauguuaaguaguuccugacucugauuuuccuugcaagauuaaacuaaacagcugaucaggaacccuuagggaaucugcagcagcuggaccuccccaagaaaagagagagagagaaagaauuuccaagcauaaaaacaaugccuauggggucucggagacccguccuaccucugccccugaucagugacuuaguuccacuuugcuuugacacagccuuagccugguguaauauuacauuacaguagguuucuugcuuuuggaauucacugcuuuagcaucagguaaaauuccacagaaucaauuccaauuuuagcguacucauuuuuauguguacagugagauuuggaguuuaaagaagguuuuuauuuuguuuuauaagaaaaagcuuaauuuuuaaaacgucuugguaucaguaugguuggacugggggaagggaagaaaggggugaccaguuguuaauacaaauguaaaggauagcuuuaacaagucaucaggauaaagccaacagcuguggaggaaaaggaaauggaauggguggaggggaaaaugaggccuuaguaaaaggagauccaagcauagaauguguucuuuguuauuagagucaacacucaguaauccuaggaaagggggccuucaggaggagcauggauaaauggaguccacagauaauccacagccccguuuaaacuguuaguucuaacucuaacugucucccucauaaaaaccuuuguuuuuaacuagaaccauaaugauuccuuggcaugcuuuaugccuaccuuuuggacaauaaugaacaaagaaauguaugcuggggugagcaagaaaaaagggcuauaaagaacuuggaaacagaaaucuguaucuucaucauuguuucucuagcacccagcagagugccuggccaggagauaauagaguuaacaaauguuugaugaauuuaauugaaagaagagaaagaauauuagauacuaccuggucugggauucugagccauagauaaucaagaauccauaaauguugauuggauaaauauauaugaaauaggugggaauugauuuucugaguuccaaauuugugggaagaagugaggaagaaagaacauuugaauuucauccacauuuggccaaaaguugauguacuuucuaccaucuuuaaacaauuuaauaauccaggcacugggggaaaaaccaaaaaaaaagcuuccagucucuuguuuccaaaggucuuacuuucucaguguuugugguuuagcuuuguauauuuguuaagcaaauauauauucucaucaccucuucacaaagaggaaaauaagacugucuucucgauccuuauguauaaugcuaguguguagcauuguagaaggaaguaaauuuucuugaauuguuucuacugcaugaaugcugucuccaacugauaugcauguucucugaaggcaagcguuggucugcagcuccuuuuauaauccccccuuaaucuuuaauauuggucugggcacauaguauguaguaaguacuuauucacaaaguuauguuguaucuaggaaguacaaugccuuauuuacacuuacuuuuuuucucuuacagauuuugauaaaccugauuucaagagaagcauaguaugccuggaagaucugcagauugggacaguucuuacaggcaaaguugagaaugccacucucuuuggaauuuuuguggauauaggaguggggaaaucugggcugauucccauacgaaauguaacagaagcaaaacuuucaaaaacaaagaagagaagaagccuuggacugggccccggagaaagaguggaaguccaaguacucaacauugacaucccccgaucuaggauuacucuggaccucauucggguguuaugaguaucccacgaaggccagacgcugauuuuauuuucucauuuccacagauugacaaggauaagucaguuguuuguaaacucuagguagcagaugagaaauaauucacuuaauaucagaaauauuuuccaaacacuuuccuuuauuuuuucuucugaauaaauagaaaaccaacaguuugauuuccuuuucccuuaaaggaaacaacuaauacacauucuuauauggcuuuauguaguaauaguuuucugacuaaaauuuuguuuuuuauuuuuuguaauuuaucuuuaacuccuuuugcauuuuguauaacagauugcuuaacuucuacuugccaacaucugccuugcuggacuuguaugggauugucuucuugauuugaauuguaccgucuuuguugacacaguagggcugggcaguguuuaauccuuccauuuuauagauuuuuuuuuaaucaggccuuuuggacuucauucauaauuuugcaauaaucucuuuucccuugucaugcaagccaaaaauauaccaguaaaacagauucugacguguuuguaguuaucaaaugaauggcucgaaacacuucucaaaaggauauacguauugaccccaacaauaaauguuuguggcuagugac

SEQ ID NO: 18451 - RNA, 2347 nt, Homo sapiens
cacgggaaagggugcacuggcccugggaaugugcagcuugggugggucccuccaggaaagagucaaagucagggugacugggcgucccggcuugauucaucuaucagaaggcaaggugggaaaucagguagucucacagaccacagccugucugucucccugggccuguggcuucagaauaccccucucagugcaacccuaccccacaggcugccugcucuguacagucacaccaaaagccacccgauuccuggcauucagcuuuccccaaggcauggggugcuuuggcaugauggaaaggagacaggagagacagggagggaagagaauuuaucaaaaagagagaaaaagcgggcacucggucucuaaagccgugcugaugcugaguuugccuguacaggccucugacgggacucugccucauccuggguucacaccuccguucaacaccuauuuagugagcacuuccacaguggaaggcugggagcuacagaagaugagaugaggcugcccugccaggcugguguccgaucaccucccgugaggcugugaagcagcugcugagagaggggaggccuuagaaccucaccagucgcaggcccugaccacagggguggucagcccaacaugucccagccaagcccagcccuggaacucccaggaugacaagucccuggcucccuccagcccccaucucuccaagggagguccuaccaacaaagggugggucccccaagaugaacagcagcagcgggggaggggaggacucuggggucuagaaggaaauuucuacuucuaaccugauguggcagacagcagcagccacgggaugacagcagcggacagcaccgagcaagagcaucgcucagcagggauguuugcugaaggccugcuccacgaggagggcagccuugggcagcugcccagggcaccuuacccaaggccuggcagccguagguacaggagccccaggguauacuucgugggcuucuagcagagcaggccacucuggauggccaggggaggaaggaggugagaagcagcccacaggcugcuguggggcaaacaggggcucuguaacuugggccugcuccucccugccauuucugaagcaucgucuuuccccaggccaaggccuacuuggggacaccucucacuggaauucuagaaugcucccaaacagucaauucaagucccaauuacacagugagaagggaggcccaggaguaauaacuggggaggcaguguggccuaaucauuagcacaaggccuuuggagucagcaagagcaggugugaaucucaacccuaccucuugaugcccaggaguuccaucagcuuuggcuucuucgucugcacaaggaggaugacagcaccucccuuacagagcugcugugaguagcagaugaguugaugucugucaagugcuuagcacagggccaggcucaaugaauagugucugucacuacuucggccaucaucaucuccacucaaugucacacagcuggccagaaacaagccugaauccaggucuccucggccaccacucccaaaaggccucacccuccuguagccugggugacccuucuccuggggacagugacaucagagagcagaguuggaagacugugggucccaggagccaacauggaucuucuuggguuuaugaccuucaaagacccacccugagagguccugcucaaaagccccucggaggggcuaugcagccagugccuaaggaauccugaaggggaaggagcagagcagccagaaggaaguuauuagguagggcucuugccuuccagggcaggacggugcacuucucccagaaagccuucccagucauacacggcccagccaccugccaucaccacuccauucgggccagucuaaacaccuaaacaaugacaaacaggggcucaauagggugucacggguacagcacauagucucaggguucaugcagcaugccuuuccaugcuaagaaugggaggaggacaccuuguccucuucagccccugcuccucuuccccgagauacacucccugaccaccuuccccaugcagagcuugcuccuuagaacccacaacuucacccuaaauggugcugagcauguggcagaugcucaacucacaucucuucaguaagcagcugccacuuaacuucuccaagcauggauguccagugaaggcagcaagcucacugugggaagagccuaucucuccucagucucaaggguccccaaagagccuaggaucaggcagaguacccaggagauggucaauugaauagugaaagugaucaaugaauaucauggcaagcugacaaaaucugcauuuccuaggagau

SEQ ID NO: 18452 - RNA, 3328 nt, Homo sapiens
gucuuuaaaugcuucuacaugcagcucuccagcaccacugaauucagacuuggggccauguaauuagguuucuugaaaggcaagauuuugcugaaaaugcagugugucucgcagaacuuauaagcaauaucacccucuacauuaugagucacaaagcccuaaaucacgaggcuugauacuuccuuuaagccagaagcuacucuggcuaccagcccugagccaaacuaagaagucagcacagcaucuuuccccuuucuauguacauuuccucuccagccacauuuagacauccaauuccuuguguuucucccccucuucuuuuguccaaagguuaguaccuucagaaaauuaccugaaacucauuuaaaccaagauaaugaauaaaggauaaggcugaauuaccccuuccagaggauuucuucucacuguaacaaggaucaaaaucuuaagcuuaaaaaaaaucucuuuucuauuauguagggaugccaaguuauuuucuaggacaguaggguuuucccagugcuuauggaguuauguuacggaugugcuucauucaccagggugaagcacguaucugacuuucaucauccccagcacuauauaugcucccaggcuauauggcuacgucggcuugagccacuucaccucaaagccagugacacaggggcuaugcagugggauuguccauguuaucucacaagacuacugagguacacaaagcugugucuucugcccagaauguucaccugaauacaaagacugcaucugauaaauaaccuuaccuauaacauggauuccugcagugccugucacuaaaagugcaaucuucuucuugaaccaccaucauuaucaccaccaccaccaccaccaccaccaccaccaccaccaccacuaccaccaccaccaccaccaccacuaacaauuacaauaaauggugacugugucgaaguuccaggacggaaggcuucaugcaugacauuuucucccuaugagguuagagcauuucuuucuacuuauauaacuacccacuagcuccaaaggcugugaauccuggcccuacuguggucagaacugaaggacaggaaugacucaaggauacuuuuacaaaaguucugaaauugugccacaagugguggccaacucuaagaaggggcgaccaaccaacaccaggccggucuggaaucagaggagagaaaccccauccuggagaggagggucccucccaugaagaaaccagaugcccuugggauguccagcugauaagagaaaaguggguaggccuaggggaggcugagcaggagcuuuuuuuccugggguuccaugguuuccugcuagcugaggaagacaaggcagauucuugcugaucugggggucagauucuuccucuuccugccccccagccacuaacugccuucagaagugguuucagcuccuugaguuuaguggaagauuuugcuuuggaggaggccaaggacaggaaguaagauauaagcaauaacaagaagccucacauguguuguggugucuggacuucucaaagugcuugcacagccauuaucucauuuuacagugaccccaugaaacagguuagaaaguguuaucucuauuuuggagaaggggaaacugagaucugaggguuuccugaggagaaacccuagaagaugagagaagaguggcaaagaguuggggguggcaaagagcugccacaggaacugucacccugggacacauggcggcucuagaugcugcagaaagcugaggucaggcagggagaucucugccaggaagggcgcaugcggggggugcugcucagcaagccccaguggcgcuuacucaagccaggccuacccugggcccagucuucugcauuuccuucccucccuggggccggccauugcuccgggcaucuguucuccccaucuuccuccuccuaccucccaucaucaggcuccacagucccagaggcagggcuggugggggaguuaggagcuguaggguaucuaaauacucccuccuaugacaaccccagucucuuccccaccugcuucaaucuucuaaaugagcuaagaacccgagauggcaugacaugccuaagcagucuuaggcacucuuucaacaacucuaauaaaggugauaauaagagcuaacacugaacauuuauuacuaaauuugaaccuaagccaucuaguccugaagcccaugcucuuaaucacuacugugucuccuaagagacacugggccuggcacugggggguuagcaucuggcucagcuaccuucaucuucuucaaaauggcuggacacuggccggaauggaguugcaugcaggaaggaacaaggcggagggaaaggcucagucaguaauggaagagggucagucuccagggcagaagcugaugcuccuuacuggccucugaagcaggaguacagauggaagucucuagacucuuucuccuggggcagaagacugccuugagaauuuccucaggagccugauacacguauggagaaauauguucacaccacaaugaugagaagaguugcacaccaggaaagcucugcagauggacccugaggcucugucaaugggagaccaccaaauacaguaccgggaaccucugaggggcacugaugcaaugaaacaguggcacagguccacgaacaugcacccggcaauaccacgucuauguucaguuccacaccuuuaauacaggcacaacuccccacacacacagguaagacccaucucugcccacagcauacacacccauggcccccuaccugucaucacaguaggugaacuucauguccaugcuguggcggcucaggaaggucuugcuauccagggggauguccaugugggaugggugcuggauugguucacacaugaugaugaggcaggacagcaggggcuccuuguagccacacagacuauugugaggagggcaguuguuguagacuuucaccuggcccgugcagugcaagaccugagacaggcguggaagggucagacauggagccgagagugcuggggguggggguagggccuuaggcauccccugcaccgccguuacccuacaccugggacuccaacccaggccugauguugcccuaccuuccagguggcugacuugagguugacaguacggccucuguuggugaccgugcacuucauccucaugaagaagucccgcucuguggacaugucuuugcuuuuuuucccaaaaccagagccuggauguggaaggaugggaagaaccagcugaagucaguuuuauauggauauucaugagaggggcccagcugcaguuuuucuuggcagccuauugu

SEQ ID NO: 18453 - RNA, 1280 nt, Homo sapiens
uaguaacaugcuaacauuaagaacugcaggaugggccuuugcugcccauaaggauggcuuugaaaacuagaguuccaacucaugcaacucagaauuccaccauuugaaauccauuuccuuggguuccuuuuuuaaaugaagauuguguuggaaaugagucacagcuccacaaacccuguuaugggcuaaaccaggucccccucucuucccaaaauucauauguugaaguauuaacucccagcccccaguaccucagaaugugaccuuauuuggagacagggucuuuauagaggugauuaagugaaagugagaucauuagggugggauccuaauccaguaugacugguguccuuguaagaagaugaugaugugaagacaagggagaaaauggcuaucuacaaaccaaggagaccggcauuguauuaggguucuccaaagaaacauaaaaugacauuuauuacacagaauuggcucaugcaauuauggaggcugagaaguuuuaugaucucccaucugcaagcuggugucccuggaaagcgggugguauaaauuccagucugagcgcaaaggccugagaaccaggagcacugaugguggaagucccaguccaaggucaggagaagacugacggaucaccucauguagucaggcaauugaauugagagcaccaguucaacuggcagucugccuuguuccauuuaggcccucaguggaguggaugaaucccacccacauugaggagggcagacugcuuuacucaguccaccaauucaaauguuaaucucuuccagaaacacccagaaauaacauuuaaucagagaucuggccauccaauggcucacugacgucaacauguaaaauuaaccaucguagaccuggaauagaucuuucucuccuagcacucagaaggaaccaacccugcuggcaccuugaucucugaugcugacucuccaggauugcgagaaaauaaauuugugucauuuacgccaaccagucugugguucuugguuacagcaaaccuaggacacuaauacaacccaucauucauacuuccacguggguagaauggagggcuggggaauguauuuugucaucuuccauuuugugaaaaaagcagcaaaacaucuuugguaguugaaagcaggauugcaauauggaaagacaaagggcugcauuugaauuccagcuucgcuacucucuccggcugugugaucaagggaaaguguauucauuuguaaaugggauaaagauuuagccacuucccuacguugcagcaccga

SEQ ID NO: 18454 - RNA, 22382 nt, Homo sapiens
cgaaaugaccucaucucagauuugcucagugaggcgaagcugagacucagcaggauuguggaggacccagaggucuaccaggggcugcuggauaaacuggugcuccagggucugcuccgacugcuggaaccugugaugauuguacgcugccggccacaagaccuccuccugguggaggcugcuguacaaaaagccauccccgaguacaugacaauuucccagaaacauguggagguccagauugauaaagaggcauaccuggcugugaaugcagcuggagguguggaggucuacaguggcaaucagagaauaaagguuucaaauaccuuggaaagccgacuggaucucucagccaagcaaaagaugccagaaauacgaauggccuuguuuggugcuaacaccaacagaaaguucuuuauauaagccucugggaagugaagcuaguguugaaccacuaaaccauaaaaguuuaaguuuuuuggggaaaggaaacuaguaguguuuccuccucuuugaugcucugauacuguucuguuuuucuucacgaaauacccuuuggauagcuaaaguguuaacuuugaaauaaagcccaaauuaaugcucagaauucaaauuccaauucauccauacaugccacagcuucugguccauucugcagucugggauaaggggagugaugacaucugcucuucagcuuggccucagguggugaaugugugagaugugaauaguguucuucgccugugaaucugggugcucuaguuuaauaugcauaugaaguguguuuuucuuuuguuucagcuucaguacccaaauuuauguuauuuaaugaggucuagagaucuuccucacauguccagaaccaacuucaugugcauccaaccagcacagucacacaggggccaagcucagaagggccccgcaccuggggauuagugaucuguauuugcugcccugaaauuccuaauuucaacuuuggauguaugcuuuguaagggaugcuugauggaacccuggggcaugugccagggguuuggagccuuggcucacacaugguacugacucccaaagccuacccaccuucuugggauggguuguuggccaaccaauucccaguccccuggugcccugaggcccagccuuccuccaccucacccaguaagcauugcuucccucugcuccuggugggggccugguguaccugcagggagggucagaaugggguuucaugcucuguggaguuucagggccugaaaucucugcccaaggcuggcagcuccauagcauauucaguagacaacuugagggaaggggugagucucuuacacaccagauacugagcccguccugguguagagguuuaaagacccuaggaguuaccuauccgcuauagggcagccagcccacuggaaggagagaugccagcucaucuucccugauccuggcccaggcccacagugguggcuagugggaagggggacccaaccacugccgaacuugcugcaccagagucuuagggcaggacccucaggagcuuguaaaugucugcacuuggccugcaaaguaucucugugccuggccggguccucccuuggacagcucagugccugggggaacuuggaugcaucucuucuggccagugugaggcaccuucugggaggagccaagaaauacagauuguauaauuuuggugacuuggcauauaggcauugcacaauagaaaaguaaaugguagaauucaugcuaauaauuuaaacuucgaaugguagaauucaugcuaauaauuuaaauuuucuucacuuaagacauuaaacagcaaauaaacacuaugaaaagucaagaaaaaacuacagaagaaaggaaaaagcuuuaucuuuuagugccauucauggcacuucuuuccugcuuuuugaacaaaggaucucacauuuucuuuacuuuucuucuucuucuuuuuuuuuuuuucuuuuuuuuuuuuuuuuugagauggaguuucucuccuguugcccaggcuggagugcaguggcacgaucauggcucacugcaaccuccgucuccuggguucaagugauucuccugccucagccucccgaauagcugggauuacaggugcgugccacuauacccagcuaauuuuguauuuuuaguagagacgggguuucacuauauuggccaggcaggucucgaacuccugaccucaggugauccaccagccucggccucccaaagugcugggauuacaggcguaagccaccgugccuggccagaucucacauuuucauuuuguacugggcucugcagauuacauagcagguucugcauauguaugugugauuuaaggucuagugcaugccugauguugcuuuacuuauuaaaauagaauuuuuuugaagaaaagaaaucccaagaugcucugcugagggcaaagguuggccugugugguuacgacucuguaaggaacagaaacuucaugaaacucaaacacaaaguaggggacaggcuacuaguaaguuggggugucucacagaaccuagaauaggaauccuucaugaucucaggagagggcuggaauugggacucagaaagccaucugaaauccucuauauggccauuuuucuuucuuuaacgagugacuuucucuguugcccaguuuaaaugguggaauaugcaugccccacaauuccaaaguugacauguuauaguuccagaaacaaacuugcuucucuugaaguccauuccauuuucccaggagggaaucuauuuggccgagcuggggucaggugucuaccuaugguccauguggugucugggguaguucccagagaaagaagggucuuugucaacugaacggacuccccacagggugucuucuaugugggcccuuuugaguuucaaaugaacauuguuuuuuuuguuuguuuguuuguuuguuuguuuuuugguuuuuuuugagauggagucuagcugugucgcccaggcuggagugcaguggcaugaucucggcucacugcaaccuccgccucauggguucaagugauucuucugccucagccucccgaguagcugggacuacaggcacgugccacaacaccuggcuaauuuugguauuuuuaguagagacaggguuucaccauguuggccaggcuggucucgaacuccugaccucaugaucugcccgccuuggccucccaaagugcugggauuacaggugcaagccaccgcgcccagccucagugaacauuuuccaaaugccagugaugagccaggcacugugcugggugcugggcugcaaaaaagaauaugaucuggcucuuuucuuuaaggagucauagacacauaaacagaugaugaucaugauaaugauacaauguagcaagugccagccuagugcugaugugcaauccugugggaagacaguggcuggaagggaggguaacagaaggguuccugggcuuuggcaguugagcuggggaaagcgcuccaggcaaaggaaggaaagcaugugccaaggcccugaggugugaaaacgcagggugcauuacaggagcuguguguaguucagcgugauggaaugugaggggugaggaggaagagaccauggaugaagguggaaagaugggccucauuacaggguguugcucuggagguuuucuuguuuguuuuuguuuuugugggguuuuuuuuguuuuuuguuauuuuuuguuuuuuuuuuuuuugagaugaggucuuguucuguugcccagacugaagugcaguggugugaucuuggcucacugcaaccucaaccuccuaggcucgagcgauccucccaucucagcagguuacagcaggaagugggagccaaauucccagaaggggaugggcugggggcuugguccccaguccugaguagcugggacuacaggcaugcaccacugcaccuggccaguuuuuuuuauucuuuguagagaugggucucacuauguuggccaggcuggucuugaccuccugggcucaaacaguccuccagccuuggccucucaaaguguuagaauuacaggcgugagucaccacaccuggccuacucaggaguuuugacuuaauucuggugggugagugauaaggaggucauugagggacuuuaagagugaaugaaacaaugagagcuggacuuucagaaagauuauuccagugucgcucuagguggaggacacauuaaugugggggagagacuggagguagggcaccucucaugggggcuauuuaucagccugagugagaggugauaaauaaccuacccgcucuuucgugaggcaggugaacuucacgacacaaagguggaagagauuagaaucagugacuucuguccuaugccuccucccuucccccaccccaauauauuuuuucauuuguccaggcuugaggcucuauuaguuucacaucaucuuacaauuuuuucuuaugagagucucccuaugcuccaagauuuccccccucucuccucaccaucauuccaggcccagcaaagcacccacuucccagcugaucaagcccccagcccuuccccuuccgggaagucagcccccacuuccugcuguaacccuggagugucugaacccccucggccuacccuagcucuggcccccugagccacccucaaucuguuagcugcccccaacaucaauucaccucccccaaaaauggacagucguagguuuuaugaaggguuuugugggaaguugaggagaguguugcauuguaccuaugggacaaacuuuccccuaaguugcauuuaagcaucucuauauuuuccaacuuuucucucuccuggagcugccacacauuagcucuuucuccccagccuucucccucucaaccccguggguuccagccuuuaccucaccaugucccuucagcaacacaaaagccuuggccucucgcagucucuggacguagggacugugucucucguugaggacuuuucacacacuacuuuucuauacuguuagcaacuuuaucuacugugucucaucuuuuuagacacagcuccuuauggacagagacugugucuuuucucuuuuuugcauccccugcugcuguguuacuuuagugccuaacacaguagguucugaacaagcguugaucauuguuacauucuucucuccaggccuggcucuggguuauggauggaggacuccagagccucucuccuuuccuaguccauagauuuggacauaaaaaugggcaaggauaugagaugguggucaggggaaagguggugcauuguauuccaaggauccuucuggacaagaaaauccucuguugcucccagggaaagacuguggaugggaacagccugaaauucaggcaggauaugcccccugccucacuucaguccagugguugguuacuccugggcuugccugaggauuuauugaaucccaucccuccaugggaaacagaugggaggggcuuugcuuuggaccugggugcagaggcaggaggcucuggagggacugggccuggucuguguccuccaugggggccucagccaugggagaggcacaucuuagccuucaugucuauguggccaucaaggcuagacuugaccuuuggggugggcuaccugucaccauccuguugagcuccgacagcuacggcccuguagaggucuuuaccuuagaaagguuugcacugggcgcauucucuuaguugagugaaugguacacacuaauaugcaucuuuuauuggcauuaacauccuccccucuagaaggcaugcuccuuguguaagcuccuuggucccgugagccaaaaggagcaaacuguuacgacggcagacaggcacaacccuuccccacaccucucuucauuaacacuuccuccccaggcgcaagggaagcugucugcuacggaugcagaggcuuugcuuauggugaugggacugcuguagacucacucccugcuggggaagagcugggggaagcugaacacacagcagggagguccugccccacaugcuaggaggccagcugccuccugaggaugguaggcagaguaacuuggugaagggagaguguggauuugguucugaucuugagcugccuggagagccagagauggaggggaugcuuugauuguguggcaggaccucagagaaggcaggggaaccaacaggaaaugcugcagggcuucaucucugacccugggcucauggggcccguagaagugggucagcagaucaacucugggcccaaccacacacaccccaccucagcucuagggagcaacugcagccccuuccuaggcuccacagggacauugcugaagucuuugcccccauccuaugcucuccccaguccacccagacaccccuuccaauucacaaguucaucucugaaaucacaccugguacugacagcacugggaaaggacucuagucucaccucccacccccaccuuacuaugggugguccuaaagcacgauaaacccucaccuuuccuagcgccccgugcuuuccugcacaaucacacagcuuacccaguggucuugccuuacaaaacggcaauaugucaaccuaaacgguagaagcagagacaaaauuaauauaaguagagaguuuauuugagucaaguuugaggauugcaaccugcgagcauagauucaaguugcccuaaauacacacucugauuagcugaaguuacaaguggauuuuuaaaggcaaaagcagaggaugggguaugggcugauauaaaguuguuugucaggaauucucauugguuuacauaaauaacauugauuugauuggcuauacauuguuaagcuauaaagcguggguuacagugucuggugaggcacuauuagguugaucuauagcuaccuguggugauagcaagcagcuucaagagacgaacacauugcucaaagcaggggaguaggacaugauugcugucucguuuuagugucucucugggccugauaauuaaaaggacuuguauuccucagauaaagguucuuuucuuaacuccuuucauugggaggugaguuacucugcuucccauugcugaugcagcaaaaggggaucaguccaggcaggcccugggcccggcuccccacacccuccagcacauccuuggagugggggcaccgagcacaugcuuucaucacuggcagaugagccuguagagggugauguuugacucacccuagcuccuaccaaaccugaguggauugauguccuggagauuacagaagguuuagagcaugaagugaccuugagagccaaauguuuguccgaaucugaagcccagaguaagccaggaagcaguccagggucaucaccagcuaagaagccuccugcaacugcaaacagaaagccugaaaagacuagguugucaucguucauuuuaugaaaaacuugcuguacagaagcuuaagaacuuuggcuuccagcaggacagagaggacagaaagugcguggccacagcuggguccuuggaaaauccuucaugucuccuucccaggguguugugaccucagggcuuggucaaaaugaaggcccacagagaaggggugccugugggugacuguacaagggaugugacuugaggggcccagggaaaggcuggaaggaaggaagaaaggaaaggagagagggaaggagggggaggggagggaguagaaacaaaaugcguugggguucaacccguagaaggagaacgauagggaguguuugaagauuuuugucuuugcuuguuuggaaauugaaccuuggguuuucauucaguuaaauucaguucaguagaccucuuauucauucauucauuugacaaauauuuauugaguaguuaccaagugucagacacucugccaggcacugcaucccuugcaaugaacaagacaguuaaggcccagccuucacaaaggaacauucuaauguggauaaagcagggaggggugggcacagugggaggggucagguuugugaaggaacccuaaacaagugggcaggugaugacuugggauugguuaaaguguuaaggagaaguaaaggguuaugggcagcauggccuuccaugaccccagcucaaggaaggccucuuccuaaaucucccuugcaccuaaaggaagggaaggagccagacacaaaaacagaagaaggggaggagggaacuggggaaacaggaagggcauucauucuaagcagagggaacggcaagcgugucacaucugucuuggauuguuugggcugcuauaagaaaauaccuuaggcugggcaauuuauaaacaagagaaauucauugcucacagucuggaggcugggaaguccaagaucaaggcaccuaaucucauucaugaggagcagagcccucccaaucuaaucaccucccagaggccccacuucuuaacacuaucaccuuggggauuaagugucaacacaugaauuuuagggggacacugacaugcagaccgcagcaacacuugaaccaugggggcaucaaggcaaaaacagcucuguugguuuaaggagcaagaaggagaccaauggggcuuugcuaaguguguggaggagaaagagaaaggauaaggcuuuugugggucuugugggcggcauuuaaggaauuuggauuuauccuaacuagagugggaagccacugggagcuccaaaguauguaagggacacggccucauuuuacugugugccaguucuugcacuugccucuccccuuccuugcucaaaauaacucucagcaacuccgcagaaguaggaaagccaaugccccaucaucagccagcuccaaccaaugcacacuuaaaacauuuuuuuuggaaagcccccuguaaauaguuucuggggacaaugauauuccuuuuccuugcaaagaauaccauuagcuucaccuaugucuuuaguagcagaaguggcuaacaugaugacaaucccaccccaaggcaggaacaaacacaugcacuguuuacagaaauccuucaggccagcagaggaagcaucaccuuauccacgcacucucaccucccuuucuccuuacuggggacccucaccugccagcaggacugcuaaaccuaggcuuagcucccccuuuuaaauuuuugugccauuaccacaccuccauaccuuucaguuuucucuuaguucuuuaaagcaugcuuaaauuucuugacuacuugaguugagaggcaccucuuccugccuccuucuaccuuccagaaacuuuccccacugugcuguggaauccucagacucggacaucuccuggacucucagcccauugguuuguuucaugugcuuuggaguuucaguuuguugcccuggagagaugaccaccccuuuaccugugacuucccagauuuuucccacuuugagccaugagguucaucagccccaccaagggacuagggaguggggugagggcuaggguauuggcucuggccccauaaaaaucagaaagauaugguuagcaagaagggugcuggguauaucuugaaugaaugaauagagccuggcuuuguggaauuguggcccugucuuugauggauuccuuugggcuuuagauugggcucacuccccguucucuccagcugcugugugacccuggcaagucacauaucuauuaagugagggaccaggggcccaugaccaacuuuucuggggcucuccaggcccccaauccccaccccagugcuggcuucaccagcugucgcugacccuugaccucuucucaucucucuuuccaggcuuauuucacugauaccggccugguuugcaacuggacuuuggcacauucuggccucggggauccuugcuucucuuacugggguugugggcaggguuguaccuuaaacugcaagaagaggauaaacuacaaauccacuggccucugucuccauccaagggcagaacacguuaccagggagacugcuuuugaggacaaggguggcuguguguguaugguuggggggaaguggguggguggaugaguuuggagagugcaggagaaugcuuuaggccuuugacuucccauucugaagaccaagagcauuaacaggcauguuuccugccuccaggcuuacccacuagagagaaccuacacuuggaucuuggguuuggggucuuaauaauagcaguuuguauucucuaggcagggcuuugcagcccucuaugugagagaaucacugugcguuuauaggccagagccuugaggcgggagcuugcaagccuaggguucuagugcagcguugccauucaccugcuaguuuacaucaagcaacuugcucacuuuuucuuggccauaacuguccugucauuaacgugggagagaaaaugccuauuugcauugggauguuugggccauaaaaugagaugaagcagaaagcauacucuaaaaggcaaaagaggcaucuagguguuccaugcuaauuuugauacuaaaccuuaaaucaaugaaacuaguuuuauuauuaaacaagaaauagaaaaauguuauagaaguucaaaaaauauuuuuaaaucaaauuuaauuuuacuauccuguugcaguuaucauuuccucuuuccuuacagauuuuacaaugauauccucaaauaauuaugcauaauaugccuagcauuuuuuauuuuuucacauaaugguuucacuuggucuuuguaaucuucauuuucaauggcugcaaacuauugcaauagauauauauuuuauaacucacuuaacaaauccaauagugacccgaguaucaacaguaauugauaugugagcuacuuucaaguuuucauuauaaugaauacugcuguaaucagcaccuggcuuuuuagugaaaucgaccuguacauaacauuuuaucuaauuguuaaauuaauacacacacacacacauuauagaaaauuuaaaagaaaaucuaaaucacuggugauuguaccacugagagauaccauagugaaaaugugggagucugucuucccauccuuuuccucugcauacauuguguguaguggcaaauguauacacauauauacacaucacuggccugaugguguauaugcaguguuguauucuuauuucuuccuaguuacuauuguggcagacaguucagaguguggaggcuaagaggcugggcucuagacucaaauuaaccuaaaucagaguucaucccuuuggauaaacuguaacccucaauuuuucacacuuuauuagcuauucaacuuuaggcaauuuuuuuuugucuaggccaguuuuuagaagaagaagaaugcugggugcaguggcucacaucuguaaccccaacacuuuggggggcugaggugggcagauugcuugaaucuaggaguuagagaccaguccaggcaacauaaugagacccuaucucuacaaaaaauuuuaaaaauagcagggcguguuggcgagugccuguagucccagcuacuugggaagcuggguuggagaauugcuugagccagggaagucgaggccguaugagccaugauugcgccacuguacucuagccugugggacagaguaagaccccgccucaaaaaaaaaaaaaaaagaaagaaagaaagaaagaauuagaugaucugucucuuaagguuguaagagucaauccacauaaagcauuuagcagaacauuuggcacaugacaaauacuugcuauugucauugggugggugcauguugcaugucaugaaaaauucuuaaaaaucagcauuuuaaaugacuuucauauuguucuuuuauaccugauuuauucauucucaucauauauaguuaguuuaauaauaagagagugaauuuuguaaaccuuugcucuaguuuggacuauuuccauaugcaagcauccuagaacaggaauuaaugaguuaaagaauaugacgauuuuuaaaaggcucuuaauacauaugccaacuugcuuuggcagaaaggauuuuaaauaacggggcuuaggcauaguuuucaaacggcagcaacgagaaguguagucuucgacuuuuuuccucccucuuucuccuccuuucuuacgucguagcauuuggagccuagacuuuugagacggucccuuggugugaaaagggccggcguaccggagagggaggaggaggagagagcagguuugaauguccggacagucuuaguaauuguaucacaguugacagaugcgacagcggccacgugacccguguaugaccucauagcuccgaggcucgugcguucagagcccgacccagcggcggcgggaggaggggagugcguuuucaucaccccaaguuggcaaguuacucaaaggauacgugaggguuugggaacucuccuugguuuccugggcacugggaagcccaggcuucucuaaucacugggaagcgagacgauuuagccucacaauuagcaaacauuugcuaaaugcaacuaggugcccuguucuggcugcaggccaagcuccgugccagguuucaucuuacuucauucugauuaucgacaucucacugccgaggaaacagacuugcagacaccgaugagaaaacuuaggagccagcuggggagggaggacuggcccaaagucacagucaacaggaggaagcggcgcgcgccuagcuacgcaaaaccguauuggacucggggagccaggggucgggguggggugggggcgcggccggcugggagggcuucccugaagaaacguaccguuuaggcaggauggaaaaacgcagagcagaacgcacccugaccuggcagagcaucuguaguggagagaaugggauuuuagaggaacgcugaaaauaaaacaagaaaacaaaagaccagaggaaaguauugcuagggugaagagggagcgccuuggcuccuuugccaccaacccagccccagugagaguuuacccccuaacuuugagggugcccucccauccccagagcccuugguuuuacgucuaaguacacuccccuugcagggaagcgccagcuccgugacccugguucucuaaacauuuuccuugcagacuccuaaaagaauuuugaaaaucuguguaccccuugcacauuuuuaggugcaaacauuuaaauuguuuucauaaguuuaaauaguuacauagagucuacuuucugguguauugcaaauauuugacauuuuaaaauaaaacugucacaguacucugaaaaauguuucuaaauguaaugcuauugugauuggauacaaccaucaucccuuuuaaaacuacaugaacaauuugaacaaauuucauuucuuuuuuucuccuugaacuuauauuucucuucuacuucccguacagaauuuuagcagaauauauuuuuacgguucaaagucuuuuauguaucacccuucacucuaucauacuucuucccaacaaaacuauguguauaagacgaauuuacuuuuaaauuuuucugugaccauauacucaguguuaaagaacauuuugucuucauuuguaccaggaugacuaguacacaaucaaaacaaaugcuuuacaaauuguaauagguaacaagaaagcauaaagaauaauuaauuugaaaugcaucuuuuaaggaaaugacgcuuccuucuucaucccaguuaguuccuauauucaugggugaauaaucguuauugcuagaaagggucagaguucagcauuaauucuauuccuguuuuucuuuuuuaaaaauugaugcucagcucagaaaccuuuuucacauaaggacaaaggaaugcaaggacuuuggugauagcagugucauucaacuguauaaauuccuuucgaguuauaugccaaaaaucauaugggccgaucauuaaaaaucuaucagcugaccgcuagaauugauucuccuucacuuugaguaaaggcagggaauugaaagcuaguugauuuguucggucauuagaguugcuccugcucauuuucucagcauggauaccaggauuuagauucucccuucacugcacuggacauuuucccuggucaaugcaccaugguaagaugugggaucgguaagagguaugcccuuuuuggggggaaaugggagaaaggggaggcaggagggagaaccacagcagcagcauccacuggcauguacucagacaggucaccuguauaagacagccaagcagaaguugaggauuuggucccgugagucucuucaaaugacccacaccaaaauacguauccuuuggaaaaucuucauauccuuaagagugccugccucuuaguuuguacuggcccauuccuggauuagugagcaaaggaaagaaaggcgauggggugagggguuccugcaaguucugaagguuuauuugcaggagggaagguacucuccugagggcugaccucccugaggggugaccuucuuucuucagggccuuucuugggaggaggcaaaaguaaaaccgaucugaaccccacgcccgccagcugucucuccagacugaaacucuucucucagagccuuccuucucuuuuugguucaacuugauuugagcucuugaaagaaccuacuucucauuccuccauggggugccucucaagggcagaguggugucugcaacagacccaucagaguggaggggagcauuguggggucagccaaggccagggagagugagaguccuguuggacccagacacagcacuggccuccuuugcuagcuucccucuccucaccagccagggcacgcucauucauggugccuuuguguccuuagaaaaagacccucuuuugggcagaugcagcaccaugagcccaugggguggggaggacaggacaccuuuguacuaagaaaaaagcuccccuucuucucaacugaugcagcccagugccaaggggcauagcuuggccaggggagggugggcuggauuucagcucccacauguccccgcagcuggacaccuuuuggcauugcacagcugccuaaccagggggguuuggggacacucaggauagauguagaagaaggaugaacggauacucuggccugcccccagcccugcucugagauguuucucauacgcuucugcuggaauucccugccaaauggacucuauuacauuauaccuuaaaaaaauaaacuaaagacagccagacugacauggaauucccuagcaugcauggcucauagaacuacccuagucuccagccucagcacacgccucaauccuugggcucagcugagaagaugucauugaaagaaaucauuaaacuucaagguugcaggcagccauguguuagcuauuuuuuuuuuuaagccuggagcaaggagucuaugaauuacguuucccaaauccguaaaugcaaccugagaaaaccccacaccgcgauuugcuauaaagaaaagcucugauagauuucucucuuaaauacagcaccucccagcaagucagugccuaacauuuguggggaccuaggacaagaggaccaaaggagauccacaaacauuguguugacauauguuuaacuauaauccguuaauagcaaacugucaaaugcuguagcccccuaucuugacaaaucuucauaaugaccuggaaggucaaguuugaauuagaaucucauuguccugagauagccaugcugaaacauugugguuguggggagaucuggcugcaggccuuccccaucgcugaccccggagccugcagcucauagcccauggccugcccuccuccugucacacugagcucugccuuaaucuuuggggagccugauacgggcauuccagacuccauauccaaguuccaaucacaccucuuauggccuacaguuuucuuuuuuuuuuuuuuuuuggugacagagucuugcucuugucacccaggcuggagugcaguggcacgaucucggcucacugcaaccuccaccucccggguucaagcgauuaucuggccucagccucccaaguagcugggacuacagucgcccaccaccacucccggagggguuucaccauguuggccggacuggucucgaacuccugaccucuggugaucugcccgccucggucucccaaaguggugggauuaaagguaugagccacugugccuggccauggccugcaguuucuagagacagaucugaggccuuuugggcaaguaauuccaggguccuguauacccagaguauggucuaggaaagaggaaggaggugugagcauggguggagacagccacuggguccuggagacuccuuaccccacagagaagagucaggcuggaggagagccagaguagaggccucuuaaagugcaugcccagagcaaggucccucuuguccaggucugagggcaguacugccucccagagugacagcagcuaugugauaugcccuugccuucuggaggccaauccccgacccucacccccaucacacacaaacugggcagguaucucaagaaccuugguuuuuuuugguaacaauuuuauugagauaauucacguaccaugcaauucacccucuaaaguacugauucuucagugguuuuuacuguguucauagagcugaacaaccaaccacuagcacaaucaauuuuggaacaucucuuuaccccaaaagaaacccuguaccuuuuaguugucacugccaaaucccucuguuccucgagcccuaggcaaccaugaaucuacuuucugucuacagacuugccuauucuggacauuccauguaaaugaaaucauacauguggcucuuugugacuagcuucuuagcauaauauauucaaggcucauccauguuauagcaggaaucaguaauucaucccuuuuuauugccaaauauuguauggauaucccacauuuuauuuaccuacccacugguugauugacaccugggcugcuuccagaccuuucauggaccauccugcgagcgcagugcucuguauguuggcagcgcacagcauaugcugugucuguggaguuucccgcugggcauccccucucagccaggcccugcugccacuuccuuuggcaccaucaucaagcccuucguggugcuagaggagggcuguuuucucucaagaaguggggaaauggcucccuucccugaagacgggcacacgugcuuacauauguuccaauggcucugcuucucuacaucucccucagacucccuugguuagguucaugaauacaucuuucuuuauagaacaggcugggcacagaugccaugguaucuccuauguuagcuguugcugagcugaggugccaagucauauaacgagaaagcccuugcaggauucagaauucuugguugugagugagagaaacccaauucaaaucaguuaacagcaaaaauggaagcugaaaggucuagggauagcucuuaucucagguggauccagggacccaaaucaugucaucaagaaaucacuuucucucucccuccuucuccaucugucuucccauaucuuggcucugcuuuucuccauaucgauuuuauucucagguaggcuuuccccaaguggaacaagaugaccaacagcaucucuggacacauagucuaccagcuuaguagccaauggaauaagagcucaucuuuccaagaguuucggcaaaacauccagguuugaaacucauuggucaggcuugggucauguguccacauauuaaccagucauuuuggccagaagauggaauacccugguuggccagaucuggguccugggccuaccccuugacuagacgucaguuaaccugaaccucauggacuaagauugaggaagagggaguggcccaaaagaaaaucaaggggaaauaaaugccggacacacgcagcagauguuacuggaaccauccuaugaacuguccugucuagggucugccccaccaguuuaucaugcauaucuagguaggccugagcccuaguaguggacauucuuaggcugaagccgggaucccguuaaauacuuaucguuacauacaugucguuacauaugauaaaucaauuccuuaugagacccuagaaauugauagcccagauauucccccucuuaaugaggguuuaucauugaacacgaacaaagccuuaguauaagcaauguugcccuaaugguggaaucaugggcuuuacggaagcacguuggagaaaauauuuugaauccaagaggccuuuuggagacagaggcucaguaaguagguacccauucauccaucacauccauguuuaggaucuaaauguccuuaauuucauaguaauuuauucaugccaggaaugagcagagaaucaggaugggggaaguaucagaggggccaagaaaucauagacaaggguguccggguaaagaagacuuuguuauaggcagcagcacaacauagcucuucucugacaucccccucacucuuucuucccaucccuguuccuuugucaccauggaaaccaaugaugcucccuccuucuccuccccucucugcucacucggguccccaggccccacugcucuuugucugacuggcuucacaccgcgguugccagccucuuugcaaacacugagccugggcaugcagcuucaccuucuuuucacccuccaccccgccacccucucccgccucauuuuccugcucccaggcuucuguuucaugccuuccuuaaucuugauccaggcuuuagugaaauugccaucuuucuucaagaaguuguaugaaaauuagauuuuugccacucuaaccugauuugaaaugcauuaagagaucugucuuuugaaacaccucaaggugaggcaauuugugaagggaagaagcaucccuuacugcggcuucugugcuuaaacauuguuagagagugaaucacauucuauuuuuguacuaggagugucuucuguuuaacgaaaucccccagcgugucucugagugaaacagagacuuuaucauaaaggaaauaacacuucgaguucagagauugugagcuguuggccccguggacuuuuguuaggucuguauaguggcuaaagaaaauugaaccaacauuuaaaaaucagcagguaucacauaaaagucuggauuucuggcugcccuugaguuggacauggggcauguaucuccacauggugaagaugggaaggagggaaaaaggaguagaggcuuccugcuuuacggcuucuuccuuuccagucagcuaugccuggccagcuucccacuuuuaucuggcccaccugggcccuccuggcaucugagcuucugacccuggcccuaauugaucuguuuuuguuuguuuguuuuuguuuuugagauggagucuugcucugucacccaggcuggagugcaguggcacgaucucggcucacugcaaccuccaccuacuggguucaaacaauucuccugccucagccucccgaguagcugggauuacaggcgcaugccaccaugccaggccaauuuuuguacuuuuaguagagaugagguuuugccauguuggucaggcuggucuugaacuccugaucucaggugaucugcccgccuuggccucccaaaguacugggauuacaggcaugagccaccaugcucaguuuccuaacugaucuguuuugagaacaaggauucucccacagugcauagaguuugcuuaagggcagucaucuggaguucuuuugaaguuggccugauaccugagagcaggugagcuuucuaccaacuacugugcuuccagagucuuccaaucauuguuuucuuggaacccacucaggcuagcucaaauauuaugggcuuuauguaugugaggcuauggagauugcucagaagugaaagucagccugagugaacuguauaggguuucucucuuacccaaccaccucccucuucuuucuuauaccuacuccugucucagaguggacauaccaaccuggucuucagaaaaagagccaggcauagcagauugaagagggaagaccccaggcugccaguuacagacugacucucccgucuuaggggaccuaggagaggacauggggugggauccagagggaguuaccgaggccuuugaguauagaucugcugccacucaugaaauggcaggugugugggucaggugggccagugagugaggccuuacaucuguccccucucaaagacauuuuccuccuuagcgcuuggugagggaagugugggaacacaggagggcaaggcugcagugagccgagauugcgccacugcacuccagcaccggugacagagcgagacccugucucaaaaaaacagaacaaaacaaacaaaaaagaaacacgggaacaguuagaauaaaaggguagauucauaagcagaaaaacucuggagccacuaccccagcuacacauaucuagagagauauacagggggccacacaaugccaucugaaauggaguagcaguucucuucccauguuaucaaaccagcucggaaccuuuguucacaaaccuaaaugaaugagacgcagcacgguucuuuguuuucuuccaaucaucuuucagcuccuugccacacuuggucucugguaccuccuggcugagcaagcuugggcaauuccugaaccucucggagucugauuucucaucagcaaagugggcgucaugggcugaauuaucuccccucaaaauucaaguguugaaguccuaacccccgaaaccucagaaugugaccucaucuggagauaggggcuuuagacuacguacuggguacaguguacacugcucgggugaugggugcaccaaaaucucagagaucaccacuauagaacuuauccauguaaucaaaaaccaccuguaccccaaaaacuauugaaaucaaaaaaagaagucauggcguuaaaaugagggcuuaauccaaucugacugguguccuuggaagaggaaauuuggacauucagagagacaccagggaugcacacagagaggaagaccacguggggaugcagugagaaggcagcagccaucugcaagccgagagaggccucagaggaaaccaaaccugccaacaccuugaucuuggacuuucaacuuccagaacuguggacaaaugagcaucuguugcugaagccacccaguuugugguauuuuguuagagcagccugggcagauuaaucuagugcguaccagugcuccuucauggagggcuaugggauaaaauagaugacaugagaguguuggacaggguacaauacauccuagguauucggcaagggugagcuuccuuuucaagaagccgucacagaaugcuuuagcucacagagccuuucucagaucgucucuuacacuccuucuguuuauuugauugaucaaucauugcuccuuaaucacugauugagcucuguggucugguuguugaacccuggcaauggguggucugugcagccacacuauuugcugcucuugcacuuccaagaccugaagcuagagcuggugcucagagaagagcugccccaugguagcaagugucugucacuggcucuuucuggggcagagggaagcuccugaaacccugcccuccccaccuccuccaccaagggucccccugcucagcacuuucugcauggcuuccugguggcugucuuccaaggccugcuuucugccccaggaccuuacaaaggcugcuuugaugaaaaguuugaggcaaagugacugugucauuugauacaagaggcucaaggggguaaaaaguguagcuuucuucuauuuuuggauuuucuagcccagcggagaaugaucagcugaaugggacuggggcggaagccaggagcagagggaggaaaugcacccaagcuggagagccccugugauuagcagcuggaagccuagagcgugaccugcuugugaagaggcgccucugcaggcagacucugcgcccagagcuggaaggcaugcaggggccacuugcccuggggccaccagacuccuuccuccaauggccugcuccaacggucccugccccugcaaaaugcacagagccugcucccucccucccuccuguugauggaguacaggccaaggauagucacucucugggugagauuugagaggcaccacaaaagccccuuaacccuggggucuccgucauccaccgccagggcaguggcacagggcccugcucucagugggggcucuccacauggcuuaaugcucugcugucaccgucguggaauucaugaugggacacugcauuguccucuugcacugggcccacaaauucaggagccggaccuccccaccucucccaguucuugaaauucagguuagcagucacuucccuucccugcucuggcugauaccucucaucuguguagcuucuuauucaccaccagccuccaccuuguuaucucacuaauugucacuauaacccugugagggacugacaucucucugacucguggcccuuuguaggauuugccccacgagcucaggccuuuugaugccaccccuuugcucucuuugaggaacaaaaaugccuaccu

SEQ ID NO: 18455 - RNA, 1907 nt, Homo sapiens
agagaagcggagauccugauguuucucagugccauugugaugaugaagaaccgcagauccaucacuguggagcaacauauaggcaacauuuucauguuuaguaaaguggccaacgcaauucuuuucuuccgcuuggauauucgcaugggccuacuuuacaucacacucugcauaguguuccugaugacgugcaaaccccccccuccccauauaugggcccugaguauaucaaguacuucaaugauaaaaccauugaugaggaacuagaacgggacaacagggucacuuggauuguggaguucuuugccaauuggucuaaugacugccaaucauuugccccuaucuaugcugaccucucccuuaaguacaacuguacagggcuaaauuuugggacgguggaugcuggacgcuauacugauguuaguacgcgguacaaagugagcacaucaccccucaccaaucaacucccuacccugauccuguuccaagguggcaagaagguaaugcggcagccacagacugacaagaaaggacgggcugucucauggaccuucucugaggagaaugugauccgagaauuuaacuuaaaugagcuauaccagcgggccaagaagcuaucaaaggcuggagacaauaucccugaggagcagccuguggcuucaacccccaccacagugucagauggggaaagcaagaaggauaaauaagauccucacuuuggcagugcuuccucuccugucaauuccaggcucuuuccauaaccacaagccugagacuacagccuuuuauuuauguuuucccuuuggcugugacuggguggggcagugcgcagcuucugauuuuaaagaggcaucuagggaauugucaggcacccuacaggaaggccugccaugcuguggccaacuguugcacuggagcaagaaagagaucucacaggauggagggggaaaugguuucccuccaagcuugggucaguguguuaacugcuuaucagcuauucagacaucuccaugguuucuccaugaaacucugucguuucauuauuccuucuuagucaaccugcacagccugguuagaccuagauuuaacccuaagguaagaugcugggguauagaacgcuaagaauuuucccccaaggacucuugcuuccuuaagcccuucuggcuugguuuauggucuucauuaaaaguauaagccuggcugggcgcgguggcucacaccuguaaucccagcacuuugggaggccgaggcggguggaucacgaggucaggagaucgagaccauccuggcuaacacgaugaaaccccaucucuacuaaaaauacaaaaaaaaaaaaaaauuagcugggcguagccgggcacaguggcucacgccuauaaucccagcacuuugggaggccgaggcggguggaucacgaggucagggguucgagaccagccugaccaacauggugaaaccccgucucuacuaaaaauacaaaacaauuagcugggcgugguggcgggcgccuguaaucccagcuacuuaggaggcuaaggcaggagaauugcuugaacccuggaggcggagguugcagugagccaagaucgugccacugcacuccagccugggcaacagagcaagacucugccucaaaaaaaaaaaaaaaaguauaagccuaacuuugucacuaguccuaaggagaaacuuuuaaccacaaaguuuuuaucauugaagacaauauugaacaacccccuauuuugugaggauugagaaggggugaauagaggcuugagacuuuccuuugugugguaggacuuggaggagaaauccccuggacuuucacuaacccucugaccuacuccccacacccaguugauggcuuuccauaauaagauugggauuuccuuuaaaaaaaaaaaaaaaag

SEQ ID NO: 18456 - RNA, 500 nt, Homo sapiens
cuacccacuggaacuugucauuugcacacugacacaguaaugauuacucucaaaguuagauacaauaucacccccucuuccccucauugcuuagacacagcuaagcagugacucucagaggcagugggaugaggacauggccuugccagcugaugcucagaaagaccaaacacuuaacuacacauaaauagcucaugaaccuaccuuucccaaaacucccaggccacaugcaucauugccacaggaacaaucagguccccaaagucauccuagagaugucugugguggguggcuggacccaugagacuuugccuucaucccuuaggauggccuuuuggagccuggagacucucaggaaacugauuucuuaugcgggaagauguugagagccaggaagaauggagcacaauguaauuuauuucugaaucuuucaucuuguuggauaugccccaggguggaguaauucuuuugaucacagauaauucagcccuggauggauc

SEQ ID NO: 18457 - RNA, 14186 nt, Homo sapiens
ugaagauccaaaagugauuucauucagaagaaaaaaugccuaaaaggggaaaguaacuuugaauucugagaauugacuccugcaaaaggagcaggguauagccgaagauagucacaggaacuaugauaagagcaggcacaugugaacauuuguaguaaacacacccugcauguggcaggagaagcugaugugaacaaaaucaacugcucgagguuuugcuucaucaguuuuauuggucauauauccagaauucaucauauauaaaucuuucaaaauaaugagcuauuacaagaauaguuuacaagucagcucugacugcacaaauacuugacacaggaaaccauuuuuacaaauacauauguuuucuuauaauacuguaauaaagaaaauaagucuguauacauccuacgacaaauuuuguagucucuuuuucccauucaaucaucguuucagguuuucuauuacagaacguccaucacauccaauaaaccaaauuacaaucugcugcuucuucucauuuucaaauacuauaaagauucacacuguuaaaggguuuuuuggguuccuuuucuaaucuuuccugauuugaaaagaauccauguaucuaggcuaaaagagguaacuucaacaauaucccucuugacuagaacuucuaucugauuaaucauuguuuggugaauuaucuuuucacuuccuacuuaggcuaggccaggugguaguuuuaccccugcugauaaaguccugacauuccuaauaguuccuaaacugcaaauaaaaaacccuagaaacgagugaaauagaaaagaaagcuaaaccacuauugauuagagaacacacucaaauucagggucucucccagguugaagaagacagaaaagcaauaaaguauaaggauguggcaguaguuguauaaaauacugaaaaucugaaagagucaucacuuaagccaguaguguaucauuuccaaaaugucagaggauacagaaucuuagacucuguggcuaggcugaacucagaaucucagacucuguggcuaggcugacauucuuaugcuguggcuuugaaauagccuaauaaauauccacuugcccagagcaaguaaucauuuaggccaggggaacuuuacagaauacugaccauguuugccugaagagauaggaaccaccagggcaaacauuugguauucacuccacuucacuguuacugaaaagcauccacuuggcaaagccuguuguuuuacuuuucaggugaugugaauuaaaauuaagaaacuagcaguauucuacuacagucaaguuccugaguacucagcuccaauuaucuaauauucuugaaaggaugcugauaugguuugguuguguccccccacaaaucucaacuugaauuguaucucccagaauucccacguguugugggacagacccagggggagguaauugaaucaugggggccagucuuucccgugcuauucucgugacagugaauaagucucaugagaucugaucaguuuaucagggguuucugcuuuugcuucuuccucauuuuuucuugccacaauguaagaagugucuuuugccucccaccaugauucugaggccuccccagccauguggaacuuuaaguccaauuaaaccacuuuuucuucccagucucggguaugucuuuaucagcagcgugaaaacggacuaauacaguaaauugguaccaguagauugggaccugcugaagaaauacccaaaauguggaagugacuuuggaacuggguaacaggcagaggcuggaacaguuuggagggcucagaagaaaacaggaaaaugugggaaaguuuggaacuuccuacagacuuguugaauggcuuugccccaaaugcugauagcaauauggacaacaaaguccaggcugagguggccucagaugaagaugaggaacuuguugggaacuggaguaaaggugacucuuguuauguuuuagcaaagagacuggcagcauuuugccccuuccauagggauuuguggaacuuugaacuugagagagaugauuuagguuaacuagcggaagaaauuucuaagcagcaaaguguucaacaggugacuugggugcuuuuaaaggcauucccuuauaaauaagggaagcaaagcauaaaaguuuggaaauuugcagccugacuaugcaauagaaaagaaaaacccauuuucuggggagaaauucaagccagcugcagaaauuugcauaaguagcaaggagccuaauguuaauccccaacaccauggggaaaaugucuccaggccaugucagggcagccccugacaugugugugcagccuagggacuuggugucuugugucccagccacuccagccauggcugaaaggggccaacauacagcucgggcuguggcuucagaguggaagccccaagccuuggcagcuucuaugugcuguuaagccugcaggugcacagaagucaagaauugagauuuggaaaccuccgccuaguuuucagaagauguauggaaaugccucaaugcccaggcaaacguuugcugcaggggagaggcccucucagcggcaggggagagaaccucugcuagggcagugcagaagggaaauguggugugggagcccccacacagagucccuacuggggcacugccuaguggagcugugagaagagggccaccguccuccagaccccagaaugguagauccaccaacagcuugcaccgugcaccuggaaaagccgcaggcacugaacaacagccgugaaagcagccaggagggaggcuguacccuacaaagccacaggggcagagcugcccaagaccaugggaacccacuucuugcaucaguaugaccuggaugugagaccuggagucaaaggagauuauucuggaacuuuaaaauuugacagcccugcuggauuucggacuugcaugggcccuguaaccccuuuauuuuggccaauuucucccauuuggaacagccgucuuuaaucaauaccuguaccccuguugguaucuaggaaguaacuagcuugcuuuugauuuuacaggcucauagguggaagggacuugccuugucucagaugagacuuuggacuguggauuuuugcguuaaugcugaaaagaguuaagacuuugggggacuguuaggaaggcaugauugguuuugaauagugaggacaugagauuuggaggggccagggguagaaugauaugguuuggcuauguccccacccaaaucucaacuugaaauuguaucuaccagaauucccacguguugugggagagacccaaggggagguaauugaaucaugggggccagucuuucccaugcuauucuugugauagugaauaaguuucacaagaucugauggcuuaucagggguuuccacuuuugcuucuuccucauuuucucuugcugccauguaagaagugccuuucaccucccgccaugauucugaggccuccccagccauguggaacuguaaguccaaguaaaccucuuuuucuucccagucucggguacgucuuuaucagcagcauuaauacagacuaauacagaugcuugaagcaagcccuuguccaauaagguauuuaauagcacuuagggacuauuagaugucccauuucucuucucuuucauuucucuuaucucuucucaccccaguguaacgaaucgcuacagguuuuuaccaaaaugcugcagcaguaguuggaaaugaguuauuuugcauuacuaaaguguucaaucacauuaucacgggucacauuuguauauaaccaggagauggccaaauaacaucuacugcagugauuuugcaaauucagcauagucaauguauccaucauuguucuugucaucaucucucaaaacaccaucuauuauguuaaucaguucaucuucacucauuaguggugccuguucacucccuuccuacaaaauacaaauuagacaaugaugaguugcgcauuuuaccggaagaagugcuuaacuaacguccaaaauauccauguucuuucauggcacuguuuauuaaaaaaaaaaaaaaaaaaaaggaaaaacaaaacaacaaaauauccacgcucauauguguccaaaaacuuucaauggaguauggggcuacuucuaggaaucuagauauauagagagagaauauguauuauugagucaauuuaucauaauccaguuuagaaauuacauuugccaguuaaaagaaggcccuucaaaauaggcuuuugcuuauuuguuucauuauggcucauucuucuuuaauuggaaaagugccaguccuccugagggucagcucugugcacaaauuugccugauaaaauagaaacagugacgaauuggacaacaaguuggcaucaaaacaagaggaagaaggcacugccgaugagcagaaccuguuaugaucuuugaggagaaaguauuucccaugcuccaagagcaggguuagugggcugaggcuguucacauccuuggcugguucuuccuuugccacaucucccacauucaccauucccucuccugucaccaccacuauccucaucugccaggacugcugaccccuaauuccuccgccuaacacuagucucuccucauguccuucagucugucucccacaaccaaggaucuucccuaaacaaugccauucuccugugcaaaaucauucaugcucccugcugccuucaaaccucaccugcacuccuagcagcgaauguaaucccacucaccuggcuaacuuugccuugcuuccucucuauagagggcaguguggcagaaggggaaugacauuaaauguggaggcacgaggauuuuuuuuuuuuuuuuuuuuuuuuuuuugagacagggucugacucugucacccaggcuggaguccaguagcacgaucacagcucacugcagccucgaccucccaggcucagguguuccuccccacuacccucccaccccgucaccccagcagcugggauuacaggcaagcaucacuauguccagcuaauuuuuguagagacgggauaucaccaugcugcccagguuggucuugaacuccugggcucaagcgauccuccugccucaaccucccaaagugcugggauaauaggcaugagccacugugcuuagccuggcacaagaucuugauuucagugucuucaccuagaaaaugggaggguuuuguuuguuuuuuguuuucugagacaggaucucgcucuauugcccaggcuggaauucaguggcaacaucgcagcuugccacagccucaaccucucagguucaagugauccuccuacuucagcaucaugaguagcugggacuacaggcaugcaccacugaaaauggaaguauuaacaaugccugccacugccuacucaagauguugcaaagauccaacgagaucucuaaccuacuugaaagggcuucagaaacuuuggagcaccauacaguaucacacaagcccucaauuacugccacgucccugaaucccuuggugucaauucaccauuaaacaacuucucccuugcucugcaguuugaauacggucugucuuuuaggcacugauucucauacucugguguguaacagaaaugccuguagcacuuaaagauacaaaugcccagcccugggacuucugccucagcaaguuauccuuugcgggaaggaucguuggacagaaagaggcagaacacagaagagaaagaagcagcagcaccuuuuuuuuucuuuucuuuuuuucucuuuuugagacaaggccucacucuguugcccaggcugaagugcgguggcaugauuauggcucacuauagccucgacauccuggacucaagcaauccucccaccuuagccuccugaguacguagaacuacgggcaugcacuaccaggccuggcuaauuuuuuaauuuuuguuuuguuuguuuuguagagacagggucucacuauauugccaaggcuggucuugaacuccuggcucaagugauccuuccacuuuggccucccaaagugcugggauuacagaugcgagccaucaugcccaguggagaagcagcacucuuggcacauaaggacaacacaagucaacaagacuggggaccaaauuaacaaagggaagccuuucugugauacagucccccaagccacugccagaccuaccuccuuauggacaugagugauggcuguggagaguucuaagccaucaagcaaauuauugccaucauaaucaugcauuuugaaguaauggagcugcaauucuuguggcgacaucuccgccucugguuuguugaugacaccuucuagaugcuccaugauaugccuaaaaaucaacagucagguucaggccaauugacagauacugggaucaugcugaaaucuuaaggacucugaaaaguucaagaucuuaaacuuccuccagcucagaaaaacaaacaccagcaguggcagaccacacucaaggauuacacagagauagacaaggccuugagaggagcaggaaaagucaaauagaccaucuguuaugcuggcaggauuaggguauucuuuccucuuuauuauuagaauuuuguuauaacauuuucaggccaucaauuuaaaaauauguccuuuaaaacuuuuuuuuuuuuuugagacagggucucacucugccacccaggcuggagugcaggagcgugaucuuggcucauuguagccucaacuucccaagcucaguugauucucccacuucagccccccaaguagcugggaccauaggcauguacugccacauccagcuaauuuuuugcaauuuuuuaguagagacagguuuucccuauauugccuaggcuggucucgaauuccugggcucaaguaauccaccugccucagccucccaaagcacugggauuacaggugugagccacugcacccagccuuaaaaacaaaggauaaccgaguauaaugcgugaggcuaacuggcccaagacaaaagcugcaacaaaugauucaauguuugaauguguugauuuaaaaaaggucuuguuauagucaagaaaccuuagcuauuuucuggauucugcuacuaugacuguguauguguaccugugugucuauuuguaugugugugugucugucuguggugaaaaaaaggagagaccggauucagacaaguaaugugccccauuugggccuaaagaucuuccaccugugauacaaugaugaaaaaagaauaccugacuuauagguggcaauaaggaauaagaaucauccuugaagaaugucaaggagccauagaaacaggaagaaggaaaggaggacugagcaugcccuugccgcuggcucagcugcagaugauggggaggccacuggaccacagcccgggcugaauacguacucuuggucgugcacuguguucuuauccaggcccaugcugccggguugggagaagcuggcugcaggcuccucagcccuggcgccuggggcacaaaaggcccagagcaggccacacaggaaggggguucugagcagggaucucauggucaucaauaucugugagaugggaaacacagaagaggaaggcagagcaucagagcaaagguuucguucagggcuugacaugguaugauccugggaaaccugaugaagcaguaagguuaggaagagagcuugucaaacacggcccaaugccagcucugcuuugagacugugggaugacccugggcacuccaagucacucaaauggcaggggaaggcucacgagguuuccugaagugccugcagagugccaagcaacacgugaaagcuugaagggacuggaagauuauucuugccucccagaaguuaugguccccugaaagaaauauuuucuaucaagagcaccaggaaaggcagccagcaaguuauaucagauuaucagagaaagcgaaaacccucuaggaguucaggggaagaaaucuccuccgaguggaggaaaaucagagaaggcugauagagcuggugacacuucagcugggccuggacagauaugcagggacugaaggaccacaggaauggugggagcagaguggcaggugcccacaagcgggaaagaaacuacaaguaguucagcugggcugcagccuagaggguaggaagcagacaggacagagguggcuccaaggccuagacaggcuguacuggacagggcuuugcacacuaggccagggcuugacaucuccugcagagaaagacaggagagucacuuacaauucaugaaugggaggugagaucagagcuugguuucagaaugacucaucuggcagcacaguggggaaggcaugaaguggcaaaagcaagacuagaggcaggagcaugguagccaagggagugguaaggcgggucagaucaaggucugcggcagcggacaagguucuguaccuccugggugguaacaguggcaaguaacuacagugagcgggcacuggaaagaaaaguuacagagaaaucaggaugccaucaggaacucccaggguuuggccacacuuggaauuguggucaauaagaugacagucagcuacagagcaagcucuuggagggcagggagaacuuuaaccccaccaguauuacccgccaagggucaggcaggccuuuaauaauuguugauucaauggaaagucuuggucuguccuagggcugacagacugaccucaaaaaggaaggugaaggacagccaggugaccuacauacaaaaacaaaagaccugaccgaacacucacuucccaacaggcaaaacagauucugcuagauaacaaggccagggauuucuaacaggucaauuguaguccacagccccaaaccagcagugguaaagacaaaccauaaggcacuggucauccccuuuacaugcuacacacagggcucagcucagaagcuguagcugucuuugugccuggggcugagagguagagguguuauagucccucuuacccauccuaaaaggcucucagggcagaacccugaaagugugaguaugccacccuacaacacuuagaaaaauuucccaaauccguuuuucccauuaccaguauugcuucccauggcccccuccuuaaaggggacaauagucacugggaugucuaacuuccaggauaggccaggcauggugguucauaccuguaaucccagcacuuugggaggcugaggcaggaggaucacuugaggccaggaguuugagaucagccuagacaacacagucagacccccaucucuacaaaaaauaaaaaauuagcugagcguagcagugcaccccuauagucccagccacucaggaggcugagauaggaagauugcuugagcccaggaguucaaggcugaaguacacuccagccuggguaacagagugagacccuguccuccaccaccaaaaaaaggaagaaacuuccagggugcuaaaaagcaccuagaaucuagucuacuucuaaacagugacaucaaaaugcaaucugucucagaccuuuuauuuuuuaauuuuuauuuuuuugagacagagucuuguucuuucgccaggcuggagugcaguggcgcaaucuuggcucacugcaaccuccgcuucccagguucaagcaauucuccugccucagccucccgaguagcugggauuacaggugcaugucaccacguccagcuaauuuuuguguuuuuaguagagacaggguuucaccaucuuggccaggcugaucucgaacuccagaccucaggugauccacccgccucggccucccaaagugcugggguuacaggcaugagccaccgugcccggccaccucagaccuuuuauaucuguaguuuaaaaaaaaaaaaaagcaauaugucauacuuaauaggaaagaaugcucaauauauauugaaugaaaaagaacaggcugcaaaaaagcaauaaagaauaauacacuuuuguaaaauaaaaauguguauuuccuacacaaacuaauaacaaagauuaucuugagacaugagauuagaauugugauuuucagccggcaugguggcucgugccuguaaucccagcacuuugggaggccgaggcgggcagaucacgaggucaggagaucgagaccacccuggcuaacacggugaaaucccguuucuacuaaaaauacaaaaauaaaaauuagccaggcgugguggcgggcaccuguagucccagcuacuugggaggcugcggcaggagaauggcaugaacccggagguggagccugcagugagccgagaucugcuaccauuuuuuaugaauauguauucaauguaaucuaucccauaauuuugucccaauacuauauggaucggauacaaaaggaguuuccgguuaauucuuaucuccacaaaauaauucagaaacagucagaaacuacacuuccaauuuuaccaaauaaaagugcccagaccuuggccagggacaguggcucacaucuaugaucccaacacuucgggaggccgaggcaaguggaucacuugaggucaggaguuugagaccagccuggccaauguggcaaaaugcgucucuacuaaaaauacaaaaaaaaauuugcugggcaugguggcgugcaccuguaaucccagcuauuugggaggcugaggcacaagaauugcuugaacccgggaggcagagauugcagugagccaagaucacaccacugcacuccagccugggcaagagagugagacugucucaaaaaaauuuuuuaaacguguccagacccugacaaggccacugccacuguaccugguaccacaaaacaagguuucagguuacuccuagcagugacugccuaggccauagcagaacaacuuguucugaccacacaucuuagaguucugggacaggaaggaucagagaagggaaucaagcuccucccaagccuuucagacucauuuacaucaaaugucucuuucuccagugaggucuuuucaauuccaagucugguguagguauucguccugcaggcucccaagugcuucccuucagaaggcucccguccacagcugaugacagcugcaaauuaauucuuuuuuuucuuuuguuuucuugugugugaaugaauucuugaaaaacugccugauuacuugucagugccccuugcuggaugggcuuuaagaggacuuggacugaauccacauucccaguaucaggcacagugccuggaacagaagcugcugguucuuagccugugugccaugguccuuggggagcuggggggauuaccaccuuugcagauaugcugccaauuuuuaaugucacuguaacugaagaugaaacuuuucuuuuggagauaucuaucauggaacucauggcaccauuuccuccaacuaugugauuggaugcuuaguauaucaauuugguguguguguguugggggugggggaaauucuauuuagauaacaccaaaaagcaaccaagugauuaaucauguaguaacuaugaguccaaaauaucccuucuuuaagggaggugggauaaaggccaagaaucacugauuuugaacuugucucauuuugguuugcuguugcagguuucuaaucauuggaaugcaacaaaagccaaaucgauaaacauaaagaaaaaaaauuccuccaagugguacacugaaaacagggaaucgggcugggcaugguggcuuaugccuguaaucucaauacuuugagaggcugaggcaagugaaucacuugagcccaggaguucaagaccagccuggacaacauggugagacucccucucuaauuagaaaaagagagagagagagaggaagaaaggaaagaaggcaggcgagggagggaaagauagaaaacagggaaucuaacugccaccuaacaaauuaaacugcugacagucaagagaaagcauaagcaacucccucuacccaaauaacagguugcaucauccaugcucuaacuacuuagcucaaggccaugggcuaacagccugaagauaagccccagcucacuggccuucuuuaggaaauuauaaaggccaggcugaagaaaaacccaacggaggagaaauuucugcaaagggacuucagggcacaacccauaccuugagacagcccucacaaggcgcagccucaguccugggagggcagugcuggaccaucaggagcagugcgccucccagugccuuggcugucacagugcuccccuccugcucugccagccucuuccuguaccacagccuccgcuccuacugguuccaucuguccaucuccaacuuccuuccaggacagguucaaaugucaccucaggauucuuccagccaagaccaauugcucucucauccgaccucagucuguagccucucacacucauuugaccugaacauacgaucacagguuguucuccuuuuccauuuuucucuuuuccucccucucugagagucaggacccucucuccucuggcucucauuuaccuuacugaucucugcugagcugaccuggcucaucgcugaaucagggaagugagucuuggcaccuagguguauuguucccuaucccacagcggaucuagccuaagcuggaacuuccuuuggaggcuuccagugguuugaccuggcccaacccuuucuuccuggugugucaucaguccuaucagcacuaaguuuggggccagccuuccugccagcagcuaguagcagcuucucccucaaggggcccuugguuaagaauucaaacccaaagcagccaaacucaccaacauccagacauccuguacccacagccaaugccaaagaaaaacugaccaguacuuugucacuuaccccugucaugguccuggaaugaaggcaagaaaauaaccaacuuccuaagcuaaagaaaccucuacacggacugaggguugagaauugguucugaaaaagcaggcauuuaauauuaauaacuugaucuauuuguucaucuagggagcccaaggagcacccaugcugcauuuauacauuuaaugaccguacuaacagcacaagguacugaagauaguacuaugaccucgacaaacuccucucacacagauuacaaccugguagaaaagagagaccggcaggcagacacccaugggguaccacgaaauccccaacugacaccugaaauaacacauaaaggauaagaaggauuauuucaaccaaaggacagugccucagacauagcgaacauacugaaggaacauguaagcccagaaggaacuuguucugaucuaagaaccaaaaaagauucaguaugguugaagacacaguacagucgagacaaaugaaucuaaaguuaaaggaagacaggucaugaagggcuuugcaagccccguucaagagcuuggaagagcaaugagaauccaccaaagggugauaagggaauggggggacgcuucuggucacaugaucagauuucuguuuuaagaccauggcuguagccucucuguauagaacaaacuacagaggaugaagaagagaugcagggaucaucaggaagacaccgagguaguccagagaagaaaagguggccugaacuagguagggcagggggaugggacuggagaaugaacguauccaagacaacuuugcaagggauucgauguggguggguaaaggagugaagcaagugagaaugaugcccaauucuggcuugggcacccggguggauggccaugcccagagagggaauacaacaggagaucagcuucccccgccgggcccgacaggaccuguggucuccccgagagagggaacaaggagcagagggagaguaaggcuuccggcccgcugcuuuugggccgggccaggagcaguguccacccgacacagcuggucccacaggccgauccucgggccccuagggaccagggaagggggcggagaucugcccagucggccccgucuggcuccagagcccccgguggggcacaggcuuccgccccgggagacaggccgugcuccuagccgguuaagcgucccgagacggccugggggcccagcccgcgcccccagacuacuccugccucucaucuugagcccaagccuccagcccacaggagaggcgccgggaucccgcccgcugcggagagugcgcuaguucacucacccuuacggucuccgaagcagacgcgaagcccuccaacgugagccucaccagcccccguccccaaaacgcucuuccucggcuucgccccgccccccccccccccccgaccugcccugcgcacgcg

SEQ ID NO: 18458 - RNA, 2534 nt, Homo sapiens
ucacaaaucuuauuccauuugcucuuugccaucacccugugagaucauucacauguuaaggaggugaacugagggccugagagggugagagacuugaguagggucacacagcaagccaggggcaggaacuggguuucggcagggugucucccaggagccaagugcgggccuccugcagccucccaaaagcggugacuugggcaguaacuacccuggaagggugcggauggcuggggugggaggaccccugguggguaaaugcugacuaucuccccuccccagugccuggagcgagccaugaaguuugcguuuggagaauuucaccuuugguaccagguggcccucuccaugguggcuugugggaagguaaggcccagggggcgcuagggguugcacacucacccgcagggggcucugcugagauggacagaggggcuuuucuggccaggggaguggguggguauuauccugccgcugguuugaaccuccgggagagugaggggcguggggugggccacacagacaccuugugugaauuccuguccacgugcgagcugugagugugccggugugcuggugugagucuguggaugcuuuucucugagcgugcguacaugcaugggagcacuguauccucugugcugaagagcuaauaaugugacugcaugugguggauaugaggugcauccaggugagugaacauuguuccacgugggcuguaguucucauccuguccacugagcauagcaucaggaaauggccugcuuguggacuggagacuugccucggaggggaagcuuaaagggcagagcagaacagcagcacccacaagggaguucggagggaguacugcaugaugcauggggcugggagcaccugcauggggacagggccuggcgggacgcugcccggagcaaggagcaccgggcaugaguucacucucuauccacccagcuccggugccaucaccccugcuuuuugcuccgaucagaauuauacuuacauaagccucuauuuuaagcagugacaugaaaggaaaaccuuucuggagcugaguucugaggguguuggggcugaggaugcuaugaaugcaggaaauaagguggcaugagcuugcagauuguuccaggagcuguaaauauccagagcccuuucauggggcugagggaauuccucgccccccuggcccaucugugccacguuccauuucuggccccgcagccgucucugaggagggcccuccuggcuugccagugccuccuccacgcaucaagggcgugccagccagcucggggccucggcagccgaggcaggccaggcccuggcagggagggggaagaggagcaggugcugcagccugagugcggggagaggcuugcuggggagccuucccuacccccaucugcugggcaugugucuuuccaaaccucucuccucucccccaucacaucggacaccucacagagcaucuugaagucacagcaugaucuccuuggcucugugcucagcagggucuugucaaggcucagggagaauucagaacacagggcaaggcccuggcccuccaaggguuagagagugagagaaacccuccuacagaacugcaggcaaaggagacaaugugggcaacggugaaggggcuggaaaagacgagcuggccguggggauggggacaggaagguguugaaggcaccggucagccugggguaguagggacagggccgggaggagguggggcuggaucuuccauggagccuggggagacagcucacaguggcaugggcagguucuuccuaccucugggaaacacagaaagcccgucuaaucuugggacagugaguacaggugggagaggccuagggccagagcagugguucgcacccuucuguggguccuggacuccuuucaggagguaagggaagcugaggacuccugcucagaaaaauucacugcacgugcaaguuagcuuuaaauccgagagaggcuccuagacgcucuccaggcucagucaaaggugucgugauagccugggagguaaggagucuucugccucugacuagcuggacucagagagauccagacacagccuggcaccaucccagcauccagggagcugguuucgcgacuuggcuccuucacagaccagcaagguggccccgggagugggcuugcaucagggaguuaagauuggccaguugcccaugcaugaggcuucaugggcuggagacacuguguguucggugcagcaggagauuguucuggaaagcauucuccaccccccuugggaacccugcccaccaaaucagucugccugauugucccaggcagcccucaagaguggccagaccuugccuuugcugaaagccuaagguggaaucaagggccuguaucugugauuaugcccgaaaggccuuccagaaggugagucuggguaguugaaccugcaggaauaauggaugaguuccgugacaugauuuaggucguuccuucucuugcucucugugcggcaauugcauuggcuguguugcuaggua

SEQ ID NO: 18459 - RNA, 1848 nt, Homo sapiens
aaauauuccuaaaauauugacugaaauacaagcaauuuuauucaugccauuucuuucuuuucugcuuucuuccuguuucucuccugacccuucucuuccucucuucccauucuuccacuuucugccucuucugcagcugccaaauuaaugcauccuuuucccuccuugugaguuuugguccccugaacuuccacugccuuauaugagauauaauaugguaaugggaagaagaauccuuguuaugaguaacauaugugauuaacagaucaucgcgacugaugcuugaguacaagguaucaagccauauuuagcagauugaguuuaaacaccugguagaacaaguuugguccaauaaaaagacccgaauucucucccuuuuaagaucucuaaagacacugguuacaucuaaaccauuggguaggggaagggugccauuugccauuguaguucagauggagggaucaccugguggagggagaguugcuuuuuagguguucccguuucgccuuacacgugucccuuugaugcguggagaaugcaagggagaggcaaagcagggcgauuuucgugggaagcuagaccagccucccucguuacauaggcucguccucugcauugcauccgagcuucagugauuugcuguuuggagacugcagauuugcauagagccccuugcuucaccagcgugugugguuuuucuuuucuuuuuuucuuuuucuuuuucuuuuucuguuucucucccuuacuccuucgucugcaucuucuucucagcugccuuuccgccguucgauucccacuuccuucagaagggcgcacucuucccucugaaccccucgccgggcguaagugucaggaggcggcggacgcggagauugccucgggagcaggcgaugcgcgccgcugcuccgcgcgcugcccgggggaggcuggcgcuagcgggcgagccggccggggcugaauggagggaaggggcgccuggauuccauggggucugcuucugucuugaaaggagguugggccggcgaaguggccucccuaguccccgcacacaaagcuaaauggauuuaccuaguggauucgcgguggaugucugucauguagaagugaggaccuuccaggaggagcuuuaaacaauuucucggccccccacccgccggcacgcacucucgcccgaaacucuuugggaguaucucucgagaaccuggagcccuggaaaucugggagcagccacccgcuccgcgcuugcuguucccggggcugccuuuccggacaagccccucuccagcugcauucgccucggcuauguuucggauuguuuggggugcuaggcacggcggacuccaggaccccgagaagacuguccgaaggagggagaggaugggugcccuggcgcggugaggcggccggccccucagcccacuccgcgccgcccgcuccccugcgcccucuccucuccccgcgccccaaacuuugccucccgcggcggcugccccucggcgggcgccccgccauguaccagaggaugcuccggugcggcgccgagcugggcucgcccgggggcggcggcggcggcggcggcggcggcggcgcaggggggcgccuggcccugcuuuggauagucccgcucacccucagcggccuccuaggaguggcguggggggcauccaguuugggagcgcaccacauccaccauuuccauggcagcagcaagcaucauucagugccuauugcaaucuacaggucaccggcauccuugcgaggcggacacggugggucugcgaugccaaguucucgcggguuauccccucgcuccccucuuucuacccugcacucgcuccugggcuccua

SEQ ID NO: 18460 - RNA, 2941 nt, Homo sapiens
caggggaccuguaagccaaaccccccucagaagccucugccugcagauccucuggccagaacaacucggcucacucaugccuuggccaggaccccaggacaaugggagacugggcuccgccuggcaccccucagguuugugugacaugccaugcccaucucuuucucucucaaacucuugugggaccaaccacgacuaauccaagccaggacaggggugcaguggucuaggccgugcuuccugcucccccuacaacugggaauaccguaaaauagacaugacaauuaccaggaaggaagcagucccugugagcuuauaaucacaggcauuggcacacagugccuaucaacagccacaguggaccuaagagagcaaaucaagaugucauaaaacuacaguaccucagaaagccaggccuguaagacacaaagaaaaagaggagcuaccaaguagcaugacaguaugaagacuggacaccuguguuagucuguucucacauugcuauaaagaaauaucgaagacuggguaauuccuaaagaaaagagguucaauuggcucacaguucuguagguuguacaggaaguauggcagcauaugcuuccggggaggccucaggaaacuuacaaucauggcggaagggggagccagcacuucacauggcuggagcaggagaaagagaaaaaggggaggugccacacacuuuuaaacaaccagauuuaaugagaacuccuaucacuuagaaccaaggagauggugcuaaaccauucaugaaggaucuagucaccucccacaaggcuccaccuucaacuuuggggauuacaauuugauaugagacuggggcaggaacacagauucagaccaucucaaugcccaccuccacaacucucagcagaaucugcccaguuccugagguccugagacauuagucggguuggaggcauacggcuggagcaagggacauauggggaguaagggaaagcagcugccuggcagcaggacacugggaaaacagggacaaugggcaaaaggaaucaccuuucacagcuuauccugcuugguccacuaggaaggcagagaccucaaucccaacuuaugcugggaggcuaaccccaugguguaggggagccagcuuacccugguuggugagagauaaccaauuuccaggaauuuugcaagcuagguguuaaaccuagccaauauuaaggauuaaauuauacaaauuuaugauauuuuauauuagaaacaaagguaauaagugcucaaaacucacuucacauuuuucuccauuuugcuauaauugucugugcucuugagauugcacucauccauuauuucuguauggcagaaaaccuaggucaugguagcugccugcaucucuuccauguuuagugaugucaggugguagcuugaaaccagccacaggaggaguauuuacaccauggacauuggcaaauacugcaaaucaggcuuuccugcccccaaccccaugggcuguucaacauuuaccagcacacagaugaguuaaacccacagccaaaguacucuucugacacacaugcccucuuggcaggaagccugcuuugugagcucaaaagaaccaaagguacuguguuggccaggcccuggguucaguaauccuguaucucugaaggagaagacacacuggagugauuuuauuacagcucuugggaagaauguuuggcccgugaaagaaagagcugcuuaauaaaugucagagauaaaggcggucaaagggucaggacaauuguuuaauucccaacuucauaaauagagaaaaauugcauagcauccuaauuauuucauugugguuugcauguugaucuugaaguuauuuuucuuguucuauuugaggaagaaacacuacuuuacaugaaaacaaugaggggaagcccuuuuucuuaaaugcccucaagcuguggccaaucuuaccucuggucaguugcugauuuugguccuguccugcacauuucauuuuuuagggauacugggugcccaccuuugcucccuguucucuggagcugugcugugggaugcagggacugcuaggcauguugcgccugguaaaagucuuacuguauuuugaagacuuaguacccuaaaaugucaacuauccauuuuuuucuauugaugaugaccuguugaaauaauccucuagguauacugaguuaaauguauuacuaaaauuaauugcaccuuucucuuuacuuuuuucauguggcuacuagaaaauuuaaaauuucuuguguagcucacauuuuuucugugggacagugcuggucuagaguugacuugugggugggaagugcggcuuuggagacagguuucccacccccguuaugaggggcagugguaucugacacagaaaacccuucagacuaucagaauacaucuccaaccccagaccucucuauccucagaaucacuucucaaggucucugaucauuuuuuuuucuccucucuucauucagaccugcuccacaauauccacaccaagugcccagauccacccacaccgccuauauuaagugagaagccgacaccuuuuuucaacagugaagacagaaguuugcacuaucuuucagcuccaguuggaguuuuuuguaccaacuuuuaggauuuuuuuuaauguuuaaaacaucauuacuauaagaacuuugagcuacugccgucagugcugugcugugcuauggugcucugucuacuugcucagguacuuguaaauuauuaauuuaugcagaauguugauuacagugcagugcgcuguaguaggcauuuuuaccaucacugaguuuuccauggcaggaaggcuuguugugcuuuuaguauuuuagugaacuugaaauauccugcuugaugggauucuggacaggauguguuugcuuucugaucaaggccuuauuggaaagcagucccccaacua

SEQ ID NO: 18461 - RNA, 2497 nt, Homo sapiens
cauggccggguggaacgccuacaucgacaaccucauggcggacgggaccugucaggacgcggccaucgugggcuacaaggacucgcccuccgucugggccgccguccccgggaaaacguucgucaacaucacgguacugcgaggccugcgcgguccggggcacugcuccgguuuggacccugagggagggacuugggugggggcgggcgcggucuagggcgcgcagcgagaggcccugacugggugcuugcccuggaagcggcgcgaauggcggcugcacgugagugggucccucaguugcccguagguccuaugccccaggcggcggcgcccaucccgcccgcuaccccgcuuuccgcgacggggcguuacauccggggcacagggcggggaggggcgcggcgcccggugcggcggcccacuuccgccucucccagggcggggcggggacgcgccucaguuuuuacuggggauugggauugagaggggacccggggauccuuggacccccagcuccccguccggcugccagcccgcgucccucuaccauuguuucuccuggugcggaagggagccccaggcgcguggucuuggucccuugcccacccucugugggcuucuggccccuccuaacuccguuagagagggcgaggccaccacacgcccccccagcucagcacguuggauucaacauuccugcgaggccaaucccggaaguccccucgcccucccuucccgccauccggcggggccuggagcaggggaacuuugugagaaguucugagacagcauaagcgaaaguauauugguuuacuaccgcugcucccaccaccaucucccuguccacacugcccggaaguggggagggggagcggaaguucaaaaggggggggaaggggguuuccgggcgggaggggaccggaugugggggcuuggggugaaagggggaggggggaaagguucccgggguaccuagacccgagagcuggccugccgggucuggccccuguccaccuucaaaaguuuuccaacuuucccggaaagcccccaggggucugcuuccucaucucagagcagagauaccuggagcuaaacucuagguuacuuggagacccaggcguccgggcccuaacagcuccugcagaaccuuugaccaaauaagggcaaaguugcuucucuugccucgcccgccccccucccuuccccucuccgcuucugcuuuuccugaaggagaguucugagcauccaaaggcuccucacuuaccucacugacucccuuuauuuccuggguuuacuuuccccauuaacacugacaucuaaaucucuagaggaguaugucaucccuuccucccugguuccauauucuaaguuucagaaucaugaucuuuuucugcacuaacgucccacaguccucagaguuucucacaguucauugauguguacugaguauauaauuuauacuuagcccccacggcggggugguucucagaaguggaagacaggugggucuuuggagaacacggugggaaucuuggugcacugacuaacuugaugggcgcuugguuccucuuccagccagcugagguggguguccugguuggcaaagaccggucaaguuuuuacgugaaugggcugacacuugggggccagaaauguucggugauccgggacucacugcugcaggauggggaauuuagcauggaucuucguaccaagagcaccgguggggcccccaccuucaaugucacugucaccaagacugacaagagugaguuccugagucuuacccuuccuuuagcuccaagaucucuaauguaccgccuucugguaaucuugagggugcuuuuuugugugauuccccaacaugaagggagucagaccaguauuguguuccuugucugcuggaugcuggaacacgggauagucccuccauucugucucaguuccucaucuuguaauucgaaguugcugaacugcauuaccucuuaaauuacuuacugccuugagcucggauuagaaacuguuuucuaggaguauagguagauuguuggggucuugaaucaucgaguucaucguuugaguucuuuuguuagaaccuggagguggcaugcacauccacagcccuuucuagccugaacacaugaaucaacagucuaugagccuuugaccccuaaguuuuuagucuguuccucuccagcguuuaagcuugauuuuccucuuuugaaaagccuuauuguuucagggugacugacagccugccuguguguggugggggggcggguugggagagaugagguuggguuacagcccccagggcuggacagcugcugaacagcuggcaggggguggaauugugacaccuggauccuagccuccuuucucuuuccuccuccuccagcgcuaguccugcugaugggcaaagaagguguccacggugguuugaucaacaagaaauguuaugaaauggccucccaccuucggcguucccaguacugac

SEQ ID NO: 18462 - RNA, 48264 nt, Homo sapiens
auguucauugcagggaaaguggcgggaauucgcugaacuucgugggggcggcgagggugcgggcuggaugcaagguacugggccgcuggagugacagagaugcugugugaugggggcugagggcucuucccccuccucacccuacuguuccacauuucuucagcaacuuucuucauuccuuaggaaaauuuuccuuuuucuuucuuauuccuguuuccccacaucccacucucucaggaaagagcuacccuucauugaaaucuuacuuuuuucuggcaacgcgcucuaaaaagaugggccaggaaugauucccuccacccccagacaaaaaugaaagcaacacuuccuuuuaggaauauaguacuuucuguuuuuaauuuuaaagcuagucaagugacacagugcgaguggagaagaaacaaaucucuggcugugaccaauuagcugcaaacaccaccgcaacgggaccagccuagugauuuauuuaaacaaacgacauuaaguaguuaaagcaaaccccuucucccucaaagaaaagaaagcuaagugcgucugccuuagcucuggggaauucuucggcggcuugggauggcgggugggagcugccgcccugccuccccaggaacuucugcgacaggggcagugcaguaaaauuugaaucugcgaccccgggccaggaguggugguggaaacagcagcccggccgccgcggcagggugcgagcgcgcgcaccgauuggucgccgggccgccuggcccacugcgccugcgcaguccuccucccgcaccgcccugucgcccaacggcggccucaggagugaucgggcagcagucggccggccagcggacggcagagcgggcggacggguaggcccggccugcucuucgcgaggaggaagaagguggccacucucccgguccccagaaccuccccagcccccgcaguccgcccagaccguaaagggggacgcugaggagccgcggacgcucuccccggugccgccgccgcugccgccgccauggcugccaugauggaucggaagugagcauuaggguuaacggcugccggcgccggcucuucaagucccggcuccccggccgccuccacccggggaagcgcagcgcggcgcagcugacugcugccucucacggcccucgcgaccacaagcccucagguccggcgcguucccugcaagacugagcggcggggaguggcucccggccgccggccccggcugcgagaaagauggcggaccuggccgagugcaacaucaaagugaugugucgcuucagaccucucaacgagucugaagugaaccgcggcgacaaguacaucgccaaguuucagggagaagacacggucgugaucgcggugagugacccccgccggcaucccuccucccgcuucuucgggccggccugugcggggaguuuagggaaguggcagggugcagaauugaaagggagcggcgguguccccagcccuccccggcgggguuugccgguucagauaacccaguggagggagacugcgcagccucgcgugcguuccuggaucgcccccaccccagucuucggcgccgggagacgggaagcgcccagccucagcccuggacacucccccaccuggggcaauggaggaacguccgggcagcaaguucagugcacguuugucugcgugugugugugugugugugugugcaauuacggauacuguugguguuuuggauuaaccccaaauuugccauucagaaaauauguaaugcuaauauaaagaucggcuggugacauugagcucugagauaagccguaguguacuuuaguaaagaugcuuaguuuuauggaaacauaaccaguccuugaaccguauuguuucccucugggagaaggaaaaagcaccaaaaagagguacaaauauuaucuauaccuccaacuuucacccaccacuuuuugagugaugaaagacuuuucauguuaacaacuacaaauggcaaaucgaugauuguagaaagaaauaguugagcuuuuuuuuuuuugaaacaggaugaucaguuuuguuuaaucuagcagaccuagccgacuuugguugggucagauaagugcuccgaaagacaaaucgcauucuugcuagguuuuaugggauaacagccuaggaaaaaguauuaacuuuuuguuuuuguaucagacagaaaguguuauaaaaacaaacuuauaaaaaagauaaaaauugaccaguauuagauucauacuucugcaguuaaggucuaucuugaagaaaauuguuguuugguaaucccaagaauagugagauacuguuuuuuuguaaugaaaaacauaacuagaguugagugaucauuaucagugagaccagaaugugaggguuuuuaaaggucugaucucuggcauugaaaggugugagaaaauagcacuccuaguugaaggagauuaaaaauuaauuguaaaguauggcauacgaaacagugacuaaauuauguugcucuuuguugguaaugcuauguaguagaacuaacuuucuacauuguuaccaugguaugaaauuuuaauauguuaauuuuuccucuaaugucauucuauaguuaauacuguauuggggcuauuuaauuuggaaauagggcagaggucacaggagaugggacauggaugauugaaagcauugacacugaagacagacuaaaguucuuuaggguuuugaugugaaaguuucuccaaaguucagcuccaaaaaaugaauugucuuagcuccuugguaggccuuuggcaaacaagucauuaggccacuaacaauugccaacuauuacuguguaaagacugucaggcgaguucuuuguuaacaaguccacuagaaaaacucguguguaaaugacaucauagcccggcagaggcggaguaguuaagcccaguaauccuuuuccuuugggaugguauauuuuacauauagucaggaggcuugcaaggccuggauuaguugucaaacuugaggcuauuaguuucuuaagaguuuuugugguuuacaguacucagcuucugcagugguuggcacaucaaaccuauuuuuccguuuacacuuguuuuaagaaugucuuauuucuucagauuuuguguuuacacagaucuguaguuaucacuaugauucuuuuuguuggaaugcuaaaauuuaggauucauaaaauguacuaagauuagaagguaaacuuugaugaggcacaaauacgacaugaacuaugaagaaagaacuaaaggaaaaugaacaaaggaaacauacauuuauucuagguuuccauugggaaaaaguugcuuauaaguuccguuucaaaauuucaguacucuauauaaaugguaauauuaggaauaauggauacauuguugguuugugaauccguaaugaacaguuaaccuuuagguaagcugauaagcauuuuaguuguuuuuugguugguugguuguuuuuuugagauuuuuuuuuuuuuuugagauauuuuugaguuuugcucuuguugcccaggcuggagugcaguggggugaucuuggcacacugcaaccuccgccucccggguucaaacgauucuccugccucagccgccccaguagcugggauuacaggcacgcgcuaccacgcccagcuaauuuuuguauuuuuaguagagauggguuucaccauguuggcuagggcggucucgaacuccugaccuaaggugauccaccugucuuggccucccaaagugcugggaucacaggcaugagccaccacgccuggccugguuuuuuuuuuuuuuuuuuaacguguaaccaaaaauacauuacaacugaauaacauagccuuaaaaaaugaaaggcaacauguuuugguucauuguuuucagaaacuaguuucuugcauauaguaacgacauuaauuauugaggucucauauuuuuguucaguuuuuuaaaugaauuauuucauuuuguaaaagguuauaagagcagccaggaggagcggaauuggaaaaucuguggguaaaaucuucucgguuugguuuuuucauuuuacugguuccuaauccugauucauaaugaacaguuuaggagagaauugcugcaaugcagcauuuaaaacuaaauuuuuaaaaacaugauuuaagaacauuuuguauacaaucuucuauuuagaucaaaauugaaagaauauuguaguuuaugauguuagaagcauaaucagugcucauggagaaaguaauuuuuaaggauucugauuuucuuauaacuugaguuuuuaauacuuugucuaaacuuuuuuccugcuacucauguaaucagugauuuuaauaugacaccauggcaggcaaaucuuucauaguguuucuguguaugcuguacagccuuuaauacagaauuuauuuuuaauuaagugcuuggugaagugcuauaaauguaacaucgaaugaaaugaauuauuuuaugaaagucuuuaagcgauauacauauaaacuauuugcuuuaaauuagagaacuuguuaccgcaaagcaaggaggacagggaaacaguuuaugucuuugaaaugagcuugcuggaaacaccagaaaaaaaucaguagaaaaaauuaggagcuugcuaaaaacaccaggaagaaaaaucaauaaaaaaauuacaucuaucuauuuaugaaucaugaaaguagaauaugguuauuugcaucauuaaguaucuuuacaaaucauuauuccuuauaugguacaccguaaaggcugccaaaaacaagcugugguaguuccgagaaauuagaagagaauaaaacuaauuagauaaucuugcccaguuccuugccuaagcaaaacaacauucucgcuuuucaagugaaugauuugguguuugaaccuucuugauuaccuuaagagggaaaaaugaaggagaggagggaaccaucaucacauaccuuuacaguuguggaauguuagcccacuauaguguuuaacuaaggaaaaucuaauauaauacacucccaagugaucugaaaugauccgcuauucagaauuccagagaaagacauaucccugccagaaggguguccuucauaaccaaauuuggucuucagucuggucggugcauacucaaacaggaaucacuucccuuaaggaaccuaagguaugcaguugagaucaacuuauuccuuuuugauuuguccccuuaaagcaucaaucagacgugaaugcaucuugugacuuggaguuacuaguaauauugaaaucugaaacuugggggaucuuugaagacacaugggauuaaaagcugcauaauguacauuucgaggcuaaaaaccagguuugaaaaauacagauguccagaugaguuuuucuuuaauuuauuugaaaaauagagauaugccuuaauuauagaccauuagaaauaauuuuuguguuucacagagucuugauuuucauuccaggaagccagagucaguaauuuauggcuagaucuuuaauuaaaacauuugccuuacuuaguauuacaaaaucaucauuugguuuugcaaucaagauaagacuguuuugucaacuuaaugcuaagcacuuaauuuuuauuuaacaauaacuucuagaaagauaaucacuccagucucaauuauuuuuauguuuguguguuaccuuuuaauaguugccauuuauauuauuuuaguaagguuguagugguaguuuauauauuugcuuggaguugauaacuagaguaagcagcuucauaaaguacuucugaaggcaggcuuuacuauuaaaacuguuuacuauuaugaagcuguuuacauuauuucuggcauaucucuugguaaaugguuuaggggcacuauuuucuauugauguaaaaauugaggccaggcaugguggaucacgccuguaaucccagcacuuugggaggcugaggcagguggaucacuggaggucaggaguuugagaccagccuggccaacauggcaaaaccucaucucuacuaaaaauacaaaaauuagccaggcgugguggcacaugccuguggucccagcuacucaggaguauauuuguagauacauauaaaauucucuugacauuacuugaucacuuauauuagauccaaguguauaacuuaacuuaguauucagguuuuuaucuggccuuauccucuauuacucuuugaacccuacagucuguacuaauuauuucuaaaauuguguuacucaucuacaauaucucauaucuuuauagucacuaaaugaaugucugcuggauaaaugagggaaaauuacuuucuuuuugcauagaaaaaacuauuaguaugguuuguuuuuggguggcgauuguuauuuugauuguacuuaacguuuguuuucagaauuguucaccaugaauauaucuugugucagcaguaaaauaauagauuucuuuuagucacaccuguagaauugaauguuaauuguuucaguagcaucugagaaaaggauacguucacauaugucacaacuaaagaauaaucagacaucgaugccuauuuuaaauugaugccaaagugagaucagcuucuuguaucugucaguaaugcuuucagcuuuagaggaaaaaccaacagcuaauaguggcuuaaauaaauaagaggauguuuuucucacauaacaaaaagccuggauauaggcccuucacgguuccucacucuguuauacuuugucguccuuagcuguugcuuuucaucauccuguuugucguauuugcaagauggaugcuacagcuccaggcauucauuccaggaaggagaaagggcaguuuuagcugagaugguccuuuuuaucaggauaacaacacccuucucagagaccucgaacagaccgccacuucauauuauucagagcuuggucaugugacuacuaguugcagggagacuaggcuaacagguauuuggcuuuccggccuauuuauugggagguagcaagggaaaggggaauugggaauggcuuuaggagugucugguucauuguuacuuuuauuucagacuuugaaguggggauguggaggguaguaggucuuuuucagcuaagacuuaggaaguguuuucuaauguuaagggcuuuuucuggggucaugauuguuuuguguuuuagggcccaacuuccuuccuuuccuuuaggagaaacuagagagcaggcagauacuugcaaauaccuagaaccccuugccucuuauuuuuggauaccuacucuuucuccuagauuauuaaaauuguuccugcaagcauuuaaacuaccucaggucuuacaagucuuaaaaaaaaaauaacuuucuuagacauacagcagauuuucugcaccacuugguuaccucccauucuuuuucaauccauuccaaucugaccuuugucauugaguacuuuuuaguuuugucuuggccucacaacuguauuugacauaaucacucccuccuugaaaauuauuauuuuuugacuugcauggacaccacugauuuuuuuuuuuuguucaauaccccuggcuccuucucagacuauauuagugguucucugagagugguccauggaguccccaguaucauuucugggguccagaagaucaaagcuguuuucagaauaagaugaugucuuuuuaaccguuuugauauuugcauuugauccuugcuccuuguacuucaacuuaacaacuuccauugguuucuugaaugcuacacuguucuuucugccuuaggaucuuuaaguauccucccagugccuagacuacuuuccuacacgaaaccuuuuucacccuucaugacuaauacuggggagagugaugaugaguuaguugcugcguauuuuucaguucuuaaauauucuuucuccaaggguguuuccgugauauucugcuuucccguagacuuagguucuccuccuauauucucucauugcacuuucauagcacucaauugcaugagucagaauucuggucacuuaauuuuuuaaugucugccccacuauuauuuaugcuccacuaaagcagagagggaaucucuugguuaucauucuagcaugucaucucacauuccauaaguauuuguuaaaugaaagaaugguugaaaagcuguugcaggacaggcauggugguucacaccuguaauccgagcacuuggggaggcugaggcaggaggaucucuugagcccagaaguucaagacaagccugggcaacauagcaugguggcacaugccucuagucccagcugcucaggaggcuaaggugggaggauuucuugagcccaggagguugaggcugcaguaagcagugauugugccacugcacuccagccugggugacagaaccgagacccugucucaaaaauaaauaaauagguauuuaaaaaaauaaaaaucacucagcaauauuuggcugccauaguagugcuaauuauaauuacugggaauuauaauuguaauuacugggcccugggaaugcagcaaagacuaaagaccauucuuguuuuccuggaguuuauucuaauggauuugugcauggugaucccuucuacuucaaagauucaaugauaccaaauuaugcauacuagguauacuauuuugaggauuaaauauauuauaugauggcaucuguaaagguuagaaauguucauuuaccuuuaauuuguauaguugaaacacuuuuuuguuuuucaguccaagccuuaugcauuugaucggguguuccagucaagcacaucucaagagcaaguguauaaugacugugcaaagaagauuguuaaagguaaauauauucaaccugcugaguugucucagcaauaaguaaauaaguuugugaucuuuucuacuuacucagcuuccuuuuuucauuuuaaugccccuuucuucuaaguuaauugcagaagaaaguuguuuaaauaauaaaaaggucaaacacaauuaguaaauauucuauugcucaaauuccaugaucuaauuauauacaguaccuaauuaagguuauuaugagaacuauguuacacacuuauucuuaagagaugcauuucuguuagauauucccaggagaguuuccaagguggcaguucuagaaagagaacaguaugagaaugaaaacaaaagggcuagacacauuucuaaaaaguaguggaaaauggcagucuaucauucuuccauuccauuguuauuccuuccccaaagacuuaccuaucccuugaggaauuuaacaaggguugccaagggugagaaaaguauguacauuccaguuaauacuauaacuuauacaagaauauuuauaacuuuauauauucuaaaaccauugaauuuuaaagcugagagagugcucauuguuuaucuggaguuacuuccaguuacuguagaaaucuguuuaaucaaaggaauggcuguuacuuugugauaugauuuauuucauuuuuugacagcuguaguuguuacaaagugcuucuuagauugaggcaaaaucuguguuguggcauucaccacauuaaaagaauugggauucaguauaaaaauagguggauuaggauagcauaggagcacagaugcucauccuaguaacaggagauaaaguggaguuauagaagguuuauagaugaggugagggagggaaaauguguauguacucauuauaucaauuucauauugucuaauacagggagcaaagucaucauggagaugaggaagggggaagagguucuaggaaaaggcaugaaauggauggauucaggcagugugagaguauugccaggcaguauuaagggcccacucaagguuagcugcugaaagaguugaauuuuugcccauuuggaguuuugcuaggugaguacaaaagagggaagugggggacaagagaauugaggauauagucaaaggagugauuauaaugguggaccaugggaucuaaggugguuaaguuacaggaagaaggauaugagggaggcugaagggcagugaaaaaaggugguaacauuaguggguuguagaucucaguggggucaaagauuuguuggaaucaggguacuggacggaguaauagaaggugaauacagacagucccugacuuagaacaacuuaaaauuguucgacuuuacgauggugcaaaagcaauacacauucaauagaaauauucaauagaaauauuucuaguaccuguacaaccauucuguuuuucacuuucaguauaguauucaauaaaucauaugaaauauuuaacacuuuauuauaaaauaggcuuuguguuagaugguuuugcugaacuguagaucaguguacguguucugagcacauuuaaaguaggcuaggcuaagccaugguguuugguagguuagauguguuugaugcauuuucagcuuaggguauuuucaacuuacagaacauuuaucaggaaguaaccccaucguaaguugauuaguaucucuacuugaaauugagauuauggaagcaaugcaguuaguaaugaaaagguaaagguguugucauggaguugacuuccgagguaguaaagaaaggauaaggccagacauggugggucacaccuguaauuccagcacuuugggaggcugaggugggaggauugcuugaggccaggaguuugagaccagccugggcaacagcgagaccccaucucuguuuuuaaaauaaaaaugaagaaagaauaagaucgcagaaaauuuggucaaggagcugagaggccagguuauuuuagugggauuaucugcuacagacuuugaaaccaccaguacuguuuuauuacaacaguaaugguauuggugagagagagugaacuggguacugacaucuucauaaaaugaaggggaauuaacacuuguaauuguguaaaugacugcaacaaagaggaacagggucaucauguuguaagcaucaugugguuuuccagagggaucgaucauagaacacaauuuuacuacauucuuugauugagacauacuucugucucaucaguacaguuuaagauuacauuagcuuucuaaccaauagaaaguuaccgauucaugaauucaugggcaauuugaauauacaggucuuuuuuguaucucuugccgccagcuuuaagccccauuccauacuugcacuuuggagagcaaaccuuuaaagugcagauuccauuuuguucauuuuagcucuuaaucauauuuugaguuuuauacuggggaucuaguaaguuggcugucagcacauuugauaagucuauuaaagugucaaagguuuugaaguuugaaaaauaugauucuaaaccauuuauaaagugcuuaaugggucauggucccuagguuaaucuucuaaaaugaauaagauuguuggcaguuauuucaaucacacuguuuggguauucagccaacuucagagccucuuaccuauacgauuggcuaguccuuaguuugucaacauacucacaagaaaaugaugaaaaacuugaauccuuuuaucaagugauggugcaugacucuaguauuugcccaaaguaccaguugaauaaccauauccaaacaggaaaugagguuaguucaaccauagucuuuacuuaauaaaauuuugguauacuuauuuccauaaucuaucccuuuucccauuuugaaaauguaaauaacauuagugucuucuauuaccuuuguucucuuuggcuuuuaaaaguaaccuacaguagcugugagauuuuuaucccuggaacguaauccuccuuaguaacuagaaacuugggcucauuugaagccauucuuuugcuaucguacuauccacauaaaccuuaaagucccuuucaacaauguuuauucuguuguucuguuuugaggaucauauuuguggaagaugguaguaaauagaaguaccucuguuuuaauaucaucaguuaauauuuucuggucuuuccuaagcaaugcagguucauucauucauuauuuuuuuucugaauaugacuuuaaaaguucuuuuuagggccuuaguuuuuauuuuguuuuggucuuaaaguuacuuauccuggacuuuuaucuuucucaugcuguucucgugaguucugucucuucucuuguauauccuuaguuacacagucucuuaauaauaggcugauacucagaguuuuucaaaaucuauuguuuuuuaagugguaccuaaccuuaaggaaaagaaaaagaugaagucuguuuuccugacguuuaggauacaugcaucuauuacuuuuguucuguuuuauuacuauuugcaguucuaagaugaaaucguuugcuuccugaaauuucucuucuuuucucaaaauuucagucccuucuucauccugcuuuacuguuuggaacugcguucaggauaauaguucccuucucuguaauaugguaagaguauaaucuuuagaaucagacaguccuagauugaauucuaggcucugccacuuucuugcugugugacuuuuggcaaguuaccuaaccuuuccaagccuccauuucuucuugugcaaaauagguacuaggaguuguuaagcacaauacagguaucagcugcuaauuguguccucugucguugucuucuuuuuuuuuuuuuaaauugagacggaguuucgcucuuguuguccaggcuggacugcaguggcgccaucuuggcucacuguaaccuaccuccgccucccggguucaagcaauucuccugccucagccuccugaguagcugggauuacgggcaugcgccaccacacccugcuaauuuuuguguuacuaguagagacaggguuccuccauguuggucaggcuggucuugaacugccaaccucaggugauccgcccaccuuggccucccaaagugcugggaucacaggcgugagccaccacgcccggcauguguccucugucuucuuagaggacauuauuaauucaaucagucguguuuguauuugggauaaacucauagucucagcuauuucuacuguacaaaauuagacuuccagcaaguguuagaauacaagguuucuaucauaaucucuuucuucuucuaugcaaccuuuguaauuuaugucaguaucaccuggcgaugauuuccuuuuaucuuuacccaagugcucuguaccauuuuggaggagacugcauguaguagcuggugggacuuguccuggacaaggauaugaauguggcagaguuaccaauaaauacacauauuuaaggagaaagauggcguagggguaggucguggguaccuagggaggugugaggacaggaaagcaauuaaauacaugguagguuguacuugggacaaucauuguuaaacagauuggaugagaagccaugguuagaaauuguugguaggcaaagaucagcagaaugaugggccagcugggauuucuuuugagauagggauuugaugagcaaguugccaguaaugaccugaaagcagauaguacucucuggguccccgacaaguucacugagaaugcacuggcucauaauuaucuggacaaguuuauaacuugauuuuauguagggcuauuaacauucccuaucuguagauuuguuagauacaauuguuacuuuugaauaagguuuauccacuuguauucucuugaauucugaaucugagugauuuguuucccuuguguuaaguagcuauuuauucauugcccacuauaugauaagcaucucaucaggucuuuguagauuuccuguuuuuuccaccauggcuuccugaccugaacucucugccgcuguauucaccuuugguuuuuccagauguagccuaccuuguauuuauuuugguuccucugcuccuugaguauauaguacagugguuaagagcaggucucuggaaccaagucuauuugcauuugcgucucagcuucaucuuacuagcuguggaguuacaggcaaguuauuuaaccucucugugucucaguuuucucaucuauaaaaugggacuaauaauaguacagugcgggcugggcgcaguggcucacgccuguaauccuagcauuuugggaggccgaagugggcgaaucuccugaggucaggaguugaagaccagccuggccaacauggugaaacccugucucuacuaaaaauaaaaaauuagccgggcaugguagcacaugccuguaaucccagcuacuugggaggcugaggcacgagaauugcuugaaccugggaggcggagguugcagugagccgagguugcagugagccgagguugcgccacugcacuccagccugggugacagagcaagacucugucucaaaaacaaaaaacuaauaguaccgugcacgggguuuugugaugauuaaauacaauaauauauaaaaaaugguuagaaccugacucauuguaagcucucagauguuaauaguaacuuuauaugaugacuucuaauucucagagcuuuugccuaaguagucauuuugcuggggaggcugaaguucagggagauacaaagugacuuucuacaacgugaugugcuguuaucucacuaccuaaauauguuuuuucuguugauacaguaugaaagaaguaauacuuguucagaguuguccaccucuguuucucauaggaauggcaaaaguauauuuaaaagggugagggaggcuuuagaaagaugcuguacauugaugaugguaauaaauauucagcaagcauuugaguuccucuggagugccaggcacuguguuaggaguuaaacacgguccugacuuugaguugacaggcuagugaguaaagcagacagguaaauugaucgaauacucauugguaaguguuaugauuaaaugcagauacuguaagaacacauaggaugagacuuuuacccagauauuuugggggugcguuguggaauuggguuagaggaagagguaaaugugauacaugaaauaauuuugcuuuccuucucaaaaauaaaaagauuuugaaggaaaguuucaaauguuuggagucucuuaaaaucuucccagggaaguuaguaaugaugucuuuuuuucucauuaauaaauguuucuguaggaaaucuguuauccacuuaguugugcccauguugggguuuuuuuuucuuuuuaaaauaaugaauaaaaacaaggauuggcuugcuuauuaguuuacuuuucacuguuauaugcuguuuccaacagaggcuucucuuuuuguuuuggcuuccucuagaauagaauguaauuucauaguaccuuucuugucaccaaaaacaaacaacaaacaaaauccucgaaagccagaaaucaaaggauugccuuuuuccccccuuugaccuaauaaaagaauauauuuaaauguuaaugucagaggcuagaaaaaaauuucauaggagggucaggugcaggggcuuacuuaggccuguaaucccagcacuuugugaggcuugaggcaggaggguuguuugagcccaggaguuugagaucagccugggcaacauagcaagacccugucucuacaaaauuuuuuuuagaauuagccaggccugguggcaugugccucuaguccuggcuacuugaagcugaagcaggcagcuuacuacacccaagagguugaggcugcagugaccagugagcuaugauugugccauugcacucugaacagaggggagacccugucucauaacauuuuuuuucauaggaacuucuugguaauugauuuugagguaggagugaguguuacacuuuguggguaggauaaagaggaaggucgggguuugugaggauuagcuacuaauuaaccaucaauuagucuuguuucuaaaaucucaucuguauguaaauuggcagaggauuuuuuuucuuuuuggucacauaaagcuuuggaguguagauguaaugacauuugagauguacacugauacaagagauucuuuauuauaagcaguggaauuuaaaauuuguuucuuaauuaaccacagaaagcagucuggguccagagaaaauugcuuagaugggucaucacuaagaaaauuacuguuguuauauauuuccuuuaaugucuuuauaaauccuuuauguacuaaacuuugauggagucuuucauauuagcauaaagaaaaucugaaucuuucuugccacucuuuccacaaauaauuuugguuuuuuuuuuuuuuuuuugagacagagucucacugugucacccaggcuggagugcaguggcucgaucucagcucacugcaaccuccuucuccugggcucaggcgauuuuugugccuuagucuuucgaguagcugaaauuacaggccacguacagcuaauuuuuuuuuuuuuuuuuugagauggugucuuacucugucacccagacuggagugcaguggcgcgaucucggcucacugcaaccuccaccugcccgguucaggcaauucuccugccucagccuccugaguagcugggacuacaggcacgcgccaccaagcccagcuaauuuuuuguauuuuuaguagagacaggguuucaccaugcugaccaggcuugaacuccugaccuugugauccgccugccuuggccucccaaagugcugugauuacaggagugagcuaccgcacccagccacucccacaauauuuuauuauacagaauuuaguaugcaaggguuaggaagaggguguguguguguguguguguguguguguguguuuuaggguguuuuauaccucacuaggaauaaacaucugauauuuuccuguaacauuaaguaauuuuuuuuuuaaccuuuucucuacccugucauccuguaguuuaaguaauuucuuaggaaucuugcuuaaggaaaaaauccccugaacuauaaaaucuuuucucauagauguacuugaaggauauaauggaacaauauuugcauauggacaaacauccucugggaagacacacacaauggagguaacguuuuauaaucuguacuuagaugugguuugcaauacauacagcauucauuauuugugauauuauuucaccaugcauaaacauuuuaauuuacucuuuauugccuuuucucauacaaauaauauacauguaacaucauuguuggaaucuaaucaguuccugaguuuaaauaguaagggauaccuguauuugagauuauauuugagauuguuuuaucaguuagcauaaccauaaaauaaauaacauuuuagacaagaauuuuuugucacccuguuauaugggaaauuuugaaugcuuauguguuguugauuuuauguaguauaaauaacuuuuuccuguucuccuuggcuccuccuuccucaaaauaacugucacucuucucugauaagaauguugccauaauuaucagugcugcuguuaauaauagauguggacccacuauagcuuugcuucuagaaaacagccugugauuuucugccacugcuaaagagcaucuguuuuuaucauuuauuugaguguacuauauuaaguaaaugacugcuucuuuuagugugauucauauuacugauuuucauaaagucauagagaacaaggacauccuaguauuugcaugaauuugccucgaaguagaaggaacaauguagaauuauauggaaagaaacuaaaaccuuuuuaauuauguucauuuuacaaugaacauuuuacaagcauggauaaucuaaaucuagugauuaaaugaaggguuaagaucuguugguaacccaugugguugauguacaguacuguguauguguaauaguugaauuggauuuuuuagguauuuacagagccguuuccacaaaaauauaguuccuguccuuucuugacuauaaguuguagauugaaacucuuuguuuuuacuucauauuuuauaauuuauuuaagaagucuaguuuuguuuuuuguuuaggguaaacuucaugauccagaaggcaugggaauuauuccaagaauagugcaagauauuuuuaauuauauuuacuccauggaugaaaauuuggaauuucauauuaagguaaauuccuugaggaaagauuauauuuuauuuuacagcaagaauaauguucuaaaaaaauaguaaaugcugguuucuuuaauuuuaaaaauuguuuuucuggaaagguacaguugaaagaucauucagguuaguaaacuuggauuuuuguucaucugccauuagaugaacaggaauguuaacuaacguaaaugauuaagucuuuagccuccuucaaaaaauaaaggagguugcuuuacugcagaacuugaagguuucuacuacauaaaacuauucuaauucauuuuagaugaagauaauguaauuuauguccaaugggaagacugcuuaaauaacuaagcuaauuuggcuaauuuaugucuucccauuagaaugugagcuauggcugguauguugauaacugucucucuagucuaaacaaugccuagcacucagaccucaauaugcgaauaaguuauauaacuuuaguugaucgguguuuuuuuaaauuugcccuuuagguuucauauuuugaaauauauuuggauaagauaagggaccuguuagaugguaaguuaaauucuugcuaaucaguuuuaaauaacaucuguuaauuccuuuuuaauaauagaugugagacuauuucuuuguaaccuauaugaaauugucuuaaguuauuggaaauagacaaaauuuuuuuucuucuaaaguuuuaguugaauaccuuuaaauagaauaacuaguuuaaagcgauguuuauggguacuucuuaguaguaauuagagcauuggacugggaguuacauaaucugagcccugaguucuagucuucugucaacugucaauuagauacauuguccuuaggcaaaucauugaaccauucaggguuaauguucuuguuuauaaaaugugggugguagguuggagugguccuaaaauucuauauuguugcauugguuucuauuuacaucuccugcugugucuguaaggucugcuuuagagcaauguuuuaauauguuuuuagaguucaacuauugcuguuaggcugcucaggaaagccuaucaguuauuucauauccaguguuaagaguuuuaggagaauguugcuaacauuuguuuuucuuucucaguuucaaagaccaaccuuucaguucaugaagacaaaaaccgaguucccuauguaaagguauuuauaguacaguugucuagaaaacccuguaauacuuuuuuuuuuuuuuuaagacagagucucacucugucgcccaggcuggagugcaguggugcaaucucggcucacugcaaccucugccuccaggguucaagcaguucuccugccucagccucuugaguagcugggauuacaggcaugcgccaccacgcccagcuaauuuuuguauuuuuaguagagacgaaguuucaccauguuggccaggcuggucuugaacuccugaccucgugauccgcccgccucugccucccaaagugcugggauuacaggcgugagccaauucauuuaauauauggaggcucgcucuguugcucaggcuggagugcauggcauggucucggcucacugcaaccuuugccucccaggcucaagcgauucuccugccucagccucccaaguagcuaggauuacaggcacccgccaccgcgcccggcuaauuuuuguguuuuuauuagagaaaggguuucaucauguuggccagacauuaacauauuuuuaaaaauuauuucacaggggugcacagagcguuuuguauguaguccagaugaaguuauggauaccauagaugaaggaaaauccaacagacauguagcaguuacaaguaaguagaaaauaacacugguuaggauuuaaaaccagcuuaaaauauccuuauccaggugauuaauuauaagauugcuucagggaaauuguuaaggggaaaucauguuuguuuauauuuguuuguguaauuuccuugcagauaugaaugaacauagcucuaggagucacaguauauuucuuauuaaugucaaacaagagaacacacaaacggaacaaaagcugaguggaaaacuuuaucugguugauuuagcugguagugaaaagguaaagucuucauguauuuugacaaauauuuaagcaucuuuguaaacuuuaguuugaguugggaguuacgcaggguucauuguugcaucuuacuuaccaaacuggauuugguaaccugagauuuguaaccgcugaugccagugccuuaugaugauaucagcugaauaaucaguuccaaguuacuguuguuugaccauacucuaguucaacccauaagugguuucuaugacuuaagauauguucauagugagaacugguucagcauauguuguuauaaacuuuauuagauaucccuuuucuaauuuuugauacguauuuuauccauauuggcaguggggucccuauuaaaacugguaacucucgauuagucuuuucugguuugguuggacuuauuucuuuccuuuggauuauuguuucauuauuacaauucuauacagucugauucuagucuauaucaaauuaaguuugaauguuauaauagggaccucugaccauuuuugcuguugugcuaauuuuguuucuucugcuuagaaugauauaucuauuccguucuacucugaagucuuacacacaucuuucaaagauuaucuaaucugagaaaucuccuaagcuauuucuucagccaacauugcuaauuuauuguucugaccuaucuuuaacauagauacuagcugggcaugguggcacaugcccguaauaccagcuacuggggaggcugaggcaggagaauugguugaacccgggaagcggagguugcagugagcugggaucaagccacugcacuccagccugggugacagagugagacucagucuccaaaaaaaaaacaccacaacauagauauuuagauauuuuauauauuuuuaaaagaagcagauuugcuuauauaauguguuuaaaacucagucucuguuuucuaacaguuacaacaucaacauuaugcauuagccaauuuuagaagguuccuguuuucuaauguagcaaaggggacuaacagauuaaugaacuacaaauuuacauuuaaauugguuauuuucaagaguaccuacaaacuacagauaaaauuugaugucucucuaaucaaacucuuaagaguaguacucaagaaauggugguaugcuuggcaaauaagaucaugaagcuuuucauguucuuuuuucuuuuuuacugguuauugaugacauaugaacauuuuagaaaauguaaagaaaauuauaaacuuguaauuuuguuucauucuuuugaaaucuuauguauagguuaguaaaacuggagcugaaggugcugugcuggaugaagcuaaaaacaucaacaagucacuuucugcucuuggaaauguuauuucugcuuuggcugaggguagugugaguauacaugucuucuaucucccuguuaccuuauggggcauuauuuaaauauagguguauaugugugccuggguguguaugagagagagagagagaaagagagauugagauucaauguguuugaaucaguauguguaaguuaguugucuuuugggaguuuauuuuauaauaacauuuuauuauacuggucuuguuuucuuucuuuguuuuuguaugcagacauauguuccauaucgagauaguaaaaugacaagaauccuucaagauucauuagguggcaacuguagaaccacuauuguaauuugcugcucuccaucaucauacaaugagucugaaacaaaaucuacacucuuauuuggccaaagguuuguuguuaagaaaguacaaaaccuaaauuuagauagaccuuuuguuuauaaaauguaggaaaaugugagcuguuauuccaaccuguacauacuguuuugugcuagacacacucaguuugaauugaugacagauaauacaaggugggucugauuuuuagacugcuugguuuaaguuuuaguacacauuaaagucagauguaauuuuagucaaauuugugugacaagcuguaauuugguauuaaagaaaauaagcauuugaaucaaauaaugaggucaaagccuggcaaacauaauccucuguuaagccuguagacaugcaugacagguuaauauaaucuguaugagaugauuaggaaaaucaguaaugaugauuccgucuuugacuuucaacaguaauuucuuaauucagccuugcaaacaaauuggaaaaauauaggccuuugucuuuuauuuuuagugguuuguugauuuuuuuuuuuuuaaagcuauucacagauuuuggagcagacucaaauuuaguugaguuguaaauaacgucauauguugcggcuuuuaguauuuagucuaagagauuacuggacaagcauaaguuucuuagccauauauacauauauuccauauagauaaaauuaaaaauaauuucagucucauccuuuuuuuccuccaauuacaucucuuagggccaaaacaauuaagaacacaguuugugucaauguggaguuaacugcagaacaguggaaaaagaaguaugaaaaagaaaaagaaaaaaauaagauccugcggaacacuauucaguggcuugaaaaugagcucaacagauggcguaaugguaauaacuuaagaauuugucaucuucaguuuguuaaauacagauuuagagcauagaaacguagaaauaguucagcaaaaucaguaagugacuagaucaagaaauuuaauagacaucgaaauaauuuuuaaaaaaauuaauagaaauccuggagcugaaaaauaaaaugagcaaaaugcaagagaccaucaguaguagaauuaauuaagcagaagaaucugaacuugaagacagauuauuugaaaauaacacagagaagaaaaaguuugaaagaacgaggcugggugcacuggcucaugccuguaauccuagcacuuugggaggccaaggugggcagaucacuugaggucaggaguuagagaccagccuggccaacauguugaaaccccaucucuacugaaaacaccaaaauuagccuggcauggugcugagcgccuguaaucccagcuaaucaggagucuugaggcaguagaauugcuugaacccuggaggcagagguugcagugagccuagauugcaccacugcacuccagccagggugacagauugagacucugucucaaaaaaaaaaaaaaaaauuuuuaaaggaaugaaauugaaauuagcuuuagacgucguuuuuuuauuaaccacuuuauuuucuuauuuuaggggagacggugccuauugaugaacaguuugacaaagagaaagccaacuuggaagcuuucacaguggauaaagauauuacucuuaccaaugauaaaccagcaaccgcaauuggaguuauaggaaauuuuacugaugcugaaagaagaaagugugaagaagaaauugcuaaauuauacaaacagcuugaugacaagguagguauugcuugauuuaggucugcuuuauauuaggauacuauugacauggguguuuuuauuuucuaacuuuucucauuucagugcugugggcacuuaggaucuuuaugcaucuuccuugauuucuguuaaucuuguaaaaauuauuguauuaacaaaauaaaaagucauaauuucaauuucuguguggaaacuguaugagcauguaucuuuucuucccccucuuuuuaagcuaaaagaacuuuauaaggcagcaguccccaaccuuuuuggcaccagggacugguuucagggaagacaguuuuuccguggaucaggucggggagaugguuuugggaugaaacuuccaccuuggauuaucaggcauuagauucucauaaggauccucuaaccuagaucucuugcaugcacagcugauaauagaguucgcgcucuuaaugauauucuaaugcugcugaucuggcagaaggcggagcucaagugguaaugcuugcugcucaccuccugcugugcuucuugguuccuaacaggcuuccaguacugcuuuguggccugggggcuuggggaccccuguucuaaugaaaauuuggcauugggucauugggagccucaaugauaccaauuguuagaaucagggcucugaagacuccaauaaaagaugaugugagagauuaagggaaacacaauagaguggaaauaauaucuuccugcuuugcauauagaaguaaugucaauaguaugaauaauagcaaacuaagaacguaauagaauggaaggcaagaacaagaguaguaaagagauuagaagaaaauauuuucuuaaguugauauuuuuaauauauuuuaagcagagauggcagguucgaaguacaugaccauuauaaguauugauaauugaaagaaauuccuuuuguuuugccauuuucuuaaaagagauuaaaauaagcaauguugaauuuagagaaaugguuuugaaauauuucuggggaguaguaaucuuauaaccuguauugggaaacaacuagaaccagguuguuagcuacugguuaaccggauacuucacaauucuaggaugaagaaauuaaccagcaaagucaacugguagagaaacugaagacgcaaauguuggaucaggaggaggugaguugaauaccuuuuacauugcuuccagaaaagcuuuauaguuuuguuuucugaaucccauugacuuugucuuuaauaguuguauaauuuuggguaugacugucuuugugggaauaagaaugucacauggauaaagugaauuuuuacuuauucaucguaucuacccagauacaaucuguuguucauuuccgccaucuuuuuuuucacccugguucuugacauuucucuucuugucacuuacuuuggauccucauuuuaucuucucacccagcagagcagggggauaauugaaaagcaguccuuuaaauuuuuuuguggggguggugggcagggugaagacaaagacugcuucgguaagaaagagauacucuccaucagugaacuuaauccuggucagaucaucuuucaacuauagcauuucauauuucaacuauagcauuauuccucaaaggggcacuauugauauuuugcauuggauaauuuauguuauucuguccuuuguauuauaggacauuaaacauuccuggucccuacuccuaaaugccauuagcauucuacccuauuauuaacacucccacagauuuccggauaucccuacaggagagccacuaauguggaugauugugguuuucuccuaacuagucucuuggcaucccugcaguucagauuuuaugugcugauaccagguuuuguuuuuguuuuugaggcgaagucuugcucuuguuccccaggcuggagugcagcggcgugaucuuggcucacugcaaccuccaccucccagguucaagcgacucuucugccucagccucccgaguagcugggauuacaggcgcccgccaccacgccuggcuaauuuuuugguauuuuuaguagagacgggauuucaccauguuggucaggcuggucucaaacuccugaccuugugauccgcccgccucggccucccaaaaugcugggauuacaggcgugagccaccccgccuggcccaaaucuaaauuuuuaagcaacucuuguagaaugccauuuuccuuuauuacauuaauuugcaugugacugcagucgaucucuccuagccaacuucuccaugaaugaauacucuuuccuguauuacuaagcacuuuaucuguccugucccucucuuaugguucugaccuucuaucuuguacugcacuuauucaugugccuaucuucucuucuacuguguuccuuaaacacagucuuugauuuucuuucugccuugcagcauccagcacagugccugcacauaguugacauuuaguaaaucuguuuaaugaauaaauguugccacacugaauaccauccauauuucacuccauuuguucuugacaaauggugaagcuucauggguguuuuuuaaaaccuguauacuuuuggggaaaauaaauuauuuucuguccuauagcuuuuggcaucuaccagaagggaucaagacaauaugcaagcugagcugaaucgccuucaagcagaaaaugaugccucuaaagaagaagugaaagaaguuuuacaggcccuagaagaacuugcugucaauuaugaucagaagucucaggaaguugaagacaaaacuaaggaauaugaauugcuuagugaugaauugaaucagaaaucgguaggauauaguuuuauuuucuuuuuuaaugcuuuaguacaaguauucuuaaccuaaaaacuacuuaaauaacuuacuuuucuauguaagucaaauaucgauaacaucaauuuucaaggacucggguuucaacuucauuucuuucuguauaugaagccuuagagguggaggaagacaguuauuuuaguuccuaaaggucuguuaauaucuaauuuaaaugcuguuuuagaggauguuugcuacuccuaauuuuaauuuuuuuaauuuaguauauagcauguagaaucuaauguuacuacuaauguuaaaggaaaaauaauuuaaagcugcuaguugcccaauaaagcuauuagaugauuguucaaacaauaaauuaaauaugcaguacaaauuaaaaugcuauuuaaucaacugugaauuauuuggaauagauguaaggauauguaacuuaacauaauuuauguuuuacuuacuguuacauuuccacuacguggaacagugccuuuuuagcacaguguagugguucccaauagauggagauuuuuuuuuuuuuuuuugagacaaaguuucacucugguugcccaggcuggagugcaauggcgcaaucuuggcucacugcauccucugccuccuggguucaaugauucuccugccucagucucccgaguagcugggauuacaggcgcccgccaccacgcccggcucauuuuguauuuuuaguagcaacaggguuucaccauguuggccaggcuggucucgagcuccugaccucaggugauccacccaccucagccucccaaagugcugggauuacaggcgugagccaccgugccuggcgacuagauggagauuuuuacuugcugaaaauugauacaggacagacaucgccaaccuccaacaaugaugacagaaauaauacauagcuaugaauguuucaacaucaucauggaggagcuauuuugugguuuuguugugguuaaugcuagcuucuuguuuagaaaucagcaucuagaguugcacucaggacccauguccaccacuuauuucccugcucacauuaacuugucuaaaagaaagcagucaacaguacaaaauaaugcuuuuaaaagguuuccugccccuaugaguuccuuuucucuuuuuaaucuacaaaguuacaguuagcuugaaguuaacauucaguacuguacagaucuaagacaccauuauaacuaacucuuacugaguugcauuauuaacaaagcuaauuguuguaugaaagaauaacaggaguuuuuuacaacucugaaaggugguccuuggccgcugauuuuagucuuuaagacaguuauauuuauguuucacuuguggagcugaaaucuaucagcauuacauugauaauaggaguuagaaaucccuaguguuuagcaucuguuuauaugcuuagacaguguugcuguucaguuagagagugucugguaauuuaaacaauuaugguagaagcaugcuauauuaugagacuugaagauaauugguaucauauuguagauuaaccuggguggauacauacucuacugauacucagaaacuuaaggaaaugacgaacuaccauaagaaauaagcaguuggaaugauggcaucuuuacuaaaagauacugaugaaaagucaauaaauggcauuacaaauacaguauaguacaggcauuacaaauacagaagccccaagcguuucagauuuuggaauguuugcauuauacuuaccaguugagcauuucuaauuggcaaguccaaaaugcuucagugagcauuuucuuugagcaucaugcaagcacucaaaaagucccagauuuucgagcacuucggaguggggaugcucaccuuguaucuguucugccauaugaguuauuuuaaagugggcaccaaacuggguuggacuuuucaaaauuuggugauuuuguagcuguuaagccagcuaugauuugagauuuauaaugauagucauuaaacucagauaauauuacuuuaacacuagcuccuggauaauugccuguaucauaguauuaucacauggauucuuuccagugaguaaguauauagaaaguagaugaagaaagcauacuaaccaucuagaaaagagugucauuguaacguuaauuugcugacucacuuucuaaagauaagacauaauauaguaauaagugauaaucaaaucuaguuaaauuugaggcuucccauuuuuagacagaaaauauuauucaaucccaggaauuuagugaaauaacagaaacugccugcucuuaauugaaaacaauguggcuacuuuuaccauagccuauuaggucuaaaauauauuuuaaguuugagcugggagcccagaaccugguagauaguucaagaaaaaugaaagcagaaaagacaugguuucguaagggcuugguguaaaacuugaaacaccgaugaguauuugauuugaauuuucauguaguagauuuaacuauacuuuuuguuuuggguucucuuaggcaacuuuagcgaguauagaugcugagcuucagaaacuuaaggaaaugaccaaccaccagaaaaaacgagcagcugagaugauggcaucuuuacuaaaagaccuugcagaaauaggaauugcugugggaaauaaugauguaaagguaaauauaauaacuaaguauuaaggacaauuaucuguauacacuggcacuuuuguuuacuacuaauaguuuguaaaguucuuuucguauucaugaucucauccucacaaacagucguguaguagauguuauuaaccgcauuuuaaauagaucaggagagagcaagagaauaagggcacccaaauagguaaauucaguaggcggcauuuauuggaccucauguuugauucuuuacuauaacauuuuccccaaccugggcaauguggcgaaacccugucucuacaaaaaauacaaaaaugagccuggcaugguggcgugugccuguagucccagcuacuggggugggaggauugcuugagccugggaggucaaggcugcagugagcugcaaucgugcaacugcacuccagccugcacaacagaucaagaugcugucuccagaaaaaaaaaaaauucgugcuuaaaaauuacguuaauaaauuuccauaagugaaaugauuggaacaacaauuaagauuaguucacggaccagacauaguggcucaagccuguaaucccagcacuuugggaggccaaggcaggaggaucacuugagcccaggaguucgagaccagccugggcaacguggcaagaccuugucccuacaaaaaauuuaaaaauuagccuagcauguaggcauggugauacaugccuguagucccagcuauuuuaagagacugaggcaggagguuaaagaugcugugaaccauguuugugccauggcacuccagccugagcaacagugagacccuaucuggaaaaaaaaaaaaaaaaaagauuagcucagggaauaaauuuauaaugaaugggcuugugguugcuuuaaauauuuaaagaaaaguuaaagaugagcacugcuuucuuaauucuuuuuuauuuuagugugaaaaauuucaaacauauaauaguagagagaauaauacaaugaacucuagaguuuucaguuuucaaaauauguccauauuuucuuuauaccucuuuguccuaaucuuuuuaaagauacuaauauugguuguuagcauuaggcauuugacuuggugguagauuuaaaaacuaagaccaaagaaccaaacuaagacucuuaacugaaaaaccaugcauauaacaugaaagauuuguauguugcaguagcuguuuagacuuuaccuuuuugauuaaagccuaauuacaauacaaagagagcauauacacuuggguuuauauugagagccuacuaaaaagcccagucuguuaaccagaguuggaacugacguaaaaguuuucaauauggaguacacauuuccaucuuuuguauuguuuaauguugcuguuugcuguuaacugauucuucaguuuaaaaaugaagaaaaaauauuuuuaaaaaauacaaaaagaauaaaagauaaaaucaacaaaauaaaaguuacuguuuguugauggaggcaaggauucucaugacucuucucuucauauguuauuucuucaguggacucacuauggggccacuugacuugcuuucccuucaccaucagucugaacauuucggcccuauucuguuuauggugaaguaaugugagauguagagaaaucucuaggauggaaaaguacauuuauuucauaucgcagaacaccagagagauguuguucaagauuugcuuuguagauuugcaacuuuuuagacaaaucuuauauuuuauguucaaauaauuaugauuuaaguuaaaaaguguaaagagagaguggaaaugguuuauguuuaguggcagagggaugaaauccagguuccaugacuacuagauuuuuuuuuccacuauaccauagcaguuugaaaauaagucgucuuugcaaauaguuauucuaauuaaaaaaaaaaaaggauccucaguauuuuugucauuaacaaguaauucuuuuccucucaucauauauaagcucuguuagagcguuacuuuuuuuuuuuuuuuuuuuuuuuugagacggaaucucacugugucucccaggcuggagugcaguagugcgaucuuggcucacugcaagcuccgccucccggguucaugccauucucccaccucggccucccgaguagcuaggauuacaggcgugugccaccacgccuggauaauuuuguuuuuguauuuuuaguagagauggaguuucaccguguuagccaggauggucuugaucuccugaccucuuuaucugcccaccucggccucccagagugcugggauuacaggcaugagccacugcgcccggccuguuguuguucuuaaguuacaguuuacaguuuuauguuacaguuuacaaugauuguuguacucauuguauucuauaguuguguggauuuuaaggagugcauaauauuauagguccgguauuuagaauaguucccacaccacccuaacaaauucccaguguuuuugcuauucaccucuacuucuugaacuucuggcaaccacugauguuuuuacuaucuuuauaguauugcuguuuccaaaauguuauauaguuggaaucauacaguauguauauguagcccuuucagcuaguuucuuucacuuaccaguaugcauuuaagauucuuccauggcuuuucauggcuugaucauuuuuuuaaauuacuaaauuauauuccaugauaugaauguaccaugguuuguuuauccauucaccuaugugguuacuuugagguuuuggcaauuaaugaacaaagcugcuauaaacauucauguguaggcugagcaugguggcucaugccuguaaucccagcacuucgggaggccgaggcgggcagaucacuugaggcuaggaguuugagaccagccuggccaaaguggugaagucccaucucuacaaaaaauaaaaaaacuagccaggcauaguggugcacgccuauagucccagcuauuugggaggcuaaggcacgagaauugcuugagcccaggaaguggagguugcagugagccaagaugguaccacugcacuccuuccuaggugacagagugagacucugucuccaaaaaaaauaauaauaauucauguguaaguuauucuuuggacauaaauuuucaguucaguugaguaaaaauaccuagaagugcuagguuguacguuaugacuauguuagcuuuguaaggaacucccaaauggucuuccaaagugguggaaacauuuugcauuccuaucagccaugaaugagagucugcuguuccacaucauugccaguguuugcucuugucaguuucuugggauuuuacuaauguaugguguuauuuuauugucauuuuaauuugcaguuguguuuuuucuuauuguugagguuuucuuuuucuuugagacggagucucgcucugucacccaggcuggagugcaguggcgugauuuuggcccaccauaaccuccgccuccuggguucaagugauucuucugccucagccugccaaauagcugggaacacaggcgcguaccaccacgccugguuaauuuuuauauuuuuaguagagaugggauuucaccauauuguccaggcugguuucgaacuccugacuacaggugguccgccugccucagccucccaaagugcugguacuacaggcaugagccacugcgccuggcccuguuguugaguuuuguuuuguuuuauuuugagauggagucucgcucugucgccuagguuggagugcaguggcaugaucucggcucacugcaagcuccucuuccuggguucaagcaauucuucugccucagccucccgaguagcugggacuacaggcucccacuaccacaccuggcuaauuuuuuguauuuuuaguagcaacuggguuucgccauauuggccaggcuggucuugaacuccugaccucaggugaucugcccgcgucagccucccaaauugcugggauuacaggcgugagccaccguaccuggccuccuauuguugaguuuuaagaguucuucggccgggcgcgguggcucacgccuguaaucccagcacuuugggaggccgaggcgggcggaucacgaggucaggagaucaagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaagaguucuucauauguuuuggauauaagucuuuuaucagauaguguuuugcauuauuucucugugucuuguuuuuuuuuuuuuguuuuuuuuuuuuacucucaacgucauuuuuugagacuaaaaauuuuuaauuuuaaugagguccaacuuaccaaguuuuacauuaauagauuguguuuuugguauuguauuuaaaaacuugucaccaaacccaauaucaccuagauuuucuccuguguuaaaaguuuuuuuuucaguuuugcauuuacauuuagaucuaugauccauuuggaguuaauuuuucugaaagggguaagguguguaccaggauucauuguuucacaucuggauguccaguugaagagacuguccucccuccauuaaauugccuuugcaccuuugucagagaucaguugacuguauuuugugguuuuauuccugggcucuuuauucuguucuguuaaccuguuuaucuguucuuugccagcacuguacuguuuugauuauuauagcuuuacaguaaguugcauagugucaaguccugugacuuuguuuguccuuaguguugugcuagcuauucagggucuuuugacuuuacauguaaacuuaaucaugucaucugcacaguuuuauuucuuccugaaggugaaggaauauacagugaccacaauuccuucugguugagcuuaaaguucauccuuucccugccaccuaaacauccucuuguuaaauuuuaagcugaacgugcacaugauuaacaaugaauuuacugaagagguccuguaaagaggaagugaaaaaauugaaagaggcagaauuuauuaguuugguuguauuuuuguguuuucuuuagguuuacauuuauuuauuuuucuuguuggcauguauuaacauuauucucaguuuuuaaaaaaaggaaggcaaaaaguaagcuguauuuauuuaccuuucguugaaaacaguaauaaaagaaaaaaauaagauccagacuuuguaugaauauugaguaauacuaaaauauauuuuauaaaaagauuuuauagccuaauugggaaaacacacauugaacauuuuuggcuuuaauuuuuuauuuuacuuuuuccuuacagcagccugagggaacuggcaugauagaugaagaguucacuguugcaagacucuacauuagcaaaaugaagucagaaguaaaaaccauggugaaacguugcaagcaguuagaaagcacacaaacugagagcaacaaaaaaauggaagaaaaugaaaaggaguuagcagcaugucagcuucguaucucucaaguauguuauagaacaaaguuuauucauuuuuuugaaacagccacauagaaauuuuauuuauuauacaaguuuucagaaaaaugugugucuauaggugaaauuuaguuguuuuuuuccuagucuagcugcaguaaauuugaaugauuuaacugaguuauauuugccuaacauaaauauggguuauguauagaaauuuaccagaaugaugugacuggugguaacuuguuaaagacuucagaauuccagggugggcaaaacugcagggaaccaguuuccuggcuuggcaacugaaugaauggggccauucaccacuaucagaauuucacaaggagggaagaugguaacguuagauggugguaucuguaaaauuaguauuucauauuugagucuucagugccuuaguuugcaaguuaugaucaccaaugaauuaauugauuacauucuuuaacauuucaaaauuggcuccugaauauuuuaguuuuaaauauucccaaauuuaucauauauagauaaugaaauguuuacugucaaauauucuuaaaguguaugcauauguuuuccacuucauaucaguauauuuuuuccaaaagcaugaagccaaaaucaagucauugacugaauaccuucaaaauguggaacaaaagaaaagacaguuggaggaaucugucgaugcccucagugaagaacuaguccagcuucgagcacaagguauagcuuccaacuguuuaugaguuacaucuguguucuuauuuuaguauaauuguaguaaacuuaauauucacacugaaagaaauaguaggaauauggcugauuucgaaugguaaacaaaucauacauauuaauguugcuuugaaacauuuuuuuguuguuguuuugagacggcgucuucacucuguugcccaggcuggagugcaguggcacuaucuugacucacugcaaccuccaccuccuggguuccagugauucuccugcugcagccucccuaguagcuaggaccacaggcacaugcccccacgccuggcuaauuuuuuaccuuuuuuguagagacagggcuucaccguguuacgcaggauggucuugaucuccugaccucgugaucugccugccuuggccucccaaagugcugggauuacaggcaugagccacugugccugucaaaacauauauauauauauuuuuaagauuuuguuugaauauggaaauagccaaucuggggauuucccacaguuacgaagcggggugugugugugugugugucuuaacauaggggacuuaggaguuaucucauuucuuuaccauucccuuaacuaaucuguucuggauuaggccaaaaaaaaaaaaaccaaacaaaccauaaaggaauacauaauaccaacacaauggauguaacuuguauacuagucuacaugucauugaacuuggagagcaggugacauuuggguaauuugaaguugaauauugcuaaggaaaaugcuuauuguaaaauccauuugcuccuugguuuauaugaggaaccuuaaaggcuuauuucacucuucuauuuucucucuauucaaacagagaaaguccaugaaauggaaaaggagcacuuaaauaagguucagacugcaaaugaaguuaaggcaaguuugaugucacauuucuaacagcuuuaauuaaucaguauuaauuuugauuagucugacuuuaacauccuuuucccccccaaaauuuuagcaagcuguugaacagcagauccagagccauagagaaacucaucaaaaacagaucaguaguuugagagaugaaguagaagcaaaagcaaaacuuauuacugaucuucaagaguaaguauuauacuucucuaguuaggaggaaagaaucgguuacugauggucaugguauauauucuuauuagaaaccugcaguuuucaucaaaauuacauuuuuaucuuggaaaauaaagaauuuucucauuuaugaguaaaacuucuaaauuccaggugaaauuuuugaggcuuuuuuuuaggucuuuugaucuaaauuauucaguaaaagaaaaaaauccccaaccuaagucuauuauugcauaccacagucuucuccaaauccuuuauuuaguuuccuuuuuuaaaaaaauucuuggcugggugcaguggcugauggccugugaccccagugcuuugggaggcuggggugggaggaucacuagaagucaggaguucaagaccagcugggcaacauagugagacuccaucucuacaaaaaauaauuuuuuaaauuagcugagcuugguggcacaugccuguagucccagugacccaggaggcuguggcacgaggauugcuugaguauuggaaucugaggcugaagugagcuaugauuguacuacagccugggugacagagcgagacccugacucaaaauucuuaacugggaaaaacuuuucuggaaauucuauggauuuucaaagguuuuuuuuuuuuuaaguugucaucuuaguuuaucuagaagcaauuucccugccuccauaaccaugugcacauacauagaguuuauggaagucagaguuugcaacaauuugaguaggaaccaagaagagaauaacauaacaaaauaaugaugagguuuggggcguaggucuuacuaugaauaccugauggaaguaggcauaaggauucaggaagaugaaagacagaggagaacagaaucaugauuucaaaccaaaauacgaaaaauuuuguauguccacaaguagccaggucccuuuccucuuuuccuccauaggguauaggauaacagaaaaguccuugaugagauuauagaauuuaaaaguuuggaaauuuuaaugaugacauugagaaaacugugauauugauacuguguuaauuauuuuuuucuuucgucagccaaaaccagaaaaugauguuagagcaggaacgucuaagaguagaacaugagaaguugaaagccacagaucaggaaaagagcagaaaacuacaugaacuuacgugaguaauuguuuuuaauuaaaguuuaaaaauaaaagcuaaauuagaggauuauaggcauuaccuuuggauauagccaguggauacauauuuuacuuuguaugggcuaaaggauuuuuucuuaaauccacugaguugguuugauuuauaucuaaauacuuggaauauauacuugcauuugagugaaagcaaggucuuauauuucauugugguuaagauuaagguuucucuuuauuaaucugcuugcuguuucuuuaucuccauauuacuucaggauccagcauaaaaaugaaccuaaaacaauauauuaaguaacuucgaagauuuuaagaucuaacacaaaaacugaguuuuuguuaaauuuucucuugcauaaaagagcauugugguguuuagccuugccauuuugaacagagguuuucaugguuuaccuuuucucauuuucucaaaacucaguuuucuagaaucuuagcagguagaaagugcaugauuauaauuuuucacauaccuugaguuugugagacaauuugcaaaucaacugauauuguuaggauaguuagaacaucaggaccaguucagaguggauuauaugaagauucugcuaacuugcagcuguaauuuuguuuagaauacuuguaauguaaaauauuuuagucuuugacaguuuauaaucuauaauuaaucaguaucauuuuggauaaauagcaguauaauacauguggcauauuuuaaaauauaaauuauagaacuauuccuuauucuuugaauucugccacauuuuauuucaucucuuccauugcuauauauggaauguauaacaauagacuguuguuuagaaggcauaugaaaauuuuuugaaauugcaaagcugcaguggcucacacccauaaucucagcacuuugggaggccagggcaggagaaucaguugagcccaguguuugagaaucagccuaggcaauauagugagaccccgucucuacaaaaauuuuuuuagacagggcugauuguacaugccuguagucccagcuauuugggagacgaggugaggaggaucacuugagcccaggagguugagguugcagugagcaguguuugggacagaaacucugugucaaaaaaaaaaaaauuuuuuuuuugaaagacagcacagguaaauuguuuaaaauaggcaucuuguauuuauuuaaauuuaagaauuuauccuuucagacacaaaauauuuuauucaacucucaugcuaaguacaauauacagaauaaaauuugaaaauauauguuuguucuucuacuguuaggguuaugcaagauagacgagaacaagcaagacaagacuugaaggguuuggaagagacagugguaagaaaaacaugaaaauaaacaggauugggaaauauuuuguggguuuuuucuaccaugauuauucuaaauuuaaagucugagcuccaaaaauaucgcuguucuuaauccaaggcaaaagaacuucagacuuuacacaaccugcgcaaacucuuuguucaggaccuggcuacaagaguuaaaaagguaauguaacuaugccgagguaggcguuugcauaaauggugcuuacuucuagguaauuauuuguauucaaagugaaauaacuuuacagucacgucaauuuuuguauaguuaagcuuaguuuuuuuuaauuuuuuuguaauacuuaccuucuuuucucagagugcugagauugauucugaugacaccggaggcagcgcugcucagaagcaaaaaaucuccuuucuugaaaauaaucuugaacagcucacuaaagugcacaaacagguacuaaagaguauauuuucugguagcugcaagauaguaaaaaucaaaaauugaggauuggcaagugaguauuucaaucuuucagaguccucaggaauuuuuauacccugagccauuuuaucagaaauuauauaaagaaaccauaaguaacuuuuagaggaguuaauauuuuuaacaacguuauuaucaaaagaggcagugaaaacauguauucucauuuucccuuuaggauuuuaagacugugcauuuucauaauuuauucaugguaauuuugaaaucucuacuacacaagacugcaguuaaaguacugcaaagucuuuuggggagaguggucuuuuuauaccuaauaccccagugugucagacauaaugacgcaguuuucauuuaaccagauuaguugucuuacugaagaaacauagcacuaucuuguaauguauugucuuugccuaguagagggaaagaacaauucucccccuaaaaaauuaaaggaaauuauaccuuugugaauaaacuagaugugugcacgcuauguauagauggauguauuccuugcguguuucugccuaaauuagauaaaugggaaacaauauaaaaugcaguuuuacuuuucuaaagagcaauuaugaaaugcucauacuuuuucaagucauccuguuaaaucuggaauccuuguuuucuuuguguacguuuaguugguacgugauaaugcagaucuccgcugugaacuuccuaaguuggaaaagcgacuucgagcuacagcugagagagugaaagcuuuggaaucagcacugaaagaagcuaaagaaaaugcaucucgugaucgcaaacgcuaucagcaagaaguagaucgcauaaaggaagcagucaggucaaagaauauggccagaagagggcauucugcacagauugguuaguagaacacauuaaaaccuuuaaaccuugcucaauuugaaugcuuucauuuaguggaaaacguaauccgaauuuuauguguugucauggugcaucugucucuauuuucuaacuuagcagaguggcacuguugggaaagaggaauaaucacauuagcagaaaaagaagauaaaugagaacuagagaagcaagcaagaauggucauggaauggagaaacuauauagagcaauauuauuaaagccaagagaauugcaagaaaauaagccaucagcaaugauuuaacguuuaagaauaaucauugguggcugggcgcagcggcucacgccuguaaucccaacacuuugggaggucgaggcggguggaucaccugaggucagaaguucgagaccagccuaacauggugaaacccugucucuacuaaauaaaaaaaauuagccaggcaugguggugaacgccuguaacccagcaacuugggaggcugaggcaggagaaucgcuggaaccugggaaguggagauugcaaugagccgagauugcaaugagccaagauugcaccauugcacuccggccugggugacgagcgagacuccaucucaaaaaacaaacaaacaaacaaacaaaaauuggugcaggaaguguuuuuuuuguguuuuauuuauuuauuuauuuuuugcuuguuuuuugagauggaguuucacucuuguugcacaggcuggagugcaauggcgugaucucggcucacugcaaccucugccuccuggguucaagcgauucuccugccucagccucccuaguagcugggauugaaggugcaagccaccaugcccagcuaauuuuguauuuuuaguagagacaggguuucuccuuguuggucaggcuggucucguacuccugaccucagaugauccaccugccucggccucccaaagugcugggauuacaggcaugagccacugcccagccauuuuuuuuguuuguuuguuugcuuguuuuuuaugacacagggucuugcuugucacccaugcuagacugcaguggugcaauuauggcucacugcagccccagccucccagggucaugcaauccucccaccucagccuuccaaguagcugggacuacaggugcacgccaccacaccuagcuaauuuuuuuauauucuguagagacaggguuuugccuuauugccuagucuggucuugaauuccuggacccaaaugauccacccaccucaggcucucaaagugcugggauuacacagguaugagccacuacgccuggccaggaagauuuuuaaaggcuaagaauuguauagguccuagagaaaaggauguuacagaaaagaaaaagugauggagaaacaaaaaggcaaagaaaaacaaaacauuugggaauuuguugugaauaagagaagaaaccuuaacagucauugcagucacaucuuaaacuuuauucuaaagucugucuuuauuuuucauauuagcuaaaccuauucgucccgggcaacauccagcagcuucuccaacucacccaagugcaauucguggaggaggugcauuuguucagaacagccagccaguggcagugcgagguggaggaggcaaacaaguguaaucguuuauacauacccacagguuuguuauuuauaucuggcuuuucauaucuguuuguggaaaauugguuguuaaauagguuuuuugguuuuaaaaaauucucacauuaguguuaugauuuuuuuaacuuaagcauuauaaaaguaauuuaguuugaucuuuuuguguaguuuagaucauacuauauauucaaauuuguggucuuaauuguuuugaaaucuagcauuggaccauuuguaauagcuuuugauacugugucuaauggauguaccaugguuuauaaacauuccuuuccuuuuggcuagacauguaauuauauuaauuuuuuccauaauugaaauuuucaaaaaccaaaauuuucauauaugaaauuugaaacaucuuuuuuuuuuuuucuuuuucuuuuugagauggaaucucacucuugucgcccagccuggagugcaauggcgugaucucagcucacugcaaccucuggcuccuggguucaagcgauaccccugccucagccucccaaacugggauuacaggcgccugccaccaugccuggcuaauuuuuguguuuuuaguagagacgagggguuucaccauguuggucaggcuggucucaaacuccugacuucaggcgaucugcccgccucggccucccaaagugcuggaauuagaggcgugagccaccgcgcccgaccugaaacaucuccuuguauucccuaaccuguuagagauuauuuccagaagguucccagaaaugcaauuacaaggaaauaugaacauuuuuaaggcucuugcuacauauuaacacauugguuucuagaaagacugcaccaaauugcuuaugagcccagcuuacuaacagauuucugaguuuuauuuauaauuauauaaguaauaucuguucuuuguagggcauaaaacagucacaaauuagaaaaaaucuagagauacuacacaauauacuaucucucucucucucucucucuuucuggagcuuucuguauuaguuuuuaaauuuaaaaguuuaaacuguugauaacuauuguaauagacuccacuuauucuacuacauaugcugcuucggagccugcuuuuuuuuccggcccccugcccccacaaaccccacaccccccugccccacuccgagacggagccucguucuuguugcccaggcugacaugcaguggggugaucuuggcucaccgcaaccucugcuucccagguugaagcgauucuccugccucagccucccaaguagcugggauuacaggcgugcaccaccacaccggcuaauuuuguauuuuguagccugcuuuuuaaacuuagcaauauauucggaacacuuucuucuacaacgugauugguuagugguugccuaauaauuggucauauagcagcaacucugauuguaacuaacucuucaggaagucccugauguguguaugugcuuuggaaauaaaaaauacuagauaauuaugaaaugaucagcuguuucugacaaauacuaaagcuaguuuauuuuaauguugcuuguuuauacuucgacauuuugcauaauacuggcucuaaguugaguagagaauuaagaaauauucugaaggauucacauuucuagcaauuuuaaacguuuuguucacacaauguaggauuuaaaacagugguagagugaaaagaacagggacuauggaguuccauccaaguuggaauccugacuacuuuuaugaacuugagcagauaaacuuuuuaauaguuuuuuucucauucugacuuguuuuacaguacuucauaaaaauuauggauuuauugcuuaacuauuuaaugaaucucuaaaauaacauuuuucuacauagccacaauauuaucacacccaguaagauuauauuuuuaauauuauuuaauaccauuccauauucagauuuuuccaauuucuuuuucacuauccuguacagcugguuugucuaaaccagaguacaauucaggacugcuguuugcguuuaguuuuaucccuuaaaucucuucugaucuugaaugagcacccucuuuagugauauugacuuacugaguaggcccaguuaucuugaggguauaacaccugugucugauuguuuuuauguguagucaccuuguucucccucuauuucuaugcaaaagcauugauuagacucagcauaaacauuuuugacaaaguuaugucauagauaauauguacuuaauaucaguagacauacaauagcugguuuucaugauaauuagagauaacuccuguguuuuuccccuuuggacucauagcaguuuuauuaguaaaauggaagucauucuuaagaauuacaugaguuggccgggagcaguggcucacaccuguaaucccagcacuugggaggcugaggugggugggucaccucaggucaggaguucgagaccagccugaccaacacggagaaacccugccucuacuaaaaauacaaaaucagcagggcgugguggcacaugccuguaaucccagcuacucgggaggcuggggcaggagaaucgcuugaacccaggaggcggaguuugcagugauccgagaucguggcauugcacuccagccugggcaacaagagcaaaacuccgucucaaaaaaaaaaaaaaaaaaauuacaugaguuaagauguuacccagcacacaguauucaguagaugcaagccuuuuccuaccuuucuggaagugggagcugggcaaggggauuuucaaagcauagauagaaaguuuauccuuuuuggauauuguccucacauuaaaauucauaugucaacuuuaaacuuaccucauuguagagagaggacagaccauacuuuuguuaacuauugcugauagcaguaaagugacaccagguuagcacauaagggagggagcuaacccagccaaacuagguuuucaagacuugaaaguuaugauguaaaaauacaauuauuuacagguuuguuuugaugcugguccaaagauagugguucuuaguuuucaaacucuuauaaucuaucuuaaaccaugauuggggaguauaugauucacuuaagugauaaauuguuuaaauguuaaauaauuugcacuggagugcaguggcaggaucucggcucacugcaaccucugcuucccggguucaagcaguucucccugccucacccucccgaguagcugggauuacaggcgcccacuaccacgcccgccuaagguuuuuguauuuuuacuagagacgggguuuugccauguuggccaggcugguauugaacuccugaccgcaggugaucugccucccucagccucccaaagugcucagauuacaggugugagccacugugcccggcgagaaauuuuuuuaauguuaagaaaaacauuucaagucacuguguuuauuuuuggaaaggaugacauuuauaauacugauacuuuuaguucccaguuuuacaugacuagucuucugccuugcauaguacuuuaaauagguugcuuuucuaaaugcauagguaaguaggcaguuuaauacuacuagaauuauuuauuucacuguuacuuuuccuacuguauacaccucuuguuuaucccuauuccucucccccuuuuuuuuuuaaagcuucuauguauauaacuaguaguugcugguuaguguuccuugguuuaagaaggucacugaccacugucugcugguuaaaagauuagccgucuuuuucuuuuuuaaacaaauacaauucauaaaucagcuuacccauagcuuuauuugggagaauaaaaacaaagggagggcugaccucccuuuaaacauuacugcuucuaaacaguucuacuuagguaguauauaaaaggaaaccaaaucauuuaauauugccauccuucuaauuuuggggaaaguagccacagauguuggcuaaaauguuuauaauaaacuguuggcauauuuuauuuuguuuuauucuucaugauuaucucaaacaccaauuuuguaaaacuaaacauauuuacucuaugcuuucucccauuuuuagguguuaaaaaguaaucgaaguacgaagaggacaugguaucaagcagucauucaaugacuauaaccucuacucccuugggauuguagaauuauaacuuuuaaaaaaaauguauaaauuauaccuggccuguacagcuguuuccuaccuacucuucuuguaaacucugcugcuucccaacacaacuagagugcaauuuuggcaucuuaggagggaaaaaggacaguuuacaacuguggcccuauuuauuacacaguuugucuaucgugucuuaaauuuagucuuuacugugccaagcuaacuguaccuuauaggacuguacuuuuuguauuuuuuguguauguuuauuuuuuaaucucaguuuaaauuaccuagcugcuacugcuucuuguuuuucuuuuccuauuaaaacgucuuccuuuuuuuuucuuaagagaaaauggaacauuuagguuaaaugucuuuaaauuuuaccacuuaacaacacuacaugcccauaaaauauauccagucaguacuguauuuuaaaaucccuugaaaugaugauaucaggguuaaaauuacuuguauuguuucugaaguuugcuccugaaaacuacuguuugagcacugaaacguuacaaaugccuaauaggcauuugagacugagcaaggcuacuuguuaucucaugaaaugccuguugccgaguuauuuugaauagaaauauuuuaaaguaucaaaagcagaucuuaguuuaagggaguuuggaaaaggaauuauauuucucuuuuuccugauucuguacucaacaagucuugauggaauuaaaauacucugcuuuauucuggugagccugcuagcuaauauaaguauuggacagguaauaauuugucaucuuuaauauuaguaaaaugaauuaagauauuauaggauuaaacauaauuuuauacgguuaguacuuuauuggccgaccuaaauuuauagcguguggaaauugagaaaaaugaagaaacaggacagauauaugaugaauuaaaaauauauauaggucaauuuuggucugaaaucccugagguguuuuuaaccugcuacacuaauuuguacacuaauuuauuucuuuagucuagaaauaguaaauuguuugcaagucacuaauaaucauuagauaaauuauuuucuuggccauagccgauaauuuuguaaucaguacuaaguguauacguauuuuugccacuuuuuccucagaugauuaaaguaagucaacagcuuauuuuaggaaacuguaaaaguaauagggaaagagauuucacuauuugcuucaucagugguaggggggcggugacugcaacuguguuagcagaaauucacagagaauggggauuuaagguuagcagagaaacuuggaaaguucuguguuaggaucuugcuggcagaauuaacuuuuugcaaaaguuuuauacacagauauuuguauuaaauuuggagccauagucagaagacucagaucauaauuggcuuauuuuucuauuuccguaacuauuguaauuuccacuuuuguaauaauuuugauuuaaaauauaaauuuauuuauuuauuuuuuuaauagucaaaaaucuuugcuguuguagucugcaaccucuaaaaugauuguguugcuuuuaggauugaucagaagaaacacuccaaaaauugagaugaaauguuggugcagccaguuauaaguaauauaguuaacaagcaaaaaaagugcugccaccuuuuaugaugauuuucuaaauggagaaacauuuggcugcauccacauagaccuuuauguuuuguuuucaguugaaaacuugccuccuuuggcaacauucguaaaugaagcagaauuuuuuuuucucuuuuuuccaaauauguuaguuuuguucuuguaagauguaucauggguauuggugcuguguaaugaacaacgaauuuuaauuagcaugugguucagaauauacaauguuagguuuuuaaaaaguaucuugaugguucuuuucuauuuauaauuucagacuuucauaaaguguaccaagaauuucauaaauuuguuuucagugaacugcuuuuugcuaugguaggucauuaaacacagcacuuacucuuaaaaaugaaaauuucugaucaucuaggauauugacacauuucaauuugcagugucuuuuugacuggauauauuaacguuccucugaauggcauugauagaugguucagaagagaaacucaaugaaauaaagagaauauuuauucauggcgauuaauuaaauuauuugccuaacuuaagaaaacuacugugcguaacucucaguuugugcuuaacuccauuugacaugaggugacagaagagagucugagucuaccuguggaauauguugguuuauuuucagugcuugaagauacauucacaaauacuugguuugggaagacaccguuuaauuuuaaguuaacuugcauguuguaaaugcguuuuauguuuaaauaaagaggaaaauuuuuugaaauguaaugacuuucuuaaaacuuaaguguuagguugauuuuacauggcugaguucaggccu

SEQ ID NO: 18463 - RNA, 17985 nt, Homo sapiens
uccuguucuccuuggcuccuccuuccucaaaauaacugucacucuucucugauaagaauguugccauaauuaucagugcugcuguuaauaauagauguggacccacuauagcuuugcuucuagaaaacagccugugauuuucugccacugcuaaagagcaucuguuuuuaucauuuauuugaguguacuauauuaaguaaaugacugcuucuuuuagugugauucauauuacugauuuucauaaagucauagagaacaaggacauccuaguauuugcaugaauuugccucgaaguagaaggaacaauguagaauuauauggaaagaaacuaaaaccuuuuuaauuauguucauuuuacaaugaacauuuuacaagcauggauaaucuaaaucuagugauuaaaugaaggguuaagaucuguugguaacccaugugguugauguacaguacuguguauguguaauaguugaauuggauuuuuuagguauuuacagagccguuuccacaaaaauauaguuccuguccuuucuugacuauaaguuguagauugaaacucuuuguuuuuacuucauauuuuauaauuuauuuaagaagucuaguuuuguuuuuuguuuaggguaaacuucaugauccagaaggcaugggaauuauuccaagaauagugcaagauauuuuuaauuauauuuacuccauggaugaaaauuuggaauuucauauuaagguaaauuccuugaggaaagauuauauuuuauuuuacagcaagaauaauguucuaaaaaaauaguaaaugcugguuucuuuaauuuuaaaaauuguuuuucuggaaagguacaguugaaagaucauucagguuaguaaacuuggauuuuuguucaucugccauuagaugaacaggaauguuaacuaacguaaaugauuaagucuuuagccuccuucaaaaaauaaaggagguugcuuuacugcagaacuugaagguuucuacuacauaaaacuauucuaauucauuuuagaugaagauaauguaauuuauguccaaugggaagacugcuuaaauaacuaagcuaauuuggcuaauuuaugucuucccauuagaaugugagcuauggcugguauguugauaacugucucucuagucuaaacaaugccuagcacucagaccucaauaugcgaauaaguuauauaacuuuaguugaucgguguuuuuuuaaauuugcccuuuagguuucauauuuugaaauauauuuggauaagauaagggaccuguuagaugguaaguuaaauucuugcuaaucaguuuuaaauaacaucuguuaauuccuuuuuaauaauagaugugagacuauuucuuuguaaccuauaugaaauugucuuaaguuauuggaaauagacaaaauuuuuuuucuucuaaaguuuuaguugaauaccuuuaaauagaauaacuaguuuaaagcgauguuuauggguacuucuuaguaguaauuagagcauuggacugggaguuacauaaucugagcccugaguucuagucuucugucaacugucaauuagauacauuguccuuaggcaaaucauugaaccauucaggguuaauguucuuguuuauaaaaugugggugguagguuggagugguccuaaaauucuauauuguugcauugguuucuauuuacaucuccugcugugucuguaaggucugcuuuagagcaauguuuuaauauguuuuuagaguucaacuauugcuguuaggcugcucaggaaagccuaucaguuauuucauauccaguguuaagaguuuuaggagaauguugcuaacauuuguuuuucuuucucaguuucaaagaccaaccuuucaguucaugaagacaaaaaccgaguucccuauguaaagguauuuauaguacaguugucuagaaaacccuguaauacuuuuuuuuuuuuuuuaagacagagucucacucugucgcccaggcuggagugcaguggugcaaucucggcucacugcaaccucugccuccaggguucaagcaguucuccugccucagccucuugaguagcugggauuacaggcaugcgccaccacgcccagcuaauuuuuguauuuuuaguagagacgaaguuucaccauguuggccaggcuggucuugaacuccugaccucgugauccgcccgccucugccucccaaagugcugggauuacaggcgugagccaauucauuuaauauauggaggcucgcucuguugcucaggcuggagugcauggcauggucucggcucacugcaaccuuugccucccaggcucaagcgauucuccugccucagccucccaaguagcuaggauuacaggcacccgccaccgcgcccggcuaauuuuuguguuuuuauuagagaaaggguuucaucauguuggccagacauuaacauauuuuuaaaaauuauuucacaggggugcacagagcguuuuguauguaguccagaugaaguuauggauaccauagaugaaggaaaauccaacagacauguagcaguuacaaguaaguagaaaauaacacugguuaggauuuaaaaccagcuuaaaauauccuuauccaggugauuaauuauaagauugcuucagggaaauuguuaaggggaaaucauguuuguuuauauuuguuuguguaauuuccuugcagauaugaaugaacauagcucuaggagucacaguauauuucuuauuaaugucaaacaagagaacacacaaacggaacaaaagcugaguggaaaacuuuaucugguugauuuagcugguagugaaaagguaaagucuucauguauuuugacaaauauuuaagcaucuuuguaaacuuuaguuugaguugggaguuacgcaggguucauuguugcaucuuacuuaccaaacuggauuugguaaccugagauuuguaaccgcugaugccagugccuuaugaugauaucagcugaauaaucaguuccaaguuacuguuguuugaccauacucuaguucaacccauaagugguuucuaugacuuaagauauguucauagugagaacugguucagcauauguuguuauaaacuuuauuagauaucccuuuucuaauuuuugauacguauuuuauccauauuggcaguggggucccuauuaaaacugguaacucucgauuagucuuuucugguuugguuggacuuauuucuuuccuuuggauuauuguuucauuauuacaauucuauacagucugauucuagucuauaucaaauuaaguuugaauguuauaauagggaccucugaccauuuuugcuguugugcuaauuuuguuucuucugcuuagaaugauauaucuauuccguucuacucugaagucuuacacacaucuuucaaagauuaucuaaucugagaaaucuccuaagcuauuucuucagccaacauugcuaauuuauuguucugaccuaucuuuaacauagauacuagcugggcaugguggcacaugcccguaauaccagcuacuggggaggcugaggcaggagaauugguugaacccgggaagcggagguugcagugagcugggaucaagccacugcacuccagccugggugacagagugagacucagucuccaaaaaaaaaacaccacaacauagauauuuagauauuuuauauauuuuuaaaagaagcagauuugcuuauauaauguguuuaaaacucagucucuguuuucuaacaguuacaacaucaacauuaugcauuagccaauuuuagaagguuccuguuuucuaauguagcaaaggggacuaacagauuaaugaacuacaaauuuacauuuaaauugguuauuuucaagaguaccuacaaacuacagauaaaauuugaugucucucuaaucaaacucuuaagaguaguacucaagaaauggugguaugcuuggcaaauaagaucaugaagcuuuucauguucuuuuuucuuuuuuacugguuauugaugacauaugaacauuuuagaaaauguaaagaaaauuauaaacuuguaauuuuguuucauucuuuugaaaucuuauguauagguuaguaaaacuggagcugaaggugcugugcuggaugaagcuaaaaacaucaacaagucacuuucugcucuuggaaauguuauuucugcuuuggcugaggguagugugaguauacaugucuucuaucucccuguuaccuuauggggcauuauuuaaauauagguguauaugugugccuggguguguaugagagagagagagagaaagagagauugagauucaauguguuugaaucaguauguguaaguuaguugucuuuugggaguuuauuuuauaauaacauuuuauuauacuggucuuguuuucuuucuuuguuuuuguaugcagacauauguuccauaucgagauaguaaaaugacaagaauccuucaagauucauuagguggcaacuguagaaccacuauuguaauuugcugcucuccaucaucauacaaugagucugaaacaaaaucuacacucuuauuuggccaaagguuuguuguuaagaaaguacaaaaccuaaauuuagauagaccuuuuguuuauaaaauguaggaaaaugugagcuguuauuccaaccuguacauacuguuuugugcuagacacacucaguuugaauugaugacagauaauacaaggugggucugauuuuuagacugcuugguuuaaguuuuaguacacauuaaagucagauguaauuuuagucaaauuugugugacaagcuguaauuugguauuaaagaaaauaagcauuugaaucaaauaaugaggucaaagccuggcaaacauaauccucuguuaagccuguagacaugcaugacagguuaauauaaucuguaugagaugauuaggaaaaucaguaaugaugauuccgucuuugacuuucaacaguaauuucuuaauucagccuugcaaacaaauuggaaaaauauaggccuuugucuuuuauuuuuagugguuuguugauuuuuuuuuuuuuaaagcuauucacagauuuuggagcagacucaaauuuaguugaguuguaaauaacgucauauguugcggcuuuuaguauuuagucuaagagauuacuggacaagcauaaguuucuuagccauauauacauauauuccauauagauaaaauuaaaaauaauuucagucucauccuuuuuuuccuccaauuacaucucuuagggccaaaacaauuaagaacacaguuugugucaauguggaguuaacugcagaacaguggaaaaagaaguaugaaaaagaaaaagaaaaaaauaagauccugcggaacacuauucaguggcuugaaaaugagcucaacagauggcguaaugguaauaacuuaagaauuugucaucuucaguuuguuaaauacagauuuagagcauagaaacguagaaauaguucagcaaaaucaguaagugacuagaucaagaaauuuaauagacaucgaaauaauuuuuaaaaaaauuaauagaaauccuggagcugaaaaauaaaaugagcaaaaugcaagagaccaucaguaguagaauuaauuaagcagaagaaucugaacuugaagacagauuauuugaaaauaacacagagaagaaaaaguuugaaagaacgaggcugggugcacuggcucaugccuguaauccuagcacuuugggaggccaaggugggcagaucacuugaggucaggaguuagagaccagccuggccaacauguugaaaccccaucucuacugaaaacaccaaaauuagccuggcauggugcugagcgccuguaaucccagcuaaucaggagucuugaggcaguagaauugcuugaacccuggaggcagagguugcagugagccuagauugcaccacugcacuccagccagggugacagauugagacucugucucaaaaaaaaaaaaaaaaauuuuuaaaggaaugaaauugaaauuagcuuuagacgucguuuuuuuauuaaccacuuuauuuucuuauuuuaggggagacggugccuauugaugaacaguuugacaaagagaaagccaacuuggaagcuuucacaguggauaaagauauuacucuuaccaaugauaaaccagcaaccgcaauuggaguuauaggaaauuuuacugaugcugaaagaagaaagugugaagaagaaauugcuaaauuauacaaacagcuugaugacaagguagguauugcuugauuuaggucugcuuuauauuaggauacuauugacauggguguuuuuauuuucuaacuuuucucauuucagugcugugggcacuuaggaucuuuaugcaucuuccuugauuucuguuaaucuuguaaaaauuauuguauuaacaaaauaaaaagucauaauuucaauuucuguguggaaacuguaugagcauguaucuuuucuucccccucuuuuuaagcuaaaagaacuuuauaaggcagcaguccccaaccuuuuuggcaccagggacugguuucagggaagacaguuuuuccguggaucaggucggggagaugguuuugggaugaaacuuccaccuuggauuaucaggcauuagauucucauaaggauccucuaaccuagaucucuugcaugcacagcugauaauagaguucgcgcucuuaaugauauucuaaugcugcugaucuggcagaaggcggagcucaagugguaaugcuugcugcucaccuccugcugugcuucuugguuccuaacaggcuuccaguacugcuuuguggccugggggcuuggggaccccuguucuaaugaaaauuuggcauugggucauugggagccucaaugauaccaauuguuagaaucagggcucugaagacuccaauaaaagaugaugugagagauuaagggaaacacaauagaguggaaauaauaucuuccugcuuugcauauagaaguaaugucaauaguaugaauaauagcaaacuaagaacguaauagaauggaaggcaagaacaagaguaguaaagagauuagaagaaaauauuuucuuaaguugauauuuuuaauauauuuuaagcagagauggcagguucgaaguacaugaccauuauaaguauugauaauugaaagaaauuccuuuuguuuugccauuuucuuaaaagagauuaaaauaagcaauguugaauuuagagaaaugguuuugaaauauuucuggggaguaguaaucuuauaaccuguauugggaaacaacuagaaccagguuguuagcuacugguuaaccggauacuucacaauucuaggaugaagaaauuaaccagcaaagucaacugguagagaaacugaagacgcaaauguuggaucaggaggaggugaguugaauaccuuuuacauugcuuccagaaaagcuuuauaguuuuguuuucugaaucccauugacuuugucuuuaauaguuguauaauuuuggguaugacugucuuugugggaauaagaaugucacauggauaaagugaauuuuuacuuauucaucguaucuacccagauacaaucuguuguucauuuccgccaucuuuuuuuucacccugguucuugacauuucucuucuugucacuuacuuuggauccucauuuuaucuucucacccagcagagcagggggauaauugaaaagcaguccuuuaaauuuuuuuguggggguggugggcagggugaagacaaagacugcuucgguaagaaagagauacucuccaucagugaacuuaauccuggucagaucaucuuucaacuauagcauuucauauuucaacuauagcauuauuccucaaaggggcacuauugauauuuugcauuggauaauuuauguuauucuguccuuuguauuauaggacauuaaacauuccuggucccuacuccuaaaugccauuagcauucuacccuauuauuaacacucccacagauuuccggauaucccuacaggagagccacuaauguggaugauugugguuuucuccuaacuagucucuuggcaucccugcaguucagauuuuaugugcugauaccagguuuuguuuuuguuuuugaggcgaagucuugcucuuguuccccaggcuggagugcagcggcgugaucuuggcucacugcaaccuccaccucccagguucaagcgacucuucugccucagccucccgaguagcugggauuacaggcgcccgccaccacgccuggcuaauuuuuugguauuuuuaguagagacgggauuucaccauguuggucaggcuggucucaaacuccugaccuugugauccgcccgccucggccucccaaaaugcugggauuacaggcgugagccaccccgccuggcccaaaucuaaauuuuuaagcaacucuuguagaaugccauuuuccuuuauuacauuaauuugcaugugacugcagucgaucucuccuagccaacuucuccaugaaugaauacucuuuccuguauuacuaagcacuuuaucuguccugucccucucuuaugguucugaccuucuaucuuguacugcacuuauucaugugccuaucuucucuucuacuguguuccuuaaacacagucuuugauuuucuuucugccuugcagcauccagcacagugccugcacauaguugacauuuaguaaaucuguuuaaugaauaaauguugccacacugaauaccauccauauuucacuccauuuguucuugacaaauggugaagcuucauggguguuuuuuaaaaccuguauacuuuuggggaaaauaaauuauuuucuguccuauagcuuuuggcaucuaccagaagggaucaagacaauaugcaagcugagcugaaucgccuucaagcagaaaaugaugccucuaaagaagaagugaaagaaguuuuacaggcccuagaagaacuugcugucaauuaugaucagaagucucaggaaguugaagacaaaacuaaggaauaugaauugcuuagugaugaauugaaucagaaaucgguaggauauaguuuuauuuucuuuuuuaaugcuuuaguacaaguauucuuaaccuaaaaacuacuuaaauaacuuacuuuucuauguaagucaaauaucgauaacaucaauuuucaaggacucggguuucaacuucauuucuuucuguauaugaagccuuagagguggaggaagacaguuauuuuaguuccuaaaggucuguuaauaucuaauuuaaaugcuguuuuagaggauguuugcuacuccuaauuuuaauuuuuuuaauuuaguauauagcauguagaaucuaauguuacuacuaauguuaaaggaaaaauaauuuaaagcugcuaguugcccaauaaagcuauuagaugauuguucaaacaauaaauuaaauaugcaguacaaauuaaaaugcuauuuaaucaacugugaauuauuuggaauagauguaaggauauguaacuuaacauaauuuauguuuuacuuacuguuacauuuccacuacguggaacagugccuuuuuagcacaguguagugguucccaauagauggagauuuuuuuuuuuuuuuuugagacaaaguuucacucugguugcccaggcuggagugcaauggcgcaaucuuggcucacugcauccucugccuccuggguucaaugauucuccugccucagucucccgaguagcugggauuacaggcgcccgccaccacgcccggcucauuuuguauuuuuaguagcaacaggguuucaccauguuggccaggcuggucucgagcuccugaccucaggugauccacccaccucagccucccaaagugcugggauuacaggcgugagccaccgugccuggcgacuagauggagauuuuuacuugcugaaaauugauacaggacagacaucgccaaccuccaacaaugaugacagaaauaauacauagcuaugaauguuucaacaucaucauggaggagcuauuuugugguuuuguugugguuaaugcuagcuucuuguuuagaaaucagcaucuagaguugcacucaggacccauguccaccacuuauuucccugcucacauuaacuugucuaaaagaaagcagucaacaguacaaaauaaugcuuuuaaaagguuuccugccccuaugaguuccuuuucucuuuuuaaucuacaaaguuacaguuagcuugaaguuaacauucaguacuguacagaucuaagacaccauuauaacuaacucuuacugaguugcauuauuaacaaagcuaauuguuguaugaaagaauaacaggaguuuuuuacaacucugaaaggugguccuuggccgcugauuuuagucuuuaagacaguuauauuuauguuucacuuguggagcugaaaucuaucagcauuacauugauaauaggaguuagaaaucccuaguguuuagcaucuguuuauaugcuuagacaguguugcuguucaguuagagagugucugguaauuuaaacaauuaugguagaagcaugcuauauuaugagacuugaagauaauugguaucauauuguagauuaaccuggguggauacauacucuacugauacucagaaacuuaaggaaaugacgaacuaccauaagaaauaagcaguuggaaugauggcaucuuuacuaaaagauacugaugaaaagucaauaaauggcauuacaaauacaguauaguacaggcauuacaaauacagaagccccaagcguuucagauuuuggaauguuugcauuauacuuaccaguugagcauuucuaauuggcaaguccaaaaugcuucagugagcauuuucuuugagcaucaugcaagcacucaaaaagucccagauuuucgagcacuucggaguggggaugcucaccuuguaucuguucugccauaugaguuauuuuaaagugggcaccaaacuggguuggacuuuucaaaauuuggugauuuuguagcuguuaagccagcuaugauuugagauuuauaaugauagucauuaaacucagauaauauuacuuuaacacuagcuccuggauaauugccuguaucauaguauuaucacauggauucuuuccagugaguaaguauauagaaaguagaugaagaaagcauacuaaccaucuagaaaagagugucauuguaacguuaauuugcugacucacuuucuaaagauaagacauaauauaguaauaagugauaaucaaaucuaguuaaauuugaggcuucccauuuuuagacagaaaauauuauucaaucccaggaauuuagugaaauaacagaaacugccugcucuuaauugaaaacaauguggcuacuuuuaccauagccuauuaggucuaaaauauauuuuaaguuugagcugggagcccagaaccugguagauaguucaagaaaaaugaaagcagaaaagacaugguuucguaagggcuugguguaaaacuugaaacaccgaugaguauuugauuugaauuuucauguaguagauuuaacuauacuuuuuguuuuggguucucuuaggcaacuuuagcgaguauagaugcugagcuucagaaacuuaaggaaaugaccaaccaccagaaaaaacgagcagcugagaugauggcaucuuuacuaaaagaccuugcagaaauaggaauugcugugggaaauaaugauguaaagguaaauauaauaacuaaguauuaaggacaauuaucuguauacacuggcacuuuuguuuacuacuaauaguuuguaaaguucuuuucguauucaugaucucauccucacaaacagucguguaguagauguuauuaaccgcauuuuaaauagaucaggagagagcaagagaauaagggcacccaaauagguaaauucaguaggcggcauuuauuggaccucauguuugauucuuuacuauaacauuuuccccaaccugggcaauguggcgaaacccugucucuacaaaaaauacaaaaaugagccuggcaugguggcgugugccuguagucccagcuacuggggugggaggauugcuugagccugggaggucaaggcugcagugagcugcaaucgugcaacugcacuccagccugcacaacagaucaagaugcugucuccagaaaaaaaaaaaauucgugcuuaaaaauuacguuaauaaauuuccauaagugaaaugauuggaacaacaauuaagauuaguucacggaccagacauaguggcucaagccuguaaucccagcacuuugggaggccaaggcaggaggaucacuugagcccaggaguucgagaccagccugggcaacguggcaagaccuugucccuacaaaaaauuuaaaaauuagccuagcauguaggcauggugauacaugccuguagucccagcuauuuuaagagacugaggcaggagguuaaagaugcugugaaccauguuugugccauggcacuccagccugagcaacagugagacccuaucuggaaaaaaaaaaaaaaaaaagauuagcucagggaauaaauuuauaaugaaugggcuugugguugcuuuaaauauuuaaagaaaaguuaaagaugagcacugcuuucuuaauucuuuuuuauuuuagugugaaaaauuucaaacauauaauaguagagagaauaauacaaugaacucuagaguuuucaguuuucaaaauauguccauauuuucuuuauaccucuuuguccuaaucuuuuuaaagauacuaauauugguuguuagcauuaggcauuugacuuggugguagauuuaaaaacuaagaccaaagaaccaaacuaagacucuuaacugaaaaaccaugcauauaacaugaaagauuuguauguugcaguagcuguuuagacuuuaccuuuuugauuaaagccuaauuacaauacaaagagagcauauacacuuggguuuauauugagagccuacuaaaaagcccagucuguuaaccagaguuggaacugacguaaaaguuuucaauauggaguacacauuuccaucuuuuguauuguuuaauguugcuguuugcuguuaacugauucuucaguuuaaaaaugaagaaaaaauauuuuuaaaaaauacaaaaagaauaaaagauaaaaucaacaaaauaaaaguuacuguuuguugauggaggcaaggauucucaugacucuucucuucauauguuauuucuucaguggacucacuauggggccacuugacuugcuuucccuucaccaucagucugaacauuucggcccuauucuguuuauggugaaguaaugugagauguagagaaaucucuaggauggaaaaguacauuuauuucauaucgcagaacaccagagagauguuguucaagauuugcuuuguagauuugcaacuuuuuagacaaaucuuauauuuuauguucaaauaauuaugauuuaaguuaaaaaguguaaagagagaguggaaaugguuuauguuuaguggcagagggaugaaauccagguuccaugacuacuagauuuuuuuuuccacuauaccauagcaguuugaaaauaagucgucuuugcaaauaguuauucuaauuaaaaaaaaaaaaggauccucaguauuuuugucauuaacaaguaauucuuuuccucucaucauauauaagcucuguuagagcguuacuuuuuuuuuuuuuuuuuuuuuuuugagacggaaucucacugugucucccaggcuggagugcaguagugcgaucuuggcucacugcaagcuccgccucccggguucaugccauucucccaccucggccucccgaguagcuaggauuacaggcgugugccaccacgccuggauaauuuuguuuuuguauuuuuaguagagauggaguuucaccguguuagccaggauggucuugaucuccugaccucuuuaucugcccaccucggccucccagagugcugggauuacaggcaugagccacugcgcccggccuguuguuguucuuaaguuacaguuuacaguuuuauguuacaguuuacaaugauuguuguacucauuguauucuauaguuguguggauuuuaaggagugcauaauauuauagguccgguauuuagaauaguucccacaccacccuaacaaauucccaguguuuuugcuauucaccucuacuucuugaacuucuggcaaccacugauguuuuuacuaucuuuauaguauugcuguuuccaaaauguuauauaguuggaaucauacaguauguauauguagcccuuucagcuaguuucuuucacuuaccaguaugcauuuaagauucuuccauggcuuuucauggcuugaucauuuuuuuaaauuacuaaauuauauuccaugauaugaauguaccaugguuuguuuauccauucaccuaugugguuacuuugagguuuuggcaauuaaugaacaaagcugcuauaaacauucauguguaggcugagcaugguggcucaugccuguaaucccagcacuucgggaggccgaggcgggcagaucacuugaggcuaggaguuugagaccagccuggccaaaguggugaagucccaucucuacaaaaaauaaaaaaacuagccaggcauaguggugcacgccuauagucccagcuauuugggaggcuaaggcacgagaauugcuugagcccaggaaguggagguugcagugagccaagaugguaccacugcacuccuuccuaggugacagagugagacucugucuccaaaaaaaauaauaauaauucauguguaaguuauucuuuggacauaaauuuucaguucaguugaguaaaaauaccuagaagugcuagguuguacguuaugacuauguuagcuuuguaaggaacucccaaauggucuuccaaagugguggaaacauuuugcauuccuaucagccaugaaugagagucugcuguuccacaucauugccaguguuugcucuugucaguuucuugggauuuuacuaauguaugguguuauuuuauugucauuuuaauuugcaguuguguuuuuucuuauuguugagguuuucuuuuucuuugagacggagucucgcucugucacccaggcuggagugcaguggcgugauuuuggcccaccauaaccuccgccuccuggguucaagugauucuucugccucagccugccaaauagcugggaacacaggcgcguaccaccacgccugguuaauuuuuauauuuuuaguagagaugggauuucaccauauuguccaggcugguuucgaacuccugacuacaggugguccgccugccucagccucccaaagugcugguacuacaggcaugagccacugcgccuggcccuguuguugaguuuuguuuuguuuuauuuugagauggagucucgcucugucgccuagguuggagugcaguggcaugaucucggcucacugcaagcuccucuuccuggguucaagcaauucuucugccucagccucccgaguagcugggacuacaggcucccacuaccacaccuggcuaauuuuuuguauuuuuaguagcaacuggguuucgccauauuggccaggcuggucuugaacuccugaccucaggugaucugcccgcgucagccucccaaauugcugggauuacaggcgugagccaccguaccuggccuccuauuguugaguuuuaagaguucuucggccgggcgcgguggcucacgccuguaaucccagcacuuugggaggccgaggcgggcggaucacgaggucaggagaucaagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaagaguucuucauauguuuuggauauaagucuuuuaucagauaguguuuugcauuauuucucugugucuuguuuuuuuuuuuuuguuuuuuuuuuuuacucucaacgucauuuuuugagacuaaaaauuuuuaauuuuaaugagguccaacuuaccaaguuuuacauuaauagauuguguuuuugguauuguauuuaaaaacuugucaccaaacccaauaucaccuagauuuucuccuguguuaaaaguuuuuuuuucaguuuugcauuuacauuuagaucuaugauccauuuggaguuaauuuuucugaaagggguaagguguguaccaggauucauuguuucacaucuggauguccaguugaagagacuguccucccuccauuaaauugccuuugcaccuuugucagagaucaguugacuguauuuugugguuuuauuccugggcucuuuauucuguucuguuaaccuguuuaucuguucuuugccagcacuguacuguuuugauuauuauagcuuuacaguaaguugcauagugucaaguccugugacuuuguuuguccuuaguguugugcuagcuauucagggucuuuugacuuuacauguaaacuuaaucaugucaucugcacaguuuuauuucuuccugaaggugaaggaauauacagugaccacaauuccuucugguugagcuuaaaguucauccuuucccugccaccuaaacauccucuuguuaaauuuuaagcugaacgugcacaugauuaacaaugaauuuacugaagagguccuguaaagaggaagugaaaaaauugaaagaggcagaauuuauuaguuugguuguauuuuuguguuuucuuuagguuuacauuuauuuauuuuucuuguuggcauguauuaacauuauucucaguuuuuaaaaaaaggaaggcaaaaaguaagcuguauuuauuuaccuuucguugaaaacaguaauaaaagaaaaaaauaagauccagacuuuguaugaauauugaguaauacuaaaauauauuuuauaaaaagauuuuauagccuaauugggaaaacacacauugaacauuuuuggcuuuaauuuuuuauuuuacuuuuuccuuacagcagccugagggaacuggcaugauagaugaagaguucacuguugcaagacucuacauuagcaaaaugaagucagaaguaaaaaccauggugaaacguugcaagcaguuagaaagcacacaaacugagagcaacaaaaaaauggaagaaaaugaaaaggaguuagcagcaugucagcuucguaucucucaaguauguuauagaacaaaguuuauucauuuuuuugaaacagccacauagaaauuuuauuuauuauacaaguuuucagaaaaaugugugucuauaggugaaauuuaguuguuuuuuuccuagucuagcugcaguaaauuugaaugauuuaacugaguuauauuugccuaacauaaauauggguuauguauagaaauuuaccagaaugaugugacuggugguaacuuguuaaagacuucagaauuccagggugggcaaaacugcagggaaccaguuuccuggcuuggcaacugaaugaauggggccauucaccacuaucagaauuucacaaggagggaagaugguaacguuagauggugguaucuguaaaauuaguauuucauauuugagucuucagugccuuaguuugcaaguuaugaucaccaaugaauuaauugauuacauucuuuaacauuucaaaauuggcuccugaauauuuuaguuuuaaauauucccaaauuuaucauauauagauaaugaaauguuuacugucaaauauucuuaaaguguaugcauauguuuuccacuucauaucaguauauuuuuuccaaaagcaugaagccaaaaucaagucauugacugaauaccuucaaaauguggaacaaaagaaaagacaguuggaggaaucugucgaugcccucagugaagaacuaguccagcuucgagcacaagguauagcuuccaacuguuuaugaguuacaucuguguucuuauuuuaguauaauuguaguaaacuuaauauucacacu

SEQ ID NO: 18464 - RNA, 497 nt, Homo sapiens
acuuuccuuuuuuuuuucuguuuaauuuuuaaugaccaaaacgaagcaucuaaaaccgcagcuucuggaagaaccgcuuguucuugccugucuuguaucucucuucaaacuugaccuuggccucucaucgggccuuguguuuaagaguagggucucugaagacauccuuauugaugacaguuuuguccaaggggauauccacagaguaccuugugggcauuagcugauugugguuauaaacuuucacaaaagacuugaucuuugaccucuuagagaucuucuucuugcccauggcagcugucacuuuguggggacagcggucaauuccagccaccagagcauggcuguaggggcgaucuaagguaccaucaucaauguucuucacgaugauggcuuugcauccagaauagcauccagccagaacaagcaccaccgucccagguuucaugaacuugcccauuucagcagcaaccccucgggccuauagcaaaaaggaa

SEQ ID NO: 18465 - RNA, 4678 nt, Homo sapiens
gcggucuugcgaguggcugguucccugcagaagagcacagaagugaugaaggccaugcaaagucuugugaagauuccagagauucaggccaccaugagggaguuguccaaagaaaugaugaaggugacuuggggcuagcccugcuuuccuuuccaaaccccagagucacucuaaacaaguaacagggggcuagggaugaggguggguggggaugaacagacuacaccugcuagacagaauuaauuuuaaggaguagcuguuaacauugauugaaaccauuugagcucagcauagcagaggcugggucagauugccagaguguucuguagaagaagcaaaagucuacccagagcucuagaggaggugggggauccaaggagcaaccauuuagggaucaaggaaauaaaguuugcaggguccaacauaggcaaggagauggaaagaaacuugauuuacaaaaacaggcagagaccguauuuggccugcagcagcuguaguuugcugaucccuguuuuaaacuaaaaaaggagagacugagaaucaaauagaaagugcguaaauaccugccacccccaggaucagggucuggcaaggaccuguacucguggcccucagacaaggacagggauaaagaaggcauugcugccgagccccggcagccacauacuguccuaucuccuagucuguucuucuagccaucgugagaaguagggauuuuuguccucguuuuacauagacagaaacugagcuuuugggucaucagguaguuucccuaaggucaccuugguuguaagugaagauauagaguuggggcacugcagucugaccuuaucacgugaguugucacagaggaaaugaggaugggaggucccucacacagaugcuguuucaugcuucagaccuguggcugacaaccaagaguguacaccucaaauucuuguauagaggcugugcauagaaaucaccucccuuccucucagggaauuucauuuaugaacuugaauuauguacaggguuuagggcaugggagagaggggcuggaaaagaaaauugcagaaaaaugacauagaaagcccagggcccagguuguuugaaugagaacuccuugggcaguagcaguaaggaaggaacugggucaggaggguauguccuuuacaaauagcauguaggugucuugcccccaaguuggugaucacuguucaucuagaaccagauaagaagaucauucuuggagugccuucaggcuugcucauuuuaacucagccaccaggaucugagagggaagccuuuuucagaaucugggaucuuuuucauaaugguuucugaauacugggaguaauacagauuuggaggaaggcuugcguguaguacauucugaaggccccaguaggggcucagcuccucaagggcaagaacacaucuuagucauucuguuuaucccaggccuauuguguggcacagagcaggacuuugaugaaucguugcugauugaaugaauaaauaaaugacaacuucuaccuccagagugugaagggcuauuacaauuaggauucugguggacucuuuuuaaccaauuagcaagcauuuauugcacuucuuuuaugguagcccccaguacuaagaugaucccauucaggaaggcccuaggguuucaccugggugaacaugaauaugaauuuauuuguucauuuugguugggaagaacggaucugaggaugggcagaauagggugcuaguuagauucaggcaggcaggauagaggguugcuuuaaaucugaacccuucagcauagucacugagaauuguacccuggcugaguacaagggagccagggccggagcugcuacaugugaccuucugcuccuugaaucaccaaaacaucaagguacaaagcaagggacuuaguuuuuucagguggcaagacaaccaggauuuucuuuuucuagcaacuucucagaaaccugaacccaugcccuccaccacagccacucagcacccccaguaccuguucugcccagggaugucagcagcccucuuguugacuuuggagguugcuguuccgacccuuugcuucaguaacaaagaacauucaguagggcccuaucugggaguugaggaacugcugagcacaaagacugcagggcuagguuggguugggccaguguuaaagccauuugcuuguguccugcaguggugccaugcugccuugagaacagaggaggcugacuggcuggcuccugcaggcugccaggcacaggacuuccagaaaagugucuggccuuuaccuuguugaguccagaaguauugucuuaguucucccaggagugggugaucagauuuugguuaauugauccuugcagaccuaccagauuaccccauucuggcagauguaaccuggacaagcuggaguccucuucaggccuuuuuuggcuuuuacccugcuguuggcauuuuuuuaucacggcaucuacuacggcuccaaccacuuuucauaccauauuccaaccccugcguucacggauuauauuugcaguguuaggacagaugcuucccaaaacagcgcuggaaauacacucaucugucagugagcuguuucucaggugcugccauuauauuaagucuggguuacuuuaggaagcucugcugacagccaguaguagcacuccccaccccuaggguguuaaauuuagagagccguuucccuuuggggcuuuugcauuucugcagagaggacaacauccaguguuuccuuuggccagcugucucgugugucagcucuugaaaggauagacuggacuuaggcuagagcucggucuaggugauguguagggugucugaugggaacagauuuaacaguugaccgaagugacauauuuauucuguuuaggcugggaucauagaggagauguuagaggacacuuuugaaagcauggacgaucaggaagaaauggaggaagaagcagaaauggaaauugacagaauucucuuugaaauuacagcagguaugaccgugagauccauccuuucuccucucuuuuuauggccauucuuccuucauucacuaaauuagcuaguagcuuuuucuuuaggcauuaacucccuucuacauuuuuaacguuuuacacugugcagcuuauuucuugaaaaguaagcacaauaucuauaaccaucuuuuaaaaaacacaauucuuaaaauuuuuagaguuugcaugauuuuaaaggaagauacugcucucauauacugcuguugggauuuuaaacugguguagacuuucuugaaagcaauuuggccauagccauucaaaagcccuugccuucgccaagugcgauggcucacgccuguuaucccagcacuuugggaggcucaggugggggaucgcuugagcccaggaguuugagaccagccugggcaaccauagcaagaccgcaucucaaaaaaauauauauuaaaaaaaaaaauuugaccuaauagauugacuucugggaguuuaaugaaauaauuaagaaugugcugaaauauuuaauucaaggaugucuguaguagcauuauuuauaaaaaugaaacguuugagggccaggugcaguggcuuaugccuguaaucccaacaccuugugagggaggcugaggcaaguggauugguugaacucaggagcccagccugggcaacauggugaaacccugucucuacaaaaaauauaaaaauuagguaggugggugugguggcacacaccuuagucccagcugcuugggagacugaggugggaggauugcuugagcccaggagguccaggcugcaguuggccaugaucgcacuacugcaguccagccugucucaaaaaaaaaaaaaaaaaaagguucgaaacaaacuaaaugccuaauaaaaucauuuguguuauauuuauuuuaauggaauacuauauauugugauagaugguauagaaauauacucguuaacauggaaugauguuuacaacaugugaauaaagccuuuuuacugaaauacauacuuuuguguaaaaacaugucuauagaagucuggaagggagaugauaaaaauaguaaucuccaagugaugguuaaugaguuuuuaaacuuuauuuuuacuucuagauuuucugaguuuuauguuuaauuaaaaaaauggugggguuuaauuuuuauuaguucauuuguuggguuuaaguuguuggggaaaggaagacaguuacuccaagaaaauauuuugugaagauuuagaaacaauuuaguuuuauucagaaagaagauuuaaaguuuucaguagcauuuaggaauuuagauuaggagcuucagaaccgagauucuuaaaauccuuacaauuauuaugacuuugguaucauuacagguagcuauuugcacauuucccagagugaguaaacccccccaaaaacagcuugcuguacugucucauuuuuguaucuggucagauugguccaggaaugaaaggcagggaagauugaggggcugcuuccuuaagccaaugugguguucaucuuugcucuuucuuuucaggggccuugggcaaagcacccaguaaagugacugaugcccuuccagagccagaaccuccaggagcgauggcugccucagaggaugaggaggaggaggaagaggcucuggaggccaugcagucccggcuggccacacuccgcagcuagg

SEQ ID NO: 18466 - RNA, 4678 nt, Homo sapiens
ccuagcugcggaguguggccagccgggacugcauggccuccagagccucuuccuccuccuccucauccucugaggcagccaucgcuccuggagguucuggcucuggaagggcaucagucacuuuacugggugcuuugcccaaggccccugaaaagaaagagcaaagaugaacaccacauuggcuuaaggaagcagccccucaaucuucccugccuuucauuccuggaccaaucugaccagauacaaaaaugagacaguacagcaagcuguuuuuggggggguuuacucacucugggaaaugugcaaauagcuaccuguaaugauaccaaagucauaauaauuguaaggauuuuaagaaucucgguucugaagcuccuaaucuaaauuccuaaaugcuacugaaaacuuuaaaucuucuuucugaauaaaacuaaauuguuucuaaaucuucacaaaauauuuucuuggaguaacugucuuccuuuccccaacaacuuaaacccaacaaaugaacuaauaaaaauuaaaccccaccauuuuuuuaauuaaacauaaaacucagaaaaucuagaaguaaaaauaaaguuuaaaaacucauuaaccaucacuuggagauuacuauuuuuaucaucucccuuccagacuucuauagacauguuuuuacacaaaaguauguauuucaguaaaaaggcuuuauucacauguuguaaacaucauuccauguuaacgaguauauuucuauaccaucuaucacaauauauaguauuccauuaaaauaaauauaacacaaaugauuuuauuaggcauuuaguuuguuucgaaccuuuuuuuuuuuuuuuuuuugagacaggcuggacugcaguagugcgaucauggccaacugcagccuggaccuccugggcucaagcaauccucccaccucagucucccaagcagcugggacuaaggugugugccaccacacccaccuaccuaauuuuuauauuuuuuguagagacaggguuucaccauguugcccaggcugggcuccugaguucaaccaauccacuugccucagccucccucacaagguguugggauuacaggcauaagccacugcaccuggcccucaaacguuucauuuuuauaaauaaugcuacuacagacauccuugaauuaaauauuucagcacauucuuaauuauuucauuaaacucccagaagucaaucuauuaggucaaauuuuuuuuuuuaauauauauuuuuuugagaugcggucuugcuaugguugcccaggcuggucucaaacuccugggcucaagcgaucccccaccugagccucccaaagugcugggauaacaggcgugagccaucgcacuuggcgaaggcaagggcuuuugaauggcuauggccaaauugcuuucaagaaagucuacaccaguuuaaaaucccaacagcaguauaugagagcaguaucuuccuuuaaaaucaugcaaacucuaaaaauuuuaagaauuguguuuuuuaaaagaugguuauagauauugugcuuacuuuucaagaaauaagcugcacaguguaaaacguuaaaaauguagaagggaguuaaugccuaaagaaaaagcuacuagcuaauuuagugaaugaaggaagaauggccauaaaaagagaggagaaaggauggaucucacggucauaccugcuguaauuucaaagagaauucugucaauuuccauuucugcuucuuccuccauuucuuccugaucguccaugcuuucaaaaguguccucuaacaucuccucuaugaucccagccuaaacagaauaaauaugucacuucggucaacuguuaaaucuguucccaucagacacccuacacaucaccuagaccgagcucuagccuaaguccagucuauccuuucaagagcugacacacgagacagcuggccaaaggaaacacuggauguuguccucucugcagaaaugcaaaagccccaaagggaaacggcucucuaaauuuaacacccuagggguggggagugcuacuacuggcugucagcagagcuuccuaaaguaacccagacuuaauauaauggcagcaccugagaaacagcucacugacagaugaguguauuuccagcgcuguuuugggaagcaucuguccuaacacugcaaauauaauccgugaacgcagggguuggaauaugguaugaaaagugguuggagccguaguagaugccgugauaaaaaaaugccaacagcaggguaaaagccaaaaaaggccugaagaggacuccagcuuguccagguuacaucugccagaaugggguaaucugguaggucugcaaggaucaauuaaccaaaaucugaucacccacuccugggagaacuaagacaauacuucuggacucaacaagguaaaggccagacacuuuucuggaaguccugugccuggcagccugcaggagccagccagucagccuccucuguucucaaggcagcauggcaccacugcaggacacaagcaaauggcuuuaacacuggcccaacccaaccuagcccugcagucuuugugcucagcaguuccucaacucccagauagggcccuacugaauguucuuuguuacugaagcaaagggucggaacagcaaccuccaaagucaacaagagggcugcugacaucccugggcagaacagguacugggggugcugaguggcugugguggagggcauggguucagguuucugagaaguugcuagaaaaagaaaauccugguugucuugccaccugaaaaaacuaagucccuugcuuuguaccuugauguuuuggugauucaaggagcagaaggucacauguagcagcuccggcccuggcucccuuguacucagccaggguacaauucucagugacuaugcugaaggguucagauuuaaagcaacccucuauccugccugccugaaucuaacuagcacccuauucugcccauccucagauccguucuucccaaccaaaaugaacaaauaaauucauauucauguucacccaggugaaacccuagggccuuccugaaugggaucaucuuaguacugggggcuaccauaaaagaagugcaauaaaugcuugcuaauugguuaaaaagaguccaccagaauccuaauuguaauagcccuucacacucuggagguagaaguugucauuuauuuauucauucaaucagcaacgauucaucaaaguccugcucugugccacacaauaggccugggauaaacagaaugacuaagauguguucuugcccuugaggagcugagccccuacuggggccuucagaauguacuacacgcaagccuuccuccaaaucuguauuacucccaguauucagaaaccauuaugaaaaagaucccagauucugaaaaaggcuucccucucagauccugguggcugaguuaaaaugagcaagccugaaggcacuccaagaaugaucuucuuaucugguucuagaugaacagugaucaccaacuugggggcaagacaccuacaugcuauuuguaaaggacauacccuccugacccaguuccuuccuuacugcuacugcccaaggaguucucauucaaacaaccugggcccugggcuuucuaugucauuuuucugcaauuuucuuuuccagccccucucucccaugcccuaaacccuguacauaauucaaguucauaaaugaaauucccugagaggaagggaggugauuucuaugcacagccucuauacaagaauuugagguguacacucuugguugucagccacaggucugaagcaugaaacagcaucugugugagggaccucccauccucauuuccucugugacaacucacgugauaaggucagacugcagugccccaacucuauaucuucacuuacaaccaaggugaccuuagggaaacuaccugaugacccaaaagcucaguuucugucuauguaaaacgaggacaaaaaucccuacuucucacgauggcuagaagaacagacuaggagauaggacaguauguggcugccggggcucggcagcaaugccuucuuuaucccuguccuugucugagggccacgaguacagguccuugccagacccugauccuggggguggcagguauuuacgcacuuucuauuugauucucagucucuccuuuuuuaguuuaaaacagggaucagcaaacuacagcugcugcaggccaaauacggucucugccuguuuuuguaaaucaaguuucuuuccaucuccuugccuauguuggacccugcaaacuuuauuuccuugaucccuaaaugguugcuccuuggaucccccaccuccucuagagcucuggguagacuuuugcuucuucuacagaacacucuggcaaucugacccagccucugcuaugcugagcucaaaugguuucaaucaauguuaacagcuacuccuuaaaauuaauucugucuagcagguguagucuguucauccccacccacccucaucccuagcccccuguuacuuguuuagagugacucugggguuuggaaaggaaagcagggcuagccccaagucaccuucaucauuucuuuggacaacucccucaugguggccugaaucucuggaaucuucacaagacuuugcauggccuucaucacuucugugcucuucugcagggaaccagccacucgcaagaccgc

SEQ ID NO: 18467 - RNA, 1833 nt, Homo sapiens
uuuuauuccuauaucaaaugaaaaguauuuuugcauuaagauuuuugcuguauauuucauuucagacuuuaagaaaacaaauauuacauguaaguauaucuuaaaagcgcucuaaaugcauuuuuaaauugaguaaauauaguuaaguacuaaaacaacaaaauucauuuguccuauacuaacauguacuauagcauauagcucaaaaaguuaguagaauacugggaaauugcaaguaacuguaugaugccuauugcuuuaccugggacagcugaccaaaaaauguuucagggguauguuagagcuaauuucauuacaauucccggugacuaacaccacugauagagaccauaaaagagaagguggcucuuuuguccuaugaauuaucaauuagaucugcuucuguggugaaauuuguuagcugaaaauugauggcugaaaccuuaggauuuaccccugucuuuaagcuccuacagcgaggucuguagaccagaagccuguacugaacucacaccacaagggcagcgccaaagacaagaugcaagcgcugcaacagcaaguuauauaacaaaagagaaccgaggacaucagaacgugcuccaaugauacuuuguaucuuccuggugcgcaaaaauguaaaccggccuuccuuuaugguuuacauuguaccccugcacaacgguuugcuaucgcguaauuugggaggugacacauaugaaauuugagggugugauuagucuuuaaaauaauaguuuugguauauauuuuaagcacuucuagcgacccccccaacacacaaacacacacacacacacgcgcacacacacacacacacacgaagaagaugcuaaggugggccacugccccggcucuggccagccgcauuuagaggggaaaaggacaaauggcgcuauuucuuuaagcuugguggggggaaaucuaaguuuguucuuuaaaaagggcgaaaguucgcuaggaccacagggccuucggcgagagcgcaggcagcuucguguuggcaccuuggggaucuucugggcugccagaagcucugagcuugcaguugcaccuaaaccgccgcuuucgcuacuuauauuugcgguaauguuaggaagcaaaguaucaucaaucagagaaucugguagccauucucucucuuugcccugugucccagcuugugauucuucuaaguuccaucuccuuugcugcgugcagauccuuggcuuugggcgcgcuuccucuucugcacuugggccaccgcggguuggccaccugggcugaacucaucccauccuugcuuucccccaucccuauacccagcggcgagggcagccucaccagcccuugccccggaggugaaugugugccuggcuuugacugagacaacuaggaccccagaagcccagugacaucagaaaagaggcuccugggcacuagcacuucccgcaauacgcuccagggcuguaggugcaaaacggagcucuaacuucccuccagcuaaucgagaggaaaauacagggcgcgucacaguggccucucccgccuagccacgcgcagugaaauuuccggcaaucgggccagcuaagacacgggauuugcaccgcagccucucagcuucuggagccggagccgagcgcucccggcagcuucuccaauuucucuccuaaagugcgaagggaaaagccccgucugcuccacgacugcaaggccggcggaucugggagccgcgcccggcuccggaggacucggcgggcccggggcuccccggcagcggcuccucugcuagggguuaacagcagcccccgcggccgggcgggcgcggacgcuuccucu

SEQ ID NO: 18468 - RNA, 646 nt, Homo sapiens
cccgcacccaccauggccacaguucagcagcuggaaggaagauggcgccugguggacagcaaaggcuuugaugaauacaugaaggagcuaggagugggaauagcuuugcgaaaaaugggcgcaauggccaagccagauuguaucaucacuugugaugguaaaaaccucaccauaaaaacugagagcacuuugaaaacaacacaguuuucuuguacccugggagagaaguuugaagaaaccacagcugauggcagaaaaacucagacugucugcaacuuuacagauggugcauugguucagcaucaggagugggaugggaaggaaagcacaauaacaagaaaauugaaagaugggaaauuagugguggagugugucaugaacaaugucaccuguacucggaucuaugaaaaaguagaauaaaaauuccaucaucacuuuggacaggaguuaauuaagagaaugaccaagcucaguucaaugagcaaaucuccauacuguuucuuucuuuuuuuuuucauuacuguguucaauuaucuuuaucauaaacauuuuacaugcagcuauuucaaaguguguuggauuaauuaggaucaucccuuugguuaauaaauaaauguguuugugcuaauauaaaaaaaaaaaaaaa

SEQ ID NO: 18469 - RNA, 4655 nt, Homo sapiens
agauucaagguuuuaauuaauucccauacugauaaaaauaacuccaugaauucuguaaaccauugcauaaaugcuauaguguaaaaaaauuuaaacaaguguuaacuuuaaacaguucgcuacaaguaaaugauuauaaauacuaccuucuggguuaagaaaauuccauucaaauaacauucucauguaaauacucaaacauacagauugaggcuuccagaaauuaauccacuugaggcguccacgcggaacaaggucugcugaccacaguuacacacgucgugacaccacuguaucacggcgaaugucgaacacuagaguuacagacgacaggcaacaagaacaugcagagccggccgccagccagcuccuacgccccgugcccgccauggccacaggggggagcugcugggcgcgccuccaccucagccuccacggggcaccuuccagccacugcugugccucagccaccuaggagccaucccugaggccauggccaccaagacaggugagggaggccccagggcacacagccccaggaucuugcccccauuuccaacccuggcagcgcugccagccauucuuuggucuucccacugcucaccuguccucagagccaguacugaucuaggggagcaggugccaccuccaucucccagcuguccccccaccccuggggcuccccagcucuaccaccccggaagcugagcccuggagacacccugaggggcgggcgccaccuccuucccagaaagagcagagcagcuggcagacuagagcucagcugcuccugaccacugacaaccgggagaugucucggcagacaccacuuaucccagaaaagaccagaggcuccaaaugggaaccaagugcauaaauacaaauaaaaacagaguuuacacaucgaugacaguagcacaaaauauacguaauuucuagauacugagcuaauaaaucacuguaguuaaaaacaaaauagauucacugaaaccaagucgauaguuaccuuggaguaguggacuagcugcagaaugucacggacccacuuccuuuaaaacaacagaauguugcuaucaguuugucuuacguuaaaacaguucuuaaaccaccuacuauauuaaauacauucuaauuuggucacugaugauaaagauuuuuaccuagacguuuugcacuuaaaaaaugcuauuaaaagucuuuggcaaagccacggucggggagaaacacgucggugccgcuucccacucgugugcccucaccacccacguggcccgcggagagccaggucgccguaaaccacagaugccuguuccugcucaacuccuagggacagucccagcccugagcagaagggucaggucaucgcggggaugcguucucagucacguuucugcugcggccgaaaccacacugucgcuccaggggcagacgggacaggggaccacagcagagccgggaccuggggggggucgcuucccccgugugcuccaggccacugagaggcuguggccggguccucuccugugaccucacuggccacauggaugagcuccgaugauaacuggcagcgcgggucaggugacugccacauacacccggcaccccggacccuggcgcacacacggcccgagcaucucccacacgagcaggaccaggguggucacgggugcuggggaggcaaccacucucccaguucacugccugaccccugccaggacgcccagcgacaucuccaaggagcuacaaagcaccauugccuaggacagcucugaguaaucagaaaacagcuuuuuuuuuuuuuuuuugagccagagucucgcucugucacccgggcuggagugcgguggcgcgaucucggcucacugcaaccucugccucccagguucaagcgauucuccugccucagccucccgaguagcugggacuacaggugcccgcucucacgccaggccaauuuuuguauuuuuacuaagacgggguugcaccauguuggccaggcuggucuugaacuccugaccuuaggugauccacccgccucccaaagugcugggaucacaggcaugagccaccgcacccagccagaagacagcugcuuaaaaaaguaauucuaaaagcucugacgucggauccccucugcugcguuuuuuguuaguaucaaacugucuuucagaggguuaagggagaaaacaaaacccaugaugcuccuucacuugcucuccgaggcgcaggcgcacagaaacagcggccacggaccacagaaaugcaggacggagcucuccugcucccacgccacgaggcuggaacaucagccccagugccuggugcacacacaggcucaggaaaacuagcuccuuccaucaaguuaaaaacaucucaauccauaaucacucugcuuauaaauacuauuugcacuuaauuggaaaauguaaaaauccuaggucuuacuacuagauaaacacucauuucauaaguacuaguuucagaauaugaaaucuaauauauuuagcauacuaugaauugacaauaaacugauaugaaauauuuaaguucacaguacacauauaaagcuucauauuaucgcauauuaaaaaaaaacagaaagcagcuuagagcaauuuauaaccucuaacuaaauuccucgguuuacaaagugcuuugaaagaccccagcucccaguggccuagucacaguagugucaggaccacaaacugcugugaucacagcgccgcguggaucccggaggcaccaggccccucagggacaggcaggcggguucuguggguuugcauuuaagguuuuugaggaaaauaccuugaaaccgucgguaggacuagauaggugacaacgugugacaggaaaggcugucaggccaagcgcaggcggggcucccagccucaugauaacguguaacaggaagggcucccagccucgguccucacgucgguggcaccagaagcgagugacgacauguccguggucaggaggagcgcuggagccagggugcccagcaggagguggcuguccccgcugaggucaccacugcaggggcuggcccuugcaguaggggcacucaggugcgguggccgcacacggcucacagaggauguggugcugacagggccgcaggacagcaccgugggcccgcucccggcaggccacacacugcuuggcgcggagcuggaagaucaccugcagggccagaacaaugacgggcucaggaggccccugcccaggcugggccagcuggggagccggagggccuuccgggcaggacucagcaucucaggccgcccggccaccagcuacagagacagggucagggagacgccccagccagggccaccucagggagaaggcagcugcggggucaggggguaugcucugucuuaagagcccugggcagaggacagccuccuggggccaccacagacacggcaguggccagacaggccaggccccugagggcagcugggugcccaggaugugggcuacgcaggacccucuguccuauagcagcgaguccaagagcccacccuuagcaggcgaggugaggaggggcacgccgaaguggaggggucaugugugagggucacagcugugaacagggagggauggggccacggggagcaguguggcauucgcugacaagagggaggggugaaagggcaagggccagccugacaggaaaggcggcucccagggagacaggcaaggaggccacagggggcugugcugggguggggcaccgucuccuccucccuaggcccggagcagacccuggggcaggggaggaaggggacaccgcaccagccagggcccuccccagacagggacagcagcccugcaggcaggcuggccccucacccugcccagagcaggacucacgccguccaccgccuccagguccaggcgcagcugacucugcagcgagugcagcuucggcaggggaauggugccgauguccccacagccccgcagccccggcaguguggaggcuacgcccaggcccuccagcuccuccugcagcugcuucaccugugccuccaccuccuccuucuucugcagcgccagcugccggucgcuaucggccacacgggcacgcuccuuggccuccugcgccucucgcugccaggcaucgcagaccugaaacccagggcccgucucagcaccccccaccucaccugugccaccugcagacccucuugccugugucaccagcgauccuccccuccccuccccagcaucagcuguggcccccucaccugagaccccugcggcccucccucccucccucccucccucccucccccucccgucucaccccccacacgcucaccugagucaccugcggcccucccucccuccccucccaucucacccccacacgcucaccugaguccccugcggcccucccucccccucaccugucuggcccccccacacacucaccugcuucaccugcugccaggacuccucccacugccggaucuuccucuuggccucguccagcugccgccugacccgggccagcucagcuccguuuggacuugcacucgaagaggauggggggccggcacucaggaugggggaggggcugggggagaagcugccggaaacaaagucccagaugcucccggggacaccguucaaaccug

SEQ ID NO: 18470 - RNA, 57323 nt, Homo sapiens
uuggguuaccuuuuagcgcggcccaguuagccgcaaccagccaccauuuacccgcuuuccccaaaccaggaaaaccacagaaacgcaugugcgcggccagucucuuccacgcccgggaacgcagagcuuacagaccaaggccgcccaaguccccucaccccaaaggcuacccaagaaccccgaguaggcuguuuggcugacucaggcgcccaacgcccacccgaacugagucgcuagggaaacucccaacugccagcucgcccgaccgguguucacaggccacucuagccgggcucagagagaccgcagucucguugcuccuggcuugacgucaucggcaggcgccgcagcgcaguggcgggcacgcgcagccgagaagaugucuccgacgccgccgcucuucaguuugcccgaagcgcggacgcgguuuacggugagcuguagaggggagggugcaggccugacccggcgcuaugcuuuguccucuucucccugaaauuacucgaauuuugcccugggguaaagugagacagagguguguccgccucagcguccgcuccgggccccgucggagguugagggguagggaaagacgcacuacccgccucuucuuugugggcugggccguccgccuccgcccacccuccagcggguccccggacugcgugcugggcgccucggcuccccgcuuggagugcccaccugcagacuacugcugguuggguccauccucucagcucguuuaguggggcaggugucucgagaaggggaaggggagcugcugaagggggagggugggagugguuucaguccaaagaccuggcucccgcccuagccuucugagcuaccaagugcuuguucccgccgucucuucaccaccccuuaacccaccgugucuaacuccuaagcgaucgaugagauccuaagcgggaaaaggcagauagaucaccuugggaaggguaaccagaugcuauuuuauucuugcucaauguggaagggugguuuugagcauuugggaaacacuugacagaucacuuucucauuuaacuauuagaguaacacugugaaguaggcuaaguugguuauuccugguacaugagguagaagcugacaccccccaaaaaguugugacuucagugguuuuucugacuuuagacacucuguucuuuuuauguugcucgucacagcaacguaaguaugaagaacacuuuuaaguugccugacucuauucgucucuagcauuugcaccaacauuucucagauauucggcuguguuuugguaguuauagggaugccaggaugaaaauugugugaaagaaaaauucauccuuuguaguaaguaguuuucuuguuugcaggguuauauauauauauauauacauauauauacguauacguauaauauauauauacacacacacacagugugagguuuuuuuuaaauggauuauauuuuguguaugucaucauaaucauuuucuuugugugcguuuugcugcaaucucuggugcuuugaaagccugcuaagaguaacuguuaggacuauccaagaucauauuggcggccgggcgcaguggcucacgccuguaaaugcaguacuucgggaggccgaggcgggcggaucaccugaggucaagaguucaaggccagccuggccaacauggcaaagccccgucucuacuaaaaauacgaaaauuagccaggcgugguggugggcgcuguaaucccaucuacuugggaggcugaggcaggagaaucgcuugaacccggacagcggagguugcagugagccaagaucaugccagugcacaacaccugggcaacagagggagacuccaucucaaaaaaaaaaaaaaaaaucauacuagcccugaaaaggaccaugaaauuggagaucaucuaguucaguguuucucaagcuucuugugaaaugcagauucuuguucaguaaguguggaagggagccugagauuuugcauuucuaccagcuuccuaggugaugccacuguagcugcugcugguaguaaaaaucuacaaaaacccucuuauuuaacuggugacgaaaaugaagcacaaagagauaaaggaacaggccccaaauuacucagccuguuaguggcagagcaaggaauggacacauuuaggauagaucuaauuccugugagguaauaagaugacuuucuaaguguaugugaguguucauagaaugaaugccuuuugcaauauuuuugucuuuaaguuaugauuacuuuaaaacaaucuacagauugucagcaugguuuuauugagugcuacgugucagggacugaacaagauaccuccaggaggcgagaccugacaugggugugggagaauggauagaauuuggaugagcagguaggaagagcaacaugaaugugugaauacaguagaaugaguuugauauaaagugaugaaaaauggcuagacuuuagugcaaaguauguguuagggaguauugggaauuaaguuuggguaaauugggauaacauuaucaaggaccuugagggaucuaugaagcuucaaaacuaaaacgggcaaauaaggagccauauggagauuuuuuuuuuuuguaagcacaauacucaugaaugugauauuuaaagagacagaaauaucaccuagaaugaaaaaguccagcaaggaagcucuugccagauuuaaagugaugaggauccguaucaugaaguagcauuggaauaaggauuacugagagaaugacugauagguaauuuuucccagguauaagcauuuuuuaguuaguaagauacacuaucaaugaacgauauauuuuucagcaaauaauaagcaaaaucuuuacaauuauuugccauuuuaauuuuuuuuuagaagucuaccagagaggccuugaacaacaaaaacaucaagccauuguuaaguaccuucagccagguaccuggcagguaaggcauugauaucuaugaaaaauacuugccucaaucuuuauacauacccugagcuguuugaaaaaugaggaugucuuuuguuuuuaauagugaaaaugaaaaaaaauguacccuugaccaagcuuucagagguauucuagaagaagaaauuguaaguauguuuuuccauuguuaaaauuuuacugacaaauuaauaaaccauguuauuuaaaaauugcuuuuuuucuuagaauggauauuuaaacaucuuuuuuuagaguaaccuuucugcuuuguaaaaguugacuugaugacuauacgauuucucuaaggauuuugauagcacagguacauuuuaaggguuugguuuaauaaaugacaagagcccucuccaagugagauaagaaaaguugacaugaggucuuaggaagaacuagaggugaaggugggcucucucacuuuccuguauaagcagugauacauccuguaguggcgcaaaaggucuaguccaagaauauuuagcuuaggagcugggauuccauucccucauuuuccucuggcauccuccucaucaguaaacuuacauaaauaacugagggcucuccaacuucgguagagaagucuaaccaugaaaaaucugaauuuguuuaccaauaauggggcaccugaaugaaaggaaaaguuucaacaguuuauucuuggucaagcaaagguuggguccccaaaagcuagauucccuucuauuggccauaguacaaugucccuuucucucagacaagucugauuaaaaaaugauucuuuccuuuucuucagacuuagucacuuuuccauugugaggcauugggcaaguucuuuuccuuuucugugcuucaguuucuuuugugagaggggaaauaccguucuuucaguguuguuguguguaaaacagcacuuaaugaacacucaguaaaugcugguuauuaugauuuuauagaaccuaagcacugucuuccuucuauuaaaaccaccccucagacacauggguguauuaguaguuaauucucauagcccugccuuugcccugugccacuggcugaguuauggcuucagcacuucuguccuugauuagcuuauagccuucaucuugcuaauauaaccauuuucuugagaccauuggauuuugagugaguugccuguuacuugacauacuucuacgacuauugauucuauauguuacuguuaaauuuugguaacuucauauuagaaaauauuguuuucuauaagaaauauuguauuccauauuucugauagucaauuuaauaucagaguacauguuuuuacuguuaaucgaguuuagucugaacucuugccccuaaauuaaauuguuucuccucuguugguagauaaaucauucaucaugugaaaacguuuuagcuauuauuucucuugcuauugggggaguaacugaagguaaguaugguuccguuuuguuuuguuuaaaguaaucuuggacaugacaugcuuuauuuaaaacgucuucuccccauacuucuccaccuaucugauuuuguuuauucuucaaguucugccugacucccaacuuugccaagaagucccaguugaauuaguucacucuuauuucucaucucuauuaugcagugcacauuuuggcacuuccuuuguucuccaguuguuuuguucauucaguaaauuuucauugagcaucuacuaugugccugguacugagcuaggaccuggagauucaauggugaauaaaacauauuccccugcuuauguggagcuaauggaagaaacagauguaugcaugccuuacuaugguguaaguacuauggucgaagugggaaugaaguguaguuagagggaauagagccaacauggcucucuaaacuucagucuaaaggagucaggagagguuuuagaaaagaacaugagaacuagaaugugagguaugaagaauuuguuagacauacuaagaaaggaauagcuagagaauuguguacagcaggaggaggagaggacaaugagaaugaugaggaaagaagcagguuagguccauuuauaaagggcacugggugccauacuaaagagcagcugcaggccgggcgcgguggcucacgccuguaaucccagcacuuugggaggcugagacgggcggaucaugaggucaggagaucgagaccauccuggcuaacacgaugaaaccccgucucuacuaaaaauaaaaaaauuagccgggcgcggugucgggcgccuguagucccagcuacucaggaggccgaggcaggagaauggugugaacccgggaggcggagcuugcagugagcugagcucgagccacugcacuccagccugggcaacagagcaagacuccaucucaaaaaaaaagagcagcugcagaugaaugauuccauuugaagugacugcuggcaggaaaacugggcaggagccuguuaaaauggcugugugugauagcuuuagaagacuucggguaaacaaugcacauaguacacagagccuaacacaaaauaggagcucguuaaauauaugcagaaagaagaaauaaaaaauuaguuuaucagcauucuucuuuaaccaauuugguuaaaauacucauuugauuaauucaaauaauauaugugaaaacuccuuuuuaaucuguaaagcauuauucacauuauguguuauuuugaugcuucuauaaaaacuggcacacaccucccaguauaggggcaaacuauuuuaugaacuuaaguucauaaauucacuuuguuaaauguuuauacaagcugccuaaucauucauucauuaggcauaguuagcugagucccacaauguaauauuccuugucuaguuucagucaaacaguguucaguguguccugaguucauugauuaccuuuauacauuauucuugcacagcuggugauguuuuuaaugaagaaguuguacaaagucuagucuauacuuggaacuuuugagaaggauaaggacuuaagagcuuaaacuguaaaggcauagugcauuuuuauuuuagggauaauuuuucuuuuugagacagacuauaauugguuaugugacauguuuuuaaauuauccauaaauauauuuuguuaaauucaauuuggccgauauuuauugagcuucuauucagugugagaugcuacugguuaaagcauacaaaaaugccuaaccuuaaaaagcucauagucuacauucaaaggugacuaguuaggaugugcuaaaugcuacaguauauuuauguagagugugcuucaaaagcauagaugaaguagccugcuucaggauaucagaguuauuuagaugagcugacauucacucuaugcuuagaaagauggaguugaaauuuaccaugugguaaagaggaggaagaguaugcagaaaacaacauugugaacaaaaccauggaaggaugaacauggcaugguguuugggaacuggggagugggaacuagaaagggaugucuguggcccagguaaggguaaggagagagauugguguggaagcugggacacagguugugaaagcucuugggggaaucacacuauaacccaaugguucccagacuugcuggcucaucagaaccaccagugaaucuauuuuuagaugagauucccaaaccuugcuuaguucuacugacucagaauuuuggcaguagaaucuagaaaaaguucuauaauuauuaaaugugaguuaacuuauuccaggcuauacugcaacuaagggcagaaaauaugcuucucaaaucucuuggaugugcaggguauauaauaucauugaaucuaaguauuguuagggacuuuagaggucaccuaguccagucucaucucuggccuagacugcuucucugcuguaacaucccugguggguggucauucagccucugcugaaucaugcucauuaguggagcucacuguuugaguccuguuagacaaaugugguuauugguguguucccuuguauugaguugaaaucugcuguuuuauuucacccacugcuucuaggcaauaucccucacgucgcauuccagauaugaucuuacuagugcagaguacagcuggaaauauuucuuccuuuuuucuggacauaguauauuaaugcacuguuuugggcuuagaucacccuagauauuuuuccuccauauaccaugccuaagugacuacuuuucuuaaacacuuaugaguguuaguaaguacucauugccuuaaaauagaaggaagaaugaguagggauauaaaaguauucuaaguagucuagauagacuacguagaccuuuucuuaagaaaaaucuuaauuuuguuguucuuuaaacaguaacuuucuacuuuuccauucuuuccccugaaacaauacuguuauuuuaaauguugaaucauaguuaauaucaaaccuuguuauuuuuugaagauaaucuuuucaaaucacaaagacaauuuagcaacauuacaaaacauuuagaaauaagaagggaaaacaguacucuuaauuccucuacuuuuaaaagcuaccauucaucugguauaaugguuuuaguuucuauagucuuuuaagaauuuuuuuuauugucauaaccauauguacauacaauuuugaauccugccuuuuuucacuuagcauuauaucauaagcauuuuuccaaguuauuauagucguuauaaccaucauuuuuaauuggcugcauuauauucuuuugaauagcuuaguggugaagaaaacagacuguggagccagacugccuggguucguaucccagcucuaccacuuacuggcucuaugaucuuggugaaguuauuuaaccucucugugucucaguuuucccauucuauaaaaugcaaauaaugauaugcucuaccucauaggauuguaaggauuaaauguguuaguauauguaaaguacuuagugugccugacauauaguaaaugcucuagaucuugucaagaauuauugucaucauuacugagugcacauaucaaaaauuacuuaaguauguccuauuuggggacuuuuagguugcuuccacuucuuguccuuuuaaaaccuuguuaugaguaacaaaguguaccuuuuaagauauucuucagaauuauuuuucauaggcuauucuacucuacaguuuuuuaaacuuuuaaauuggcuugugcuccacuugaagguauuuguaccgcaucuacaccuuuuguauuguugggagauguuuuggauugucuuccuuuggaucagugugacacaauauucacuuuuguggaaaaaaauguugcuacuuggaaaucaguaagugccuuaguuucuuuuccugcuaacuuuaucuuucuauagauccagaauucugaggguagauuuuuuuuuuuaaauuuauuuguaguauugcugaaugccaacaaguuucugccuaugaaaaaauuauauacugcucucucgggagagccaaauaaaaaccauguguggagaaaaacuugaaauacaaaauuugauuuaauuuguguaauaaaaauuaacuugaaaauucacacuuucacauguuuaaaacaguuacuuaguaucauguuuucuuauaucugaaaauauuuuuauuucauugaaaauguuauuugcuuaaaaaaagugaaaguggcauaguagauucucagugcauguuaguguucuuuaauauuucacucuggcaacuuauuauugaagaauguguaacaaguucugaagaagagugauaauuuccgucuuaauuucagaauacauucuauucugcugggaaaaauuacuuacuacguaugugcaaugguaaguaauugagugauaaaaugauugcuuuuuaaguguaaauaugcccagaaaaacacaugguugaauuaaauaccagugauaacauuuuaaagauagauuagguaucugcauuuuuaacuaacaaucugauuuguuagaacucauuauucacuuuaaacuguuuuuguucugggcauaagcuuaaagucagaaacguaguaaaguuugucuuuuucaugucauguugaacuuguuuuguuccuaauuuauaguacuuuuuuguggcagugguuucggcccccaauuuaagaacuacugcuuuaggaaaauacucuugacacacugguuuagaaacuuuuaggugugguuguaauaaacauagaauuaucuuuucuguguaacguucauuuucauauauuguuagaucuccuaagaagauugucuaaaucccagaauacagucuucuguggacggauucagcucuuuuuggccaggcuuuucccucugucugagaaaucagguaagcuuuuaugcauuaaaugaguuuucugcaggaaaaucuuuuccaguuuuuaauagauuaaaaucugucaugauaaugagaaaaaugguucuaaaaaguugaaagacaucauagaaauugucacuuuauuuucuuuuacuuauaaauguauagcaguccuaguauauaauacagguaauccugaaacaaagucauggauucuuuuaaguucaaagcuuauuaauguaaaguugaaucacacugaaacauguagauaugaaccaucauauccguauuucauaauguaugccuauuuuuguguuuggauuuucucucagucacaacuauuuagcuauauagacuuccuuucauuucucuuuuuuuaacaaauuuuuauugugaaauauaacgcucauauagaaaaguacauaaagcgaauaauaaugaaacaaauacuguauaaccacuaucuagcuccugaaaugggacauugcuuguccuccagagccuuccgccuccccaguauguucaaauaugcgagauuuuaauaucuccuugcuucaguccucccuuccuuaauauugggcuaauguaccaccuacuuuauauguucugaggauuaaaugaauuaaaacaugugaagagcuuacauuagugccugcauguagaaagaccuauagcauauguuagcagugguuuaugugcuuucuuuuugucaucuuaugucugugcuguuuucuuucauacuuauuuuauguggucaggguuaauauagauuuaccacuucuuguauuucuggcuuucugucugugaucauuuucccuuuuagacuuuucuucagugcaggucuguguuuugccuaaaaaucguuacuucuccuuuauuuuuuuuccuuucuuucuuccaaacuccuguuaauauugguauuuugaccuccucccaauagguauaagauucuagauuggcacuagauacaggauuucaucucacgggaaauaaucuuuacuuugucuucuguuucccauuuuucuauugacaagucagaugucagucucacuucuugaagauaaucuacauuuuuuucucugcgcuuaagauuuuuuuucuccuuugguuuucuuuuaguuuuacuaugauguaucucuguguaaauuucuuuuuauuuguccugcuuaggauuguggacaucuugaauguauggauuagauucuuccaucuaguuuguaaaaauuuagccauuaucucuucaaauauuguguaugccucuuuaucuuuuucuuuuucuggaacuucaauuaaacauccauuauaccuucucacuguauccucuguuuuuuacuccuuauauauuuuuucaucuguuugucucucucuaccugauucugaauaauuucuuaagaauuguuuuuuuuaguuuucuaaacuugguaaacauuguuacuuuauugucuguaucugguaaugccaauaccuuaaauaagucuuggugggucuguuucuccugucuguuuugacuguuucucacucaugguaucuugccucuuugugugucugguuaucauuggcuguuacguuugagaagaugugcucauugcuacuggaguaucacuacuucuaggcccucucagagaccagagcuaggagagacauauguguauacuaaccauacucaucuguauuuguuucuguaucugucaguauauauuuuacaugaacagcagcaaaaaauaugagauucuacugauaccucugaguugaauccagcaccaguagaucuguuuauuaaccucuuucucuaacaguaagaaacuuggcucucauuaacuauaauguauuuacuuauuuguuauacauuaucacuuuuucauuaauauaauuuacauuugugcuuccaacagaauuauaaauuauucuauauugcauucuguggaauuguucuggaauagucaugaauaauaaggaucaacucuauuauaauguauauagaauucuguuuacagacauaccguggguuuuguuccagaccaccacaauacagugaauauugcaauaaagcaauauucauucaaccaacauuuuuugguuucccagugcguauaaaaguuauguuuacacuaugcuguagucuauuaaguaugcaauagcaucuaaaaaaauguacauaccguacuucuagaauacugcuaaaaacugguaaugaccaccaaagccuuuugcaagucgucaucuuuuugcuggugggggucuuaccuugauguugauggcugcugacugauccaggguggugguugcugaagguugggcuggcuaugacaauuuucuucaaauagcacagugaaguuugccacaucaauugacucuuccuuucacgaaagauuucucuguagcacaugaugcuguuugguagcaucuuauccacaguagaacuuucaaaguuagggucaguccucucaaacccugccgcuacuuuaucaacuaaguuuauguaauauucuaaacucugucucagaaaaaaaauaaaaaauaagccgagaucgcaccauugcacuucagccugggcaacaggagugaaacucugucucagaaauaaaauaaauccuuuguugucauucaacaguguucgcagcaucuucaccaggaguagaauucaucucgagaaaccacuuucuuugcucauucguaagaagcaacuccucaucuguuucaaguccaaucaugagauugcagcaauucugucauaucuucaggcuccacuucuaauuguaguucucuugccauuucuacuacguagaucugcaguuacuuccuccacugaagucuugaaccccucgaagucaucuaugaggguuggaaucaaccucuuccaaacuccuguuaaugugaauauuuuuaccuccuuugaugaaucacaaguguucuuuauggcaucuagauuuguagguccuuuccagaaggaguuccauuuacuuugcucagauccauaaaaaaaucacuauguagcuauagccucaugaaauguauuucuuagauaauaagacuugaaagcugaaauaacccuuugauccuuuggcugcaaaauggaugauguauuagcaggcaugaaaacaacauuaauuuccuugcccaucuccaucagagcuguugggugaccaggugcauugugaauaagcaauaauauugugaaaggaaaucuuuuuuucugagcaguuaagucucaacaguggccuuaaaauugucaguaaaccaugcuauaaacagaugugcugucaucaggguuugucuuuuuauggauggagccaaggcagaguagauuuagcauaauucucaggagccccaggauuuucagaaugguaaaugaacauuggcuucaacuuaaagucaccagcugcauuagcuccuaacaagagagucagccugucccuugaaggcaagcagugacuucucucuagcuaugaaaguccuaaacagcaucuuccaauaucagaauguuucaucugcauugaaaaaucuguugaguguagccaccuucaucaauauucuuagcuagaucuucugauaacuuacugcaacuucuccauugguaguugcugcuucaccuugcacuauuauguuacggagagggcuuuuuucuuuaaaccucguaaaccaacuucugcuagcuucguacuugucuucugugguguccucaccugucucagccuucacagaauuaauaagagaguuaaagccuuucucuggcugguuugcuugucuauccagaccacucagacuuucucuguaucagcaguaaggcuguuuugcuuucuuaucauucauguauucacuggaguggcacuuuuaacuucccucaagaacuuuaucuuugcauucacaacuuggcuaacuguuaagcgcaagagaacuuucagccugucguggcuuuugacaugccuuaauuacuaagcuuaaucauguauagguuuuuauuuaaagugagaaaugugagacucauccuuuuacuugacacuuagaauccauugcaggauuauuaguuggccuaaauucaauauugucucgucucagggaauaaggaggcccaaggagagagagagagucaugggaacgguuggucggugaagcagucagaacacacacagcauuuauugauugaauuugcuaucuuacuagcuuaggcaacauggcaaaagcccgucucuacuaaaaauacaaaaaaauuuagccaggcaugguggugcuugccuguagucccagcuacucaggaggcugaggugggaggaucaucugagcuugggaagcugaacuugcagugagccaugaucaugccacugcacugcagccugggugacaggagugagucgcugucucaaaaaaaaaaaaaaauaguuuacugucuuagaucuuagaugggcacaguuuguggcaaaaacaaaucuguggcaaaacaaugacaauguuaaccucaaagaucacugaucacagaucaucauaacagauauaauaauaaugaaaaaguuugaaauauugugagaauuaccaaaaugugacagaggaagugagcauaugcuguuggaaaaauggugcugauagacuugcacgaugcaggguugccauucaauuuauuuaaaaaaacaagaaacugugaagaacaacaaaacaagguaugcccauacuccaaagguacuuuuaagaaaugaauuuuugaaaggauuugaaaaucaaauguguuaauuuugacugcucuuuauggauuuggcauuuuguaguuuugauuaugacacaaguuauacauaaguuuaggugucacuggacuugcuuugcaucuuuuuuuuguuuuuuuacuaggucuuaacuugcagagucaguuuaaucuggaaaaugucacuguuuucaauacaaaugagcaggaaagcacccugggucagaaggugaggcugauuugaaaucuucucagauaacauauuugcaaguuuguuauuaagauaguggguccaggcacaguggcucacacuuguaauccuagcacuuugggaggcugaggugggcagaucgcuugagccuaggaguucaagaccagccuggacaacauggcaaauccucauuccuacaaaaaaguacaaaaauuagcagggcaugguggugcacgccuguggucccagcuacucgagaggcugaggugggagaaucgccucagcccagggaggucaagcugcagugagccuugaucaugccacuguacuccagccugggcgacagagugagaaccugucucauuuaaaaaaaaaaaaaaaaaaaaaauuucauguaaaugggccuacaagucaucaaaaauuuaaaaacuuuuaacuuuauuuccaacuuacagaaauaauguuuuguauguaaaaaauucaaccaguguuuaagauagaauguacaguuauucuguaauccaagguagaccaugguagauuauggcauagcuuucuauuaaaguggauuaacaaaguagcuauacuuucuguuuuaauaguguuaaucauaagguagauuauagaauagauguacuuucuguuuuaaacauuggguuauuuuuugcagaauauguauuuuuucuauaaauucauauuauuucuauaaccacucauaacauucucugucucaccauaccaggacuuuuuguguauauguacaaacauguuguuuuucuccagaaugaggucauucauacuauucugaaauucacuuucuuccuuuaagauuuaguuuuaucuuaguuuuuaaauggcucuugauaaaucucagaguggauauaucacauuucucugccuguggacauucagauuaucucugauagugaaaaacaauguuacagugucuaguaguguauaauauugcaucagucugcagcgucugcaucaauuaugcagaugucuuuuuaggauaaauuccaguaaguaaaauuacuggguuaaaauauaugcauauuccauauuucaauagcuauugccugguuacuucucaaaaagguuauaccaauuuauacagccaccaguggcacauggagaaugccugcccuuuuuccccacagccucaccccaacagugugaauuaucaauuuuuaaaaaauauuggcuuaauugauguauauauuugaaaaauaagucuucuuaguuuuaauuucauuuccuugaucauuauugguguugaggaacuuauuauauguugguuggaauuuauuuuucuucugugaauuagcuauucaugcuguuugcucauuuuauuguugaauugucuugugcauuuccaaaacauuuagcccuuuauucccagagggaaucuauugauuauguuuagaaauguagauuugaaacuuucuacugucuucaugacuguguuauaucauugucauacugcucuugaguucuucuguccaucagguaaaauucugauugccuuacagauuaacuauaggucuagauaguuagugacuagacuucucuaacuguggguugccuaggaauguguaacugaccacuuauucuagcauuuaucucuucugucugaugacugcuucaugacaggcuauacauuuuuuuuucaauuuagcacacugaagauagagaagaaggaauggauguagaagaaggcgaaaugggagacgaggaagcuccaacaacguggugaguuuucagagccuaagcuuuuugauuuacagagauaaucuccuaauuuauugaguauccucucuggagugaggagauagacaaggaggaaagaaauuauaagaaauuucuuucauuuguaauuuucauguauauuacuuaauaaaucguaaaucacuaaugggcuuuaucugcugguuucuauauuaugugcagacaguucauuguuuauauagacuacccuaugcauaaucccagcauuugaaaagccaaccacaggcagccuuaggagcuccuccccuuaaucccuuccauuaaacuuguggacccagugccuguguguauugggcuaacuuuuaaugaaauaggcaaguuaagaagccuuuccuccuucucuccccuugcucuuaaaacuguuucuuaucuccuccucuguagcccugugcuuucuuuccaaaagcaauccucaguggcauagauagguucuagaaacugcaacauuaagugaaaugauguaugaugaaaucaauuuucccauaggcuaacaaacaaaaguuagguucuuauggccuauuucuggucacaaaaacaaucaccaaacuccuagauaaagaucaaaaugcuucuguuauuaaacauugaauaaaugugagcuauacaugcauuugagaaagauuaauaaaaacaaguaagauaauuauuugccuaguuauuccaauuuaagguuguggguggccagagccugucacagcagcucagagcgcagggcgggaaccaacccuguacaggacgccaucugcucacaguguguauacccacccacccacacucacuuauccuggaaccauuuagacaugccaguuauuuucauguacaccucuuugggaugcaggagggaaucugacuaccuagagaaaacccacacagacauagggagaaugugcaaacucuacauagaccguggccccagccaggaaucgauuuuuuuuuucucaucaacguuacaauaaaacaauguugaaggaaacaucguuauuugaagacuuuccauaauuucuuccuagugcuggcuuagaagcaaugagcaagagaaaagagaaggcauuaaggaaaauuuuccuucacuggcacucuuccaggugucugaggugaugagagucauuaguuauaauugaaagaauuuccauuacugucuagaaaaucaagaugggauuccuguaucugcccagggagauguauuucuggcaucccagaauucaaauucaaacacaucuccagaagaaacauuagagguaguguggcuccaagcuuaacuccaauacuuccuagucaugugaccuggggccaauuacuuaaccuucuacaacacaguuuccacaucuuuaaaauguaguaaugccaccuacucucuacaguuaagaggauuaaauaagacgaugaucagaaauagucuauuaaggcacuaauuguuuauauguagugguaaguguaaagcacuuagaauauugucuauucagugucuaguagcuauuauuuguuaucguuauuauuuuuuuuuagagaccuauuuauucauuauacaugaauaaaguaggcuuuaaggucuggccugagcaacauaagggcucuggggcaaguuaguaggcuacaagaugaugagucaccugaaguguaaacagcccaaaagacacuggccagugcaguuuugucugcuuagauuuugccuaagacuguauagacaauucaucccuauugguuauguuuguaaaucacuuaaauaagacucaacacucagcugccucugucacagucacuaauguugaauagagggagaaaauacgugaggaauuacuuugugacagcuguuaucaccagauggucuuaggcacuguaauuuacaaagcagaacucauuacccaucuaccuacaauaugaaguccauuucagauuuggcucaaauacaccaguaaacauuuuuguuaagaaauuucaauguauaacauccuguaaaauagcugaacauuuaaaaaaauauaucaaguuuuccagaguuuuuuugguuaaaauaguuacaagacauucuauuuuacauaguaacugggucucugauuuguuauuauuugcaaauacaauaauugguuacauuugcuuuguguggguaaacagaaaauucaaaaguuucuguggaguguugaagguggaaggcaaauugcaaguggguugaagaaugaacaggaagguaaugaaguggugacauggaguauagacaacucuuugaagaauuuuauucagcugugaaggaaaagagcaagggacagcaucuaggagaggggacuuuaaauuuuuaaaaauauauuaaugccucaacuguaaaaacugccuaacaguaagauauuaacacuacuucaaaauuuauucuguaagacaccucaaauacccaccaagccaauuaaagauaaaagggaagagaucaaaagucuuuuacagguaggagaugguaauuagcaacauggaauaauauugugauugguauuaaguguuaaauuagaugugaaguucuuagcaauugagacaaaaagggacauauaaugguugcaugagucucauucucuguuagagguagccccauuuuuaagagacaaacuuuccugguacauuucaagagguauuuauuauauucaaucuuacauguuguaacugaguaacauuuuguuacucagugugugugugcacaugcacuucagaaacauucuuuaucaaauguauggaacuauacaaauauugguucuuguucuuucaugaauguaaauaauuuauauagugcuauuucuuuucucuauuuacuuuaacguuuuagggaauguucuuuuugcggcuuuuuuuuuuuucuuuuuugagacggagucucgcucugucacccaggcuggagugcagugcugugaucucggcucacugcaagcucugccuccugggcucaagcgauucuccugccucagccuccugaguagcugggacuacaagcacgcaccacaaugccuggguaauuuuuguacuuuuaguagagaugggguuucaguauguuggucaggcuggucuugaacugaccucgugauccgcccgccucagccucccaaaguguugggauuacaggugugagccaccgugcccagccuguggcuuuuuuuaaaaacccaauucauagaaaacccagagguauaaucuuacuguuguaaaucagugaagcugcuuuaauuauagagagaaguuaauguguacaucauuguuuuccuacuuucagaguuguuacuagggaaaaguuuaggaagagcgaaaguaaacaugcccauuagagucuuucagauacuacuaauucaugaugaaagcuuuggcaagaacuagauuuagauuuuuguuaguuaaaagucaguauucuucacuguugauuuucacgugcuucagauacuagccguuuaucagauauuagcuguuuuaaaaauuaaaagaauaggccgggugcagugguacacgccuguaaucccagcacuuugggaggcugaggugggcagaucaugaagucaggaacucgagaccauccuggauaacacggugaaaugcugucucuacuaaaaauacaaaaaauuagccgggcaugguggcgggugccuguagucccagcuacucaggaggcugaggcaggagaaucgcuugaacccgggaggcggagcuugcagugagcugagaucgcaccacugcccuccagucugggcaacagagugagacuccuuuaaaaaaaaaaauuuaaauuaaaagaauauguauugacacuguagauuugugacauaucaagauuagaaguugaauuaguagugccauaauaaaguuacuagauaaagggcuuauuuuugugaugcuaacuugauauguaccauauauguuuuucucauacuggugcuucuuaggauauaauauuuuuaguuaggauaugauaccugugacuuuuaacauagauucagauuaacauugguuuaaacaacauaaaaguugauuuuucccccucauaucgaagucuagaagcaggcaguccaaggcugguaagggagcacugcucggugagauugccuagacccaggcuucuucuaccuucuucuuccaucaucuugguguuugcccuuuuuccuguagugcaagguggcucacgcucacaucugcauucuagccagcaggaagaggaaaaggccagugauaaaauauggcccaaaaguugcacauaugacuuccgcucucaacugauuggccagaauuuaaucacaugaccaugcgagcagcaagauugguugggaaacauaaucuuuaauucugaauaaccauguguccuuccaaaauucaggggcuccaccaguguagauaaagagucuauuggggucuaugaguucccuaaaaugauuuguaaaaguuuauauaagcauuugugaauguguacuuuucugauaacuuucauuagcuucugaaaacgguuugugaccaaagcuaaguuaagaauauuuagauauuuguaaaagaauuugaaugauuuauuuaauauaacguuuauuuuauuagcucuauuccaauugauuacaaccuguaucgaaaauucuggucacuucaggauuacuucaggaacccugugcaaugcuaugagaagauuucauggaaaacuuuucucaagguaaguugccauugacagacuaucagaagcccaguauuuuauagacagugauagagcuaaaacuuaaucuugucuaacauacuuuucacuauguaauucugccucuuacauuuuuauaccaauuucauaacaagugaaauuauaaauuaauauuuaaaccacuaauauugugaaguaguauauaagaaucggauauuuaaaaguucgucauuacagccuugcuuuuuuugaauauaaugaguguuguuaacauaaauugauauuuugcagaauauauucuaucuuuguacaaaauuauuuuagcuaucuuguugaaacagaaguccucaagucauggcucugggccagaucuaaccuacugcuuauaaacaaagguuuauuggaauaguaccaugaccauccacuuaccuguggcuguuuuugcacuauaauggcacagcugaguaguugcaacugagauuauaaaggccacaaagccugaaauacuuacucucugguccuuuacagaaaaaguuugccaauccuguuuuagaagaauuuguuauauuuuucuuggcuacuuaaagaucaguuguccuuuuuugucauaauuaaaaucuaagauaaauagguaguucucagaauagcaugguguguguuauguuauuuuuaauaguuuuuguuuuauaugcaauuuuuugugggggcagcaccauccaaauucagauuaagugguuagugagaaauaaucuggaauugucuucuaacuggacagaauuugguggaauuuauuugcucaguuuuuagcacaagaaaugcguaagaguuuccacaggugguuaaacaauuucacugguaaauuucuguacacucuuaaaaauguucccuaaucuauuugucccuuacacagacuucuuaaaucauauuucuucguuuuuuuuuuuuuuuuuuuugagacggagccucccagguucaagggauucuucagccucagucuccugaguagcugggacuacaggugcccgccaccacaccuggcuaauuuuuguauuuuuagucgagacgggguuucaccauguuggccaggcuggucucaaacuccugaucucaaguuacccgccccccuccgccucccgaagugcugggauuacaggcgugagccaccaccacuggccaagaaauuauauuucuuuaggaguagggagcuuguaccuacuuuugcaacaagugaaauaucauacaaaauaguuuuaacucccauucugcuaucauaauuuguauuguuagugugccuugcaauauacagucuacauacaugauugacugggaguaaauucuaggcauuuugaugcagaaaagcacuaaacaaauuuggguaacaaugucgaauaaaacuaauauuuuuauuuugcaguauucugaagaaguuuuagcuguuuuuaagaguuauaaauuagaugauacucaggccucaagaaaaaagauggaagaauugaaaacaggaggagaacauguauauuuugcaaaauuuuuaacaagugaaaagguauaaguuuuucuuuuucauuaagcauaauaagaaauggucuuguuuuauuuccguuuagcugacagccuuucuaaguuaaacugaauagaaauguuucuuauuuuacuuuggguuaaagcugauugauuaauguuaguuugaaagucccauuucuuccuuucagaaguaggacuaauuugguuucaaaggugaaaguaguucuacauuaagucuguuuuguaaacuaauuuuggaauaaaugcaguuuaauuacuuucaugucuauauauuuuaaaugucaaguuaggauuuaauuuguauaugaaaauauuucauaauuauuauuuaggugcaaguaagggguuuaaaaguuccuuguuaaucuuauuuauacauuuuaaaaaguaaauuuuauucaaauauaaugcuacaagauuauguaaaguuucuagucaagauggcacauugaguuuauguuucgacucacucccuuugcuccaaacacauagcaaugacggguaaaauauaaacgagaaaacaaaagagacaaggcugggcuuccagaaacaagauaaauaucuucauggaccagaaaugccaaguagugagcaaaacugcagccugggccugcuggacucucuauccaaggcagguggugguguccaggaauuuggcuacaaguaacagagacuaaaugugcaccaugugggacaaggggccagagccagauucacuucuugaagccaaggacuaggguggaacuuuuauccaguuuugggaagaaacuaagaaaaaauauugccagucuucugccaagggcuaugguuuuauaggaaguugugagccuagggauaacaaagacagcuuuguguccaucugcuugcucagugaccagauaugugauaugcucaguauacuuaugaaacagcugcuccaagaagucaucauaagacuucuucuagacuuuuggacucaggggcccugguagaagcagaugcaaaacugcuagacagggaaggauguacacagagagggaggggaaaggaaguaaacaaacaucccaaaagaaaaggcuccuguucaaaacucugauaaauuaaaauuccaaaauccauaaaucuaaugcuaagaaggaucaccagcaaaaucaacuauugggauauauauauauauuuauuccagaugaaauauauagccugaccaagacuuuauguauguuuuggauacucaaaaagauaaucgaugagauaacauccauugaaaaggaacaagaaaucaugaaacaaaagcaggcugaaaugaaguaggacagucgauacaacuaaucgggagucuugggaaugaaaaauacaauaauugaaaccaaaacucagcacacagaauuaaacuauacacuggacauagaugaacaaagaacuagugaacugaagaaggugaugagaacuucauccagcaagcagcacagacagauuuuuuuuuuuuaaguggaagagcaguuaaaagccauggugaauagauugggaauuuccaacaucugucuaguaggauuuccaaagaagaaaauggagggaaugguagagaaacuggauugcaaagaauugaaggaaaucucaaauccucagcuuaaaagugugucacaacugccaagcaggauaaagaaagauaaaucuacucuucauuacaucaugccauaacugugggcauucagagaaaaccuaaaagccacuaagggauaagaaagacaaauauacugggaaggcacagcaguuugacuguuagcagauuucuaacauaucaaccauuaauaccagaagacaguagagaaauauuaaagugcugaaagaaaaaugacauucaaucuagaauuuuauaccgaguuaaauauacucaagacugucgaugaaagaaagacauuuuuauuuaaagaccaggauaacuuaccacucagugacccucauuuugaaaaaaacuacucaaggauguucuucaggaggaaggaaauugaacccauaagaauggagugggauacagaaggcaacggugagcacaaaaauugaaaaauaugacaguaaauuuacuauugacuauaaacacaaaaaagucaugaaugauuuaaaauuuuuuuaauuaaaaaauuuuauuaacguggaacuuaacuagaugacaguaauaauauggaaggggaaagcagagauguuuagugaguaauuuaaaauuauggcaguccuuguaaucuucaggaguaggaaaggaauacugaauauuccuuuucauguauauuaaaaggguaaccaccaaaagaaaaccaacuuguugcucucaaagaacagagaucaaagggaggcagggaggaaucuagaccacuuuauaaauccagcgaauggcagaaaaaaggaagagaaaggaggagagaaauaggucaguaauaacaaguauagacugauuuaauauaccuaauaagacuuuaucagauuggauuuuuaaaacuccagcuauauuuguuaauuuaaaugaaacaaauauagaaaccuuuugguuaacuaaagaauucaaaaguuuuauucuacuucauguguaagaaaaucccaaagcucuucuugcuuaacaaagaaccuucccaagguuaccuacuuuuagaaugcagaggugucaguuuaauauuaucagggcaaaaaaguuacaaaauaaaacaaccaguaagaguuguguauuuuuaagaguuacagguccacauuucucaggacaugacagcuauuucaaaacucuggaugucuuaauugauauauauauauauauuuuuuuuugagacggaguuuugcucugucgcccaggcuggagugcaauggcguggucuuggcucacugcaaccucugccaccuggguuuaagcgauucuccugccuccaccucccgaacaaauagcauuucuaaagacauuuuaguaaugaaaaacagcaggauuaaacauuuucagagaaaucuccacauuggaauaugggauugaugcuuuuauaucauucuccauucacuuugucacacuuggcuuucuaauaguaucucuccuuuucugauucuuugugaacuugcuuucaccagcaguuagaacaugaacuuucaggauuaagcacugaaauuucauuaauuaauaucacaucacgaggaagguaaaaacagcuuugagaagcuuaaaacuuaccauaggaguaagaaaaaggcacaaaauuguaccaaagagaaugugaggcauguaauguuuugcaucuucauuucccuuuguugccccuuaagcaacaacuuugucuuaaauuuacaguccucuuuguacauucuucauauuuuuugguguauuuuuaguuuuuacuacuuaauauacaagugaaaauauuuguaaugcauuacguguaucauggaaaauaugcaacauuuuauaagcuuuacugcugcacugaaagaagccuuccagcaucucuguaccuuacaugguguuuugauacuaggauucccaaaaaggccuucacaccuaaauauaugccaguuuugggccugauguuacuuucaacuuuugauauagauuugguaagucaugagaaaggucuggauuuuucagggauaugggugccauauuccuugccaguaagagcuagcuaaagugaaaucuaaagcuaugauuauuuggagcauaacucuuuagccuaucauuucacuggugagcagguuuagaaaagugcuugucauuacaagguuagaucuuucaucucuguaauagagccgugaccccauccaaugggaauauuauccagaagcauuguguuuuguuacaugaaucuggucagacuuuuccuuagggauaguccggaaacaaugcuuggcaaggaugauacaaacuuuuuuuuuuuuuuugagacacuuuuuuuuuggcccacuguaacuuccaccuccuggguucaagcgauucucgugccucagccucccaaguagcugggauuacaggcgcccaacaccacgccuggccaauuuuuguauuuuuaauagagacagguuuuuugccauguuggccaggcuggucucgaacucgcagccucaggugaucugccugccucagccuuccaaagugcagggauuacaggcgugagccaccacgcccagccagaugauauaaacuuuauaguuggagauaggccagucauguggcaacuacagguagguagagguucuacaaauaaaaugggugucuuuguaaauuauugugucuuccuucuuaaagaaagaaguuuccccuagaaacaaagugccacauuuuuguacuaccuggagugugauucugaauacuagugcccaacaguauaguucccuuuuuagcagagcaaaauaauccaggguuacuacuugcuaaauguagugcugauacaccuggguugcuuauuuucuaaugcaguggaaaaguaucuguucuuuaagguuaguccaggaucauacucagaaauguuaagggaggauuuuaccucuaauuguucaacuuauaccaaauaaaaggcacugguauuguagggauuccucccucuguacuauguagcauguaaaagcagaacaacauuucaaaauguuuaaguaccaugaguauuaccaugaugguuaaaggaauauauuuuuggaucuuuuaaguucucacagaaaagaguauaauaacacuaauuagauauaggcuuuaggguuacccaguccuucagaauaauacacuucucacuuuccaucugagacucaaugaccaaaaugaucagauggaauacucaguggcuagcaguuaccagggugagguuacccacaguuauguacuguugacccuaguguggucauuaggccauucauuuucauggagaaaagaaaauucacaauuuugcuuggucucugcauugugugaagaggccucuaguuaggacuuuuggucauuuuuuaaaaaaaaguuccuggcaguaagaaacuauccauauagucauucugccuuaaauguuuuguacuuuuuauguccauuugagagguugaaucuuuauguaguaacggcuaaggugggucucuuauaagauauacuauagccuagcuaggagcaaaugaaggcagaagcaagacccuccuguuaacaagugggcaggcuaaccacuaugcuacaauuuuuuuuuuuaucucauuaguuguucucggcaugggaggcuuuuagauagcucuggaacaggguugcacagcaggaggugagcagugggcaagcaagcgaagcuucaucuguauuuacagcugcucuccaucacucauauuaccaccugagcuccgucuccuaucagaucagcagcagcauuagauucucauaggaacaugaacccuauuguaaacugaucaugagggaucuagguugugugcuccuuaugagaaucuaaugccugaugaucugucacugucucccaccaaccccagaugggaccuucuaguugcagguaaacaagcucagggcuuccacugauucuacauuauggugaguuguauauguauuucauuauauauuacaauauauuaauaauagaaaugaaguacacaauaaauguaaugcacuugaaucaucccaaaaccauucccucuaccccauaaccccuggucuguggaaaaauugucuuccaugaaaccagucccuggugccaaaaagguuggggaucccugcuuuagaagucuuuugcugacagucaugucagucuuagcauaugggugugcuuucacucguccuguaaagguaaauacuauagccaaaaccuuuucauaugauuguaaaauugacuuguaauggucuucagggcggaaagcaugaacuacccucuguuuugacauuuuugaacucugguccugacagauagaacaguucuuuaaauaucauugagcauauuacaaaacuuagagcauacucugccauuguuauuuuuagaauaaccucugugugugagucaagccaugguuauacaagcaagauaagaaaguaaagugauugaugcuaccaaguagcagcccucuaggaaagaccaaagacagggugcagaagauguacugccaaaguaggcucugaauuuggagccuaaucuugaagagaggcaaagucugaaaggcuuagcagaggagacuaguuauuugauaagauaaagagcagagauagaauaagaagucacccaaccuucuuauuagccaaaguaauagaaauuaauacugacuauaacagaaagaccauuacaaauuuuagauccucuagaaaugagaacucucauuauuuuuacaacaguguauagucaugauuacacaaaagcauaacaaagucauauuuuaaauguuaauagaccuuugaaaagaaaauguucucugaugaggacaauaauuuuggacuccuggacagacucuguagagggcaaaaaauuauuaccugguuauaaauggacuucauacccagaggaaaaaaaaauuuuuucucuguguuaauugggcucccuccucuauuauauacaaguguuuauuaguuuucaguauacuuugauaugcauguuuuaauagaucaguguuuaauaacaguauuauuuaaaacuuugguuuuuaaaacaauucuaucauguuuaauauguaaacauuaacugauuuauuucauccugaguguuaugaagaacaaacauguuaagguauagucagagauacauagguuuaaaaacauaugaaucaggccaggcacaauggcucacgccugugucccagcacucugggaggccgaggcagacagaucacuugaggucagguguuugagaccagccuggccaacacagcgaaacucugucuguacuaaaaauacaaaaaauuagccgggcgugguggcaggugccuaugaucccagcuacucgggaggcugagguaggagaauugcguaaaccuaggaggcagagguugcagugagcugagaucacaccacugcacuccauccugggcaacagagcgagacucugucucaaaaaauaaauaaauaaaauaaauaaaaguaucguauguuagggacuuuuuauguuuucugugucugaauuuuaacuuuuuguagaaauuuuuucaauacucuguaauccuauagaauauuaaaacuuuaccggauagcguaagaauauucuguaaauucauauaauuuucaguauugucugagauuuaugaaaaccaauauauaaacacuggcuguuuaaucacagcuugauuuaguuguucacccauguuuauguguaaauaauccugaguuaauaauagagguaacaacaaaauaaccaauguuaauuagaaaguuucauuuuagccuuuuaaagguagaaaagucuuauguuuauuaaaauucuauauuuguaucuuuuuucuaccuugugguuuaaucaaagaaaagucauaaagucaucuuuuaaacugaaaacuuucaaacaguacuaauguaaaacauuaaagaguuuguuuuacauugacuaugaguauuaaggaaaaugaaauuuaaauuuuugauauuuauuuuauugaggaauacuguagccuucuaagucuacuucacaguacagucaugcaccccauaauggcaccacauaacaaccacauaacuggucaacaguggaccccauguacaacagugguucuguaagauuauagauuauauaauacuguguuuuuacuuugccuuuucuauguuuagauacacaaauccuuaaccauuguguuacaguugcuuacaguauucagugcaguaacaugcucuacagguucguagcccaggagccauaggcuguaccauauagccuaguuguguaguaggcaauacuauuguuaaguacacucuaugauauucacacaauggggaaauugccuaaugacaccuuucuuagaauguaucccuguagguaagcaacacauuauuaguacagaaaguugcuuaaaacuuuuuaauuugagacuguaucuucagguuaccuuuuuacuaaauaaaaggauugagacuugauagcuccugccuucagugggcaucuccuuuuaucuuauaacucagcagggacacugagagaccuuuaagcuaaaauuagauuuuucauuuuuuuaagaacuuuuuuuugaaagacaguuugaaaagaauuauuagaaaguagagcugggugcaguggcucacaccuguaaucccagcaccuugggaggccaaggugggcaaaucacuugaggucaggaguuugagaaccagccuggccaacauggugaaaccccaucuccacaaaauacaaaaauuauccaggcgugguggugcgugccuguaaucccagcugcccuagaggcggaggcauggggauccauugaaccugggaggcagagguugcggugagccaagauugcaccgcugcacucuagccugggcaacagagugagacuccaucucaaaaagaaaaaaaaaggaauacuauuuaaauuuauaauuuaguuguuuuuauacaauuguuuacacauucuuuuucucagaaaccaaauguuuucuauuucaauugaguaaguuauauggaagguacuauuccagguagaaaacuauuguacaguuuaguccucuagacccuaauuuaauaucuaacacauuugugaaaauuaaaaguuuaaauuguuuaacguuuaaagcgaaauauuuguaaacauacuaacuguggaaccuguauuuuuuuuuuccuaaucuggggagaaaauggguauauucaaaacauuugguguuuaggcuugauuucuuaauugucugggcagauuuuaacagcucguccaggauuauguaagcacuuaguggugccuuucaacaauuuaaaaaggaaauccaguaugugaagcccagugugguggcucacgcucguaaucccagcacuuugagaggucaagguggguggaucacuugaggccaggaguuugagaucagccuggccaacauagugaaaccccaucucuacuaaaaauacaaaauuuagcugggugugguagugcgcaccuguagucccagcugcucaggaggcugaggcagaauugcuugaacccgggaggcagagguuguaguaagccacgauugugccacugcacuccagccuggguaacagagcaagacucugucucaaaaaaaaaaaaaaaaaaaauccaguacaugagagauuuaguacuuuucuagaaaucucucaagccacacagucugaucagacuuauauacaguagaaacuguagagcuguguucuuuucagagacuuaauacuuuuuugagaaauaugcaacuccugcagucaugcuacagaaagacuacccucuugccuacucccugacacacaauucauauggguuuucacauaaaagaaaaaaaaaagccuaacagucacaggaaaauuauuaaauuauuaggccaacuagaggucauacaagagcacuuugaaggagugaaaacauucugaacuaacucaagguuaauagaagcgauccuuuuguguacuguaccucacuggggcucaagagcaaaacauaaaaucacauuuacacagaugcucugagcgucccauguaccaaauugccauugguacauuugucuuccgggugcaccaguuuccuuuuaaugagguuugcaucuuagaaucuuauucuuucgccgggcgcgguggcucacgccuguaaucccagcacuuugggaggccgaggcgggcggaucacgaggucaggagaucgagaccauccuggcuaacacggugaaacccugucucuacuaaaaauacaaaaaaaaaaaaauuagccgggcgugguagcgggcgccuguaguucccagcuacucgggaggcugaggcaggagaauggcgugaacccgggaggcggagcuugcagugagccgagaucgcgccacugcacucccgccugggcgacagagcgagacuccgucucaaaaaaaaaaaaaaaaaaaaaaagaaucuuauucuuuccuaguuaugcaaagcugaguucuguaauuccaugauuuucaguaagaaggaaaaaagcagaccuaagaagcuuaaaacuuacauggaaaauaaaagaacacaaaauuuaauaaauugaagauggagcaguuuguauccacaagggauauauaccuaaaacaaaacucaugauugaaauauuaggauggaaagagacauaccaggcuaauaccaacaaaaagaaagcuacauaaauaacaaauaaaauagaauuuaagggaaaaaguauaaauaggacaagaaacacuacauaauaaaggaaugaaccaccaaggugucaugaacuuauauguauuuaacaauauacccucaaaauauauuaagcaaaaacuuacaaaauuaugaaaaguuggcccacaauuacaguauguauuuuuaacugcuucugauggaucagguugacuaaagauuaguuaaguauauggaagauuugaacaaugacaguaauaagcuugguguaguauagaacaaauagaagcaacauauuucuuuuuguguauacguggaacauucacaaaauuugaccauguacuaggucacaaagaaauucucagcaaauuucaaagauuauacacgaagaacacauucucuggccacauuucucuguaaucaaauuagaauucuaaaauuagagcugcaaaaaggauagcuuaaaaaaaggcaaauauaugaaaacauaaaaaugcauuucccaggaguuaaagaagaacucauaauggaaauuccaaauuuguaauaaauguauaucaaaauuguaauuauaggaagaauuacaugucagaaguguggguugcaaauaaagggagaugcaaagggacaguuaaagcuucauaugcauuaauggaaaaaaugucaagaaagagugacaaauugagcguucaacucaagaaguuagaaaaaguacaaaauaaagcucaagaaaauggaaguaauaauagcacaacuuagugaaauaaaacaaacuaaaacauaucagcaaaacugaaaguguuucuuugaaaagaaaauguuauaaaaagaaauccagagcuugugcaaggaaaaugaaaagauaccagcaaacaauauuaacaguaaaaauugacauagagauauuucaaaugauuaagaggauauuaugaacaacuacgaauaaauuuugaagccuaauaaaaugggaauuguuuagaaaauuuuaaugaccgaaauagacucucaaaaaaaaaaaaaaauagaaaaccaaauaaaugaacaaccauuaaggaaauaccagccagaaugacacuuuuugaaugacaucaggcccagagguuuuuaaggcauaucuuaucaacacuucaaagaauaaauaauuucuaccauaaaugaaaauuuucagaaguuagaaaaagagaagccccccaguucauuauguaagauuauaacuuaaaaucccaauaaggacagaacaaggaaaaauguguauguauauucaucucacauauaaauagaauguuuucuauuuauagaaauaaaaaaugucuuacaaacucacaaauuaaguaauuuuuuuaaaaauagagacauacaguuuauccuaggaauguaaguaugguucaucagaaagaugaauauaaugccagauuaacaaccgauuggcugggcguauuggcuuacgccuguaaucccagcacuuugggaggccaaggccggaggauugcuugagcccaggaguucaagaccagccugggcaacacagcaagaccgugucugaaaaaacaaaacaaaaaaaaaacagauuaaagauuuuuaagaucuguaugaucaucucagaagccaagaaaauucaauaaaaucuaauauucaauacaaaaaguagaaaggaauguucucugaguugauaaaggacugauuuuaaaaacccuauugcaaacaucauacacaauuaugaaacuuuagaaaguauucccauuaaauccaaaaagaagacauggauggacacuaaccauauuucuguucaacaccguacuggaggaucuaaccauuucaauaagagaaaaaaacaaaaaaggaguaagaguuauaaguauuggaaagaaaagaguaaacuauccccauuugaagacaauauaauugucuacagagaaaaguccaagagaaccaagaaacuguuagaacuaaugaaacuucagcaagauugcaagagaaacaucaauaguguucuuauaaaccaguaaucaauuacaacauguuauucagaauagcagugaaagcucuccaauaccuaggcguaaucuucauagagaaacauuacaaaaauggagcaguguuucuacauuuauagauacagacccagugccccuucuccccagauuuauugauucaguauauuuugaaucaguauccaaauggguuuuuuaauuugaguuauacccaaaggaauauaaauuguuuuauuauaaagaccaaauggguuuuuucaugggaacucaaaaaguuagucuuacuauuucuauggaaaagcaaagagccaagaguaagaaaaccaugaagaaagcgggaacacuugcugugucagauauuaagaccuauacagcaauaguaauuagggcagguaauuauuaguacuaauauacagaagaagaaaacuaaaacaauagaaaguccaaauuguagaaaagguuaauauacaaaagaagauugcauuauaaacuagugaggaaaggaugaauuauuuauuuauuuguuuauuuugagacagaguuucacucuuguugcccaggcgagugcaguggcgcgaucuuggcucaucgcagccuccaccuccuggguucaagugauucucuugccucagccucccgaguaacugggauuacaggcaugcgccaccaugcccggguaauuuuauauuuuuaauagagacaagguuucuccauauuggucaggcuggucucaaacucccaaccucaggugaucugcccgccucagccucccaaagugcugggauuacaggugugagccaccaggccuggccuauucuuaauaaauguugcuuggacaauucauuauccauauggaaaaauuaaaauucagucuauaccucaguacagucaauucuagguuaaucaauuccagguuaauugaaaguaugaaugagaaaagcaagacuuuuaaacauuuagaagaaaacaugaaauauguaaauuuggaguagggagagauuucuugagcuacaaaaagcacaaauugugagggaaaaauaucaauuuaguauuuaagauuuaauauuaagauguaaaagucuugaauagcaaaagauaccguaggcaaaguaaaaagacaaggcacagacugggagaagauuauuugucaccuacauaaccgggaaaaauuaguauucaaaauauuccauugauaaaagacaaccaaauggaaaacugaaaagaugauaagaaaaaguaauuuaaagauguagaaaacugaauagugaaugagcuuauaaaaguugcuaagcaucucuagugcagauaaaauaugagauaaccauacacuuagcaaacuggccaaaauugaaaagccuaacaauacuaguauuggcagagaugugggaaaaugagaacuuuuauacacuguugaaauauaaauugaaucaaccacuuugcagaauacuuuuguaaaaacuagugaaguuaaaauuuguuccuaaauauggcccccuacacaggacccacauacacaaggaaaucucuaagaagauucacuguaccauuguuuguaaaugauguauuuguaaaugaaaguuuagaaacagugucaauguucacaagcagaagacugggugauaagauaauuuuacgugacaguucuauaaagcacugaaaauggauuaauuauagcagggguuggcaaaucuggccuaucaucuauuuuuguagauaauuuuuauugggccaggugcaguggcuguaaucccagcacuuugggaggccaagacgggaggauugcuugaaaccaggaguuugagaccagccugagcaacaaagugauacccccaucucuacaaaaaaauuuuaaaaugagcugagugugguggcauaugccuguagucccagcuacaggggaggcugaggcaggagaaucacuugagcucaggaggucaaggcugcagugagccauauucaugcuccugcauuccagccuggcugacagagucagauccuaucucagaaaacaauaaauaagaauaauaauuuuuauuggaacacagccacccucauucauuuagauugucucugacugcuuuugcucuguaacagcagagauaaauaguugugacagagauauauaguccauaaagccuaaaauaguuucuggcugguccuuaaaagauuugccaaucccugaacuagagcaacauguauuaagauggguaaauuucaaacauaguguuguaugaaaauagcaaauugcagaauagcacauaauguguagaguuugaaacagugcaaaguacauccauauauuauuuauagauguuuacauauguaguaauauaaaauguguauaaaaauccuaaccgugaaauacaugguagugguuaccauaguagagggagggagggaaauaggaguggggaggguuauagagggagcuucaacaaugucuaugauauucuguuucuuuaacagauauguaacaaguaaaaaauguuaggauuuuauauguagcuggguaguggguacaugaauguuguauuacuuaacuauaccuuuuugaacauuuaaaauauuucauaauuuaaaaauuggauaauuugaucucagcugauguguuaugacaguugguaagauuuuaaugagaauguucugaauauuuucuagcacauguuuuuuauguauuuuguguuaaauugauagaaauggaagauuucauacacuuuaauuuuacccaggaauauuauuuauauguaaaauugauugacagagaggcauguaaggaugacuaaaaugaaaagcaugagccuuuuuaggguuagaauaucgggaaaacugaggccugagcuaagaugugccauaaaagcuaaggacaguagccuaguccagugauguaugccugaaguuccagcuauuuaggagaccagggcgggaggaucacuugggccuaggaguucaaguucagccugggcaacauagcgagacccuucuguacuaaauacauacauacauacagcuaaggauaauaaaagcccuuugcucaagauacaaagacauuuacaaagaaacauuugggccaggcaugauggccuacaccuguaaucccagcacuuuguaaggcugaggcugcaggauugcuugaaguucaaaacagccuggaguucacaacagccugggcaacaaagugagacucugucucuacaaaaaauuuaaaagaaaaaaauuagcugggcauuguggcauaugccggugguccuagcuacucaggaggcugaggcgagagaauugguugagccccugaguucaaggcugcagugagcuaugauggugccauugcacuccagccugagaagcagagugagacccugucgcuaaaaauaauaauaaugaaauguuugacccaugacauaguguaaaugauauaauuuuuuaaauaaccaaagaaaaauggaacuagauaguagauauuaugaaagaaaggguacaauugaguguauuaguuuuacucucagcugugucacuaacuagcuguguaaucuugccuagguaguuuuaacuuuucuggaccuaguuuccuuaaguauaaugugaagcaguuagcuugaaucacauuagguccuuuccaccccugauucaguguuuuguugacuccuauuuucaauccauuguuucuaucaaggaaaaucuuucaacauaaaaaaauaaaaugaacagcuaguaagcaucaccuagccacuuugguucgucucuuuaagcuagggguucacaucucuacuccagauguauugaacuguguacuucgguccuucaaauaggccagucucuuauuuggcuccccuucuugcacccccaucccccaacccccacucuccaccuuuagguuuguuccuuguugagaguuuagaugcugcuuucuccaggaagccuuccuagaguugcuugggcaaauggauguuggagccucucauugaauuagccaaugcuggagaacagcuuuuguggaggaaauugauguuuuacuuuguucaugaaaucugaucaggugucaguugaacauucagguagagaugugugauagguugucuaguguacaaagcuggagacuaggaacaagaucuagguugagaguauaguuguaggaguuaccaguuuauaaaugguaauucaaacuguagaguguaugaaaugagcuaaaggggagaguguagauucagaagagaagaaaauacugaaaucccgaagaaaacccauguuuaagggagaaugaagggagaagaggagaagauugaagaguaaccugugagauuagagaaaaacuagaaaagcaugcacucauggaagccaagcauaucaaguaggaugaggacaguaaagaguguucacaggauuuaacaacaaauaagucauuggugaucuugacaaaacacuuucuucccccgccccaagaccgauuguugcucugcugcccaggcuggagugcaguggcauggucuggacucauugcaaccuccgccucccagguuuaagcuauucuccugccucagccuccagaguagcuggaauuacagggcaugcaccaccacgccccgcuaauuuuuuuuuuuuuuaaauagagacgggguuucaccauguuggccaggcuggucucgaacuccugaucuugugauccgcccgccucagccucccaaagugcugggauuacaggcgugaaccaccacacccagccgacaaaaacacuuucaauggauuaguggaugaggcggucagaugauagcagguugaggagcugauuggcaacagugccuauagucaauuauuuuaagaagcuuugcuguuaaaggguuaggugagaaugugggagauuuuugagggagcuuauuuaaugcuuauggaaaggagcuuggaaagaauagguuguagauacagaaaccagggcaguuaguugauggaacucaauuguuagggauauugggauuccagauggaagguaauccagauggaauaccuuuagccgugaaggaguugugacagaaggaaaugaaguaaacaaagguguaggugcagcugauuugucauuuugggggccaagaaaugaaaugcuuuccaauuuaauuuuucuucucauugaaggcaaaaguaguuaucuacugaaagugagaaggggugguaaaguaguauuuuugcuaaguggaaaggguugaaaaucauuacugugaagaguaggagagagaauggccuugaagaauaaagaaagauugcugauuaaaaacagauguuuaagguggugacaacauaccaguggugccuucugcauagcuguguaauuugggguauucacucaggcaccucacuuucagcugagauuggaauccugaggguugguauagagaaggugacuaacaguugguuuauucaagguugcuguuugcucacuagacaugacagaagaaauaugggacaaguguguugaaguuggcaagaaaauggccgaagagauuaaccaugaagucuagaccaggaguuggcagacuauagccuauaggccaaaucuggcccaccaccuguguugguuguuuuuggugauuuugguuuuuuuuucccccuuacauuuuagauguuuaaauaccuacauaauauccauaauaugucucuuagcccacauaaccuauuaauaaaaauacuuacuauuugacacuucaggaaaaaguuugcugaccccuuaucuagacuaaaauaggauuauaauaaaaugggaugggacuaacaggcagagaauagacgggucaagggccuuaaagucucgguaagauccaaauauuagguauauuggaagcaacugagcgagagaccugggaaggauagagguuguggugagauaggauugugaguugaagacuucagaucuggggcagcugugagugaccccaggucuagcuguggccacaguaguggguagcuggagcagagaugggccuguccguggaguuaagggcaaggaacuaacagccugaguggagacagucaaguugcccaggggcuggaggaagggaaggcugauggccggccauucacauuuccaauuugggauaggagaguuaauauaaauaacaaucaaauauauucaauccuuaaacgugagggaaaccugacuggaaggcugaucauuaauuuuuuuuuuuaagaccuggagccacaguguggaagggguugcuagugaauagggaggcuugugcguguuagguagcauuaguaaaugguaccaaccacguaaagcagagccaccagcacuugggacauugaaccaaaaccaaucuucgacgcuuccagcugccuuacuggcgauucauuuagaagaacguggcuuuccuuuguuacuguaguuuuugaaggcagaacuagcaugaguuuguggauacagacuucagccuuccuucaguguuccaugcacauaaucagaaugaccuuccuucaucgccgcagguuauucuuacagcuggauggcagggucguugaagaacuuccucaugagugaccuucaaguccuuucuaauccagauucugugauaauacaaguaugaugcaauuuucacuaaaagcuaaaaaaaaaagcccaucuaaucagagaugaucuucaccucuaauuucuuguuuauugucaaguaauaccucuguugcaggcacuuuauagggcuacaaaaaugagugguccccguugauauugugcuguuauccguaucuucuuuagccauuauuucuucauaugugagaaaguaguagccucaguuuuacuuuaaaaaaaaauuuuuuuuuuaaauuuagagucuugcuauguugcucagacugaucucgaacuccugagcucaagugauccuccuucucagcuuccugaguagcugggacuauaauaggcuuugugccaccaugcccagcuuacuuuuuucuauuucugcuuuauuuuauccucaugucuggaccauagauagaucauuguuauccaccagcaagaaugugucauggcauaaaacagucaagaaaucuaagugaaaccuugacugggcugucuuugggcuugugcgguaaugccucacaugcagugaacucucaacaaauggcuuuuaaauugaauuggaaucuuccauuucuauauuagcacauuuuguaccuuuaggaaaaacuugauuuuaauguguuguuuucguauguguuugcuuguuucuugaguagcugauggauuuacaacugagugacaguaacuuucgucgacacauccuguugcaguaucucauuuuauuccaauaucucaaggggcaggucaaauucaaaagguaagauaauauggguaguaaacaauuuguaaacaguagccaagaaaaaaaaggacuugcuuacgauuuuucuuauguauguguccauuucauguuaaggcuguaucccuaaaacacauguauugcagcugauacauugaaggcuuuucgauauuaggauauuuaaggaaaagauguuaaauauaucugucagugugaguuuuuccugcccaacuccagggcuugccaggaguugucgucuuuauuagcagguggaggucucugcuccaaaauuccgucauucccuucucaccucccucagaccuccuccaaagcugauuugcagacuaagccaguaauacauaucucacaagguguggagcucugcaggacauucaagcuaaaagaugcaaagaaaauuuuuaagcaaaaaggaguucauuuauuugggguuucacaaaaccucauuaggcucucuacugucuaucuaaauacuuccauccauuuccuccuauccuguccauaacugaagguggagcccacuguuacuuaacgguauuuguguuaaggacacugagcaaugccguauuaguuguauaaugacuucacuaccugcuggguuugaaucccaggcucgucauuugcuggcugcagugcagcucuuucagacuuguaauuuuaagguaguagcacaugguaaacacucaaaaaauguuauuucuuauccuucuaucuauuuuggagguuugguauagcauaguaggaagaugagggacuuugaagugagacguggguuugaauuaaaucuuuauggccuugggcaaaucagugagacacgguagucucuguuuaauauguacauguacuuguuccgagaauucaaugaauaauguauguaaaguguucagauccuagccaucaauauuuauuggaugucuuuaaaucaccuagugcauuaugagagcucaguuaguggcagcuauuaacaauuuggguuugccuguugccuuuucuaggguuuggguguuuuauucguuguauuuugaaugaaucuuaauguagcaugccauacugaaugugcaucauguauacacauaucuuaauaucaaaucagaaguuuucguuucacacucagcuuauuuuaggaaacauauauugcucuguucauagugaaucugauugauuaauugaauguuuuauucccugcauaugcuuuuaugucuucaguaccaacccucuugaggaagaagugcaagaauuuucucuuauaauccucucauuugugauuauucuugucuugguaauuuuugacacuauccacaguauaguuacauguuacaugccuuguguuuuuuaaaccuuaaaguugcauaugcauugcuguaacucaagcaugcuuucauugcuuuguucccuaguucaaacuauguuuuaacugaugagcaaucacuuuggauugaagauacuacaaaaucaguuuaucaaguaaguucaacacgcaacaaacccaugauugaaaaaauggaaauuuaggauuuucuuuguuucagccccaaauaggaaaauaaggauaaaguuaagcucagguacaagaccacaaacacuccuugguucucugccuacaaaccacuccuaugaugcagaaaguuguugaaagcuuaguauauucuuucuaaucacagcuacuaucugaaaacccccccgauggagaaagauuuucaaagaugguagagguauguguuuuuuaugcuuacauccucuucuuagcacgaaauagaacuucagaggauuccacuaaccaaaauguaaucgcuuuguuuuucccagcauauauuaaacacugaagaaaacuggaacucguggaaaaaugaagguugcccaaguuuugugaaagaaagguaaauacauacugaaagaaagguaaauacauacucaucacaagaacgacgagaaaggcuuuugaaaaugugcuccgauaugauuauagcauguaaaaauacauguauauauuucacauaaaaaauguaaguugaacuuuguaagaguacaaccacuuugauuuaccucuguauuuuuuaaaccucauaaauuucuugucauuaaauuccuggaacaaacaucuuauuauugagaagaauacuguauaucuacuccguguaauuugccauauaauguggcauuuuuaucuuauaucugauaauuguucuaucauaauaugaaguuuucauuuuuuuuuuuuuuuugagagggagucucacucugucacccaggcuggagugcaguggcaugaucuuggcucaccgcagccuccgccucuuggguucaagcgauucucaugccucagccuccugaguugcugggauuacaggcgccuaccaccaugccuggcuaauuuuuguauuuuuaguagagacaggcuuucaccauguuggccaggcuggucucaaacuccugaccucaggugauccaccuaccucagccucccaaagugcugggauuacaggcaugagccaccaugcccagccaguuuucaucuuuuuuaagaggaaaacaauaacuaaauuuucuuuuacguuaaacauucuucuauuucuguuauccauuuguaauucaaaaaauaguguauguuuuguucacgacagaacaucagauaccaaaccuacgagaauaauucggaagagaacagcacccgaggacuuccuagggaaaggacccaccaaaaaaauucugaugggaaaguaggugaauuugucuucaugugggauguucuuaguuauuuuuauauuuugaagauguuacuuuaagaacucuccauccaaaauauaguaugagauuguguuugguacacacauagauagccaaagcaaaccgcacugucuauacugcccauuguguggguucaugcaccagauaaaccuucauuuugucuccagcuuccaaaaucugugucucuaggcugugccauuuuuuccguuucagacaguagaauuguuuagauuccaguuguugcaagguaccauaauccuugaguucucuuaccuuccaguuaacuauucauugcuuuauauugugcuggaauauuuuuagaaaaaacuaaagauuauaucauuaucauuagucaugauuaaugauuauaugcucauauagagaauaauuuuagguauuuuaaauaccaaaaauuauugagaaaaguaaaacucauacugucaacauccccaaauccacuguuuacauuguauuguuuuucuguucaguuucaaggcacaugaggaugguguccauaaaaaauguauuuauuucugugucuauuuuguagugaggaguuaacaaggcuuuggaaucuuugcccugauaauauggaagccuguaaaucagagacaaggcaaguugaacauuuuucaaaugaaguguugcuuuugucaaguguugaguagaauggagccuuuucucagcuaugaucagagcucaaaugaaauuuaaaaguuuauugugguugacuuuuggcacagcagcguguaacuucccaccauaaaacuccucaaagugcugauaaaauaauuuuagaaaucacaaaaaaauaaagauucacaaaaggaaucaaaacuacaaacagaagaguaagccuaugaacugauacgguucuagggcagcaguacuaaugauugccagcuuugagaaccagggaacuuggguuuuaauagucacaaaaguucguugaacuugcaaaaugggcaaguuuaauagcagucuagacauagguaaaguaagaauuaauggguuaauuaaugauuaagaaaucacccagaaagcaauacagaaggagcagaguuagaaacgaugacuuaaugauaguugaggagguccagcaaacaucugauggcagaaagaaauaauagagaaugggaaagaggcaauaauugaguuaauuauuaagaauaggcaugaauucauagguucaagaaguauaauacuuaaggaggauaaaccaaauaaauccauaucucuguacaugauaauaaagucaccagagagaaaaaacagacaaccuacaaaggagcaaaguuaaacuaacaguugacuucaagaacaacaaaaaucagaagacagugggaugagugcuugaaaaugucuuucacauucucuauuauuucuuucugccauuagauguuugcuggaccuccucaacuaucauuaacucaucguuuccaacucuugcuccuucuguauugcuuucugggugauuucuuaaucauuaauccaguaauucuuacuuucccuauguccagacugcuguuaaaccugcucguuuuguaaauucaaugacuauauuuucucauuucuagaaguauuacuugcuuuuucaacauuucaacuaaaaaauucuguaacaaguuaaacaguugugguugagugauugacuaaaacuaugagaaauuaucaacaguccccaguaaaaaagcugucuuaaggaaacugaacccagaaaggaguaaauugcagaaaggauuacuguguagacacuuugguaaacaugaagaaaucugaauaaaucuuaucaagaauucacuguuauaaaauaguaauaauuauuauuuaggguuauuuuaaaagguaaacuugauaaaagugacauguaagacaagaagggguggucagaauuaaagaauguuaugguuuaagucaaacaugcuuguaaaguaugugaaagaaauggaauauguaauuuuuaaauaaauugagggguaaaaguaaauacagaaaauuuaagcaaguaaauuagaagguaggagaggaggaaaaaagcacagaaaacacaacagaaaguacaaaacaguaugguuaaauucaaauauaaauggaaauggacuuucuggcucaaagacagaaauugguguuauauuuuaaagaucuaucggccaggcgcgguggcucauaccuguaaucccagcacuuugggaggccaaggcgggcggaucaugaggucaggagauagagaccaucguggcuaacacggugaaaccccgucucuacuaaaaauacaaaaaauuagccaagugugguggcaggcgccuguagucucagcuacuugggaggcugaggcaggagaauggcgugaaccugggaggcggagcuugcagugagucgagaucgcaccacugcacuccagccugggcgacagagcgagacuccgucucaaaaaaaaaaaaaaaaaaaagauccaucuauauguuuauaagaaauauaccuuaaaaauaaagauauggaaagguugaaacugaaagaacuuuuaaaagacguaauuuuuaaaaggcauaguuauauugauaucaggcagaaaaggcuuaaaagcagaaagcauuauuaaaaauaaaggcaaucauugcauaaagauaaaaggaaaaaauagaaauauacacauuuuaaacuuuauuuucuaagaauguguucucaaaaauuugacaaaauuagaaugagaaguugacccagggucaguuuucaccauccaccaccacccagaaaaccuaccaucuaguaggauuuugacagaccuuucucagaauuuaauaaauuugguggaaaaaacuuaguguaauacauuuagaauuuaacaaaauaauuaacaggcuuggucuuacagaaaccacaaguuuuuguaaauuaugugugaauagcaaaagcaaaaauacuuacaacuccuuuaaacacacuucuaaauaacccuugaaucaaagaagucauaauggaaauuggaaaauguagagcuaaauaauaaugaaaacacuacauguucagacuuuugagaucuaacucaguagaacacagaagagaaauguauagccuuaaguguuuacacuuucaaaaagaaugaaaucuaaaaaccaagcuaauaagagucugacacugagagucauucagaagaaaaguaaacucauagaaguagaaaguaaaauaagauuagaaaucaguaaaauagacaacaaacaauagagaagauaacaaaaucaaaagagaagaucaauaaaaacaaaaaccaggaaaaauagauaaaauucuaacaugauugauuccugccaaaucugugagagugaaucaacccaguagaaaaauguacaaaugaauagucagauucagaaguagaaaccuuaauaaaccucugagaagacggggaacuucacuaguaacuggaaguacaguuaaaaacuacagcaagcaguuuccagcuaagagauucaguaauuuaaaaauacccagauuuuauaagaauuauggauaaaaauaauuugccagugcugcugguaggagucugauggcacagucacucuaucugaauguuaaagaugucugugccccacuaguagguguguugaucagaauaguguuuuuaaaaacuaaguuugagaaucauuggugguuuguaaagucaauuuaguaauuucaacuagcauuuuuuaaaugaaauaggaaauauacuuuugugaagcauuagcuuuacuuauauauaucuguacauauacuugcauauauguguguacuggguugcaguguaaaaugaauuucuuauuguggguugcaguggaaguuugaaggcccagugccuaaagaaaucaguucaucuacaaggagacaggugcaagaauguucauuuaacauugucagagcaaagagugggaagacaaauaucucuguguaggacauggauaacuuggggcauguucauaaaauggaauauaguaucuguagcauuagaaaaugaauggauauugggauaguuuucuuaaaagagcccauuuuccuaguuuuacucuagaagaugucuucugauccugagaccucauuucuuugcuugacccuguaucaaaauuuuauuucuaaaaacaaauucaagaaagaugcauuuuaaaaaucaaccaugcuaccaugguaacaauuuaaauaagagcuaaagguuaaacccuugaaaucguauuauggucugauuauuaguuuugguuuaauucugguuuaaagaaaaaauaauucguggauagggacuuaauguaaaaguuuauuugcugguaaaauucaaaugcuauaaaauacccuggcugcccucuuugaauagcaacauauuuauauauuauaguguguaauuaaaguauauaauauuauauguaguaaauacuauguaauauuuaguauuagacuauccccuuuauuuauuguccuuuuugaauuuaguuuugacgguuuuacuuccuuaaaagucuggaguucccacguaaucaaaacuguaacuaaaaguauggggccauuagaaucuuguccugccaccacuuuaugaguauuuauuauuaagaguauaugccauccucacugguuauuuuguaccgcucagggaacacaugcccacaaucuuguccugccaccacuuuaugaguauuuauuauuaagaguauaugccauccucacugguuauuuuguaccgcucagggaacacaugcccacaaucuuguccugccaccacuuuaugaguauuuauuauuaagaguauaugccauccucacugguuauuuuguaccgcucagggaacacaugcccacaaucuuguccugccaccacuuuaugaguauuuauuauuaagaguauaugccauccucacugguuauuuuguaccgcucagggaacacaugcccacaaucuuguccugccaccacuuuaugaguauuuauuauuaagaguauaugccauccucacugguuauuuuuguacugcucagggaacacaugcccacaaucuuguccugccaccacuucaugaguauuuauuauuaagaauauaugccauccucacugguuauuuuuguaccgcucagggaacacaugcccacuuuggaggaauucuuugaagaagccauugaacaggcagacccugaaaauaugguggaaaaugaauauaaguaaguaugcuccucauuagcuccuuuuaauuuucuucaauuuguuucuuccuuaggaauuguguguauacuagaaagccucuuaagagaggcaguagauagaauagugcuuuuucucuuaggugaguuuauguuccaaguucuuguuaguacacauccugauuucaaggauuauuccuguuaacuaagcaugacuuggaaucacccuuguuucaaaauauaagaaaaaaaaaacucccccugauccccauuucucuccaacuauuaguucuguucucucuacccuucaaagcacaguaucucacagcagcuguuaaccuauccuguuccccuuaauguuuucuucucuuggcguccaugagaauccaaauccaugguucuucuguuugcccuuugcccucguugcccacuccaccucacauuccauuucagccuccucauccucugccuaacucaaauuuuggaguaacaucaggaauuggucuuagccucuuuaucuagaaccuucugggugacaccgcagucucauggcuuuaaauaggaauugaagaguagugguuuaaaggcaagaggccucuggucagaaugcauagguucgauucccucuaccacuuacuuacuaggcaacuaaggcuaauuuaauuauuaaaccgccaguucccuuuccucaucuguuaaauaguaacaguacccauuucacaggguuauucugaggauuaaauaagacagugcacuuugaacccuacagggcaugugguuagcacucaguauuugugacuagugugacccugugaccagaguuguuaauuacugugaccucuuaacuaaucucucuaguuguggucagugcuccaugcaucagccagugaucuuuaaaauaauuguccaagucuaaucugcuuaaaaucucccagugagugccuauuccaaacuccuucccagggccuaaaagaccuccuuggucuggcucauacucuccuguguggccaugccuccccucugcuuuaaccacagcaggccucuugguccugucuuucccuuuccugucaggaccuucacacuuuacugucucacuugcuugaaccacuuuuuccccaagguugccguggcuuaaagucccccuggcugggaagcucuuccccucccuggucuccucuuuugcauucucgugguuuuuauuucacggcacuuaccacuauccaaaugagaagguggcacuuaccacuuucucauuucucaaguuuuccucauccuuaugaaauugucuuauaccuuguguguuuaucacuagcaaugccugccuuacugugccucagguacucuccacagcuacugagugccuggcucaaaaguguuugucgauugaaagaauauuaauuuaucacuguuacauaagacuagguggacucauuccuaaagugauaguucaaauuauuaucuccaaagaggguuuuguggagaauaagaaaaaugauguguauaauugacagugaauuuugaaaaugccuaaaauaaucaaauugucuaaacagauaugucagagaggaaggcucuuaacuguuuaggcaaagccucacagcagguguuaacuugggaagaguccccagugucuauggguaguuuuuguuaagucuucagugguaccugcacauccuaaagguaacauaugcuuauuuauaagaggugaccaaauaaaccaaauugcuauucuuaggggaggaagagacuuccaauccaaaacucuuaaauggaauaaauuugugguuugguuucuuccgcagcauugcauauuucugacgcauuaucuuuagaauuucucugcaguuuguuucucaccugaugguauaccacccugaucauuguuauacuucauuagggaacaguucauggauuccaaauagcuagauggaugauuccuguuguauacguacugcauccagccaguacugcacacacuuguugacuuguuaaaauuaaacaaaaugaacggaaacuuugaaaauguguuugcugcauaugagccugccucuucaggcauuguugguuccugugauuaguuacaugugcaucuauugguuuguuauuaucaguggacuacauacugaaaaguucuuuaggaauaagauucaaauacaaagaauggcacuuugagcuauuuaccuuaaauacagaauuacacauggcagaacugagcagaagggaauacagaaauacaaagcuauaaauuacaagccugacaccucuuuuuauagggcugugaacaauucaaauuaugguuggagagcccugagacuauuagcacggagaagcccucacuucuuccagccaaccaaccagcaguuuaaaaguuuaccagaauaucuugaaaauaugguaauaaagcuagccaaggaauuaccgguaaguaccauagaucaacuuuucauacccuuuaguugacaucuucuuuaaaauugcugucacuaugugagcaaaaaacugacuuaaucaugugaaaaaccagugauccacaagcucccauguuuuagaaugagggaaaaacacauuggaauauacauuuacaggaaauacaugaguugauaaagaaguaacugauaauuuucuguacagcauguaauuuaaaguucaacagggcugugggugcgguggcucacgacuguaaucccagcacuuugggaggccgaggcggguggaucaugaggucaagagauugagaccauccuggccaauauggugaaaccccgucucuacuaaaauauaaaaaauuagccaggugugguggcacgugccuguagucccagcuacucaagaggcugaggcaagggaauugcuugaaccugggaggcggagguugcagugagccgagaucucgccacugcacuccagccuggcaaccaagcaagacuccgucucaaaaaauuaaaguucgugauacuucagguaaacuguuaugcaccuauacacacagacaugaauuuuuuccuguuugccaaugcauuauauugucuuuuaucaaagauaaaagauaagaaucagaaacuuuuaaggacacuguugcuacuggcuuccuugaggccgucuuuacuaaauaaacccuggguauuugcaaauccuggaacugugcuuuuuacugacuuccugcuucccagauuggggguggggagucuuuccaacucugaggucuucccaaguucacuccuucugcaggugaagauagucccacuuaggauccuuaccugacacugucauuuaacgcucucaggggugagguucuggcacccuguacuuggaaucucacaaccguccuuauccaaacaaaauaccuguuaccuuacuucagaggcuggcauucuuucaaacauucuucuuucucauuuuuagccuccuucugaagaaauaaaaacaggugaggaugaagaugaggaagauaaugaugcucuacugaaggaaaaugaaaguaagaacugaauuuucuugguuauuuaacaaaauugaagacgauugggguucuuuguugauagguacauuauuuaauuugaucgacuucucaacuucucccauuuuaucucaacuguuucugacauagugaggaauuuaaaacauugcuuaauaauaacuuuaaaaacacuacauuuuaugcaauaaaauugggaaguaauggugcuuuaaaagggaaugaaaauacauuugaaggcgacccauaccucuguuaauuauugguuauuggagggggagcaccucauuucagggaaagccuacguaauuauagguaacagcuuuagcuuugauuauugaccaugcuuauuaagagugguauucaacuuacggagaauauaaaaaauaauuguuuacuuuuaaaauaaagucuacuaaaggugguuaauaaaacuuauuggccccauagcuuuccauuucuguuguauacuuagaauugcgcauaauuuauauucucuucauuuucuagguccugauguucggcgagacaaaccuguaacaggagaacaaauagagguauuugccaacaagcugggugaacaauggaagauucuggcucccuacuuggaaaugaaagacucagaaauuaggcagauugagugugacagugaagacaugaagaugagagcuaagcagcuccugguugccuggcaagaucaagagggaguucaugcaacaccugagaaucugauuaaugcacugaauaagucuggauuaagugaccuugcagaaagucuaacuaaugacaaugagacaaauaguuagcuucuuuuuuuuuucuuuuuauuaaaacugugauagauuuuguuaccaagcagcauuugauaagagguccacugguuuugguaaacaauaaacauuuuuauaacaauuguuguacagucggcuggugcucugagaacaauagaacacauauuggcucaaaccagaguuuggggagguuggguugagauaaugaccuaaacgaagugaccucaagaucacaaaauauauuuuuuuguuaaguagauguauuuauaaugaaguuaaauaagcacuauuuagggauaugucguuucuuauaccaaauuaguuuccuguguguuguuuguuaguaguuuuacaaaauuuauccugaaaucccagaauaacacuuucugaaaccauaugacugcucuguucucacuuauucgugcuuucaagcagaggaucaacaaaugaugguuuguucugccugccacgagucuugaucauuaaaauuguacuggcacccagcugugcucacucauaacuaacuaacuaacugucuauggcuccagcuacacuauaacaacagcaaagcuaaggagcugcagcacuuuauagccugcaaagccugaaauaauuuacuaucaaucaucaaucaaucaucaucuaucuaucuaucuaucuaucuaaucuaucuaucuuguccauuacagaaaauguuuguuugccaacuuuaaaagaaaugaagucuaaaaccucacuuuuccuucuagccuuacaaaaauugccugaccucucaagacuuuuaaucacuucagggauucuugugacauucaacugagauauaugugaacacacccuauacacagcaaagcacuaaguaguaguagcagaagacaguaccaccgacuuuucuuguucccacauaagcauuucccuuuagggcucuaagaugaggucaucaucguuuuuaauccugaagaagggcuacugagugagugcagauuauucgguaaacacucuuaggccuaaccuagcuagucagucaagcaguaaucuagcacaacucuaauguugagaugauggccucggugugaguggcacagcauauaaggcacauucaggaaucaagacuuuuuuuuuuuuggccuacuccucucccuucucaaagaccuuacaggcaaggcugaauucuaaaauagccuuauuaguuaaaaacaacacugguauaacuaacucccauuucuacuugaaaaaauucuuuggaauaaugcuuuuuuagaucaaauaaaaaaaucaagcuuuuuauaaugaugauaaggaauuaauuacaauuuuuaaaauucuaauauaguccauacaaggcuuauauacuuugcucuaaaccuagcucaccuggucuaguagcuacaacauuuaguagcuacagucagaaaaucuaaauucuaauuguuaaauucauguccucaauaaaauuguucugaccaaaugagacaaugaauaaaaaagacuuugcaaaguuacaagcaucauacaaauauacaugaaucauuauaauuuucauggucucauccugcccauucuauucuuaauccccuccacaaaguagaaaguauugauugccaagucaaaguuuaggugaggaagcuauuuacaaauaaguuucccugcaaugcuuauuuuauccccuccuaguguucacagauugcaucacaucagauuugaaaguaaaauggcuguuauuuucuauuuuuaauaguuaucaucaguguugugcucugccgagcauuaaaacaacauacacaaagauaugagauguuaugauaauccccaaacuuuauuauaaauaacucaaaaucagagccaaacuggcugguauucuaugcuuuauccuuucccuagcaucagucaaggguccuggaacaaagaugaguaacuauuaaaauguaagaagccuaucauauugaaauaccucauaugcuugguauuuucuacuaucacuuuaaaaucacuaaaauucugaaacagacauuaagauuugggaauuuuuucuuuuuuuuuuugagacagagucucucugucacccaggcuggagugcaguggugugaucucagcucacugcaacuucugccuuccagguucaagcaauucucccaccucagccucccaaguagcugggaucacaggugugcaccaccacauccagcuaauuuuuauaucuuuaguagagacaggguuucaccauguggccaggcuggucucgaacucaaccuccagugaaccaccugccucagccucccaaagugcugggauuacaggcgugagccaccgugcccagccaagauuuggggaauuaagaaaggaaauacaaacacaacugagccaaggaaagaaucugacugauaacaucacugcauucagcauccaaagaaauccauuacuuuuacaacuuuguauuucuuuuuaaaauacaggcaggcaaagaagauaacaaauauuuuuaaauggaugcuuaacagcacaguguuaauaaccaucuucagaaauuguacaguauuaaacaugucuucagccaagcuccaacacucagaagacaaaagacuugaggucaaaagcuauuaaucccuuuuuuuuuauuauuauuaaauguccucauuuucuaaaaauaagcaaccagagcuugucaacauuuucuuaagacugauuauuacaaagccauuccaaaguuaaauguacaauccacaguacaucagagagagacacaauaauaaauguauaaucaaagguacuauuauugaucacaauuuauuuuaaagucaggaaaagccugcaauaggcuggacaaauacuugauugugcccauguuuccaugggauggacagcagcacugagucacacaaugagagcaacacuuccuuuuccaccuuccuggaaaaauguuuguuagauaaggcaaaggauggguggcuacagaauggugguuugaaccaugcaagaacagcaaauaauagguaauaggugugcaguaaacaucugacugcugaaucuugggugaaaaaggcagcaagaaaaaugaccacagaaggaaaugguugaaaggcauuucaacucugaacuuuuuaaaauaaugcaagaaauaauaagcuuuuuaaaaaugucuuucugccaccuuuauauagggcagcacaauccaaagauaauuuucucuucucuguaauuuuuuagguuggugcacagaguggucugcuucuguccucuuuuguuccaaaugaggugaaacauaaacccaccuaugugucuuccucuaaagcucuggauuauagaaaugaucaacaaauaacauuuauuuucacaucuaagcauaaauacuaaaaugaagauuacuguucacuuuccucuuccauuauuucaacucugcgaggcccauagaguagaacguaagcgauaugccagucuccaccaccagaaagccguaagauaucuucugguguuacgaugcugacuuugucaucaucaaacuuaauccauucaucuaaauaacagggacaagaagaugaauuaauguuaugcaggauucgucucagaguuc

SEQ ID NO: 18471 - RNA, 57323 nt, Homo sapiens
gaacucugagacgaauccugcauaacauuaauucaucuucuugucccuguuauuuagaugaauggauuaaguuugaugaugacaaagucagcaucguaacaccagaagauaucuuacggcuuucuggugguggagacuggcauaucgcuuacguucuacucuaugggccucgcagaguugaaauaauggaagaggaaagugaacaguaaucuucauuuuaguauuuaugcuuagaugugaaaauaaauguuauuuguugaucauuucuauaauccagagcuuuagaggaagacacauagguggguuuauguuucaccucauuuggaacaaaagaggacagaagcagaccacucugugcaccaaccuaaaaaauuacagagaagagaaaauuaucuuuggauugugcugcccuauauaaagguggcagaaagacauuuuuaaaaagcuuauuauuucuugcauuauuuuaaaaaguucagaguugaaaugccuuucaaccauuuccuucuguggucauuuuucuugcugccuuuuucacccaagauucagcagucagauguuuacugcacaccuauuaccuauuauuugcuguucuugcaugguucaaaccaccauucuguagccacccauccuuugccuuaucuaacaaacauuuuuccaggaagguggaaaaggaaguguugcucucauugugugacucagugcugcuguccaucccauggaaacaugggcacaaucaaguauuuguccagccuauugcaggcuuuuccugacuuuaaaauaaauugugaucaauaauaguaccuuugauuauacauuuauuauugugucucucucugauguacuguggauuguacauuuaacuuuggaauggcuuuguaauaaucagucuuaagaaaauguugacaagcucugguugcuuauuuuuagaaaaugaggacauuuaauaauaauaaaaaaaaagggauuaauagcuuuugaccucaagucuuuugucuucugaguguuggagcuuggcugaagacauguuuaauacuguacaauuucugaagaugguuauuaacacugugcuguuaagcauccauuuaaaaauauuuguuaucuucuuugccugccuguauuuuaaaaagaaauacaaaguuguaaaaguaauggauuucuuuggaugcugaaugcagugauguuaucagucagauucuuuccuuggcucaguuguguuuguauuuccuuucuuaauuccccaaaucuuggcugggcacgguggcucacgccuguaaucccagcacuuugggaggcugaggcaggugguucacuggagguugaguucgagaccagccuggccacauggugaaacccugucucuacuaaagauauaaaaauuagcuggaugugguggugcacaccugugaucccagcuacuugggaggcugaggugggagaauugcuugaaccuggaaggcagaaguugcagugagcugagaucacaccacugcacuccagccugggugacagagagacucugucucaaaaaaaaaaagaaaaaauucccaaaucuuaaugucuguuucagaauuuuagugauuuuaaagugauaguagaaaauaccaagcauaugagguauuucaauaugauaggcuucuuacauuuuaauaguuacucaucuuuguuccaggacccuugacugaugcuagggaaaggauaaagcauagaauaccagccaguuuggcucugauuuugaguuauuuauaauaaaguuuggggauuaucauaacaucucauaucuuuguguauguuguuuuaaugcucggcagagcacaacacugaugauaacuauuaaaaauagaaaauaacagccauuuuacuuucaaaucugaugugaugcaaucugugaacacuaggaggggauaaaauaagcauugcagggaaacuuauuuguaaauagcuuccucaccuaaacuuugacuuggcaaucaauacuuucuacuuuguggaggggauuaagaauagaaugggcaggaugagaccaugaaaauuauaaugauucauguauauuuguaugaugcuuguaacuuugcaaagucuuuuuuauucauugucucauuuggucagaacaauuuuauugaggacaugaauuuaacaauuagaauuuagauuuucugacuguagcuacuaaauguuguagcuacuagaccaggugagcuagguuuagagcaaaguauauaagccuuguauggacuauauuagaauuuuaaaaauuguaauuaauuccuuaucaucauuauaaaaagcuugauuuuuuuauuugaucuaaaaaagcauuauuccaaagaauuuuuucaaguagaaaugggaguuaguuauaccaguguuguuuuuaacuaauaaggcuauuuuagaauucagccuugccuguaaggucuuugagaagggagaggaguaggccaaaaaaaaaaaagucuugauuccugaaugugccuuauaugcugugccacucacaccgaggccaucaucucaacauuagaguugugcuagauuacugcuugacugacuagcuagguuaggccuaagaguguuuaccgaauaaucugcacucacucaguagcccuucuucaggauuaaaaacgaugaugaccucaucuuagagcccuaaagggaaaugcuuaugugggaacaagaaaagucggugguacugucuucugcuacuacuacuuagugcuuugcuguguauaggguguguucacauauaucucaguugaaugucacaagaaucccugaagugauuaaaagucuugagaggucaggcaauuuuuguaaggcuagaaggaaaagugagguuuuagacuucauuucuuuuaaaguuggcaaacaaacauuuucuguaauggacaagauagauagauuagauagauagauagauagauagaugaugauugauugaugauugauaguaaauuauuucaggcuuugcaggcuauaaagugcugcagcuccuuagcuuugcuguuguuauaguguagcuggagccauagacaguuaguuaguuaguuaugagugagcacagcugggugccaguacaauuuuaaugaucaagacucguggcaggcagaacaaaccaucauuuguugauccucugcuugaaagcacgaauaagugagaacagagcagucauaugguuucagaaaguguuauucugggauuucaggauaaauuuuguaaaacuacuaacaaacaacacacaggaaacuaauuugguauaagaaacgacauaucccuaaauagugcuuauuuaacuucauuauaaauacaucuacuuaacaaaaaaauauauuuugugaucuugaggucacuucguuuaggucauuaucucaacccaaccuccccaaacucugguuugagccaauauguguucuauuguucucagagcaccagccgacuguacaacaauuguuauaaaaauguuuauuguuuaccaaaaccaguggaccucuuaucaaaugcugcuugguaacaaaaucuaucacaguuuuaauaaaaagaaaaaaaaaagaagcuaacuauuugucucauugucauuaguuagacuuucugcaaggucacuuaauccagacuuauucagugcauuaaucagauucucagguguugcaugaacucccucuugaucuugccaggcaaccaggagcugcuuagcucucaucuucaugucuucacugucacacucaaucugccuaauuucugagucuuucauuuccaaguagggagccagaaucuuccauuguucacccagcuuguuggcaaauaccucuauuuguucuccuguuacagguuugucucgccgaacaucaggaccuagaaaaugaagagaauauaaauuaugcgcaauucuaaguauacaacagaaauggaaagcuauggggccaauaaguuuuauuaaccaccuuuaguagacuuuauuuuaaaaguaaacaauuauuuuuuauauucuccguaaguugaauaccacucuuaauaagcauggucaauaaucaaagcuaaagcuguuaccuauaauuacguaggcuuucccugaaaugaggugcucccccuccaauaaccaauaauuaacagagguaugggucgccuucaaauguauuuucauucccuuuuaaagcaccauuacuucccaauuuuauugcauaaaauguaguguuuuuaaaguuauuauuaagcaauguuuuaaauuccucacuaugucagaaacaguugagauaaaaugggagaaguugagaagucgaucaaauuaaauaauguaccuaucaacaaagaaccccaaucgucuucaauuuuguuaaauaaccaagaaaauucaguucuuacuuucauuuuccuucaguagagcaucauuaucuuccucaucuucauccucaccuguuuuuauuucuucagaaggaggcuaaaaaugagaaagaagaauguuugaaagaaugccagccucugaaguaagguaacagguauuuuguuuggauaaggacgguugugagauuccaaguacagggugccagaaccucaccccugagagcguuaaaugacagugucagguaaggauccuaagugggacuaucuucaccugcagaaggagugaacuugggaagaccucagaguuggaaagacuccccacccccaaucugggaagcaggaagucaguaaaaagcacaguuccaggauuugcaaauacccaggguuuauuuaguaaagacggccucaaggaagccaguagcaacaguguccuuaaaaguuucugauucuuaucuuuuaucuuugauaaaagacaauauaaugcauuggcaaacaggaaaaaauucaugucuguguguauaggugcauaacaguuuaccugaaguaucacgaacuuuaauuuuuugagacggagucuugcuugguugccaggcuggagugcaguggcgagaucucggcucacugcaaccuccgccucccagguucaagcaauucccuugccucagccucuugaguagcugggacuacaggcacgugccaccacaccuggcuaauuuuuuauauuuuaguagagacgggguuucaccauauuggccaggauggucucaaucucuugaccucaugauccacccgccucggccucccaaagugcugggauuacagucgugagccaccgcacccacagcccuguugaacuuuaaauuacaugcuguacagaaaauuaucaguuacuucuuuaucaacucauguauuuccuguaaauguauauuccaauguguuuuucccucauucuaaaacaugggagcuuguggaucacugguuuuucacaugauuaagucaguuuuuugcucacauagugacagcaauuuuaaagaagaugucaacuaaaggguaugaaaaguugaucuaugguacuuaccgguaauuccuuggcuagcuuuauuaccauauuuucaagauauucugguaaacuuuuaaacugcugguugguuggcuggaagaagugagggcuucuccgugcuaauagucucagggcucuccaaccauaauuugaauuguucacagcccuauaaaaagaggugucaggcuuguaauuuauagcuuuguauuucuguauucccuucugcucaguucugccauguguaauucuguauuuaagguaaauagcucaaagugccauucuuuguauuugaaucuuauuccuaaagaacuuuucaguauguaguccacugauaauaacaaaccaauagaugcacauguaacuaaucacaggaaccaacaaugccugaagaggcaggcucauaugcagcaaacacauuuucaaaguuuccguucauuuuguuuaauuuuaacaagucaacaagugugugcaguacuggcuggaugcaguacguauacaacaggaaucauccaucuagcuauuuggaauccaugaacuguucccuaaugaaguauaacaaugaucagggugguauaccaucaggugagaaacaaacugcagagaaauucuaaagauaaugcgucagaaauaugcaaugcugcggaagaaaccaaaccacaaauuuauuccauuuaagaguuuuggauuggaagucucuuccuccccuaagaauagcaauuugguuuauuuggucaccucuuauaaauaagcauauguuaccuuuaggaugugcagguaccacugaagacuuaacaaaaacuacccauagacacuggggacucuucccaaguuaacaccugcugugaggcuuugccuaaacaguuaagagccuuccucucugacauaucuguuuagacaauuugauuauuuuaggcauuuucaaaauucacugucaauuauacacaucauuuuucuuauucuccacaaaacccucuuuggagauaauaauuugaacuaucacuuuaggaaugaguccaccuagucuuauguaacagugauaaauuaauauucuuucaaucgacaaacacuuuugagccaggcacucaguagcuguggagaguaccugaggcacaguaaggcaggcauugcuagugauaaacacacaagguauaagacaauuucauaaggaugaggaaaacuugagaaaugagaaagugguaagugccaccuucucauuuggauagugguaagugccgugaaauaaaaaccacgagaaugcaaaagaggagaccagggaggggaagagcuucccagccagggggacuuuaagccacggcaaccuuggggaaaaagugguucaagcaagugagacaguaaagugugaagguccugacaggaaagggaaagacaggaccaagaggccugcugugguuaaagcagaggggaggcauggccacacaggagaguaugagccagaccaaggaggucuuuuaggcccugggaaggaguuuggaauaggcacucacugggagauuuuaagcagauuagacuuggacaauuauuuuaaagaucacuggcugaugcauggagcacugaccacaacuagagagauuaguuaagaggucacaguaauuaacaacucuggucacagggucacacuagucacaaauacugagugcuaaccacaugcccuguaggguucaaagugcacugucuuauuuaauccucagaauaacccugugaaauggguacuguuacuauuuaacagaugaggaaagggaacuggcgguuuaauaauuaaauuagccuuaguugccuaguaaguaagugguagagggaaucgaaccuaugcauucugaccagaggccucuugccuuuaaaccacuacucuucaauuccuauuuaaagccaugagacugcggugucacccagaagguucuagauaaagaggcuaagaccaauuccugauguuacuccaaaauuugaguuaggcagaggaugaggaggcugaaauggaaugugagguggagugggcaacgagggcaaagggcaaacagaagaaccauggauuuggauucucauggacgccaagagaagaaaacauuaaggggaacaggauagguuaacagcugcugugagauacugugcuuugaaggguagagagaacagaacuaauaguuggagagaaauggggaucagggggaguuuuuuuuuucuuauauuuugaaacaagggugauuccaagucaugcuuaguuaacaggaauaauccuugaaaucaggauguguacuaacaagaacuuggaacauaaacucaccuaagagaaaaagcacuauucuaucuacugccucucuuaagaggcuuucuaguauacacacaauuccuaaggaagaaacaaauugaagaaaauuaaaaggagcuaaugaggagcauacuuacuuauauucauuuuccaccauauuuucagggucugccuguucaauggcuucuucaaagaauuccuccaaagugggcauguguucccugagcgguacaaaaauaaccagugaggauggcauauauucuuaauaauaaauacucaugaagugguggcaggacaagauugugggcauguguucccugagcaguacaaaaauaaccagugaggauggcauauacucuuaauaauaaauacucauaaagugguggcaggacaagauugugggcauguguucccugagcgguacaaaauaaccagugaggauggcauauacucuuaauaauaaauacucauaaagugguggcaggacaagauugugggcauguguucccugagcgguacaaaauaaccagugaggauggcauauacucuuaauaauaaauacucauaaagugguggcaggacaagauugugggcauguguucccugagcgguacaaaauaaccagugaggauggcauauacucuuaauaauaaauacucauaaagugguggcaggacaagauugugggcauguguucccugagcgguacaaaauaaccagugaggauggcauauacucuuaauaauaaauacucauaaagugguggcaggacaagauucuaauggccccauacuuuuaguuacaguuuugauuacgugggaacuccagacuuuuaaggaaguaaaaccgucaaaacuaaauucaaaaaggacaauaaauaaaggggauagucuaauacuaaauauuacauaguauuuacuacauauaauauuauauacuuuaauuacacacuauaauauauaaauauguugcuauucaaagagggcagccaggguauuuuauagcauuugaauuuuaccagcaaauaaacuuuuacauuaagucccuauccacgaauuauuuuuucuuuaaaccagaauuaaaccaaaacuaauaaucagaccauaauacgauuucaaggguuuaaccuuuagcucuuauuuaaauuguuaccaugguagcaugguugauuuuuaaaaugcaucuuucuugaauuuguuuuuagaaauaaaauuuugauacagggucaagcaaagaaaugaggucucaggaucagaagacaucuucuagaguaaaacuaggaaaaugggcucuuuuaagaaaacuaucccaauauccauucauuuucuaaugcuacagauacuauauuccauuuuaugaacaugccccaaguuauccauguccuacacagagauauuugucuucccacucuuugcucugacaauguuaaaugaacauucuugcaccugucuccuuguagaugaacugauuucuuuaggcacugggccuucaaacuuccacugcaacccacaauaagaaauucauuuuacacugcaacccaguacacacauauaugcaaguauauguacagauauauauaaguaaagcuaaugcuucacaaaaguauauuuccuauuucauuuaaaaaaugcuaguugaaauuacuaaauugacuuuacaaaccaccaaugauucucaaacuuaguuuuuaaaaacacuauucugaucaacacaccuacuaguggggcacagacaucuuuaacauucagauagagugacugugccaucagacuccuaccagcagcacuggcaaauuauuuuuauccauaauucuuauaaaaucuggguauuuuuaaauuacugaaucucuuagcuggaaacugcuugcuguaguuuuuaacuguacuuccaguuacuagugaaguuccccgucuucucagagguuuauuaagguuucuacuucugaaucugacuauucauuuguacauuuuucuacuggguugauucacucucacagauuuggcaggaaucaaucauguuagaauuuuaucuauuuuuccugguuuuuguuuuuauugaucuucucuuuugauuuuguuaucuucucuauuguuuguugucuauuuuacugauuucuaaucuuauuuuacuuucuacuucuaugaguuuacuuuucuucugaaugacucucagugucagacucuuauuagcuugguuuuuagauuucauucuuuuugaaaguguaaacacuuaaggcuauacauuucucuucuguguucuacugaguuagaucucaaaagucugaacauguaguguuuucauuauuauuuagcucuacauuuuccaauuuccauuaugacuucuuugauucaaggguuauuuagaaguguguuuaaaggaguuguaaguauuuuugcuuuugcuauucacacauaauuuacaaaaacuugugguuucuguaagaccaagccuguuaauuauuuuguuaaauucuaaauguauuacacuaaguuuuuuccaccaaauuuauuaaauucugagaaaggucugucaaaauccuacuagaugguagguuuucuggguggugguggauggugaaaacugacccugggucaacuucucauucuaauuuugucaaauuuuugagaacacauucuuagaaaauaaaguuuaaaauguguauauuucuauuuuuuccuuuuaucuuuaugcaaugauugccuuuauuuuuaauaaugcuuucugcuuuuaagccuuuucugccugauaucaauauaacuaugccuuuuaaaaauuacgucuuuuaaaaguucuuucaguuucaaccuuuccauaucuuuauuuuuaagguauauuucuuauaaacauauagauggaucuuuuuuuuuuuuuuuuuuuugagacggagucucgcucugucgcccaggcuggagugcaguggugcgaucucgacucacugcaagcuccgccucccagguucacgccauucuccugccucagccucccaaguagcugagacuacaggcgccugccaccacacuuggcuaauuuuuuguauuuuuaguagagacgggguuucaccguguuagccacgauggucucuaucuccugaccucaugauccgcccgccuuggccucccaaagugcugggauuacagguaugagccaccgcgccuggccgauagaucuuuaaaauauaacaccaauuucugucuuugagccagaaaguccauuuccauuuauauuugaauuuaaccauacuguuuuguacuuucuguuguguuuucugugcuuuuuuccuccucuccuaccuucuaauuuacuugcuuaaauuuucuguauuuacuuuuaccccucaauuuauuuaaaaauuacauauuccauuucuuucacauacuuuacaagcauguuugacuuaaaccauaacauucuuuaauucugaccaccccuucuugucuuacaugucacuuuuaucaaguuuaccuuuuaaaauaacccuaaauaauaauuauuacuauuuuauaacagugaauucuugauaagauuuauucagauuucuucauguuuaccaaagugucuacacaguaauccuuucugcaauuuacuccuuucuggguucaguuuccuuaagacagcuuuuuuacuggggacuguugauaauuucucauaguuuuagucaaucacucaaccacaacuguuuaacuuguuacagaauuuuuuaguugaaauguugaaaaagcaaguaauacuucuagaaaugagaaaauauagucauugaauuuacaaaacgagcagguuuaacagcagucuggacauagggaaaguaagaauuacuggauuaaugauuaagaaaucacccagaaagcaauacagaaggagcaagaguuggaaacgaugaguuaaugauaguugaggagguccagcaaacaucuaauggcagaaagaaauaauagagaaugugaaagacauuuucaagcacucaucccacugucuucugauuuuuguuguucuugaagucaacuguuaguuuaacuuugcuccuuuguagguugucuguuuuuucucucuggugacuuuauuaucauguacagagauauggauuuauuugguuuauccuccuuaaguauuauacuucuugaaccuaugaauucaugccuauucuuaauaauuaacucaauuauugccucuuucccauucucuauuauuucuuucugccaucagauguuugcuggaccuccucaacuaucauuaagucaucguuucuaacucugcuccuucuguauugcuuucugggugauuucuuaaucauuaauuaacccauuaauucuuacuuuaccuaugucuagacugcuauuaaacuugcccauuuugcaaguucaacgaacuuuugugacuauuaaaacccaaguucccugguucucaaagcuggcaaucauuaguacugcugcccuagaaccguaucaguucauaggcuuacucuucuguuuguaguuuugauuccuuuugugaaucuuuauuuuuuugugauuucuaaaauuauuuuaucagcacuuugaggaguuuuauggugggaaguuacacgcugcugugccaaaagucaaccacaauaaacuuuuaaauuucauuugagcucugaucauagcugagaaaaggcuccauucuacucaacacuugacaaaagcaacacuucauuugaaaaauguucaacuugccuugucucugauuuacaggcuuccauauuaucagggcaaagauuccaaagccuuguuaacuccucacuacaaaauagacacagaaauaaauacauuuuuuauggacaccauccucaugugccuugaaacugaacagaaaaacaauacaauguaaacaguggauuuggggauguugacaguaugaguuuuacuuuucucaauaauuuuugguauuuaaaauaccuaaaauuauucucuauaugagcauauaaucauuaaucaugacuaaugauaaugauauaaucuuuaguuuuuucuaaaaauauuccagcacaauauaaagcaaugaauaguuaacuggaagguaagagaacucaaggauuaugguaccuugcaacaacuggaaucuaaacaauucuacugucugaaacggaaaaaauggcacagccuagagacacagauuuuggaagcuggagacaaaaugaagguuuaucuggugcaugaacccacacaaugggcaguauagacagugcgguuugcuuuggcuaucuauguguguaccaaacacaaucucauacuauauuuuggauggagaguucuuaaaguaacaucuucaaaauauaaaaauaacuaagaacaucccacaugaagacaaauucaccuacuuucccaucagaauuuuuuugguggguccuuucccuaggaaguccucgggugcuguucucuuccgaauuauucucguagguuugguaucugauguucugucgugaacaaaacauacacuauuuuuugaauuacaaauggauaacagaaauagaagaauguuuaacguaaaagaaaauuuaguuauuguuuuccucuuaaaaaagaugaaaacuggcugggcaugguggcucaugccuguaaucccagcacuuugggaggcugagguagguggaucaccugaggucaggaguuugagaccagccuggccaacauggugaaagccugucucuacuaaaaauacaaaaauuagccaggcauggugguaggcgccuguaaucccagcaacucaggaggcugaggcaugagaaucgcuugaacccaagaggcggaggcugcggugagccaagaucaugccacugcacuccagccugggugacagagugagacucccucucaaaaaaaaaaaaaaaaugaaaacuucauauuaugauagaacaauuaucagauauaagauaaaaaugccacauuauauggcaaauuacacggaguagauauacaguauucuucucaauaauaagauguuuguuccaggaauuuaaugacaagaaauuuaugagguuuaaaaaauacagagguaaaucaaagugguuguacucuuacaaaguucaacuuacauuuuuuaugugaaauauauacauguauuuuuacaugcuauaaucauaucggagcacauuuucaaaagccuuucucgucguucuugugaugaguauguauuuaccuuucuuucaguauguauuuaccuuucuuucacaaaacuugggcaaccuucauuuuuccacgaguuccaguuuucuucaguguuuaauauaugcugggaaaaacaaagcgauuacauuuugguuaguggaauccucugaaguucuauuucgugcuaagaagaggauguaagcauaaaaaacacauaccucuaccaucuuugaaaaucuuucuccaucggggggguuuucagauaguagcugugauuagaaagaauauacuaagcuuucaacaacuuucugcaucauaggagugguuuguaggcagagaaccaaggaguguuuguggucuuguaccugagcuuaacuuuauccuuauuuuccuauuuggggcugaaacaaagaaaauccuaaauuuccauuuuuucaaucauggguuuguugcguguugaacuuacuugauaaacugauuuuguaguaucuucaauccaaagugauugcucaucaguuaaaacauaguuugaacuagggaacaaagcaaugaaagcaugcuugaguuacagcaaugcauaugcaacuuuaagguuuaaaaaacacaaggcauguaacauguaacuauacuguggauagugucaaaaauuaccaagacaagaauaaucacaaaugagaggauuauaagagaaaauucuugcacuucuuccucaagaggguugguacugaagacauaaaagcauaugcagggaauaaaacauucaauuaaucaaucagauucacuaugaacagagcaauauauguuuccuaaaauaagcugagugugaaacgaaaacuucugauuugauauuaagauauguguauacaugaugcacauucaguauggcaugcuacauuaagauucauucaaaauacaacgaauaaaacacccaaacccuagaaaaggcaacaggcaaacccaaauuguuaauagcugccacuaacugagcucucauaaugcacuaggugauuuaaagacauccaauaaauauugauggcuaggaucugaacacuuuacauacauuauucauugaauucucggaacaaguacauguacauauuaaacagagacuaccgugucucacugauuugcccaaggccauaaagauuuaauucaaacccacgucucacuucaaagucccucaucuuccuacuaugcuauaccaaaccuccaaaauagauagaaggauaagaaauaacauuuuuugaguguuuaccaugugcuacuaccuuaaaauuacaagucugaaagagcugcacugcagccagcaaaugacgagccugggauucaaacccagcagguagugaagucauuauacaacuaauacggcauugcucaguguccuuaacacaaauaccguuaaguaacagugggcuccaccuucaguuauggacaggauaggaggaaauggauggaaguauuuagauagacaguagagagccuaaugagguuuugugaaaccccaaauaaaugaacuccuuuuugcuuaaaaauuuucuuugcaucuuuuagcuugaauguccugcagagcuccacaccuugugagauauguauuacuggcuuagucugcaaaucagcuuuggaggaggucugagggaggugagaagggaaugacggaauuuuggagcagagaccuccaccugcuaauaaagacgacaacuccuggcaagcccuggaguugggcaggaaaaacucacacugacagauauauuuaacaucuuuuccuuaaauauccuaauaucgaaaagccuucaauguaucagcugcaauacauguguuuuagggauacagccuuaacaugaaauggacacauacauaagaaaaaucguaagcaaguccuuuuuuuucuuggcuacuguuuacaaauuguuuacuacccauauuaucuuaccuuuugaauuugaccugccccuugagauauuggaauaaaaugagauacugcaacaggaugugucgacgaaaguuacugucacucaguuguaaauccaucagcuacucaagaaacaagcaaacacauacgaaaacaacacauuaaaaucaaguuuuuccuaaagguacaaaaugugcuaauauagaaauggaagauuccaauucaauuuaaaagccauuuguugagaguucacugcaugugaggcauuaccgcacaagcccaaagacagcccagucaagguuucacuuagauuucuugacuguuuuaugccaugacacauucuugcugguggauaacaaugaucuaucuaugguccagacaugaggauaaaauaaagcagaaauagaaaaaaguaagcugggcaugguggcacaaagccuauuauagucccagcuacucaggaagcugagaaggaggaucacuugagcucaggaguucgagaucagucugagcaacauagcaagacucuaaauuuaaaaaaaaaauuuuuuuuuaaaguaaaacugaggcuacuacuuucucacauaugaagaaauaauggcuaaagaagauacggauaacagcacaauaucaacggggaccacucauuuuuguagcccuauaaagugccugcaacagagguauuacuugacaauaaacaagaaauuagaggugaagaucaucucugauuagaugggcuuuuuuuuuuagcuuuuagugaaaauugcaucauacuuguauuaucacagaaucuggauuagaaaggacuugaaggucacucaugaggaaguucuucaacgacccugccauccagcuguaagaauaaccugcggcgaugaaggaaggucauucugauuaugugcauggaacacugaaggaaggcugaagucuguauccacaaacucaugcuaguucugccuucaaaaacuacaguaacaaaggaaagccacguucuucuaaaugaaucgccaguaaggcagcuggaagcgucgaagauugguuuugguucaaugucccaagugcugguggcucugcuuuacgugguugguaccauuuacuaaugcuaccuaacacgcacaagccucccuauucacuagcaaccccuuccacacuguggcuccaggucuuaaaaaaaaaaauuaaugaucagccuuccagucagguuucccucacguuuaaggauugaauauauuugauuguuauuuauauuaacucuccuaucccaaauuggaaaugugaauggccggccaucagccuucccuuccuccagccccugggcaacuugacugucuccacucaggcuguuaguuccuugcccuuaacuccacggacaggcccaucucugcuccagcuacccacuacuguggccacagcuagaccuggggucacucacagcugccccagaucugaagucuucaacucacaauccuaucucaccacaaccucuauccuucccaggucucucgcucaguugcuuccaauauaccuaauauuuggaucuuaccgagacuuuaaggcccuugacccgucuauucucugccuguuagucccaucccauuuuauuauaauccuauuuuagucuagauaaggggucagcaaacuuuuuccugaagugucaaauaguaaguauuuuuauuaauagguuaugugggcuaagagacauauuauggauauuauguagguauuuaaacaucuaaaauguaagggggaaaaaaaaaccaaaaucaccaaaaacaaccaacacagguggugggccagauuuggccuauaggcuauagucugccaacuccuggucuagacuucaugguuaaucucuucggccauuuucuugccaacuucaacacacuugucccauauuucuucugucaugucuagugagcaaacagcaaccuugaauaaaccaacuguuagucaccuucucuauaccaacccucaggauuccaaucucagcugaaagugaggugccugagugaauaccccaaauuacacagcuaugcagaaggcaccacugguauguugucaccaccuuaaacaucuguuuuuaaucagcaaucuuucuuuauucuucaaggccauucucucuccuacucuucacaguaaugauuuucaacccuuuccacuuagcaaaaauacuacuuuaccaccccuucucacuuucaguagauaacuacuuuugccuucaaugagaagaaaaauuaaauuggaaagcauuucauuucuuggcccccaaaaugacaaaucagcugcaccuacaccuuuguuuacuucauuuccuucugucacaacuccuucacggcuaaagguauuccaucuggauuaccuuccaucuggaaucccaauaucccuaacaauugaguuccaucaacuaacugcccugguuucuguaucuacaaccuauucuuuccaagcuccuuuccauaagcauuaaauaagcucccucaaaaaucucccacauucucaccuaacccuuuaacagcaaagcuucuuaaaauaauugacuauaggcacuguugccaaucagcuccucaaccugcuaucaucugaccgccucauccacuaauccauugaaaguguuuuugucggcuggguguggugguucacgccuguaaucccagcacuuugggaggcugaggcgggcggaucacaagaucaggaguucgagaccagccuggccaacauggugaaaccccgucucuauuuaaaaaaaaaaaaaauuagcggggcgugguggugcaugcccuguaauuccagcuacucuggaggcugaggcaggagaauagcuuaaaccugggaggcggagguugcaaugaguccagaccaugccacugcacuccagccugggcagcagagcaacaaucggucuuggggcgggggaagaaaguguuuugucaagaucaccaaugacuuauuuguuguuaaauccugugaacacucuuuacuguccucauccuacuugauaugcuuggcuuccaugagugcaugcuuuucuaguuuuucucuaaucucacagguuacucuucaaucuucuccucuucucccuucauucucccuuaaacauggguuuucuucgggauuucaguauuuucuucucuucugaaucuacacucuccccuuuagcucauuucauacacucuacaguuugaauuaccauuuauaaacugguaacuccuacaacuauacucucaaccuagaucuuguuccuagucuccagcuuuguacacuagacaaccuaucacacaucucuaccugaauguucaacugacaccugaucagauuucaugaacaaaguaaaacaucaauuuccuccacaaaagcuguucuccagcauuggcuaauucaaugagaggcuccaacauccauuugcccaagcaacucuaggaaggcuuccuggagaaagcagcaucuaaacucucaacaaggaacaaaccuaaagguggagaguggggguugggggaugggggugcaagaaggggagccaaauaagagacuggccuauuugaaggaccgaaguacacaguucaauacaucuggaguagagaugugaaccccuagcuuaaagagacgaaccaaaguggcuaggugaugcuuacuagcuguucauuuuauuuuuuuauguugaaagauuuuccuugauagaaacaauggauugaaaauaggagucaacaaaacacugaaucagggguggaaaggaccuaaugugauucaagcuaacugcuucacauuauacuuaaggaaacuagguccagaaaaguuaaaacuaccuaggcaagauuacacagcuaguuagugacacagcugagaguaaaacuaauacacucaauuguacccuuucuuucauaauaucuacuaucuaguuccauuuuucuuugguuauuuaaaaaauuauaucauuuacacuaugucaugggucaaacauuucauuauuauuauuuuuagcgacagggucucacucugcuucucaggcuggagugcaauggcaccaucauagcucacugcagccuugaacucaggggcucaaccaauucucucgccucagccuccugaguagcuaggaccaccggcauaugccacaaugcccagcuaauuuuuuucuuuuaaauuuuuuguagagacagagucucacuuuguugcccaggcuguugugaacuccaggcuguuuugaacuucaagcaauccugcagccucagccuuacaaagugcugggauuacagguguaggccaucaugccuggcccaaauguuucuuuguaaaugucuuuguaucuugagcaaagggcuuuuauuauccuuagcuguauguauguauguauuuaguacagaagggucucgcuauguugcccaggcugaacuugaacuccuaggcccaagugauccucccgcccuggucuccuaaauagcuggaacuucaggcauacaucacuggacuaggcuacuguccuuagcuuuuauggcacaucuuagcucaggccucaguuuucccgauauucuaacccuaaaaaggcucaugcuuuucauuuuagucauccuuacaugccucucugucaaucaauuuuacauauaaauaauauuccuggguaaaauuaaaguguaugaaaucuuccauuucuaucaauuuaacacaaaauacauaaaaaacaugugcuagaaaauauucagaacauucucauuaaaaucuuaccaacugucauaacacaucagcugagaucaaauuauccaauuuuuaaauuaugaaauauuuuaaauguucaaaaagguauaguuaaguaauacaacauucauguacccacuacccagcuacauauaaaauccuaacauuuuuuacuuguuacauaucuguuaaagaaacagaauaucauagacauuguugaagcucccucuauaacccuccccacuccuauuucccucccucccucuacuaugguaaccacuaccauguauuucacgguuaggauuuuuauacacauuuuauauuacuacauauguaaacaucuauaaauaauauauggauguacuuugcacuguuucaaacucuacacauuaugugcuauucugcaauuugcuauuuucauacaacacuauguuugaaauuuacccaucuuaauacauguugcucuaguucagggauuggcaaaucuuuuaaggaccagccagaaacuauuuuaggcuuuauggacuauauaucucugucacaacuauuuaucucugcuguuacagagcaaaagcagucagagacaaucuaaaugaaugaggguggcuguguuccaauaaaaauuauuauucuuauuuauuguuuucugagauaggaucugacucugucagccaggcuggaaugcaggagcaugaauauggcucacugcagccuugaccuccugagcucaagugauucuccugccucagccuccccuguagcugggacuacaggcauaugccaccacacucagcucauuuuaaaauuuuuuuguagagauggggguaucacuuuguugcucaggcuggucucaaacuccugguuucaagcaauccucccgucuuggccucccaaagugcugggauuacagccacugcaccuggcccaauaaaaauuaucuacaaaaauagaugauaggccagauuugccaaccccugcuauaauuaauccauuuucagugcuuuauagaacugucacguaaaauuaucuuaucacccagucuucugcuugugaacauugacacuguuucuaaacuuucauuuacaaauacaucauuuacaaacaaugguacagugaaucuucuuagagauuuccuuguguauguggguccuguguagggggccauauuuaggaacaaauuuuaacuucacuaguuuuuacaaaaguauucugcaaagugguugauucaauuuauauuucaacaguguauaaaaguucucauuuucccacaucucugccaauacuaguauuguuaggcuuuucaauuuuggccaguuugcuaaguguaugguuaucucauauuuuaucugcacuagagaugcuuagcaacuuuuauaagcucauucacuauucaguuuucuacaucuuuaaauuacuuuuucuuaucaucuuuucaguuuuccauuugguugucuuuuaucaauggaauauuuugaauacuaauuuuucccgguuauguaggugacaaauaaucuucucccagucugugccuugucuuuuuacuuugccuacgguaucuuuugcuauucaagacuuuuacaucuuaauauuaaaucuuaaauacuaaauugauauuuuucccucacaauuugugcuuuuuguagcucaagaaaucucucccuacuccaaauuuacauauuucauguuuucuucuaaauguuuaaaagucuugcuuuucucauucauacuuucaauuaaccuggaauugauuaaccuagaauugacuguacugagguauagacugaauuuuaauuuuuccauauggauaaugaauuguccaagcaacauuuauuaagaauaggccaggccugguggcucacaccuguaaucccagcacuuugggaggcugaggcgggcagaucaccugagguugggaguuugagaccagccugaccaauauggagaaaccuugucucuauuaaaaauauaaaauuacccgggcaugguggcgcaugccuguaaucccaguuacucgggaggcugaggcaagagaaucacuugaacccaggagguggaggcugcgaugagccaagaucgcgccacugcacucgccugggcaacaagagugaaacucugucucaaaauaaacaaauaaauaaauaauucauccuuuccucacuaguuuauaaugcaaucuucuuuuguauauuaaccuuuucuacaauuuggacuuucuauuguuuuaguuuucuucuucuguauauuaguacuaauaauuaccugcccuaauuacuauugcuguauaggucuuaauaucugacacagcaaguguucccgcuuucuucaugguuuucuuacucuuggcucuuugcuuuuccauagaaauaguaagacuaacuuuuugaguucccaugaaaaaacccauuuggucuuuauaauaaaacaauuuauauuccuuuggguauaacucaaauuaaaaaacccauuuggauacugauucaaaauauacugaaucaauaaaucuggggagaaggggcacugggucuguaucuauaaauguagaaacacugcuccauuuuuguaauguuucucuaugaagauuacgccuagguauuggagagcuuucacugcuauucugaauaacauguuguaauugauuacugguuuauaagaacacuauugauguuucucuugcaaucuugcugaaguuucauuaguucuaacaguuucuugguucucuuggacuuuucucuguagacaauuauauugucuucaaauggggauaguuuacucuuuucuuuccaauacuuauaacucuuacuccuuuuuuguuuuuuucucuuauugaaaugguuagauccuccaguacgguguugaacagaaauaugguuaguguccauccaugucuucuuuuuggauuuaaugggaauacuuucuaaaguuucauaauuguguaugauguuugcaauaggguuuuuaaaaucaguccuuuaucaacucagagaacauuccuuucuacuuuuuguauugaauauuagauuuuauugaauuuucuuggcuucugagaugaucauacagaucuuaaaaaucuuuaaucuguuuuuuuuuuguuuuguuuuuucagacacggucuugcuguguugcccaggcuggucuugaacuccugggcucaagcaauccuccggccuuggccucccaaagugcugggauuacaggcguaagccaauacgcccagccaaucgguuguuaaucuggcauuauauucaucuuucugaugaaccauacuuacauuccuaggauaaacuguaugucucuauuuuuaaaaaaauuacuuaauuugugaguuuguaagacauuuuuuauuucuauaaauagaaaacauucuauuuauaugugagaugaauauacauacacauuuuuccuuguucuguccuuauugggauuuuaaguuauaaucuuacauaaugaacuggggggcuucucuuuuucuaacuucugaaaauuuucauuuaugguagaaauuauuuauucuuugaaguguugauaagauaugccuuaaaaaccucugggccugaugucauucaaaaagugucauucuggcugguauuuccuuaaugguuguucauuuauuugguuuucuauuuuuuuuuuuuuuugagagucuauuucggucauuaaaauuuucuaaacaauucccauuuuauuaggcuucaaaauuuauucguaguuguucauaauauccucuuaaucauuugaaauaucucuaugucaauuuuuacuguuaauauuguuugcugguaucuuuucauuuuccuugcacaagcucuggauuucuuuuuauaacauuuucuuuucaaagaaacacuuucaguuuugcugauauguuuuaguuuguuuuauuucacuaaguugugcuauuauuacuuccauuuucuugagcuuuauuuuguacuuuuucuaacuucuugaguugaacgcucaauuugucacucuuucuugacauuuuuuccauuaaugcauaugaagcuuuaacugucccuuugcaucucccuuuauuugcaacccacacuucugacauguaauucuuccuauaauuacaauuuugauauacauuuauuacaaauuuggaauuuccauuaugaguucuucuuuaacuccugggaaaugcauuuuuauguuuucauauauuugccuuuuuuuaagcuauccuuuuugcagcucuaauuuuagaauucuaauuugauuacagagaaauguggccagagaauguguucuucguguauaaucuuugaaauuugcugagaauuucuuugugaccuaguacauggucaaauuuugugaauguuccacguauacacaaaaagaaauauguugcuucuauuuguucuauacuacaccaagcuuauuacugucauuguucaaaucuuccauauacuuaacuaaucuuuagucaaccugauccaucagaagcaguuaaaaauacauacuguaauugugggccaacuuuucauaauuuuguaaguuuuugcuuaauauauuuugaggguauauuguuaaauacauauaaguucaugacaccuuggugguucauuccuuuauuauguaguguuucuuguccuauuuauacuuuuucccuuaaauucuauuuuauuuguuauuuauguagcuuucuuuuuguugguauuagccugguaugucucuuuccauccuaauauuucaaucaugaguuuuguuuuagguauauaucccuuguggauacaaacugcuccaucuucaauuuauuaaauuuuguguucuuuuauuuuccauguaaguuuuaagcuucuuaggucugcuuuuuuccuucuuacugaaaaucauggaauuacagaacucagcuuugcauaacuaggaaagaauaagauucuuuuuuuuuuuuuuuuuuuuuuugagacggagucucgcucugucgcccaggcgggagugcaguggcgcgaucucggcucacugcaagcuccgccucccggguucacgccauucuccugccucagccucccgaguagcugggaacuacaggcgcccgcuaccacgcccggcuaauuuuuuuuuuuuuguauuuuuaguagagacaggguuucaccguguuagccaggauggucucgaucuccugaccucgugauccgcccgccucggccucccaaagugcugggauuacaggcgugagccaccgcgcccggcgaaagaauaagauucuaagaugcaaaccucauuaaaaggaaacuggugcacccggaagacaaauguaccaauggcaauuugguacaugggacgcucagagcaucuguguaaaugugauuuuauguuuugcucuugagccccagugagguacaguacacaaaaggaucgcuucuauuaaccuugaguuaguucagaauguuuucacuccuucaaagugcucuuguaugaccucuaguuggccuaauaauuuaauaauuuuccugugacuguuaggcuuuuuuuuuucuuuuaugugaaaacccauaugaauugugugucagggaguaggcaagaggguagucuuucuguagcaugacugcaggaguugcauauuucucaaaaaaguauuaagucucugaaaagaacacagcucuacaguuucuacuguauauaagucugaucagacuguguggcuugagagauuucuagaaaaguacuaaaucucucauguacuggauuuuuuuuuuuuuuuuuuuugagacagagucuugcucuguuacccaggcuggagugcaguggcacaaucguggcuuacuacaaccucugccucccggguucaagcaauucugccucagccuccugagcagcugggacuacaggugcgcacuaccacacccagcuaaauuuuguauuuuuaguagagaugggguuucacuauguuggccaggcugaucucaaacuccuggccucaagugauccacccaccuugaccucucaaagugcugggauuacgagcgugagccaccacacugggcuucacauacuggauuuccuuuuuaaauuguugaaaggcaccacuaagugcuuacauaauccuggacgagcuguuaaaaucugcccagacaauuaagaaaucaagccuaaacaccaaauguuuugaauauacccauuuucuccccagauuaggaaaaaaaaaauacagguuccacaguuaguauguuuacaaauauuucgcuuuaaacguuaaacaauuuaaacuuuuaauuuucacaaauguguuagauauuaaauuagggucuagaggacuaaacuguacaauaguuuucuaccuggaauaguaccuuccauauaacuuacucaauugaaauagaaaacauuugguuucugagaaaaagaauguguaaacaauuguauaaaaacaacuaaauuauaaauuuaaauaguauuccuuuuuuuuucuuuuugagauggagucucacucuguugcccaggcuagagugcagcggugcaaucuuggcucaccgcaaccucugccucccagguucaauggauccccaugccuccgccucuagggcagcugggauuacaggcacgcaccaccacgccuggauaauuuuuguauuuuguggagaugggguuucaccauguuggccaggcugguucucaaacuccugaccucaagugauuugcccaccuuggccucccaaggugcugggauuacaggugugagccacugcacccagcucuacuuucuaauaauucuuuucaaacugucuuucaaaaaaaaguucuuaaaaaaaugaaaaaucuaauuuuagcuuaaaggucucucagugucccugcugaguuauaagauaaaaggagaugcccacugaaggcaggagcuaucaagucucaauccuuuuauuuaguaaaaagguaaccugaagauacagucucaaauuaaaaaguuuuaagcaacuuucuguacuaauaauguguugcuuaccuacagggauacauucuaagaaaggugucauuaggcaauuuccccauugugugaauaucauagaguguacuuaacaauaguauugccuacuacacaacuaggcuauaugguacagccuauggcuccugggcuacgaaccuguagagcauguuacugcacugaauacuguaagcaacuguaacacaaugguuaaggauuuguguaucuaaacauagaaaaggcaaaguaaaaacacaguauuauauaaucuauaaucuuacagaaccacuguuguacaugggguccacuguugaccaguuaugugguuguuauguggugccauuauggggugcaugacuguacugugaaguagacuuagaaggcuacaguauuccucaauaaaauaaauaucaaaaauuuaaauuucauuuuccuuaauacucauagucaauguaaaacaaacucuuuaauguuuuacauuaguacuguuugaaaguuuucaguuuaaaagaugacuuuaugacuuuucuuugauuaaaccacaagguagaaaaaagauacaaauauagaauuuuaauaaacauaagacuuuucuaccuuuaaaaggcuaaaaugaaacuuucuaauuaacauugguuauuuuguuguuaccucuauuauuaacucaggauuauuuacacauaaacaugggugaacaacuaaaucaagcugugauuaaacagccaguguuuauauauugguuuucauaaaucucagacaauacugaaaauuauaugaauuuacagaauauucuuacgcuauccgguaaaguuuuaauauucuauaggauuacagaguauugaaaaaauuucuacaaaaaguuaaaauucagacacagaaaacauaaaaagucccuaacauacgauacuuuuauuuauuuuauuuauuuauuuuuugagacagagucucgcucuguugcccaggauggagugcaguggugugaucucagcucacugcaaccucugccuccuagguuuacgcaauucuccuaccucagccucccgaguagcugggaucauaggcaccugccaccacgcccggcuaauuuuuuguauuuuuaguacagacagaguuucgcuguguuggccaggcuggucucaaacaccugaccucaagugaucugucugccucggccucccagagugcugggacacaggcgugagccauugugccuggccugauucauauguuuuuaaaccuauguaucucugacuauaccuuaacauguuuguucuucauaacacucaggaugaaauaaaucaguuaauguuuacauauuaaacaugauagaauuguuuuaaaaaccaaaguuuuaaauaauacuguuauuaaacacugaucuauuaaaacaugcauaucaaaguauacugaaaacuaauaaacacuuguauauaauagaggagggagcccaauuaacacagagaaaaaauuuuuuuuuccucuggguaugaaguccauuuauaaccagguaauaauuuuuugcccucuacagagucuguccaggaguccaaaauuauuguccucaucagagaacauuuucuuuucaaaggucuauuaacauuuaaaauaugacuuuguuaugcuuuuguguaaucaugacuauacacuguuguaaaaauaaugagaguucucauuucuagaggaucuaaaauuuguaauggucuuucuguuauagucaguauuaauuucuauuacuuuggcuaauaagaagguugggugacuucuuauucuaucucugcucuuuaucuuaucaaauaacuagucuccucugcuaagccuuucagacuuugccucucuucaagauuaggcuccaaauucagagccuacuuuggcaguacaucuucugcacccugucuuuggucuuuccuagagggcugcuacuugguagcaucaaucacuuuacuuucuuaucuugcuuguauaaccauggcuugacucacacacagagguuauucuaaaaauaacaauggcagaguaugcucuaaguuuuguaauaugcucaaugauauuuaaagaacuguucuaucugucaggaccagaguucaaaaaugucaaaacagaggguaguucaugcuuuccgcccugaagaccauuacaagucaauuuuacaaucauaugaaaagguuuuggcuauaguauuuaccuuuacaggacgagugaaagcacacccauaugcuaagacugacaugacugucagcaaaagacuucuaaagcagggauccccaaccuuuuuggcaccagggacugguuucauggaagacaauuuuuccacagaccagggguuaugggguagagggaaugguuuugggaugauucaagugcauuacauuuauuguguacuucauuucuauuauuaauauauuguaauauauaaugaaauacauauacaacucaccauaauguagaaucaguggaagcccugagcuuguuuaccugcaacuagaaggucccaucugggguuggugggagacagugacagaucaucaggcauuagauucucauaaggagcacacaaccuagaucccucaugaucaguuuacaauaggguucauguuccuaugagaaucuaaugcugcugcugaucugauaggagacggagcucaggugguaauaugagugauggagagcagcuguaaauacagaugaagcuucgcuugcuugcccacugcucaccuccugcugugcaacccuguuccagagcuaucuaaaagccucccaugccgagaacaacuaaugagauaaaaaaaaaaauuguagcauagugguuagccugcccacuuguuaacaggagggucuugcuucugccuucauuugcuccuagcuaggcuauaguauaucuuauaagagacccaccuuagccguuacuacauaaagauucaaccucucaaauggacauaaaaaguacaaaacauuuaaggcagaaugacuauauggauaguuucuuacugccaggaacuuuuuuuuaaaaaaugaccaaaaguccuaacuagaggccucuucacacaaugcagagaccaagcaaaauugugaauuuucuuuucuccaugaaaaugaauggccuaaugaccacacuagggucaacaguacauaacuguggguaaccucacccugguaacugcuagccacugaguauuccaucugaucauuuuggucauugagucucagauggaaagugagaaguguauuauucugaaggacuggguaacccuaaagccuauaucuaauuaguguuauuauacucuuuucugugagaacuuaaaagauccaaaaauauauuccuuuaaccaucaugguaauacucaugguacuuaaacauuuugaaauguuguucugcuuuuacaugcuacauaguacagagggaggaaucccuacaauaccagugccuuuuauuugguauaaguugaacaauuagagguaaaauccucccuuaacauuucugaguaugauccuggacuaaccuuaaagaacagauacuuuuccacugcauuagaaaauaagcaacccagguguaucagcacuacauuuagcaaguaguaacccuggauuauuuugcucugcuaaaaagggaacuauacuguugggcacuaguauucagaaucacacuccagguaguacaaaaauguggcacuuuguuucuaggggaaacuucuuucuuuaagaaggaagacacaauaauuuacaaagacacccauuuuauuuguagaaccucuaccuaccuguaguugccacaugacuggccuaucuccaacuauaaaguuuauaucaucuggcugggcgugguggcucacgccuguaaucccugcacuuuggaaggcugaggcaggcagaucaccugaggcugcgaguucgagaccagccuggccaacauggcaaaaaaccugucucuauuaaaaauacaaaaauuggccaggcgugguguugggcgccuguaaucccagcuacuugggaggcugaggcacgagaaucgcuugaacccaggagguggaaguuacagugggccaaaaaaaaagugucucaaaaaaaaaaaaaaaguuuguaucauccuugccaagcauuguuuccggacuaucccuaaggaaaagucugaccagauucauguaacaaaacacaaugcuucuggauaauauucccauuggauggggucacggcucuauuacagagaugaaagaucuaaccuuguaaugacaagcacuuuucuaaaccugcucaccagugaaaugauaggcuaaagaguuaugcuccaaauaaucauagcuuuagauuucacuuuagcuagcucuuacuggcaaggaauauggcacccauaucccugaaaaauccagaccuuucucaugacuuaccaaaucuauaucaaaaguugaaaguaacaucaggcccaaaacuggcauauauuuaggugugaaggccuuuuugggaauccuaguaucaaaacaccauguaagguacagagaugcuggaaggcuucuuucagugcagcaguaaagcuuauaaaauguugcauauuuuccaugauacacguaaugcauuacaaauauuuucacuuguauauuaaguaguaaaaacuaaaaauacaccaaaaaauaugaagaauguacaaagaggacuguaaauuuaagacaaaguuguugcuuaaggggcaacaaagggaaaugaagaugcaaaacauuacaugccucacauucucuuugguacaauuuugugccuuuuucuuacuccuaugguaaguuuuaagcuucucaaagcuguuuuuaccuuccucgugaugugauauuaauuaaugaaauuucagugcuuaauccugaaaguucauguucuaacugcuggugaaagcaaguucacaaagaaucagaaaaggagagauacuauuagaaagccaagugugacaaagugaauggagaaugauauaaaagcaucaaucccauauuccaauguggagauuucucugaaaauguuuaauccugcuguuuuucauuacuaaaaugucuuuagaaaugcuauuuguucgggagguggaggcaggagaaucgcuuaaacccagguggcagagguugcagugagccaagaccacgccauugcacuccagccugggcgacagagcaaaacuccgucucaaaaaaaaauauauauauauauaucaauuaagacauccagaguuuugaaauagcugucauguccugagaaauguggaccuguaacucuuaaaaauacacaacucuuacugguuguuuuauuuuguaacuuuuuugcccugauaauauuaaacugacaccucugcauucuaaaaguagguaaccuugggaagguucuuuguuaagcaagaagagcuuugggauuuucuuacacaugaaguagaauaaaacuuuugaauucuuuaguuaaccaaaagguuucuauauuuguuucauuuaaauuaacaaauauagcuggaguuuuaaaaauccaaucugauaaagucuuauuagguauauuaaaucagucuauacuuguuauuacugaccuauuucucuccuccuuucucuuccuuuuuucugccauucgcuggauuuauaaaguggucuagauuccucccugccucccuuugaucucuguucuuugagagcaacaaguugguuuucuuuuggugguuacccuuuuaauauacaugaaaaggaauauucaguauuccuuuccuacuccugaagauuacaaggacugccauaauuuuaaauuacucacuaaacaucucugcuuuccccuuccauauuauuacugucaucuaguuaaguuccacguuaauaaaauuuuuuaauuaaaaaaauuuuaaaucauucaugacuuuuuuguguuuauagucaauaguaaauuuacugucauauuuuucaauuuuugugcucaccguugccuucuguaucccacuccauucuuauggguucaauuuccuuccuccugaagaacauccuugaguaguuuuuuucaaaaugagggucacugagugguaaguuauccuggucuuuaaauaaaaaugucuuucuuucaucgacagucuugaguauauuuaacucgguauaaaauucuagauugaaugucauuuuucuuucagcacuuuaauauuucucuacugucuucugguauuaaugguugauauguuagaaaucugcuaacagucaaacugcugugccuucccaguauauuugucuuucuuaucccuuaguggcuuuuagguuuucucugaaugcccacaguuauggcaugauguaaugaagaguagauuuaucuuucuuuauccugcuuggcaguugugacacacuuuuaagcugaggauuugagauuuccuucaauucuuugcaauccaguuucucuaccauucccuccauuuucuucuuuggaaauccuacuagacagauguuggaaauucccaaucuauucaccauggcuuuuaacugcucuuccacuuaaaaaaaaaaaaucugucugugcugcuugcuggaugaaguucucaucaccuucuucaguucacuaguucuuuguucaucuauguccaguguauaguuuaauucugugugcugaguuuugguuucaauuauuguauuuuucauucccaagacucccgauuaguuguaucgacuguccuacuucauuucagccugcuuuuguuucaugauuucuuguuccuuuucaauggauguuaucucaucgauuaucuuuuugaguauccaaaacauacauaaagucuuggucaggcuauauauuucaucuggaauaaauauauauauauaucccaauaguugauuuugcuggugauccuucuuagcauuagauuuauggauuuuggaauuuuaauuuaucagaguuuugaacaggagccuuuucuuuugggauguuuguuuacuuccuuuccccucccucucuguguacauccuucccugucuagcaguuuugcaucugcuucuaccagggccccugaguccaaaagucuagaagaagucuuaugaugacuucuuggagcagcuguuucauaaguauacugagcauaucacauaucuggucacugagcaagcagauggacacaaagcugucuuuguuaucccuaggcucacaacuuccuauaaaaccauagcccuuggcagaagacuggcaauauuuuuucuuaguuucuucccaaaacuggauaaaaguuccacccuaguccuuggcuucaagaagugaaucuggcucuggccccuugucccacauggugcacauuuagucucuguuacuuguagccaaauuccuggacaccaccaccugccuuggauagagaguccagcaggcccaggcugcaguuuugcucacuacuuggcauuucugguccaugaagauauuuaucuuguuucuggaagcccagccuugucucuuuuguuuucucguuuauauuuuacccgucauugcuauguguuuggagcaaagggagugagucgaaacauaaacucaaugugccaucuugacuagaaacuuuacauaaucuuguagcauuauauuugaauaaaauuuacuuuuuaaaauguauaaauaagauuaacaaggaacuuuuaaaccccuuacuugcaccuaaauaauaauuaugaaauauuuucauauacaaauuaaauccuaacuugacauuuaaaauauauagacaugaaaguaauuaaacugcauuuauuccaaaauuaguuuacaaaacagacuuaauguagaacuacuuucaccuuugaaaccaaauuaguccuacuucugaaaggaagaaaugggacuuucaaacuaacauuaaucaaucagcuuuaacccaaaguaaaauaagaaacauuucuauucaguuuaacuuagaaaggcugucagcuaaacggaaauaaaacaagaccauuucuuauuaugcuuaaugaaaaagaaaaacuuauaccuuuucacuuguuaaaaauuuugcaaaauauacauguucuccuccuguuuucaauucuuccaucuuuuuucuugaggccugaguaucaucuaauuuauaacucuuaaaaacagcuaaaacuucuucagaauacugcaaaauaaaaauauuaguuuuauucgacauuguuacccaaauuuguuuagugcuuuucugcaucaaaaugccuagaauuuacucccagucaaucauguauguagacuguauauugcaaggcacacuaacaauacaaauuaugauagcagaaugggaguuaaaacuauuuuguaugauauuucacuuguugcaaaaguagguacaagcucccuacuccuaaagaaauauaauuucuuggccaguggugguggcucacgccuguaaucccagcacuucgggaggcggaggggggcggguaacuugagaucaggaguuugagaccagccuggccaacauggugaaaccccgucucgacuaaaaauacaaaaauuagccaggugugguggcgggcaccuguagucccagcuacucaggagacugaggcugaagaaucccuugaaccugggaggcuccgucucaaaaaaaaaaaaaaaaaaaacgaagaaauaugauuuaagaagucuguguaagggacaaauagauuagggaacauuuuuaagaguguacagaaauuuaccagugaaauuguuuaaccaccuguggaaacucuuacgcauuucuugugcuaaaaacugagcaaauaaauuccaccaaauucuguccaguuagaagacaauuccagauuauuucucacuaaccacuuaaucugaauuuggauggugcugcccccacaaaaaauugcauauaaaacaaaaacuauuaaaaauaacauaacacacaccaugcuauucugagaacuaccuauuuaucuuagauuuuaauuaugacaaaaaaggacaacugaucuuuaaguagccaagaaaaauauaacaaauucuucuaaaacaggauuggcaaacuuuuucuguaaaggaccagagaguaaguauuucaggcuuuguggccuuuauaaucucaguugcaacuacucagcugugccauuauagugcaaaaacagccacagguaaguggauggucaugguacuauuccaauaaaccuuuguuuauaagcaguagguuagaucuggcccagagccaugacuugaggacuucuguuucaacaagauagcuaaaauaauuuuguacaaagauagaauauauucugcaaaauaucaauuuauguuaacaacacucauuauauucaaaaaaagcaaggcuguaaugacgaacuuuuaaauauccgauucuuauauacuacuucacaauauuagugguuuaaauauuaauuuauaauuucacuuguuaugaaauugguauaaaaauguaagaggcagaauuacauagugaaaaguauguuagacaagauuaaguuuuagcucuaucacugucuauaaaauacugggcuucugauagucugucaauggcaacuuaccuugagaaaaguuuuccaugaaaucuucucauagcauugcacaggguuccugaaguaauccugaagugaccagaauuuucgauacagguuguaaucaauuggaauagagcuaauaaaauaaacguuauauuaaauaaaucauucaaauucuuuuacaaauaucuaaauauucuuaacuuagcuuuggucacaaaccguuuucagaagcuaaugaaaguuaucagaaaaguacacauucacaaaugcuuauauaaacuuuuacaaaucauuuuagggaacucauagaccccaauagacucuuuaucuacacugguggagccccugaauuuuggaaggacacaugguuauucagaauuaaagauuauguuucccaaccaaucuugcugcucgcauggucaugugauuaaauucuggccaaucaguugagagcggaagucauaugugcaacuuuugggccauauuuuaucacuggccuuuuccucuuccugcuggcuagaaugcagaugugagcgugagccaccuugcacuacaggaaaaagggcaaacaccaagaugauggaagaagaagguagaagaagccugggucuaggcaaucucaccgagcagugcucccuuaccagccuuggacugccugcuucuagacuucgauaugagggggaaaaaucaacuuuuauguuguuuaaaccaauguuaaucugaaucuauguuaaaagucacagguaucauauccuaacuaaaaauauuauauccuaagaagcaccaguaugagaaaaacauauaugguacauaucaaguuagcaucacaaaaauaagcccuuuaucuaguaacuuuauuauggcacuacuaauucaacuucuaaucuugauaugucacaaaucuacagugucaauacauauucuuuuaauuuaaauuuuuuuuuuuaaaggagucucacucuguugcccagacuggagggcaguggugcgaucucagcucacugcaagcuccgccucccggguucaagcgauucuccugccucagccuccugaguagcugggacuacaggcacccgccaccaugcccggcuaauuuuuuguauuuuuaguagagacagcauuucaccguguuauccaggauggucucgaguuccugacuucaugaucugcccaccucagccucccaaagugcugggauuacaggcguguaccacugcacccggccuauucuuuuaauuuuuaaaacagcuaauaucugauaaacggcuaguaucugaagcacgugaaaaucaacagugaagaauacugacuuuuaacuaacaaaaaucuaaaucuaguucuugccaaagcuuucaucaugaauuaguaguaucugaaagacucuaaugggcauguuuacuuucgcucuuccuaaacuuuucccuaguaacaacucugaaaguaggaaaacaaugauguacacauuaacuucucucuauaauuaaagcagcuucacugauuuacaacaguaagauuauaccucuggguuuucuaugaauuggguuuuuaaaaaaagccacaggcugggcacgguggcucacaccuguaaucccaacacuuugggaggcugaggcgggcggaucacgaggucaguucaagaccagccugaccaacauacugaaaccccaucucuacuaaaaguacaaaaauuacccaggcauuguggugcgugcuuguagucccagcuacucaggaggcugaggcaggagaaucgcuugagcccaggaggcagagcuugcagugagccgagaucacagcacugcacuccagccugggugacagagcgagacuccgucucaaaaaagaaaaaaaaaaaagccgcaaaaagaacauucccuaaaacguuaaaguaaauagagaaaagaaauagcacuauauaaauuauuuacauucaugaaagaacaagaaccaauauuuguauaguuccauacauuugauaaagaauguuucugaagugcaugugcacacacacacugaguaacaaaauguuacucaguuacaacauguaagauugaauauaauaaauaccucuugaaauguaccaggaaaguuugucucuuaaaaauggggcuaccucuaacagagaaugagacucaugcaaccauuauaugucccuuuuugucucaauugcuaagaacuucacaucuaauuuaacacuuaauaccaaucacaauauuauuccauguugcuaauuaccaucuccuaccuguaaaagacuuuugaucucuucccuuuuaucuuuaauuggcuugguggguauuugaggugucuuacagaauaaauuuugaaguaguguuaauaucuuacuguuaggcaguuuuuacaguugaggcauuaauauauuuuuaaaaauuuaaaguccccucuccuagaugcugucccuugcucuuuuccuucacagcugaauaaaauucuucaaagaguugucuauacuccaugucaccacuucauuaccuuccuguucauucuucaacccacuugcaauuugccuuccaccuucaacacuccacagaaacuuuugaauuuucuguuuacccacacaaagcaaauguaaccaauuauuguauuugcaaauaauaacaaaucagagacccaguuacuauguaaaauagaaugucuuguaacuauuuuaaccaaaaaaacucuggaaaacuugauauauuuuuuuaaauguucagcuauuuuacaggauguuauacauugaaauuucuuaacaaaaauguuuacugguguauuugagccaaaucugaaauggacuucauauuguagguagauggguaaugaguucugcuuuguaaauuacagugccuaagaccaucuggugauaacagcugucacaaaguaauuccucacguauuuucucccucuauucaacauuagugacugugacagaggcagcugaguguugagucuuauuuaagugauuuacaaacauaaccaauagggaugaauugucuauacagucuuaggcaaaaucuaagcagacaaaacugcacuggccagugucuuuugggcuguuuacacuucaggugacucaucaucuuguagccuacuaacuugccccagagcccuuauguugcucaggccagaccuuaaagccuacuuuauucauguauaaugaauaaauaggucucuaaaaaaaaauaauaacgauaacaaauaauagcuacuagacacugaauagacaauauucuaagugcuuuacacuuaccacuacauauaaacaauuagugccuuaauagacuauuucugaucaucgucuuauuuaauccucuuaacuguagagaguagguggcauuacuacauuuuaaagauguggaaacuguguuguagaagguuaaguaauuggccccaggucacaugacuaggaaguauuggaguuaagcuuggagccacacuaccucuaauguuucuucuggagauguguuugaauuugaauucugggaugccagaaauacaucucccugggcagauacaggaaucccaucuugauuuucuagacaguaauggaaauucuuucaauuauaacuaaugacucucaucaccucagacaccuggaagagugccagugaaggaaaauuuuccuuaaugccuucucuuuucucuugcucauugcuucuaagccagcacuaggaagaaauuauggaaagucuucaaauaacgauguuuccuucaacauuguuuuauuguaacguugaugagaaaaaaaaaaucgauuccuggcuggggccacggucuauguagaguuugcacauucucccuaugucuguguggguuuucucuagguagucagauucccuccugcaucccaaagagguguacaugaaaauaacuggcaugucuaaaugguuccaggauaagugaguguggguggguggguauacacacugugagcagauggcguccuguacaggguugguucccgcccugcgcucugagcugcugugacaggcucuggccacccacaaccuuaaauuggaauaacuaggcaaauaauuaucuuacuuguuuuuauuaaucuuucucaaaugcauguauagcucacauuuauucaauguuuaauaacagaagcauuuugaucuuuaucuaggaguuuggugauuguuuuugugaccagaaauaggccauaagaaccuaacuuuuguuuguuagccuaugggaaaauugauuucaucauacaucauuucacuuaauguugcaguuucuagaaccuaucuaugccacugaggauugcuuuuggaaagaaagcacagggcuacagaggaggagauaagaaacaguuuuaagagcaaggggagagaaggaggaaaggcuucuuaacuugccuauuucauuaaaaguuagcccaauacacacaggcacuggguccacaaguuuaauggaagggauuaaggggaggagcuccuaaggcugccugugguuggcuuuucaaaugcugggauuaugcauaggguagucuauauaaacaaugaacugucugcacauaauauagaaaccagcagauaaagcccauuagugauuuacgauuuauuaaguaauauacaugaaaauuacaaaugaaagaaauuucuuauaauuucuuuccuccuugucuaucuccucacuccagagaggauacucaauaaauuaggagauuaucucuguaaaucaaaaagcuuaggcucugaaaacucaccacguuguuggagcuuccucgucucccauuucgccuucuucuacauccauuccuucuucucuaucuucagugugcuaaauugaaaaaaaaauguauagccugucaugaagcagucaucagacagaagagauaaaugcuagaauaaguggucaguuacacauuccuaggcaacccacaguuagagaagucuagucacuaacuaucuagaccuauaguuaaucuguaaggcaaucagaauuuuaccugauggacagaagaacucaagagcaguaugacaaugauauaacacagucaugaagacaguagaaaguuucaaaucuacauuucuaaacauaaucaauagauucccucugggaauaaagggcuaaauguuuuggaaaugcacaagacaauucaacaauaaaaugagcaaacagcaugaauagcuaauucacagaagaaaaauaaauuccaaccaacauauaauaaguuccucaacaccaauaaugaucaaggaaaugaaauuaaaacuaagaagacuuauuuuucaaauauauacaucaauuaagccaauauuuuuuaaaaauugauaauucacacuguuggggugaggcuguggggaaaaagggcaggcauucuccaugugccacugguggcuguauaaauugguauaaccuuuuugagaaguaaccaggcaauagcuauugaaauauggaauaugcauauauuuuaacccaguaauuuuacuuacuggaauuuauccuaaaaagacaucugcauaauugaugcagacgcugcagacugaugcaauauuauacacuacuagacacuguaacauuguuuuucacuaucagagauaaucugaauguccacaggcagagaaaugugauauauccacucugagauuuaucaagagccauuuaaaaacuaagauaaaacuaaaucuuaaaggaagaaagugaauuucagaauaguaugaaugaccucauucuggagaaaaacaacauguuuguacauauacacaaaaaguccugguauggugagacagagaauguuaugagugguuauagaaauaauaugaauuuauagaaaaaauacauauucugcaaaaaauaacccaauguuuaaaacagaaaguacaucuauucuauaaucuaccuuaugauuaacacuauuaaaacagaaaguauagcuacuuuguuaauccacuuuaauagaaagcuaugccauaaucuaccauggucuaccuuggauuacagaauaacuguacauucuaucuuaaacacugguugaauuuuuuacauacaaaacauuauuucuguaaguuggaaauaaaguuaaaaguuuuuaaauuuuugaugacuuguaggcccauuuacaugaaauuuuuuuuuuuuuuuuuuuuuuaaaugagacagguucucacucugucgcccaggcuggaguacaguggcaugaucaaggcucacugcagcuugaccucccugggcugaggcgauucucccaccucagccucucgaguagcugggaccacaggcgugcaccaccaugcccugcuaauuuuuguacuuuuuuguaggaaugaggauuugccauguuguccaggcuggucuugaacuccuaggcucaagcgaucugcccaccucagccucccaaagugcuaggauuacaagugugagccacugugccuggacccacuaucuuaauaacaaacuugcaaauauguuaucugagaagauuucaaaucagccucaccuucugacccagggugcuuuccugcucauuuguauugaaaacagugacauuuuccagauuaaacugacucugcaaguuaagaccuaguaaaaaaacaaaaaaaagaugcaaagcaaguccagugacaccuaaacuuauguauaacuugugucauaaucaaaacuacaaaaugccaaauccauaaagagcagucaaaauuaacacauuugauuuucaaauccuuucaaaaauucauuucuuaaaaguaccuuuggaguaugggcauaccuuguuuuguuguucuucacaguuucuuguuuuuuuaaauaaauugaauggcaacccugcaucgugcaagucuaucagcaccauuuuuccaacagcauaugcucacuuccucugucacauuuugguaauucucacaauauuucaaacuuuuucauuauuauuauaucuguuaugaugaucugugaucagugaucuuugagguuaacauugucauuguuuugccacagauuuguuuuugccacaaacugugcccaucuaagaucuaagacaguaaacuauuuuuuuuuuuuuuugagacagcgacucacuccugucacccaggcugcagugcaguggcaugaucauggcucacugcaaguucagcuucccaagcucagaugauccucccaccucagccuccugaguagcugggacuacaggcaagcaccaccaugccuggcuaaauuuuuuuguauuuuuaguagagacgggcuuuugccauguugccuaagcuaguaagauagcaaauucaaucaauaaaugcuguguguguucugacugcuucaccgaccaaccguucccaugacucucucucucuccuugggccuccuuauucccugagacgagacaauauugaauuuaggccaacuaauaauccugcaauggauucuaagugucaaguaaaaggaugagucucacauuucucacuuuaaauaaaaaccuauacaugauuaagcuuaguaauuaaggcaugucaaaagccacgacaggcugaaaguucucuugcgcuuaacaguuagccaaguugugaaugcaaagauaaaguucuugagggaaguuaaaagugccacuccagugaauacaugaaugauaagaaagcaaaacagccuuacugcugauacagagaaagucugaguggucuggauagacaagcaaaccagccagagaaaggcuuuaacucucuuauuaauucugugaaggcugagacaggugaggacaccacagaagacaaguacgaagcuagcagaaguugguuuacgagguuuaaagaaaaaagcccucuccguaacauaauagugcaaggugaagcagcaacuaccaauggagaaguugcaguaaguuaucagaagaucuagcuaagaauauugaugaagguggcuacacucaacagauuuuucaaugcagaugaaacauucugauauuggaagaugcuguuuaggacuuucauagcuagagagaagucacugcuugccuucaagggacaggcugacucucuuguuaggagcuaaugcagcuggugacuuuaaguugaagccaauguucauuuaccauucugaaaauccuggggcuccugagaauuaugcuaaaucuacucugccuuggcuccauccauaaaaagacaaacccugaugacagcacaucuguuuauagcaugguuuacugacaauuuuaaggccacuguugagacuuaacugcucagaaaaaaagauuuccuuucacaauauuauugcuuauucacaaugcaccuggucacccaacagcucugauggagaugggcaaggaaauuaauguuguuuucaugccugcuaauacaucauccauuuugcagccaaaggaucaaaggguuauuucagcuuucaagucuuauuaucuaagaaauacauuucaugaggcuauagcuacauagugauuuuuuuauggaucugagcaaaguaaauggaacuccuucuggaaaggaccuacaaaucuagaugccauaaagaacacuugugauucaucaaaggagguaaaaauauucacauuaacaggaguuuggaagagguugauuccaacccucauagaugacuucgagggguucaagacuucaguggaggaaguaacugcagaucuacguaguagaaauggcaagagaacuacaauuagaaguggagccugaagauaugacagaauugcugcaaucucaugauuggacuugaaacagaugaggaguugcuucuuacgaaugagcaaagaaagugguuucucgagaugaauucuacuccuggugaagaugcugcgaacacuguugaaugacaacaaaggauuuauuuuauuucugagacagaguuucacuccuguugcccaggcugaagugcaauggugcgaucucggcuuauuuuuuauuuuuuuucugagacagaguuuagaauauuacauaaacuuaguugauaaaguagcggcaggguuugagaggacugacccuaacuuugaaaguucuacuguggauaagaugcuaccaaacagcaucaugugcuacagagaaaucuuucgugaaaggaagagucaauugauguggcaaacuucacugugcuauuugaagaaaauugucauagccagcccaaccuucagcaaccaccacccuggaucagucagcagccaucaacaucaagguaagacccccaccagcaaaaagaugacgacuugcaaaaggcuuugguggucauuaccaguuuuuagcaguauucuagaaguacgguauguacauuuuuuuagaugcuauugcauacuuaauagacuacagcauaguguaaacauaacuuuuauacgcacugggaaaccaaaaaauguugguugaaugaauauugcuuuauugcaauauucacuguauugugguggucuggaacaaaacccacgguaugucuguaaacagaauucuauauacauuauaauagaguugauccuuauuauucaugacuauuccagaacaauuccacagaaugcaauauagaauaauuuauaauucuguuggaagcacaaauguaaauuauauuaaugaaaaagugauaauguauaacaaauaaguaaauacauuauaguuaaugagagccaaguuucuuacuguuagagaaagagguuaauaaacagaucuacuggugcuggauucaacucagagguaucaguagaaucucauauuuuuugcugcuguucauguaaaauauauacugacagauacagaaacaaauacagaugaguaugguuaguauacacauaugucucuccuagcucuggucucugagagggccuagaaguagugauacuccaguagcaaugagcacaucuucucaaacguaacagccaaugauaaccagacacacaaagaggcaagauaccaugagugagaaacagucaaaacagacaggagaaacagacccaccaagacuuauuuaagguauuggcauuaccagauacagacaauaaaguaacaauguuuaccaaguuuagaaaacuaaaaaaaacaauucuuaagaaauuauucagaaucagguagagagagacaaacagaugaaaaaauauauaaggaguaaaaaacagaggauacagugagaagguauaauggauguuuaauugaaguuccagaaaaagaaaaagauaaagaggcauacacaauauuugaagagauaauggcuaaauuuuuacaaacuagauggaagaaucuaauccauacauucaagauguccacaauccuaagcaggacaaauaaaaagaaauuuacacagagauacaucauaguaaaacuaaaagaaaaccaaaggagaaaaaaaaucuuaagcgcagagaaaaaaauguagauuaucuucaagaagugagacugacaucugacuugucaauagaaaaaugggaaacagaagacaaaguaaagauuauuucccgugagaugaaauccuguaucuagugccaaucuagaaucuuauaccuauugggaggaggucaaaauaccaauauuaacaggaguuuggaagaaagaaaggaaaaaaaauaaaggagaaguaacgauuuuuaggcaaaacacagaccugcacugaagaaaagucuaaaagggaaaaugaucacagacagaaagccagaaauacaagaagugguaaaucuauauuaacccugaccacauaaaauaaguaugaaagaaaacagcacagacauaagaugacaaaaagaaagcacauaaaccacugcuaacauaugcuauaggucuuucuacaugcaggcacuaauguaagcucuucacauguuuuaauucauuuaauccucagaacauauaaaguaggugguacauuagcccaauauuaaggaagggaggacugaagcaaggagauauuaaaaucucgcauauuugaacauacuggggaggcggaaggcucuggaggacaagcaaugucccauuucaggagcuagauagugguuauacaguauuuguuucauuauuauucgcuuuauguacuuuucuauaugagcguuauauuucacaauaaaaauuuguuaaaaaaagagaaaugaaaggaagucuauauagcuaaauaguugugacugagagaaaauccaaacacaaaaauaggcauacauuaugaaauacggauaugaugguucauaucuacauguuucagugugauucaacuuuacauuaauaagcuuugaacuuaaaagaauccaugacuuuguuucaggauuaccuguauuauauacuaggacugcuauacauuuauaaguaaaagaaaauaaagugacaauuucuaugaugucuuucaacuuuuuagaaccauuuuucucauuaucaugacagauuuuaaucuauuaaaaacuggaaaagauuuuccugcagaaaacucauuuaaugcauaaaagcuuaccugauuucucagacagagggaaaagccuggccaaaaagagcugaauccguccacagaagacuguauucugggauuuagacaaucuucuuaggagaucuaacaauauaugaaaaugaacguuacacagaaaagauaauucuauguuuauuacaaccacaccuaaaaguuucuaaaccagugugucaagaguauuuuccuaaagcaguaguucuuaaauugggggccgaaaccacugccacaaaaaaguacuauaaauuaggaacaaaacaaguucaacaugacaugaaaaagacaaacuuuacuacguuucugacuuuaagcuuaugcccagaacaaaaacaguuuaaagugaauaaugaguucuaacaaaucagauuguuaguuaaaaaugcagauaccuaaucuaucuuuaaaauguuaucacugguauuuaauucaaccauguguuuuucugggcauauuuacacuuaaaaagcaaucauuuuaucacucaauuacuuaccauugcacauacguaguaaguaauuuuucccagcagaauagaauguauucugaaauuaagacggaaauuaucacucuucuucagaacuuguuacacauucuucaauaauaaguugccagagugaaauauuaaagaacacuaacaugcacugagaaucuacuaugccacuuucacuuuuuuuaagcaaauaacauuuucaaugaaauaaaaauauuuucagauauaagaaaacaugauacuaaguaacuguuuuaaacaugugaaagugugaauuuucaaguuaauuuuuauuacacaaauuaaaucaaauuuuguauuucaaguuuuucuccacacaugguuuuuauuuggcucucccgagagagcaguauauaauuuuuucauaggcagaaacuuguuggcauucagcaauacuacaaauaaauuuaaaaaaaaaaaucuacccucagaauucuggaucuauagaaagauaaaguuagcaggaaaagaaacuaaggcacuuacugauuuccaaguagcaacauuuuuuuccacaaaagugaauauugugucacacugauccaaaggaagacaauccaaaacaucucccaacaauacaaaagguguagaugcgguacaaauaccuucaaguggagcacaagccaauuuaaaaguuuaaaaaacuguagaguagaauagccuaugaaaaauaauucugaagaauaucuuaaaagguacacuuuguuacucauaacaagguuuuaaaaggacaagaaguggaagcaaccuaaaaguccccaaauaggacauacuuaaguaauuuuugauaugugcacucaguaaugaugacaauaauucuugacaagaucuagagcauuuacuauaugucaggcacacuaaguacuuuacauauacuaacacauuuaauccuuacaauccuaugagguagagcauaucauuauuugcauuuuauagaaugggaaaacugagacacagagagguuaaauaacuucaccaagaucauagagccaguaagugguagagcugggauacgaacccaggcagucuggcuccacagucuguuuucuucaccacuaagcuauucaaaagaauauaaugcagccaauuaaaaaugaugguuauaacgacuauaauaacuuggaaaaaugcuuaugauauaaugcuaagugaaaaaaggcaggauucaaaauuguauguacauaugguuaugacaauaaaaaaaauucuuaaaagacuauagaaacuaaaaccauuauaccagaugaaugguagcuuuuaaaaguagaggaauuaagaguacuguuuucccuucuuauuucuaaauguuuuguaauguugcuaaauugucuuugugauuugaaaagauuaucuucaaaaaauaacaagguuugauauuaacuaugauucaacauuuaaaauaacaguauuguuucaggggaaagaauggaaaaguagaaaguuacuguuuaaagaacaacaaaauuaagauuuuucuuaagaaaaggucuacguagucuaucuagacuacuuagaauacuuuuauaucccuacucauucuuccuucuauuuuaaggcaaugaguacuuacuaacacucauaaguguuuaagaaaaguagucacuuaggcaugguauauggaggaaaaauaucuagggugaucuaagcccaaaacagugcauuaauauacuauguccagaaaaaaggaagaaauauuuccagcuguacucugcacuaguaagaucauaucuggaaugcgacgugagggauauugccuagaagcagugggugaaauaaaacagcagauuucaacucaauacaagggaacacaccaauaaccacauuugucuaacaggacucaaacagugagcuccacuaaugagcaugauucagcagaggcugaaugaccacccaccagggauguuacagcagagaagcagucuaggccagagaugagacuggacuaggugaccucuaaagucccuaacaauacuuagauucaaugauauuauauacccugcacauccaagagauuugagaagcauauuuucugcccuuaguugcaguauagccuggaauaaguuaacucacauuuaauaauuauagaacuuuuucuagauucuacugccaaaauucugagucaguagaacuaagcaagguuugggaaucucaucuaaaaauagauucacuggugguucugaugagccagcaagucugggaaccauuggguuauagugugauucccccaagagcuuucacaaccugugucccagcuuccacaccaaucucucuccuuacccuuaccugggccacagacaucccuuucuaguucccacuccccaguucccaaacaccaugccauguucauccuuccaugguuuuguucacaauguuguuuucugcauacucuuccuccucuuuaccacaugguaaauuucaacuccaucuuucuaagcauagagugaaugucagcucaucuaaauaacucugauauccugaagcaggcuacuucaucuaugcuuuugaagcacacucuacauaaauauacuguagcauuuagcacauccuaacuagucaccuuugaauguagacuaugagcuuuuuaagguuaggcauuuuuguaugcuuuaaccaguagcaucucacacugaauagaagcucaauaaauaucggccaaauugaauuuaacaaaauauauuuauggauaauuuaaaaacaugucacauaaccaauuauagucugucucaaaaagaaaaauuaucccuaaaauaaaaaugcacuaugccuuuacaguuuaagcucuuaaguccuuauccuucucaaaaguuccaaguauagacuagacuuuguacaacuucuucauuaaaaacaucaccagcugugcaagaauaauguauaaagguaaucaaugaacucaggacacacugaacacuguuugacugaaacuagacaaggaauauuacauugugggacucagcuaacuaugccuaaugaaugaaugauuaggcagcuuguauaaacauuuaacaaagugaauuuaugaacuuaaguucauaaaauaguuugccccuauacugggaggugugugccaguuuuuauagaagcaucaaaauaacacauaaugugaauaaugcuuuacagauuaaaaaggaguuuucacauauauuauuugaauuaaucaaaugaguauuuuaaccaaauugguuaaagaagaaugcugauaaacuaauuuuuuauuucuucuuucugcauauauuuaacgagcuccuauuuuguguuaggcucuguguacuaugugcauuguuuacccgaagucuucuaaagcuaucacacacagccauuuuaacaggcuccugcccaguuuuccugccagcagucacuucaaauggaaucauucaucugcagcugcucuuuuuuuuugagauggagucuugcucuguugcccaggcuggagugcaguggcucgagcucagcucacugcaagcuccgccucccggguucacaccauucuccugccucggccuccugaguagcugggacuacaggcgcccgacaccgcgcccggcuaauuuuuuuauuuuuaguagagacgggguuucaucguguuagccaggauggucucgaucuccugaccucaugauccgcccgucucagccucccaaagugcugggauuacaggcgugagccaccgcgcccggccugcagcugcucuuuaguauggcacccagugcccuuuauaaauggaccuaaccugcuucuuuccucaucauucucauuguccucuccuccuccugcuguacacaauucucuagcuauuccuuucuuaguaugucuaacaaauucuucauaccucacauucuaguucucauguucuuuucuaaaaccucuccugacuccuuuagacugaaguuuagagagccauguuggcucuauucccucuaacuacacuucauucccacuucgaccauaguacuuacaccauaguaaggcaugcauacaucuguuucuuccauuagcuccacauaagcaggggaauauguuuuauucaccauugaaucuccagguccuagcucaguaccaggcacauaguagaugcucaaugaaaauuuacugaaugaacaaaacaacuggagaacaaaggaagugccaaaaugugcacugcauaauagagaugagaaauaagagugaacuaauucaacugggacuucuuggcaaaguugggagucaggcagaacuugaagaauaaacaaaaucagauagguggagaaguauggggagaagacguuuuaaauaaagcaugucauguccaagauuacuuuaaacaaaacaaaacggaaccauacuuaccuucaguuacucccccaauagcaagagaaauaauagcuaaaacguuuucacaugaugaaugauuuaucuaccaacagaggagaaacaauuuaauuuaggggcaagaguucagacuaaacucgauuaacaguaaaaacauguacucugauauuaaauugacuaucagaaauauggaauacaauauuucuuauagaaaacaauauuuucuaauaugaaguuaccaaaauuuaacaguaacauauagaaucaauagucguagaaguaugucaaguaacaggcaacucacucaaaauccaauggucucaagaaaaugguuauauuagcaagaugaaggcuauaagcuaaucaaggacagaagugcugaagccauaacucagccaguggcacagggcaaaggcagggcuaugagaauuaacuacuaauacacccaugugucugaggggugguuuuaauagaaggaagacagugcuuagguucuauaaaaucauaauaaccagcauuuacugaguguucauuaagugcuguuuuacacacaacaacacugaaagaacgguauuuccccucucacaaaagaaacugaagcacagaaaaggaaaagaacuugcccaaugccucacaauggaaaagugacuaagucugaagaaaaggaaagaaucauuuuuuaaucagacuugucugagagaaagggacauuguacuauggccaauagaagggaaucuagcuuuuggggacccaaccuuugcuugaccaagaauaaacuguugaaacuuuuccuuucauucaggugccccauuauugguaaacaaauucagauuuuucaugguuagacuucucuaccgaaguuggagagcccucaguuauuuauguaaguuuacugaugaggaggaugccagaggaaaaugagggaauggaaucccagcuccuaagcuaaauauucuuggacuagaccuuuugcgccacuacaggauguaucacugcuuauacaggaaagugagagagcccaccuucaccucuaguucuuccuaagaccucaugucaacuuuucuuaucucacuuggagagggcucuugucauuuauuaaaccaaacccuuaaaauguaccugugcuaucaaaauccuuagagaaaucguauagucaucaagucaacuuuuacaaagcagaaagguuacucuaaaaaaagauguuuaaauauccauucuaagaaaaaaagcaauuuuuaaauaacaugguuuauuaauuugucaguaaaauuuuaacaauggaaaaacauacuuacaauuucuucuucuagaauaccucugaaagcuuggucaaggguacauuuuuuuucauuuucacuauuaaaaacaaaagacauccucauuuuucaaacagcucaggguauguauaaagauugaggcaaguauuuuucauagauaucaaugccuuaccugccagguaccuggcugaagguacuuaacaauggcuugauguuuuuguuguucaaggccucucugguagacuucuaaaaaaaaauuaaaauggcaaauaauuguaaagauuuugcuuauuauuugcugaaaaauauaucguucauugauaguguaucuuacuaacuaaaaaaugcuuauaccugggaaaaauuaccuaucagucauucucucaguaauccuuauuccaaugcuacuucaugauacggauccucaucacuuuaaaucuggcaagagcuuccuugcuggacuuuuucauucuaggugauauuucugucucuuuaaauaucacauucaugaguauugugcuuacaaaaaaaaaaaaucuccauauggcuccuuauuugcccguuuuaguuuugaagcuucauagaucccucaagguccuugauaauguuaucccaauuuacccaaacuuaauucccaauacucccuaacacauacuuugcacuaaagucuagccauuuuucaucacuuuauaucaaacucauucuacuguauucacacauucauguugcucuuccuaccugcucauccaaauucuauccauucucccacacccaugucaggucucgccuccuggagguaucuuguucagucccugacacguagcacucaauaaaaccaugcugacaaucuguagauuguuuuaaaguaaucauaacuuaaagacaaaaauauugcaaaaggcauucauucuaugaacacucacauacacuuagaaagucaucuuauuaccucacaggaauuagaucuauccuaaauguguccauuccuugcucugccacuaacaggcugaguaauuuggggccuguuccuuuaucucuuugugcuucauuuucgucaccaguuaaauaagaggguuuuuguagauuuuuacuaccagcagcagcuacaguggcaucaccuaggaagcugguagaaaugcaaaaucucaggcucccuuccacacuuacugaacaagaaucugcauuucacaagaagcuugagaaacacugaacuagaugaucuccaauuucaugguccuuuucagggcuaguaugauuuuuuuuuuuuuuuuugagauggagucucccucuguugcccagguguugugcacuggcaugaucuuggcucacugcaaccuccgcuguccggguucaagcgauucuccugccucagccucccaaguagaugggauuacagcgcccaccaccacgccuggcuaauuuucguauuuuuaguagagacggggcuuugccauguuggccaggcuggccuugaacucuugaccucaggugauccgcccgccucggccucccgaaguacugcauuuacaggcgugagccacugcgcccggccgccaauaugaucuuggauaguccuaacaguuacucuuagcaggcuuucaaagcaccagagauugcagcaaaacgcacacaaagaaaaugauuaugaugacauacacaaaauauaauccauuuaaaaaaaaccucacacuguguguguguguauauauauauuauacguauacguauauauauguauauauauauauauauaacccugcaaacaagaaaacuacuuacuacaaaggaugaauuuuucuuucacacaauuuucauccuggcaucccuauaacuaccaaaacacagccgaauaucugagaaauguuggugcaaaugcuagagacgaauagagucaggcaacuuaaaaguguucuucauacuuacguugcugugacgagcaacauaaaaagaacagagugucuaaagucagaaaaaccacugaagucacaacuuuuuggggggugucagcuucuaccucauguaccaggaauaaccaacuuagccuacuucacaguguuacucuaauaguuaaaugagaaagugaucugucaaguguuucccaaaugcucaaaaccacccuuccacauugagcaagaauaaaauagcaucugguuacccuucccaaggugaucuaucugccuuuucccgcuuaggaucucaucgaucgcuuaggaguuagacacgguggguuaagggguggugaagagacggcgggaacaagcacuugguagcucagaaggcuagggcgggagccaggucuuuggacugaaaccacucccacccucccccuucagcagcuccccuuccccuucucgagacaccugccccacuaaacgagcugagaggauggacccaaccagcaguagucugcaggugggcacuccaagcggggagccgaggcgcccagcacgcaguccggggacccgcuggagggugggcggaggcggacggcccagcccacaaagaagaggcggguagugcgucuuucccuaccccucaaccuccgacggggcccggagcggacgcugaggcggacacaccucugucucacuuuaccccagggcaaaauucgaguaauuucagggagaagaggacaaagcauagcgccgggucaggccugcacccuccccucuacagcucaccguaaaccgcguccgcgcuucgggcaaacugaagagcggcggcgucggagacaucuucucggcugcgcgugcccgccacugcgcugcggcgccugccgaugacgucaagccaggagcaacgagacugcggucucucugagcccggcuagaguggccugugaacaccggucgggcgagcuggcaguugggaguuucccuagcgacucaguucgggugggcguugggcgccugagucagccaaacagccuacucgggguucuuggguagccuuuggggugaggggacuugggcggccuuggucuguaagcucugcguucccgggcguggaagagacuggccgcgcacaugcguuucugugguuuuccugguuuggggaaagcggguaaaugguggcugguugcggcuaacugggccgcgcuaaaagguaacccaa

SEQ ID NO: 18472 - RNA, 538 nt, Homo sapiens
gccuggaguaaggcuucuggaucccagccaggagauggggaaccuggggccauaagaggugaaaugaugaguuauccaagucaugcagcuaauuaaguggcagaacugggauuagaacucagguuuccugccuccuaagaauguuaaaaucaaccuuuggaagcaaaccuccagugccuucuuaaagcauaucaucagaagaccaguugugguaaaauuaaauccuggagugaauuauugaggggaccuggcuugccuggaugacugcucgaauauagcccugagaaggcagaggaauauguaaguggacaaccgaagaguaaguauggguaugcauuucucugaggaaacaaugugucgcauaucaguacacaggagagaaggaugugaagacaacuagagagccacacuuuucagagcuggauauauauuuacagauuuuuuccuauuuuugguuauuuugugauauaauuugucuuguuuuauaauaguuaaugauuuuucacuuuuguaagauaaauguaugauauuguggauu

SEQ ID NO: 18473 - RNA, 24101 nt, Homo sapiens
aaugagccuguuuggaacaaccucagguuuuggaaccagugggaccagcauguuuggcagugcaacuacagacaaucacaaucccaugaagguaccacgaaaagcuuccuggggcuuguaggaagaguuugggcagaguuucucccaucaaggacagaacccgagaugacuugggagccuccuuuaggcugaaagcuuugaaacuuugucuaacucauguuucugaaacacuggagcacagaaaauguguccccguacuuguguccuguucuuccuggccugccaggucuccagaaucacccaaggugcagauuccggugcagauucccagggccuggcccagccaggacuguugacucagaauucccaugguuggagagaggggauggcaggugaaaacugugaucuagcacuguggggccagagugaacuggucauuuagaaaacaagaccaugggcauuucauuagcagcugcuacugcuaguccugguggugcugguacuuucucuagcuuauuuuuuacuccugucuuugaucaaaguaaggaaaggucuaauucaguuaguucuuguacacaaggaaaggccaccgugagguaauuagugagaaagaaaacaauuuggaaugaaguugugagcgugcauacauuuuaacauugacuuuuuucccgcaggauauugaaguaacaucaucuccugaugauagcauugguugucugucuuuuagcccaccaaccuugccggggaacuuucuuauugcaggaucaugggcuaaugauguaagugcuccuuaaauacguguucuagaaaucaucucucuuuguauggccaagguuagcuuuagcuccguuguuucccaaguaaaugaaucaguuggacuuauuuauggccuuuuuugagaaaucaauuuagggggugugaacccuucugaauggcagacauuauucuuacacccguuuuuguuaggaaagcacaaucauauguguugcucgaaauuuucuacuuuaguucagucucuugaaguuuauucccaaaucaaauaucauauucauccagagugaacauuauacccaguggcacacaccaacaaauucccuuucuuggcauccugacaguguuccucaggcauguaugaaacuuuuucaacguuaaauaauagcacagauuugccuagauacuuacucaucauguacaaaaagaaagacaaaaaaauuacaguuuacuaaaagaaagaaaacucugguagaaaaauaagcaaaggguguaaagagggacuucacaaaagaaagaauaaaccugaaccauucauccaugcuuguaaucagauaaaugcaaauuuaagacuuuuuuuuauuaaauuaacaaaauuaaaaguuuaaaagaauaauagugccagcaaggauaagcugaaacccugcauguauggcugguagguauguaaguuggcuuuuccacaggauaauuggcaauaguuaucaaaaauccuucagcuuauacccuuuaucucacugauacccuucugggacuugaguaggaaaucugauaauguacuucaucugcauuaucuaaauuaaccuuuauaacagccaaagcacugugaacuugugaaaauuuugaaaauuuuaauauccaguaguaauggcaauguauaguauguuuguaugauggaauaccauuguaaguuuuuggaaaagcuuuugaacuguagccuacagcacaggggcagcagggguuaggagaacaggagggaggaugguagucaagguugagcaagcuugcuuucuacauguaauuuuuagaaagauuucagauuauuugcugcuuaaaaaaaggauguuucaaguugaacaggcuagugaugcaggugaggaaagcuguagcugcaaaagugaagacacuguauaaucuagugucuuccagaaaauaugcguacauggaaagaagacuaagagcacacagaaccauuagcugugguugucuguggugugauuagggugauuuuuauuuuuuugccauauuuacaaaaucucuaaaauguauuacuuuuuuaacggaggggagauuauauaaaguauucagaaaagagguaaguuucuacuuuggucuugauucucugaaugguaauggguaagugauauucuacuuuaaaagacauaucucauagaugcauugagaaaauuaucugcaauuuuauguguaagcaauagaauuuguuuauuuuaauagcuuaggcgaagaaaacaguugcuuucauagauauuuuaauuccuuuguucuugaaguuagauaauuagguugcuaugagaagucuauguaugguuaagguguaccccauuaguuuuuagguguuaaaugcaagcaauacaucguaauugcuuuguuugcauugaauuuuuuuguuacuacagguucgcugcugggaaguucaagacaguggacagaccauuccaaaagcccagcagaugcacacugggccugugcuugaugucugcuggagugacguacguucccuuccauuucucguguuccauuuuacuuaaaguacagaaugauuuagaauauuuaauaauccaaacacaaauagcauauauguguucauauuguaggaauucuaaguuucugaacauaaauauagucauuuauugauguucuuaauguuggcuuuaguuagccacuuucuuugaaagcuuuucuuguauuaaauuuugugugugugauugaggagaguuuaaugauuaagggauaauuuaugaagaagccagcagggaaggugaaacaccggugccaagcugcagugggcgggccuccuggagcacagcaugagcugcagcuguagaggggcuuccaccuggcgcgggagagccaggggaugaacagcuguagacgggccucggccuggcgaggggagccagggguugaacaccccagccucucuccucccuucuccugccauugcugcugguggcugaacccaacaguagugagaauguuaaggggccuggugacaggcagacacacugcagugcugaagaagcuaagccuugaggccccuuccgaggccuuguaccuguuccuuuagucagguuuauugagucugauuugccugcuguaaaacugaaccuuuuugguauacagcucugugaguguuaagaaaugcauagaguuguguucuagauauagaacagauccaucggccuccaaauucucuuccuuccuuuugucgucaaauccuucccagcucgcagccccuggaaacuacucaucuguuuuuuuugucccuauaguuuugcuuuuacaagaguaucaucuaaauaaauccuauagggugcaaccuuugcgcucagcauguugcauuaacguauggugauuguuuugucagauauauuuccuauguuuggggugggaugcuggaaauuaggacaagcauugagauauagcaucugcaaaaugcuaauguaagugguaggaguuuucucauaaaagauguacgaguuggucuuagcgguauugggguuaugccauucgaauuuguaagaagagagugguuuagaagggucuugguaauuaaauuugugguauagaguucugguaaauauacaguguguagugcuccuaggaaaauaguaguaguuagggcauuuauuaugauaauauucauguauucugcuauaaagaagggggcaaaugagccugcggcauauucgauguugaagccugagacuaacucugacucuccuuuuguuagaucaaaagaggcucaguuaguuucugcuaguguggggauaaaucauauuauggcuaggggccaugaugauaggagcagucagaggaauucuugugaugaguauguguaaguuaaaugagcugcuuaucaguagaacugauagcuggauaauagcuagggugacuucauaugaaaucgugugggccacagcucauagugcgcugauuagugcauauuuugaauuagaugcucauccugaucauagaauagauagacggcuaggcuugauguggcuaguuuaaauaggaggccuacauuaaaauuagaggaucugguauagggagggggguucauaagaggagagcgauagagagggcuaggauuggagcaauaauauaaagggugauaguagauguuaagggccgcgaggguucuuuggugaaaaguuuuauugcaucaaaaaaugguucaagcagucuguaaggaccuacaauguugaguccuuugcauaguuguauauagccuaagauuuuucauucgaugaguguaaggaacgcuaucgcgauaagaguggggauaaugagcaggaggagguuaauuacaggcauguuguuaagaagaggaguugaaccucugauuauaaaguguuaaguuuuaugcaaucgcugggcucugccaucuuaacaaacccuguucuuggguaggaugugugaugauuuaagagacugggauggcaucaucuauggagugagggcacuuuaugaagugggcccuauuucucuuguccuuucguaguaggaggaauguuaaguagguagaaaccgaccuggauuacucuggucugaacugagaucacauaggacuuuaaucauugaacaaacaaacucuuaauagcggcuacaccauuaggauguccugauccaacaucgaggucguaaacucuauugucgauauggacucuaguauaggauugcgcuguuaucccuaggguaacuuacuccguuuaucaaauuauugggucgauguguaauaacucacuuagacuuguguggucuuagguuguuaggagguugaauuaugcuccgaggucaccccaaccaaaauuuuuaaugcagggauaggaggcuagggccuguaggcuuguuggaguuuuuauuugcauugaugaauuaaagcuccauaagguuuucucgucuuauuuguuuauauccgccucuucacggauagaucaauuucacugguugaaaguaagagacagcugaaccuucguguggccauucauucaagucccuauuuagagaacaagugauuaugcuaccuucgcacggucaggauaccacagcuguugaauauaugucacugggcagauagugccucuaauacugguaaugcuagaggugauguuuuugguaaacaggcgggguaagauuugcugaguuccuuuuauuuuuuuguaauguuuccuuagagcaugccuguguuggguuaacagugcaaauaauacgguguuuauuauaucauuuauuaauauugggauguuaacugucaguggguuacucccgucugauguaagcuuaugcaauggagaaugucuucaucuuacuuacauuaacauuacugcuucuauuaaguaauagauuaguccaaugugauguuaggaguucaguagacugguuagaauuuaagauaguuagauauugagcuuaaaugcuuucuuaauuaguggcugcuuuugggccaacuguggugguaauguuuuuuacucucuguaggaagggucuaaagagcugucugucucucuagacuaacaguuaaacuuacagggaguuuaaguaauucuguggguaaguugaaaguugaacuaagccagccagcuaucaccaggcucgguaggcgugucaccgcuacucaugaaucuucccacuguuuugccacauaggugagugugcucuuucagcuauucuuggguagcucgucugguuucgggggacuuggccauaguucuauguaaaguuauuucuaguuaaugcauuaugcagaagguauaagggcuugucuuugcuuuuuaguccucaauacaguucuuucauccuucccuuacaguacugugucuauugccagaaauaucuaccaggguagaaauuucuaucgccuauacuuuuguuuaagguaaaugguuugauuaagauaguuugauaauauuuuuagcgagguuuggggcuagaguugucugaguggucaggucaugaugaaaucuucuggauguaagccggaugcuuuggguuaagcuacacuuugguuuauccaagcgcacuuuccaguaugcuuaccauguuacaauuuaucuccucuauaccuguguagaaaauuaucaguaauagugauuucuagaguaguauucgaggaaggugaugggcugugugugcgugcuucauggccuuauucaaccaagcacucugcucuugguuuacugcuaaauccuccuuaagcccuuagauuucauaaggcugucaugagauuuucuggacauagaaaauguugcccauuucuugccaccucaugggcuacaccuugaccuaacguuuuuauguguauacuugugcuuacucuauaaccuuuuuaggguuugcugcagaugggcauauaggccaggggcaagagguggugagacguaucgggguuuauugauuauagaacaggcuccucuagagggauauaaagcaccaccaaguccuuugaguuuuaaauuguugcuuguaguacucuggcgaaugguuuuguuaauguaacuguuaggguuuagggcuaagcauagagggguaucuaaucccaguucuugucuuagcuacugugucuucaggguauuaaagcuacuuucguaguauguuuuauuucaacuggaguuuuuuacaacuuagauggagcuuagcacucuuuacgccaaguucuauuagcuuggguuaacuguauggccaugguggcgggcacgaaauuaaccaacccuaaauauuaguauagcuuaguuaaacuucuguuuauuacuagauuuaacacugcuguuuccugugggggugugguugagcaaaguguuuugagcugcauuugugcaugcuugauaccugcuccuuuugauccgggugaucuagaggacauuuucacugggguagggguguuugcauguguaaucuuacaaagaacuaauaaaaaggucaggaccaaaccuaucuauaagguuuuguggacccaucuagacauuuucagugucuugcuuugagugguuaagcuacauuaacuguguagaauacuuaaguggaaaauuaaaguaugagaaagaaagaaagaaagaaagaaagaaauagaaauaguugcuuacaguucuggaaauucagggucuuuaaaguuggauuggcagagguuuggcugagaggguuauucauaauuagaguaugguugauuuaggguuaugguguacuggggcagcacuuucagaggguuaugcucaagguaucauaucaguauuagggcagaaguuuaguuaaucuauuauacauaguggaggauuuauuggguaggaggagccuuaagauuuuuuagaaaauuacaucaaucgagggguagcuguugggguguucgugguuaaaauaugucugggcucugacuggguugcauuuuaguuucuuguguuugggguuuggcaaagguauguuuaccuagguugaugguaaagucagauuaggaggggggaguuugcggauuuauucggaaauaguucuugaaauugagcauacgugcaugcgugagcaucuauugauuaauuguuaaguccuucaaccaugaauuaacaccuuaugguuguuaugucaguccggaauauucaguauaaguucagcuacaauggauuuggcaggagucaggcuguugccaugcugagucacagcaucccaaaguuaaaaaauaccaaaugcaugacagugcucccgugacuggcuaauagggugguagugauuaauccaucaagaugucuuauuuaaagggaaccuaugggcaaucuuaauuuuauggccauacguuaaugcagggguccccaacccccaggcuguggaccagaacagguccauggccuguuaggaacuaagcugcacagcaggaggugaauggugggccagugagccuuacugccugagcuccgccuccugucagaucagcggcggcauuagauugucacaggagcucgaacccuguugugaagugcacacgugagggaucuagguugugucuuccuuaugagaaucuaaugccugaugaucugagauggaacagcuuuauccugaaaccauacccucacuucaccccagucuggaaaaauugucuuccaugaaacuggucccuggugccacaaagguuggggaccgcugcuuuaaugugaucuuauuuagcuuauauauaagaaauaauucuguguauaaacauuuugacauaguuuaggggccacaguugcucccauuuuauucaguagcaaggaucagcuucucugaggcauuuuuaucaccuguaaaaugucuuccugacauaccugauuaaguuauugugacacuacauuaauagauauaugaaaaguuugaaaagugaagcauucauuucauaugcaacuuauuuuuaguuuacacacagaaaaguagcagcaugaguagauuugaaacauuucuaauguauuuugucugucuuuacugaucgggcaacgggucagaauuagaaaguuucuuauaaaguacggcaagaaauagaauuaacuaaugcaggaauccuuuugcucaaauguuaucuaauggcuauuggaauuuauaaaacggaaucuaaguuucauagcaucuagugggaggaucagacacaggaaugagaguuguacguucugacggggaggcaggaugaacuggugcugggugggaaaaacaauacagaaagcagcuguaaaguuuggaaaggcuucugugaaugcuuuacagaagacaagaauagagguaaauuuuuguuuguuuguuuguuuuugaguguugcucuguagcccaggagugcaguggugcgaucucagcucacugcaaccuccaccuccuggguucuaagugauucuccugccucagccucccaaguagcugggguuacaggcgcccaccaccacacccagcuaauuuuuguauuuuuaguagagaugggguuucgccauguugccgagacugaucacaaacugcugagcucaaagugauccacccgccuuggccuccccaaguucugggauuauaggcaugagccaccacgccuggccagcagagcugauucuugaaaaguaaaccauuugccuauagcuuuuuaagcauugucucauccaauugaggccuggguucaaauuucagcucugucucuuccaggcuuuugacuuugccaaguuguuuaaucuuucuaaauuuguuuucuuguuuagaaaaugaagguaggcugggugcaguggcacuuugggaggcuugggaugaaggauagcuugaggucaggaguuugagaccagccugggcaacguaaggagacccggucucuacaaaaaauagaaaaauuagccggguuugguggcgcacaccuguagucccagcuacuugggagacugaggcaggaggaucacuugaucccaggagacugaggcugcagugauccaugaugacaccacugcauuccagccuggcaacaacccugucucaaaaaauaaaaaaaauuaucugagugugauggcacaucccuauaguccuagcuacucaggagacugaggugggaagaauccuugaguccaggaacuggagaguacagugagcuaugauugcaccauugcacuccaagcugagcaauagagcaagaccgugucucuaaaaaaauaauaaauaacaauaauaaaguaaauaauaaaaugaagguaauaacacauaauaacauuauuaauucagcaaauaauugucaggcaccuauuguaugcuaaauccuggagauaaaguggaaaucaaaguaggcaaaaccuacacuucugaaacucaugaucucuuaggacaaacaagaagaacaaauacaacuucucgauaguggaaaauugugaugacuagauuaaaccuacacggaaggauuagcacagugcugucacaaagugguuaaggagcuugccugugagaacaaaagugacuggcugagccuaggcccagaccuuccuggugauggagcccaugugcuuagcagccucccucauggagcuuuacaggaagagucggagcuacccgggagagaaagacauguagguaaaggcacaggggcgcuaaagacccaaaguuaccuuggaggcauaaaagccaaacuugguaaaguugaaucuucaguacuuuaaggacaugguucaaacucugcaguugaagcagguagacuuagagcagcugguggagcauucacacauacucuuucucuccccaguguuuugcuggauucuccuuuaugucugcacguguccacugagguuggcaugcucugcuccacaaugcugaugacgugguggggcuggcauuaugagauugagaggccaguguucacuuggacucagggcagcccucuccauacacucauaccuuuccuuugcuguguuuucaaggauuuguagaauuacaaccucauuaaaagcaugaggagcaaguuuuaucucuucuuucaaaugaagucacuucaauggaacaaguuuuugcuagaggagaaugguggucaauuuuugagcucuggaaccaaaaaugaaauauagacuaggccaagguucagcaaacuauggcccaugagucaaaccugacccauugucuauuuuuguaaauaaaguuuuauugaaaugcagccacacucauugacauaauaugucugggugcuuucaagcugcagugacagagaagaccuacuuugaguucucugugugaauauugugaaaccaucacacagugaccacuaauuuuuaaaucuauuugacaaguuagauaggaccaaugacuguuguaaauuggcauagcuuuauugcauguacuuggaaguguuauuagauagggaccgaauaaaaguaauuaagauuauaguuauguguuuuguauauagagagaaagauaaaugugacagaauguuuacaauugaugaaucuaugugaagugcuuauggguauuuuuuguauuuuugcaacuuuucugaaggcuuaaauuuuaucaaaauaagaaaaaaauuuuaaagugguccaugguugcugcugagaggagaccugggaucagggacaagagaaagaguuuguuuucacuaguuugugauuucugauuuuuaaaauccuguuuauauguucucgcuuagaaaaguaagucaaucaugaaauagaugaaaaugaauuuuuuguaugaugcuguaguuugcaguacacugguccccaaacaauuggaaaaauaaagauugccaaaguuugccucaauauguucaacguaguaucuaaauauauauauaguuaaagauuuaauuuuucuuaaaaugcaaaauuuucuccauuuuauuuuaggaugggagcaaaguguuuacggcaucgugugauaaaacugccaaaaugugggaccucagcaguaaccaagcgauacagaucgcacagguaacagaagccucugcagaaaggcuaggcacaacugguacccaggacugugauggcucuuuaagugaaauaauuauuauaauuauaauaagaaaacgugcaguuagacucugucaaaucaauuagacaauauaacagaaaccucuuuagcacaaaaauaacaauuuuauaaccauucucauucuuaacuaguguucacagauugucuugucauggaucuucauauauguauggauggagucauaaggaguuagugacauuaaaaucuaugaaagacaggucauaggugguccuugccauucacagguuggacguugugaccucgugcauggcuggucuucuaccaacugcauuuggucacuuacucauucagcaaguguucugucuaugggccaguaauagagcagcgaguaagaggggcauuuccccacacguguggaacuuuuaccguuacucagggaccacuggcagguacugugugaagaaugccaagggcagaaguaaugaagauaagagaacuuagaaccagaggguccagccugcuaagggggcuucaggaagagcacagugcugaaacauuuucaggaaggcacugcauacucaggucacagugcugugugcuagaaacaucucauugaucucuuaauucccaucaccucagugaguaaaacugugguggaauccccugcuuguuauuucugaauaucucccuaaggaggagcuuacuuucacucgcacauaugucuuaauuaugaguaaaaaaauuaaaguuugcuagaauggaagguagauauauguuuuuguguuaaauugacuguuuugauuauggguguauuagucccuuccugcauugcuauaaagaaauaccugagacuggguaauuuauagagaaaagaaauuuaguuugcucauguucugcagguuguaugaguauggugccggcaucugcucggcuucuggggaaucccaagggagcaggagauggagcaggcacaucacauggcaaaagcaggaaagagagcuaugggagagaggaggugccauacuuuacaacagccagaucucagagaacucacuauugugaggacugugcuaacacaggagggauccgcccccaugacccagacaucucccaccaggccccaccuucaacacuggggauuacaucucaacaugggauuugguggggacaugcaaacucugucagugaggaaggauugguaaaaugcuaaguauguuuugguuuuuguuugguauggccccaguauuuaaauuaguuucuucccuuugaauugccacaacuaaagcuguucagcacauucuuacauuuaccuugaucuguuuuguuuuugucuuguugaaagcaugaugcuccuguuaaaaccauccauuggaucaaagcuccaaacuacagcugugugaugacugggagcugggauaagacuuuaaagguauaaugugcaguugaggcauuguuuggccccaucaggauugucauuuauuuuugcaccauuucgacuucugcucugaauggucacauacuggcuucucuuuuuugcuuuuaguuuugggauacucgaucgucaaauccuaugaugguuuugcaacucccugaaagguguuacugugcugacgugguaagggauuucaacuuaauauguauuuacuuuaaaaaaaaaacaaaauaaguauucucaccuuguggcguccugcaguuagugaguggauaauauaaaaauccugcuagcuuuaguaauagauauaaaggaucgaguugagauugccucagucgucuccaauugggagauuuuugugcugcguuucuuuuagaaguacuaaaugcuggaugucaaguuuuccugccacucguuugaacauaugcagcuagcuacaugccaucucuagugugacaucuaucauguccuuuccauggcaguaggaaaacuugcaguaaguuugugaggugguaccaggucuuuggggacuguuucugagugggauagaaauugaacuuucucggccaggcaugguagcucacgccuauaauccuagcacuuugggaggcaaagguggguggauugcuugaggucaggaguucgagaccacccuggccaacauggugaaaccccaucucuaaaaauacaaaaauuagcugggcaugguggcgcacgucuguaauccuagcuauucgggaggcugacgcaugagaauugcuugaacccagcaaguagagguugaagugagcugagaucacgcuguugcacuucagccuuggugauagagugagauacuaucucaaaaaaaaaaaaaaaaaaggaaagaaaaagaaauggaacuuucuccauuuguuuagucacaucuuaaaguuuuguaccaacaaucccguaauuccacuuuuaggaauuuaucacaagaaaauaaucauagauacagauggucuuuguuuuuuuuguuuguuugguuuuugagauggagucuugcucugucgccaggcuggagugcaguggcaugaucucagcucacugcaaccucugccuuccggguucaagcgauucuccugcuucagccucccguuaacugggacuacaggugugugccaccaggcccagcuaauuuuuauacuuuuaguagagacgggguuucacauguaggccaggauggucucgaucuuuugaccucaugauccaccugccucggccucccaaagugcugggauuacaggcgugagccaccaugcccggcuggucuuuguuuuauguaauauagugaaacauuggaaguggccuaaggggccaccaagacacagauaaauaaacccugugguagguucauuugaggggacguuagaagccacugcuaguacuugaaaaagugugugacguggaccuuaugaaacauguuuugaguaaaggauaugaacuguacagaaauaugcuacauaccaaguauaacgcugagaacaaaggcuggaauagugacagcaacugaaggagugguguaggggauuuuuauuuauucuuaguuccugaguauauuuucuaaauauccacauauuuuauaguuaguuuuaaaacacgagacuuuuuaaaauauaugaauguucuacuuucaaauacuauuucucuagguuuuagugaaauauaaucccaggauuauuaaaauccagacuuaauguuguaaccaaaaauugaucaaauacauuaguauaaaaacagcacacuccuucaccugaagcgcaucucuguuuucuuccauucccuagauauaccccauggcugugguggcaacugcagagaggggccugauugucuaucagcuagagaaucaaccuucugaauucaggaggauagaaucuccacugaaacaucaggugcgucauuagucaaaucaagaaguauguauuuagcaccuguuguaugcaagauugugcucacaucuggaauacaguuguacuuuguaaaaccuguaaguauguucaaagaggggugaauugaaggauauaaacacaaauacuuagugagugaauauuaaguaauacuaagguaucccuggaugaacugaauuuaugucuucuccaaacaugccccuggauggcugagugcuacugaauuguaggggccaagggaaaacuucuccuuugcccucugaagggguucacugaaaaguagcugguaaaagacagauuaauaggagaaauggcauacaaauguauugaugugcacagcgucuuacaacgaucuuaaaggcaauaugguugaugcuuucauaccaucuugaggucacagaaagaagggggcucagggcauggcccaaaacaggcuuucaugguaaauuggguucucguggcaagacagguuaugggaagaagagaagaagaggucuguguagcaaagguggucuuguuaauguggaggaaaccccacagguagcacccucggagagaacugagaccuuuaacggcaucagacugcaguuaaucuucccuaaucaggacaagggaagggccuuggagaaagccuggcugcaucaaugccgauuuucucugcagaugcagaucuccccaccaaagauagcuuuucagcuauuauuuccagcccuucuguauagccaucuugaaauaugucagagaagucuauuuuggggcaaaauauuuugguuuccuugagaauaaaauuacacaucuggauggguugguuccauuguaaauuccuagcuuccaacuucaacucugucugcaucaugccuagaugcuugcuagcuuuuucaccuuagcucaauccuccacuugccacagggcugcugggccugcacucuugucagcuucuccuuccuuuagucuuugucucagccaaucagaucagcucuugcucagagaaaaaagaagcuaaugggaacuuccuccucuuucuccugccagaucuagaaaucugcccgugcuugccuccuccccugccuuuucccccaugagguggaagccguccugcuaaggccaguuuuguggugggacccaugcccuccagccuucucaggaaccguaugcagaguaucaccucuuucccauacacccgucucuccugccgcguaguacuucucccuuagcacugacacuagcucaagucuaguugauccuagaaaacacaccucccuugauccccacauccuccuccaguacugcccgcgucccuauuccuuccgcaguggggcaucuuggaugaaauguccuuuauucccucaccucccacucauuucuaacucagugagaccuuugccccccauuguuccaccagaacuguuuuuggcgugacuaccaguggcauccucauugguaauuccaggggacccuggacacccauccucuuacuggaacagagcuucauucacuguucuuacaagaaacauuuccccuggcugcugucuugccagccucuuacccgcuaccucuguggcucuucuauccuugcuggcucuuggcugaauguggagguuccacagacaucucccuaagccgcugccuccuccacccaagcacaacugaucucccauccacugucgcucagccacgcccuguggacuggagacucguaccucauuccugugcuccugacauggacacccagucggacagcuccuuggugugucucccaggcgucugaagcuacgguaucccacaccaaacccaagacuacauucuguagcucuuuauucacauguuacccuugccucaggauucucccuugcuacugccaccaguaccaucuacuuuauacguauguauggaugucauauacauacuaaauauuucccuucuuuugccuacuagaauguaaacuccaugagagcagagauuuuuguuuguauuuguugcugccucccagcacuuggaggagggccuuaaguguaaaaggugcucugugaauauuugcagagugaacauuugaucugaaccugccccucucggccaccaccagccuguugcuccugaugugcuucacagcccauucaaugggaccuccaucuccuuuguuauagccagaaaucuugaggucaccccugauuggaacuuucccucuccugucucacuaauccucagucuccuccccucuacccugaaauuauuugggaaucuguucauuuuucucccucccuccugccaccacaucuaauucaaaucuuggaaagcacuuagaucagaacucuaugacauuggucuuggcaguaauuucuuggauaugacaccaaaaagcacaggcaacaaaagcaaaaauggccaaguggaacuguguuaaacuaacagcucuugcacagcagagggaaccauggaaaagagugaaaaggcagccuguggaaugggagaaaacaucuggaggcuauuucugacaagggauugauuuccaaaauacguaaggaaccccugcaacucaauagugagaaaacuggugacgugaaaaauggaccaaagacuugaauagacaugucuccaaagaagacauacaaauacccagcagguguauggaaaugugcuuaacauccuaacuaucaaggaaaggcaaacaaaaaccacagugagauaccaucuccuagcugaugggaccacuguuaccagaaagcccaaagauaacaagcgcuggggaggguguggggaacauggaacccuugugcacuguuggggggaugcaaaaugccacaaccguuacagaaaacuggaggccucaaaacaugaaaaacagaaucaccauacgaucuagcaguuccacuuacaggucuugauucaaaagaaucaaaauggguauuuugaagagagaccuguacugcuaguguuccuugcagcacuguucacaauagccaagugaacagauaaagaaaaugaaguguauaccugcaguaggaugcugugcgugcagccugaaagaaggaaauccugccauucgugacaacgugggugaccaugaaggagauuaugcaaaaugaaauaagccagacacagaaagaaacugcaugguuccacuuaaaugugauauccagcauagacucacagaaguaaaggguggaauggcggucaucaggggauugggggagagggaaauggggagcuacuuaaucaaugggaugaaauuucauuaaacaagaugagaauguucuagagauaugccguacuacaugguaccuguagucaacaauaauguagacuuagaaauguguuaagcgguggcucucauguucacucuucuuaccacaguaaaaucagcacuuagaccuuggcccugguucaaggcguccuccggagcugaggcaggggcucuuguaagcggcaccacuggccuugccggaccccagccuaagcccuucccugccuccccauuuccuuuugguugaauccaaaaaaaaccuggucccaucuggcuucacuuccugccacccggugcuagcgcccuggccucuccguuguugagaacugauugccaucggccuuugcacagggccagugcauguggcucuuggugcaagugacaccccuggcauugugcaguuccuggugugccgcacaguagacccugugcugaugaccagccauggccuuuucugucaucuaagaacuuacagauguuugucaguuugcuuuacuuuuuuucuucguacucacaaaaguaauggucuggcaguuuuuaaaaaggcaggggagcaaacaguacaggaaugaaagaggaggccguuuuccuucguacuuaggaaacgugcaucaccagcagcugucacgaugccagaggcugcuucucccuucgucuugccuggccccugccuggguccugccaggcuuccccugaacucacacggaagcucagaugaccagcuuaggcaggguggauggcccuccaagcuuuggccagguugccacgacuggaaggaggaagugguaacuccaaaguuggcuucuccucgggguggucggcuuuucugcccaggaggcuggguaguggaauuucuggguucuucuguagaauagagaccugcccuugggcccucacacucaacacugggcgaagugcagcguguugcuugucuguagcauggccacugcacccaccguccccuucacccuguuacccugugagacgggugcggcagagccugcaucccuccuccagcuggggaggcagaagcgcagaagcuucgggugaccuccugaggggugucugccuagccagggacgucuccauuccccacaggcagggccgcugucugccucgcagcccauggggcucugcuggcgugaacgcggccuugcaggguggcagagggagagcgagcagcgggggcgggggaggagcacagggugugcaguugggucauaaacucacugcuuagauggaguuacuaaggaguuagaaagcaaugcuuacugcuguaucauauuugagugauuuuuucugguucuucuaaaaccuaaacaugggguaaaaaugacuuaccuucacguuagucaugaaaucuuauauuaugcugugauuaugucucuuuuuuauuuuaacuguagcaucgguguguggcuauuuuuaaagacaaacagaacaagccuacugguuuugcccugggaaguaucgaggggagaguugcuauucacuauaucaaccccccgaacccguaagugugacucugucagcuugcagauuucacuggacuuuuuuuaacaaaggaagacuuacaugaaccuuugucuuucagcgccaaagauaacuucaccuuuaaaugucaucgaucuaauggaaccaacacuucagcuccucaggacauuuaugcgguacguuuuuagacacuuuaaccgugguaauacaucuggaaaccagacuuggagguggcugaggaauugugggaucagaaaagacucaucacugaagagcuuguguguucauguccggagauaaguggcuuaugcuguaggcuucagguuucuguggauuuuuguuguuguuuuugagacggagucgcucugucgcccaggcuggagugcaguggcgugauaucaccucacugcaaccuccgccuccuggguucaagcgauucuccugccucagccucccaaguaguugggacuacaggcgcccagcuaauuuuuguauuuuuaguagagacggcguuucaccauauuggccaggcuggucucgaacuccugaccuugugauuugcccgccucggccucccaaagugcugggauuacaggcgugagccaccgcacuuggccuuguuuucuguguuaacgugccgccuaacuagcaguguuguguauuuguuucugaacauaagcuuaggauguuuugccgagagucuucucccucccucaggagcgcugguagacaguucacacccacagcucagacugagaaaucuguuugcucaaaagaaacauuuuccugaggucugcuccuuguuucuugcuguccacaugcucacuuucucuggugugcagcccucacaggaggcaagauuggguucugggcuggcauuugauggaggaagccuggauaguuucucuugcuaucagcgggcagcagcuggaaggaaauguaccugugcgcuuuguuuccuaacucaagcaggaagugugcguggguggaaccuucucugcgccccucugccuggcuucucauugugcaugucaauccuugcagguaaauggaaucgcguuccauccuguucauggcacccuugcaacugugggaucugaugguagauucagcuucugggacaaagaugccagaacaaaacuaaaaacuucggaacaguuagaucagcccaucucagcuugcuguuucaaucacaauggaaacauauuugcauacgcuuccagcuacgacuggucaaaggugagaacucccgggccugcucugggugcuccaaggcagcagagccaggcucuggguucagaaggccuaggccugaguugugacucuucucaggacucacguguguccuugggcaggucaccguccccucccuguaaggggaaauugcaggacuuccucaaaugguuguggggauucaguacagccuuuggccagaacccagcacacaggaagugcucggccagugugagccauuacgggcugcucuguuccugggcacagaagcacaggcaagccgggggcugcacuuuaugaaggggguggcagggcgggucauggagcuuucgccugggugcuguugguugcuugguuggcuggugguuugggcagggggaguuaggagcuggcaggaguggggcugcauuuuugaggccuuugggcaugauggugaaauguguagacucggguacucugcccaaccccaugggaaguguguuggcuuucaaccagccugcguguuucuccacugcucagcucuucuggagagguugucaucauuguauuugugguuuucaucauucuccucccaccccacucugcccuuugcccacaacagccuucuagacuuuucccuacccugcccuggcuuccgauggggaggucaccugcuucacauaggaggggcuuccaguggccugcagugucuuucccgcucaccucaugucugccugcgcugaccccgucuccuuccacccucauggcucuuuucugggccuucucccacugucuucuguccccguccaccagcuccuccccucugucuaagcauggaaggcucgaggaaccauuuccauguauauuaaggcuaucgagagaguggugucagcaccuacccucuugguucccugugcucuggccccuccucaguccacugccagguacuuucuggccucuugcagcuguacucagagucccuguggccacguccuccucauccaguccagaagcuuccuuucugucugugccggucacucacccgucccuuccuguuccauacagcucuccucccugcuucuuggccauguccugguuuauucugcuuugggcugugguuccuguccuccugccagcuccugucuccugccccucuugccuugcuggccccccgcuaucucagccuggggggccaccacagggcucuaaacagcgcuuugcauucccaagacaccugcugccacacaagccagugacuggagacgucccuugguucgggcccugcccgcuccaccuuuaguauuucccagucucaggagcguggcugcaccugagucucccugaggccccgaacuuagacacagaaguccagcugauugccuuccaucccucugaccccuccaggccugcugcugcuucuguguuucccuguuugaggguuugcugugugagccaugaagcuguguucuuuuuuuaaagcaacuuuauugagguacaauugaaauacagucauuguuuaaaguguacaauuugaucaguuucaacaucuguaaauacccaugaaacuaucaccauagucaucuccccgaaagguuuuuguguauauuacuguaaucuucccuuacgcacacacaaaaccauggaucuguuuucuggcauuauggacuagucugaauuuucuagaauuuuauauaaguggagcccuacgcuacauuuuccccucgccccagcuucuuucccucagcauaaggauuuugaaauucacccaugcuguugagugaaucacuuguccguuacuuuucagugcuggguaguauucccggguggggugugccauuuguuuauccauucaccuguguaagccaugcacucaguuuugugacaagaguguacuuuuuugguucugccuggcuggggguggacaggcuguggcgugcguggagcccgaggccucagcucccacaucgggcucuucauugaaucuccucuuugcauacucaucccagcagcugcaucaaaauucugcauuuuaacuuaaaugacgcgggacucuauacguuauacgcguuaaaaaauguaguaaauugaaagcagugagaaagguaauugcuuugagugcuguuuaaaaauugaaguaaaaucucauucauuuaagcaguuaaugucagcuuauuguggggguuacauaaauuagcaucuuuuuaguuuaaaagagaaauuugcuucagggguuuuucauuguucuuaguucaaggacaguuaucuccagugcaaagucaugaucacauaugauugauguuauuagcuugcugcuugaguuacuguucagaaaaacuacacuuuguauauuaugagaauuaguggucacuguugagcaaaacuucuagagcuuucuuggcaugccuguugggaagagaauaaaaaugugucaucagaguacaggugacagagugcacccagcgccaugccccaccucccucuuccaguccuuuggcccaccugcggcuccugccugcugucuuucuuccggaucaucugccuggcccaccccacucaccucucuucuuaaaacuuaaaugugaucacaucacugaccugccuacagccuccuuuucccuggggaauaacguucaaaggccucccucugccauucacagcccuguagucuggccucauccugauuucgggggucuuucgaugcuguauagcccugcauccccuccggugugggcccgggcagacgugcacaccuccgcacacgccucuggcucacucaccaccguucaugccucugcugugcuccgugucuguugcuccuuccauguggggcgggguguccuccuucauccccaugauaccccgcaggucagauguccuccuuucugugaagcauucucaggucagaacuaauucugaccaagggacccaaggcaguuauccuggcguuaaaguccugggguguuaaaagggggcucaguguugaaaaggaacucacagguuccuacucacagacucucucaguaggacauugaugacacacugguaccaaccacauccuuaggccuuucucugaggacugaaguucugcuucgcauuugacuuuaucuuuguuguuuuauuucucugagagauuauauguuuccaguauuguagcacaggacuucaccuagaaaaagcaccuacaaaugcuaacuuucuuuugaauaauaagaucauugguguuuuuugcucucuuuagggacaugaauuuuauaauccccagaaaaaaaauuacauuuuccugcguaaugcagccgaagagcuaaagcccaggaauaagaaguaguggcuggagacucuggcucagccagaguuguuucucucc

SEQ ID NO: 18474 - RNA, 24101 nt, Homo sapiens
ggagagaaacaacucuggcugagccagagucuccagccacuacuucuuauuccugggcuuuagcucuucggcugcauuacgcaggaaaauguaauuuuuuuucuggggauuauaaaauucaugucccuaaagagagcaaaaaacaccaaugaucuuauuauucaaaagaaaguuagcauuuguaggugcuuuuucuaggugaaguccugugcuacaauacuggaaacauauaaucucucagagaaauaaaacaacaaagauaaagucaaaugcgaagcagaacuucaguccucagagaaaggccuaaggaugugguugguaccagugugucaucaauguccuacugagagagucugugaguaggaaccugugaguuccuuuucaacacugagcccccuuuuaacaccccaggacuuuaacgccaggauaacugccuugggucccuuggucagaauuaguucugaccugagaaugcuucacagaaaggaggacaucugaccugcgggguaucauggggaugaaggaggacaccccgccccacauggaaggagcaacagacacggagcacagcagaggcaugaacgguggugagugagccagaggcgugugcggaggugugcacgucugcccgggcccacaccggaggggaugcagggcuauacagcaucgaaagacccccgaaaucaggaugaggccagacuacagggcugugaauggcagagggaggccuuugaacguuauuccccagggaaaaggaggcuguaggcaggucagugaugugaucacauuuaaguuuuaagaagagaggugaguggggugggccaggcagaugauccggaagaaagacagcaggcaggagccgcaggugggccaaaggacuggaagagggagguggggcauggcgcugggugcacucugucaccuguacucugaugacacauuuuuauucucuucccaacaggcaugccaagaaagcucuagaaguuuugcucaacagugaccacuaauucucauaauauacaaaguguaguuuuucugaacaguaacucaagcagcaagcuaauaacaucaaucauaugugaucaugacuuugcacuggagauaacuguccuugaacuaagaacaaugaaaaaccccugaagcaaauuucucuuuuaaacuaaaaagaugcuaauuuauguaacccccacaauaagcugacauuaacugcuuaaaugaaugagauuuuacuucaauuuuuaaacagcacucaaagcaauuaccuuucucacugcuuucaauuuacuacauuuuuuaacgcguauaacguauagagucccgcgucauuuaaguuaaaaugcagaauuuugaugcagcugcugggaugaguaugcaaagaggagauucaaugaagagcccgaugugggagcugaggccucgggcuccacgcacgccacagccuguccacccccagccaggcagaaccaaaaaaguacacucuugucacaaaacugagugcauggcuuacacaggugaauggauaaacaaauggcacaccccacccgggaauacuacccagcacugaaaaguaacggacaagugauucacucaacagcaugggugaauuucaaaauccuuaugcugagggaaagaagcuggggcgaggggaaaauguagcguagggcuccacuuauauaaaauucuagaaaauucagacuaguccauaaugccagaaaacagauccaugguuuugugugugcguaagggaagauuacaguaauauacacaaaaaccuuucggggagaugacuauggugauaguuucauggguauuuacagauguugaaacugaucaaauuguacacuuuaaacaaugacuguauuucaauuguaccucaauaaaguugcuuuaaaaaaagaacacagcuucauggcucacacagcaaacccucaaacagggaaacacagaagcagcagcaggccuggaggggucagagggauggaaggcaaucagcuggacuucugugucuaaguucggggccucagggagacucaggugcagccacgcuccugagacugggaaauacuaaagguggagcgggcagggcccgaaccaagggacgucuccagucacuggcuuguguggcagcaggugucuugggaaugcaaagcgcuguuuagagcccugugguggccccccaggcugagauagcggggggccagcaaggcaagaggggcaggagacaggagcuggcaggaggacaggaaccacagcccaaagcagaauaaaccaggacauggccaagaagcagggaggagagcuguauggaacaggaagggacgggugagugaccggcacagacagaaaggaagcuucuggacuggaugaggaggacguggccacagggacucugaguacagcugcaagaggccagaaaguaccuggcaguggacugaggaggggccagagcacagggaaccaagaggguaggugcugacaccacucucucgauagccuuaauauacauggaaaugguuccucgagccuuccaugcuuagacagaggggaggagcugguggacggggacagaagacagugggagaaggcccagaaaagagccaugaggguggaaggagacggggucagcgcaggcagacaugaggugagcgggaaagacacugcaggccacuggaagccccuccuaugugaagcaggugaccuccccaucggaagccagggcaggguagggaaaagucuagaaggcuguugugggcaaagggcagaguggggugggaggagaaugaugaaaaccacaaauacaaugaugacaaccucuccagaagagcugagcaguggagaaacacgcaggcugguugaaagccaacacacuucccaugggguugggcagaguacccgagucuacacauuucaccaucaugcccaaaggccucaaaaaugcagccccacuccugccagcuccuaacucccccugcccaaaccaccagccaaccaagcaaccaacagcacccaggcgaaagcuccaugacccgcccugccacccccuucauaaagugcagcccccggcuugccugugcuucugugcccaggaacagagcagcccguaauggcucacacuggccgagcacuuccugugugcuggguucuggccaaaggcuguacugaauccccacaaccauuugaggaaguccugcaauuuccccuuacagggaggggacggugaccugcccaaggacacacgugaguccugagaagagucacaacucaggccuaggccuucugaacccagagccuggcucugcugccuuggagcacccagagcaggcccgggaguucucaccuuugaccagucguagcuggaagcguaugcaaauauguuuccauugugauugaaacagcaagcugagaugggcugaucuaacuguuccgaaguuuuuaguuuuguucuggcaucuuugucccagaagcugaaucuaccaucagaucccacaguugcaagggugccaugaacaggauggaacgcgauuccauuuaccugcaaggauugacaugcacaaugagaagccaggcagaggggcgcagagaagguuccacccacgcacacuuccugcuugaguuaggaaacaaagcgcacagguacauuuccuuccagcugcugcccgcugauagcaagagaaacuauccaggcuuccuccaucaaaugccagcccagaacccaaucuugccuccugugagggcugcacaccagagaaagugagcauguggacagcaagaaacaaggagcagaccucaggaaaauguuucuuuugagcaaacagauuucucagucugagcugugggugugaacugucuaccagcgcuccugagggagggagaagacucucggcaaaacauccuaagcuuauguucagaaacaaauacacaacacugcuaguuaggcggcacguuaacacagaaaacaaggccaagugcgguggcucacgccuguaaucccagcacuuugggaggccgaggcgggcaaaucacaaggucaggaguucgagaccagccuggccaauauggugaaacgccgucucuacuaaaaauacaaaaauuagcugggcgccuguagucccaacuacuugggaggcugaggcaggagaaucgcuugaacccaggaggcggagguugcagugaggugauaucacgccacugcacuccagccugggcgacagagcgacuccgucucaaaaacaacaacaaaaauccacagaaaccugaagccuacagcauaagccacuuaucuccggacaugaacacacaagcucuucagugaugagucuuuucugaucccacaauuccucagccaccuccaagucugguuuccagauguauuaccacgguuaaagugucuaaaaacguaccgcauaaauguccugaggagcugaaguguugguuccauuagaucgaugacauuuaaaggugaaguuaucuuuggcgcugaaagacaaagguucauguaagucuuccuuuguuaaaaaaaguccagugaaaucugcaagcugacagagucacacuuacggguucgggggguugauauagugaauagcaacucuccccucgauacuucccagggcaaaaccaguaggcuuguucuguuugucuuuaaaaauagccacacaccgaugcuacaguuaaaauaaaaaagagacauaaucacagcauaauauaagauuucaugacuaacgugaagguaagucauuuuuaccccauguuuagguuuuagaagaaccagaaaaaaucacucaaauaugauacagcaguaagcauugcuuucuaacuccuuaguaacuccaucuaagcagugaguuuaugacccaacugcacacccugugcuccucccccgcccccgcugcucgcucucccucugccacccugcaaggccgcguucacgccagcagagccccaugggcugcgaggcagacagcggcccugccuguggggaauggagacgucccuggcuaggcagacaccccucaggaggucacccgaagcuucugcgcuucugccuccccagcuggaggagggaugcaggcucugccgcacccgucucacaggguaacagggugaaggggacggugggugcaguggccaugcuacagacaagcaacacgcugcacuucgcccaguguugagugugagggcccaagggcaggucucuauucuacagaagaacccagaaauuccacuacccagccuccugggcagaaaagccgaccaccccgaggagaagccaacuuuggaguuaccacuuccuccuuccagucguggcaaccuggccaaagcuuggagggccauccacccugccuaagcuggucaucugagcuuccgugugaguucaggggaagccuggcaggacccaggcaggggccaggcaagacgaagggagaagcagccucuggcaucgugacagcugcuggugaugcacguuuccuaaguacgaaggaaaacggccuccucuuucauuccuguacuguuugcuccccugccuuuuuaaaaacugccagaccauuacuuuugugaguacgaagaaaaaaaguaaagcaaacugacaaacaucuguaaguucuuagaugacagaaaaggccauggcuggucaucagcacagggucuacugugcggcacaccaggaacugcacaaugccaggggugucacuugcaccaagagccacaugcacuggcccugugcaaaggccgauggcaaucaguucucaacaacggagaggccagggcgcuagcaccggguggcaggaagugaagccagaugggaccagguuuuuuuuggauucaaccaaaaggaaauggggaggcagggaagggcuuaggcugggguccggcaaggccaguggugccgcuuacaagagccccugccucagcuccggaggacgccuugaaccagggccaaggucuaagugcugauuuuacugugguaagaagagugaacaugagagccaccgcuuaacacauuucuaagucuacauuauuguugacuacagguaccauguaguacggcauaucucuagaacauucucaucuuguuuaaugaaauuucaucccauugauuaaguagcuccccauuucccucucccccaauccccugaugaccgccauuccacccuuuacuucugugagucuaugcuggauaucacauuuaaguggaaccaugcaguuucuuucugugucuggcuuauuucauuuugcauaaucuccuucauggucacccacguugucacgaauggcaggauuuccuucuuucaggcugcacgcacagcauccuacugcagguauacacuucauuuucuuuaucuguucacuuggcuauugugaacagugcugcaaggaacacuagcaguacaggucucucuucaaaauacccauuuugauucuuuugaaucaagaccuguaaguggaacugcuagaucguauggugauucuguuuuucauguuuugaggccuccaguuuucuguaacgguuguggcauuuugcauccccccaacagugcacaaggguuccauguuccccacacccuccccagcgcuuguuaucuuugggcuuucugguaacaguggucccaucagcuaggagaugguaucucacugugguuuuuguuugccuuuccuugauaguuaggauguuaagcacauuuccauacaccugcuggguauuuguaugucuucuuuggagacaugucuauucaagucuuugguccauuuuucacgucaccaguuuucucacuauugaguugcagggguuccuuacguauuuuggaaaucaaucccuugucagaaauagccuccagauguuuucucccauuccacaggcugccuuuucacucuuuuccaugguucccucugcugugcaagagcuguuaguuuaacacaguuccacuuggccauuuuugcuuuuguugccugugcuuuuuggugucauauccaagaaauuacugccaagaccaaugucauagaguucugaucuaagugcuuuccaagauuugaauuagaugugguggcaggagggagggagaaaaaugaacagauucccaaauaauuucaggguagaggggaggagacugaggauuagugagacaggagagggaaaguuccaaucaggggugaccucaagauuucuggcuauaacaaaggagauggaggucccauugaaugggcugugaagcacaucaggagcaacaggcuggugguggccgagaggggcagguucagaucaaauguucacucugcaaauauucacagagcaccuuuuacacuuaaggcccuccuccaagugcugggaggcagcaacaaauacaaacaaaaaucucugcucucauggaguuuacauucuaguaggcaaaagaagggaaauauuuaguauguauaugacauccauacauacguauaaaguagaugguacugguggcaguagcaagggagaauccugaggcaaggguaacaugugaauaaagagcuacagaauguagucuuggguuuggugugggauaccguagcuucagacgccugggagacacaccaaggagcuguccgacuggguguccaugucaggagcacaggaaugagguacgagucuccaguccacagggcguggcugagcgacaguggaugggagaucaguugugcuuggguggaggaggcagcggcuuagggagaugucuguggaaccuccacauucagccaagagccagcaaggauagaagagccacagagguagcggguaagaggcuggcaagacagcagccaggggaaauguuucuuguaagaacagugaaugaagcucuguuccaguaagaggauggguguccaggguccccuggaauuaccaaugaggaugccacugguagucacgccaaaaacaguucugguggaacaauggggggcaaaggucucacugaguuagaaaugagugggaggugagggaauaaaggacauuucauccaagaugccccacugcggaaggaauagggacgcgggcaguacuggaggaggauguggggaucaagggagguguguuuucuaggaucaacuagacuugagcuagugucagugcuaagggagaaguacuacgcggcaggagagacggguguaugggaaagaggugauacucugcauacgguuccugagaaggcuggagggcaugggucccaccacaaaacuggccuuagcaggacggcuuccaccucaugggggaaaaggcaggggaggaggcaagcacgggcagauuucuagaucuggcaggagaaagaggaggaaguucccauuagcuucuuuuuucucugagcaagagcugaucugauuggcugagacaaagacuaaaggaaggagaagcugacaagagugcaggcccagcagcccuguggcaaguggaggauugagcuaaggugaaaaagcuagcaagcaucuaggcaugaugcagacagaguugaaguuggaagcuaggaauuuacaauggaaccaacccauccagauguguaauuuuauucucaaggaaaccaaaauauuuugccccaaaauagacuucucugacauauuucaagauggcuauacagaagggcuggaaauaauagcugaaaagcuaucuuugguggggagaucugcaucugcagagaaaaucggcauugaugcagccaggcuuucuccaaggcccuucccuuguccugauuagggaagauuaacugcagucugaugccguuaaaggucucaguucucuccgagggugcuaccugugggguuuccuccacauuaacaagaccaccuuugcuacacagaccucuucuucucuucuucccauaaccugucuugccacgagaacccaauuuaccaugaaagccuguuuugggccaugcccugagcccccuucuuucugugaccucaagaugguaugaaagcaucaaccauauugccuuuaagaucguuguaagacgcugugcacaucaauacauuuguaugccauuucuccuauuaaucugucuuuuaccagcuacuuuucagugaaccccuucagagggcaaaggagaaguuuucccuuggccccuacaauucaguagcacucagccauccaggggcauguuuggagaagacauaaauucaguucauccagggauaccuuaguauuacuuaauauucacucacuaaguauuuguguuuauauccuucaauucaccccucuuugaacauacuuacagguuuuacaaaguacaacuguauuccagaugugagcacaaucuugcauacaacaggugcuaaauacauacuucuugauuugacuaaugacgcaccugauguuucaguggagauucuauccuccugaauucagaagguugauucucuagcugauagacaaucaggccccucucugcaguugccaccacagccaugggguauaucuagggaauggaagaaaacagagaugcgcuucaggugaaggagugugcuguuuuuauacuaauguauuugaucaauuuuugguuacaacauuaagucuggauuuuaauaauccugggauuauauuucacuaaaaccuagagaaauaguauuugaaaguagaacauucauauauuuuaaaaagucucguguuuuaaaacuaacuauaaaauauguggauauuuagaaaauauacucaggaacuaagaauaaauaaaaauccccuacaccacuccuucaguugcugucacuauuccagccuuuguucucagcguuauacuugguauguagcauauuucuguacaguucauauccuuuacucaaaacauguuucauaagguccacgucacacacuuuuucaaguacuagcaguggcuucuaacguccccucaaaugaaccuaccacaggguuuauuuaucugugucuugguggccccuuaggccacuuccaauguuucacuauauuacauaaaacaaagaccagccgggcaugguggcucacgccuguaaucccagcacuuugggaggccgaggcagguggaucaugaggucaaaagaucgagaccauccuggccuacaugugaaaccccgucucuacuaaaaguauaaaaauuagcugggccugguggcacacaccuguagucccaguuaacgggaggcugaagcaggagaaucgcuugaacccggaaggcagagguugcagugagcugagaucaugccacugcacuccagccuggcgacagagcaagacuccaucucaaaaaccaaacaaacaaaaaaaacaaagaccaucuguaucuaugauuauuuucuugugauaaauuccuaaaaguggaauuacgggauuguugguacaaaacuuuaagaugugacuaaacaaauggagaaaguuccauuucuuuuucuuuccuuuuuuuuuuuuuuuuuugagauaguaucucacucuaucaccaaggcugaagugcaacagcgugaucucagcucacuucaaccucuacuugcuggguucaagcaauucucaugcgucagccucccgaauagcuaggauuacagacgugcgccaccaugcccagcuaauuuuuguauuuuuagagaugggguuucaccauguuggccaggguggucucgaacuccugaccucaagcaauccacccaccuuugccucccaaagugcuaggauuauaggcgugagcuaccaugccuggccgagaaaguucaauuucuaucccacucagaaacaguccccaaagaccugguaccaccucacaaacuuacugcaaguuuuccuacugccauggaaaggacaugauagaugucacacuagagauggcauguagcuagcugcauauguucaaacgaguggcaggaaaacuugacauccagcauuuaguacuucuaaaagaaacgcagcacaaaaaucucccaauuggagacgacugaggcaaucucaacucgauccuuuauaucuauuacuaaagcuagcaggauuuuuauauuauccacucacuaacugcaggacgccacaaggugagaauacuuauuuuguuuuuuuuuuaaaguaaauacauauuaaguugaaaucccuuaccacgucagcacaguaacaccuuucagggaguugcaaaaccaucauaggauuugacgaucgaguaucccaaaacuaaaagcaaaaaagagaagccaguaugugaccauucagagcagaagucgaaauggugcaaaaauaaaugacaauccugauggggccaaacaaugccucaacugcacauuauaccuuuaaagucuuaucccagcucccagucaucacacagcuguaguuuggagcuuugauccaauggaugguuuuaacaggagcaucaugcuuucaacaagacaaaaacaaaacagaucaagguaaauguaagaaugugcugaacagcuuuaguuguggcaauucaaagggaagaaacuaauuuaaauacuggggccauaccaaacaaaaaccaaaacauacuuagcauuuuaccaauccuuccucacugacagaguuugcauguccccaccaaaucccauguugagauguaauccccaguguugaagguggggccuggugggagaugucugggucaugggggcggaucccuccuguguuagcacaguccucacaauagugaguucucugagaucuggcuguuguaaaguauggcaccuccucucucccauagcucucuuuccugcuuuugccaugugaugugccugcuccaucuccugcucccuugggauuccccagaagccgagcagaugccggcaccauacucauacaaccugcagaacaugagcaaacuaaauuucuuuucucuauaaauuacccagucucagguauuucuuuauagcaaugcaggaagggacuaauacacccauaaucaaaacagucaauuuaacacaaaaacauauaucuaccuuccauucuagcaaacuuuaauuuuuuuacucauaauuaagacauaugugcgagugaaaguaagcuccuccuuagggagauauucagaaauaacaagcaggggauuccaccacaguuuuacucacugaggugaugggaauuaagagaucaaugagauguuucuagcacacagcacugugaccugaguaugcagugccuuccugaaaauguuucagcacugugcucuuccugaagcccccuuagcaggcuggacccucugguucuaaguucucuuaucuucauuacuucugcccuuggcauucuucacacaguaccugccaguggucccugaguaacgguaaaaguuccacacguguggggaaaugccccucuuacucgcugcucuauuacuggcccauagacagaacacuugcugaaugaguaagugaccaaaugcaguugguagaagaccagccaugcacgaggucacaacguccaaccugugaauggcaaggaccaccuaugaccugucuuucauagauuuuaaugucacuaacuccuuaugacuccauccauacauauaugaagauccaugacaagacaaucugugaacacuaguuaagaaugagaaugguuauaaaauuguuauuuuugugcuaaagagguuucuguuauauugucuaauugauuugacagagucuaacugcacguuuucuuauuauaauuauaauaauuauuucacuuaaagagccaucacaguccuggguaccaguugugccuagccuuucugcagaggcuucuguuaccugugcgaucuguaucgcuugguuacugcugaggucccacauuuuggcaguuuuaucacacgaugccguaaacacuuugcucccauccuaaaauaaaauggagaaaauuuugcauuuuaagaaaaauuaaaucuuuaacuauauauauauuuagauacuacguugaacauauugaggcaaacuuuggcaaucuuuauuuuuccaauuguuuggggaccaguguacugcaaacuacagcaucauacaaaaaauucauuuucaucuauuucaugauugacuuacuuuucuaagcgagaacauauaaacaggauuuuaaaaaucagaaaucacaaacuagugaaaacaaacucuuucucuugucccugaucccaggucuccucucagcagcaaccauggaccacuuuaaaauuuuuuucuuauuuugauaaaauuuaagccuucagaaaaguugcaaaaauacaaaaaauacccauaagcacuucacauagauucaucaauuguaaacauucugucacauuuaucuuucucucuauauacaaaacacauaacuauaaucuuaauuacuuuuauucggucccuaucuaauaacacuuccaaguacaugcaauaaagcuaugccaauuuacaacagucauugguccuaucuaacuugucaaauagauuuaaaaauuaguggucacugugugaugguuucacaauauucacacagagaacucaaaguaggucuucucugucacugcagcuugaaagcacccagacauauuaugucaaugaguguggcugcauuucaauaaaacuuuauuuacaaaaauagacaaugggucagguuugacucaugggccauaguuugcugaaccuuggccuagucuauauuucauuuuugguuccagagcucaaaaauugaccaccauucuccucuagcaaaaacuuguuccauugaagugacuucauuugaaagaagagauaaaacuugcuccucaugcuuuuaaugagguuguaauucuacaaauccuugaaaacacagcaaaggaaagguaugaguguauggagagggcugcccugaguccaagugaacacuggccucucaaucucauaaugccagccccaccacgucaucagcauuguggagcagagcaugccaaccucaguggacacgugcagacauaaaggagaauccagcaaaacacuggggagagaaagaguaugugugaaugcuccaccagcugcucuaagucuaccugcuucaacugcagaguuugaaccauguccuuaaaguacugaagauucaacuuuaccaaguuuggcuuuuaugccuccaagguaacuuugggucuuuagcgccccugugccuuuaccuacaugucuuucucucccggguagcuccgacucuuccuguaaagcuccaugagggaggcugcuaagcacaugggcuccaucaccaggaaggucugggccuaggcucagccagucacuuuuguucucacaggcaagcuccuuaaccacuuugugacagcacugugcuaauccuuccguguagguuuaaucuagucaucacaauuuuccacuaucgagaaguuguauuuguucuucuuguuuguccuaagagaucaugaguuucagaaguguagguuuugccuacuuugauuuccacuuuaucuccaggauuuagcauacaauaggugccugacaauuauuugcugaauuaauaauguuauuauguguuauuaccuucauuuuauuauuuacuuuauuauuguuauuuauuauuuuuuuagagacacggucuugcucuauugcucagcuuggagugcaauggugcaaucauagcucacuguacucuccaguuccuggacucaaggauucuucccaccucagucuccugaguagcuaggacuauagggaugugccaucacacucagauaauuuuuuuuauuuuuugagacaggguuguugccaggcuggaaugcaguggugucaucauggaucacugcagccucagucuccugggaucaagugauccuccugccucagucucccaaguagcugggacuacaggugugcgccaccaaacccggcuaauuuuucuauuuuuuguagagaccgggucuccuuacguugcccaggcuggucucaaacuccugaccucaagcuauccuucaucccaagccucccaaagugccacugcacccagccuaccuucauuuucuaaacaagaaaacaaauuuagaaagauuaaacaacuuggcaaagucaaaagccuggaagagacagagcugaaauuugaacccaggccucaauuggaugagacaaugcuuaaaaagcuauaggcaaaugguuuacuuuucaagaaucagcucugcuggccaggcgugguggcucaugccuauaaucccagaacuuggggaggccaaggcggguggaucacuuugagcucagcaguuugugaucagucucggcaacauggcgaaaccccaucucuacuaaaaauacaaaaauuagcugggugugguggugggcgccuguaaccccagcuacuugggaggcugaggcaggagaaucacuuagaacccaggagguggagguugcagugagcugagaucgcaccacugcacuccugggcuacagagcaacacucaaaaacaaacaaacaaacaaaaauuuaccucuauucuugucuucuguaaagcauucacagaagccuuuccaaacuuuacagcugcuuucuguauuguuuuucccacccagcaccaguucauccugccuccccgucagaacguacaacucucauuccugugucugauccucccacuagaugcuaugaaacuuagauuccguuuuauaaauuccaauagccauuagauaacauuugagcaaaaggauuccugcauuaguuaauucuauuucuugccguacuuuauaagaaacuuucuaauucugacccguugcccgaucaguaaagacagacaaaauacauuagaaauguuucaaaucuacucaugcugcuacuuuucuguguguaaacuaaaaauaaguugcauaugaaaugaaugcuucacuuuucaaacuuuucauauaucuauuaauguagugucacaauaacuuaaucagguaugucaggaagacauuuuacaggugauaaaaaugccucagagaagcugauccuugcuacugaauaaaaugggagcaacuguggccccuaaacuaugucaaaauguuuauacacagaauuauuucuuauauauaagcuaaauaagaucacauuaaagcagcgguccccaaccuuuguggcaccagggaccaguuucauggaagacaauuuuuccagacuggggugaagugaggguaugguuucaggauaaagcuguuccaucucagaucaucaggcauuagauucucauaaggaagacacaaccuagaucccucacgugugcacuucacaacaggguucgagcuccugugacaaucuaaugccgccgcugaucugacaggaggcggagcucaggcaguaaggcucacuggcccaccauucaccuccugcugugcagcuuaguuccuaacaggccauggaccuguucugguccacagccuggggguuggggaccccugcauuaacguauggccauaaaauuaagauugcccauagguucccuuuaaauaagacaucuugauggauuaaucacuaccacccuauuagccagucacgggagcacugucaugcauuugguauuuuuuaacuuugggaugcugugacucagcauggcaacagccugacuccugccaaauccauuguagcugaacuuauacugaauauuccggacugacauaacaaccauaagguguuaauucaugguugaaggacuuaacaauuaaucaauagaugcucacgcaugcacguaugcucaauuucaagaacuauuuccgaauaaauccgcaaacuccccccuccuaaucugacuuuaccaucaaccuagguaaacauaccuuugccaaaccccaaacacaagaaacuaaaaugcaacccagucagagcccagacauauuuuaaccacgaacaccccaacagcuaccccucgauugauguaauuuucuaaaaaaucuuaaggcuccuccuacccaauaaauccuccacuauguauaauagauuaacuaaacuucugcccuaauacugauaugauaccuugagcauaacccucugaaagugcugccccaguacaccauaacccuaaaucaaccauacucuaauuaugaauaacccucucagccaaaccucugccaauccaacuuuaaagacccugaauuuccagaacuguaagcaacuauuucuauuucuuucuuucuuucuuucuuucuuucucauacuuuaauuuuccacuuaaguauucuacacaguuaauguagcuuaaccacucaaagcaagacacugaaaaugucuagauggguccacaaaaccuuauagauagguuugguccugaccuuuuuauuaguucuuuguaagauuacacaugcaaacaccccuaccccagugaaaauguccucuagaucacccggaucaaaaggagcagguaucaagcaugcacaaaugcagcucaaaacacuuugcucaaccacacccccacaggaaacagcaguguuaaaucuaguaauaaacagaaguuuaacuaagcuauacuaauauuuaggguugguuaauuucgugcccgccaccauggccauacaguuaacccaagcuaauagaacuuggcguaaagagugcuaagcuccaucuaaguuguaaaaaacuccaguugaaauaaaacauacuacgaaaguagcuuuaauacccugaagacacaguagcuaagacaagaacugggauuagauaccccucuaugcuuagcccuaaacccuaacaguuacauuaacaaaaccauucgccagaguacuacaagcaacaauuuaaaacucaaaggacuugguggugcuuuauaucccucuagaggagccuguucuauaaucaauaaaccccgauacgucucaccaccucuugccccuggccuauaugcccaucugcagcaaacccuaaaaagguuauagaguaagcacaaguauacacauaaaaacguuaggucaagguguagcccaugagguggcaagaaaugggcaacauuuucuauguccagaaaaucucaugacagccuuaugaaaucuaagggcuuaaggaggauuuagcaguaaaccaagagcagagugcuugguugaauaaggccaugaagcacgcacacacagcccaucaccuuccucgaauacuacucuagaaaucacuauuacugauaauuuucuacacagguauagaggagauaaauuguaacaugguaagcauacuggaaagugcgcuuggauaaaccaaaguguagcuuaacccaaagcauccggcuuacauccagaagauuucaucaugaccugaccacucagacaacucuagccccaaaccucgcuaaaaauauuaucaaacuaucuuaaucaaaccauuuaccuuaaacaaaaguauaggcgauagaaauuucuacccugguagauauuucuggcaauagacacaguacuguaagggaaggaugaaagaacuguauugaggacuaaaaagcaaagacaagcccuuauaccuucugcauaaugcauuaacuagaaauaacuuuacauagaacuauggccaagucccccgaaaccagacgagcuacccaagaauagcugaaagagcacacucaccuauguggcaaaacagugggaagauucaugaguagcggugacacgccuaccgagccuggugauagcuggcuggcuuaguucaacuuucaacuuacccacagaauuacuuaaacucccuguaaguuuaacuguuagucuagagagacagacagcucuuuagacccuuccuacagagaguaaaaaacauuaccaccacaguuggcccaaaagcagccacuaauuaagaaagcauuuaagcucaauaucuaacuaucuuaaauucuaaccagucuacugaacuccuaacaucacauuggacuaaucuauuacuuaauagaagcaguaauguuaauguaaguaagaugaagacauucuccauugcauaagcuuacaucagacgggaguaacccacugacaguuaacaucccaauauuaauaaaugauauaauaaacaccguauuauuugcacuguuaacccaacacaggcaugcucuaaggaaacauuacaaaaaaauaaaaggaacucagcaaaucuuaccccgccuguuuaccaaaaacaucaccucuagcauuaccaguauuagaggcacuaucugcccagugacauauauucaacagcugugguauccugaccgugcgaagguagcauaaucacuuguucucuaaauagggacuugaaugaauggccacacgaagguucagcugucucuuacuuucaaccagugaaauugaucuauccgugaagaggcggauauaaacaaauaagacgagaaaaccuuauggagcuuuaauucaucaaugcaaauaaaaacuccaacaagccuacaggcccuagccuccuaucccugcauuaaaaauuuugguuggggugaccucggagcauaauucaaccuccuaacaaccuaagaccacacaagucuaagugaguuauuacacaucgacccaauaauuugauaaacggaguaaguuacccuagggauaacagcgcaauccuauacuagaguccauaucgacaauagaguuuacgaccucgauguuggaucaggacauccuaaugguguagccgcuauuaagaguuuguuuguucaaugauuaaaguccuaugugaucucaguucagaccagaguaauccaggucgguuucuaccuacuuaacauuccuccuacuacgaaaggacaagagaaauagggcccacuucauaaagugcccucacuccauagaugaugccaucccagucucuuaaaucaucacacauccuacccaagaacaggguuuguuaagauggcagagcccagcgauugcauaaaacuuaacacuuuauaaucagagguucaacuccucuucuuaacaacaugccuguaauuaaccuccuccugcucauuauccccacucuuaucgcgauagcguuccuuacacucaucgaaugaaaaaucuuaggcuauauacaacuaugcaaaggacucaacauuguagguccuuacagacugcuugaaccauuuuuugaugcaauaaaacuuuucaccaaagaacccucgcggcccuuaacaucuacuaucacccuuuauauuauugcuccaauccuagcccucucuaucgcucuccucuuaugaaccccccucccuauaccagauccucuaauuuuaauguaggccuccuauuuaaacuagccacaucaagccuagccgucuaucuauucuaugaucaggaugagcaucuaauucaaaauaugcacuaaucagcgcacuaugagcuguggcccacacgauuucauaugaagucacccuagcuauuauccagcuaucaguucuacugauaagcagcucauuuaacuuacacauacucaucacaagaauuccucugacugcuccuaucaucauggccccuagccauaauaugauuuauccccacacuagcagaaacuaacugagccucuuuugaucuaacaaaaggagagucagaguuagucucaggcuucaacaucgaauaugccgcaggcucauuugcccccuucuuuauagcagaauacaugaauauuaucauaauaaaugcccuaacuacuacuauuuuccuaggagcacuacacacuguauauuuaccagaacucuauaccacaaauuuaauuaccaagacccuucuaaaccacucucuucuuacaaauucgaauggcauaaccccaauaccgcuaagaccaacucguacaucuuuuaugagaaaacuccuaccacuuacauuagcauuuugcagaugcuauaucucaaugcuuguccuaauuuccagcaucccaccccaaacauaggaaauauaucugacaaaacaaucaccauacguuaaugcaacaugcugagcgcaaagguugcacccuauaggauuuauuuagaugauacucuuguaaaagcaaaacuauagggacaaaaaaaacagaugaguaguuuccaggggcugcgagcugggaaggauuugacgacaaaaggaaggaagagaauuuggaggccgauggaucuguucuauaucuagaacacaacucuaugcauuucuuaacacucacagagcuguauaccaaaaagguucaguuuuacagcaggcaaaucagacucaauaaaccugacuaaaggaacagguacaaggccucggaaggggccucaaggcuuagcuucuucagcacugcagugugucugccugucaccaggccccuuaacauucucacuacuguuggguucagccaccagcagcaauggcaggagaagggaggagagaggcugggguguucaaccccuggcuccccucgccaggccgaggcccgucuacagcuguucauccccuggcucucccgcgccagguggaagccccucuacagcugcagcucaugcugugcuccaggaggcccgcccacugcagcuuggcaccgguguuucaccuucccugcuggcuucuucauaaauuaucccuuaaucauuaaacucuccucaaucacacacacaaaauuuaauacaagaaaagcuuucaaagaaaguggcuaacuaaagccaacauuaagaacaucaauaaaugacuauauuuauguucagaaacuuagaauuccuacaauaugaacacauauaugcuauuuguguuuggauuauuaaauauucuaaaucauucuguacuuuaaguaaaauggaacacgagaaauggaagggaacguacgucacuccagcagacaucaagcacaggcccagugugcaucugcugggcuuuuggaauggucuguccacugucuugaacuucccagcagcgaaccuguaguaacaaaaaaauucaaugcaaacaaagcaauuacgauguauugcuugcauuuaacaccuaaaaacuaaugggguacaccuuaaccauacauagacuucucauagcaaccuaauuaucuaacuucaagaacaaaggaauuaaaauaucuaugaaagcaacuguuuucuucgccuaagcuauuaaaauaaacaaauucuauugcuuacacauaaaauugcagauaauuuucucaaugcaucuaugagauaugucuuuuaaaguagaauaucacuuacccauuaccauucagagaaucaagaccaaaguagaaacuuaccucuuuucugaauacuuuauauaaucuccccuccguuaaaaaaguaauacauuuuagagauuuuguaaauauggcaaaaaaauaaaaaucacccuaaucacaccacagacaaccacagcuaaugguucugugugcucuuagucuucuuuccauguacgcauauuuucuggaagacacuagauuauacagugucuucacuuuugcagcuacagcuuuccucaccugcaucacuagccuguucaacuugaaacauccuuuuuuuaagcagcaaauaaucugaaaucuuucuaaaaauuacauguagaaagcaagcuugcucaaccuugacuaccauccucccuccuguucuccuaaccccugcugccccugugcuguaggcuacaguucaaaagcuuuuccaaaaacuuacaaugguauuccaucauacaaacauacuauacauugccauuacuacuggauauuaaaauuuucaaaauuuucacaaguucacagugcuuuggcuguuauaaagguuaauuuagauaaugcagaugaaguacauuaucagauuuccuacucaagucccagaaggguaucagugagauaaaggguauaagcugaaggauuuuugauaacuauugccaauuauccuguggaaaagccaacuuacauaccuaccagccauacaugcaggguuucagcuuauccuugcuggcacuauuauucuuuuaaacuuuuaauuuuguuaauuuaauaaaaaaaagucuuaaauuugcauuuaucugauuacaagcauggaugaaugguucagguuuauucuuucuuuugugaagucccucuuuacacccuuugcuuauuuuucuaccagaguuuucuuucuuuuaguaaacuguaauuuuuuugucuuucuuuuuguacaugaugaguaaguaucuaggcaaaucugugcuauuauuuaacguugaaaaaguuucauacaugccugaggaacacugucaggaugccaagaaagggaauuuguuggugugugccacuggguauaauguucacucuggaugaauaugauauuugauuugggaauaaacuucaagagacugaacuaaaguagaaaauuucgagcaacacauaugauugugcuuuccuaacaaaaacggguguaagaauaaugucugccauucagaaggguucacacccccuaaauugauuucucaaaaaaggccauaaauaaguccaacugauucauuuacuugggaaacaacggagcuaaagcuaaccuuggccauacaaagagagaugauuucuagaacacguauuuaaggagcacuuacaucauuagcccaugauccugcaauaagaaaguuccccggcaagguuggugggcuaaaagacagacaaccaaugcuaucaucaggagaugauguuacuucaauauccugcgggaaaaaagucaauguuaaaauguaugcacgcucacaacuucauuccaaauuguuuucuuucucacuaauuaccucacgguggccuuuccuuguguacaagaacuaacugaauuagaccuuuccuuacuuugaucaaagacaggaguaaaaaauaagcuagagaaaguaccagcaccaccaggacuagcaguagcagcugcuaaugaaaugcccauggucuuguuuucuaaaugaccaguucacucuggccccacagugcuagaucacaguuuucaccugccauccccucucuccaaccaugggaauucugagucaacaguccuggcugggccaggcccugggaaucugcaccggaaucugcaccuugggugauucuggagaccuggcaggccaggaagaacaggacacaaguacggggacacauuuucugugcuccaguguuucagaaacaugaguuagacaaaguuucaaagcuuucagccuaaaggaggcucccaagucaucucggguucuguccuugaugggagaaacucugcccaaacucuuccuacaagccccaggaagcuuuucgugguaccuucaugggauugugauugucuguaguugcacugccaaacaugcuggucccacugguuccaaaaccugagguuguuccaaacaggcucauu

SEQ ID NO: 18475 - RNA, 1590 nt, Homo sapiens
uggcggcgaaaggcgcuuccucagcccgcgcgggagacccagaaguaguacugagguagcgcucguccucccgccgguccaccaccaccgaguguagcccgggcccggccuauuucaucagacacaaccccagagccgggagccaccccuaccccgggagcccuucgccaagcacgcagcuccagaccagaagcagucgcuccgacccagagcuccgggugggguaaagagauugcuuuuacucaccgccuccgagauugccucgggauucgcgaaagcccccgaagggaagcgagcacuuucugaggcugugaaaggacggcugcucgcuuuucucuuucgcccuuuucccucaccagagugccaaauccucggugggaaagccgaccccuccggacagcccgcgcuuuaaggccgggggcugccggccgggcucggaggcggccggacccgccccgcccgggagcccgcgcgacgucacgcgggaguuccacuugcgucacgccccuuccuccagcugcccaucgcggcggcgcacuucgugcccuagcugaggagcgggcucuucggugcggcccaucccggagggcgaugguuggggaggggagcgcuaccucggagcugccgggagcuacccgaagagucuggcgaccgccacagcauuucugaauugcgcuggggaaagcucaagccguucuguugggggagcaucaagcccuugcgguucugugaaaguuaucuguacacugugucuagcuuaagcauuuugcagggaagcauguguagagugaccuguaccgaaugaagaguuaaaauuaacugaugggggguauggacgcggauccgucuaacauaguuuucggccuugucgcuguuaucugcaguuuagugaugugaccugacaggguugugcgguaacgccauagaucaaaacgaucuguauuuugcugagguuaaacgggaaguuucuggcaaauuugaaacgagaaggaaucuccuucagcauuauuuauugggacaacaugcuguuagauaauuuuuuuuaaaaaguccauuuuucuuguggcuguucguuugagauucaaaccgauaguagguauuccuauuucuccugauuuguaaaagaaucguuuuuagaccacuagaaauucuacaaaugaacaaaauagacuagaaucaaauaucuuuuaaaccaguccaguacuuuuguguaauuauucuaagaccugggaagggauaauauuaacaggcuuuaaaaguuuaguacuuagaaaucauaaauacaaaguggaaagguaauuuuuccaccugucccacaucuuaagggaugaauaaauauaacuuaaaaaguuaguauacagaagaggggugcuaaaccuucuauuagccuguuacagcaacuaucauucacuuccccauuuuauaagacuuaacuccacauuuuuaaaagaaaauggaugaaauuuugacuauguaauuuuuaacgcaagauaggaaacauaauugacagagugaagcuuuuauguuuaugacagaaauaaccuguaauaaguuugucauuuaacagaguauugaaagagcagugugcug

SEQ ID NO: 18476 - RNA, 1316 nt, Homo sapiens
ucacuuggccagugaaaaacaagaucgugcuuguuuccccuccaguaucaucaggguguguaagccaguccugcucaaauacaugcuacggugauacagaaaguacgcugaagaaauagagagcccuaaccacucaagguggccuuugggagauccagccgcccuccgccccucuuuccgcucccuccauccccaucccggcacccccgcggccagugcccccuugccgagguccgcggggucccgccccagaacuucccgaaucgcccacgaagccgcccucuccgagcuuuccgagagauccagcccgugugaccaaggcuaguacuccagucucgucugccacuuaccuugcuggguccccaggccgcugccgucccgggcucaggcgaugccacuccuaccagauccauucgggaaugaaggcagagacaagaacagagcagagagguggcaggacgggcagcaggcuccgccgaggagacaggcgggacacgggcgacuggcugcugaugccggaguggaggugacagauggcggcgacggcggcggccgcguccggaacuggaucucuccucuuccgcccucuucgcuaggacagucgcuugcaauuggccgcacgccccuagcuccuccuuaaggcaccuuuccccgcccccgggcgggcuacuuccggcugcugaccgccgggcucggagaagcaagcaucagcuggcugucgcuuggggucacguugccugugucgggcagggcagggcaagaacuggguguggcuuccuuuggcccaggcucugcccuguccccgcacugccaucuccuucuuuccuccuuggcaccccaaaaauugccgcuggaucuaaacuagauuagacuaguggauuguaaauaaauaaacaaacuaggcucucucuguucauucauuauuuccuggagcaguucuaaacugggaugacuugggagacagaaaacggcagguuuauagagggaaagggccuggaaaggacggucggaguuuguggugguuguuguugaagggcggggcguggaaugcggaaaauguguaaaauguguuacguaacagugaacaaaaauaagacugcauaauaaaacuuuuguuucuguauuuuguagagauucuaauaaaaugaccagauaaaagauaacuaaacauugcauuucacuuaguauaucaaugcacuguucaaaucuuucauuaacuuuuuaguccucaaaauuaccgugagagcuaaauucugucauuaucucuauuuuacugauauugaaacugaggcacagagagguaaaguaauuuaguu

SEQ ID NO: 18477 - RNA, 5661 nt, Homo sapiens
caucuuuaaugauuaaaaguaccugauaaccacauaggaggcaaaaggcacuggucggagagcuccuggggcggggugcaauuuucuaaguaaaaagugaacauccugcugucaucaggcuacaggcuugugcaaucucuaaagaauaacaaauuacaggcagacuagcccagaacuaggccaggaaaucacauuuccauggucagaggcaccaucagguauacuaguauagccgcaaggaaugggacaagagaaaaaauugaacagaaauugccuguaaugugccuaugcucccagauguccaacucaaugcucgcucccucuaugcccugucccaccaccauccagcacuccuccagcacucauccugccucuccaugugugccaagagcaagcgccagacuugguaucuuacuccaucuuuaggguuuacauggaaucuaagacagccaauucccccaagugaaacaggagcuagggacaaacugagacuguaugaggacucaccaucaccagguugaccaaggauacagcguucagacugaugccccagagccacauaacuccaaacauguugaccaagaccauggcgaugguggcacacaugaugacugcagaccagagcucacagcccaggaggaccauggucaccagaaauaucgcgcccagggacacaccgagguugaagauagugucgucaaugauggucagguacuguucguagaagacauaaaacacacuggaggggagaggggaggccucauuaaagcucgcucucacucccgaacacugcguguucauccugucaccacugccaaguggucagacuccuuugggaaacaucccuugcagaaaaccuugcuggcugucuacaagacucaccgaaagcaacucacuugaccucucauggccacugaccacccagagaagggcccagcagugaugcaaaauguauauuuuugauaaaguuucuguuuauaagcccaaucuaugcuauuuuauagacauuuacagagagcauuccacagcauucugaaaaaacacaaaaaaacaaagaauccugaucuauccugagacacuaccucaggcucagcgggguccgugcaaggccugaggaaaacaugcuuucauuuauuuucugccagagcuaaccggcucuuaacuucuuccaaacaaauccaggccuuccugcuuuaagcgagaucauggggaggcaggaaaaauaaaucacuuguuucuccuaccuuucuacaguuucuaaauucaguaguucauacauaauacuuuucuuccugggaaaaaaaaccccuaacaauauaaaaagucuacauacaggcagcaucccaaauaaccagcaguuagggauucugguucauuguuggccaagaaugugggccgggcccugcucugagccgccugcucuccaagcgcccccugccuuaagccauuuuccagugugugucucuugcagcugugcaguggcgcagagaucaaguuuugcgucucuagcccucaggccuucacagagacuuuagauucugaacuccuuugcccagcacccauuuccuuugauauacugcccugugcucagaauggagcaggggccagaacccaaccugaaaaucagcaucuugccaagggaacccuccccacucccacccaguguaggcccuuugcuggguaaaccccauugaaaaagggcaggcuuuaccuguaaggaaauacucgguaggcacugccguuaaugcccaugguuucggugacauuacuggcuauaagucgggcuuucuucagagcgucaauaaagucagcagaggucugcagcacggugugguaggucaugaaguacguggcuccgacccuggugccauggccaaggaggauguuaacugcagaacuauaggcagcauguccccugaggaaagaauccugggugucaagagaguccaggucuugcaaaauaucagcagaaucugagcacuugaggcuaagcaaaaucaccugacccuggacucagaggucagacccagcuguacauuucagggaugaagaaggcccccagauaagggaacaccaaagguuuagcuuguucucucccagacuggcuucuuuuuuuuuuuauuuugagacagagucuugcucuguagcccaggcuggagugcaguggcgugaucucggcucacugcaaccuccaccucccggguucaagcaauucucccugccucagccucccgaauagcugggauuacaggcaccugccaccacgcucaacuaacuuuuguauuuuuuuaguagagacaggguuuugccauguuggccuggcuagucuugaacuccugaggugaucucaggugauccgcccaccucggccuccaaaaguacugggauuacaggugugagccacuucgccuggccagaugggcuuuucucgauugcucuggguucuuugguacauagcugcuguuucuccaccugguuucauguauaaucaaagguacaggguuuacucaguccuguuguguaauaggaagcaggaaagggcaagggcccugggaacaaccucagcccugccacuuacuggucauguaaccccgagcaaaaugaccaccucugagccccagucuccucuucuguaaauggguauaccaccaccuacucauaggcugcgugaugagaaauggaauaaugucagggagugccuggcaugacgcuggcacccuggaggcuccccaggaacgguggcuacugccuucagaaaaacugaaucuacuucaacuuauuuuacguaggccaaagcauccagucagugaguaaaucaagcugcaagauucauuucuacuuaacuuuuaggaggagucaucccaugauaccucgaauaggucucaaagcacaugcaugauauaaaugauucacugauaugacucuggucagauguauguucuuaugaaaaaccuaaguucaggguuuaccuaacauacauggggauacucaucuuccaccucccaaagcuuccaaaucaaggccagagacuuccggucaucaucacuauuuuugggccauauaucuggcuuccguggguaacuggcugccuggcuggaugggggagugagauagcccauaacccuauacauggaugggcuggcaaggagcaugacgaggcuaaaagaaucgcaaccuuaaugugggauaauguuacuaaagcuaagaucacgccccagcugccaucaguacaagugaacaggccaaguuccuucaggccuggauuaccagcaggccguccucucccucagccccgcuuggaaugugcacaggaaucugcguucauucucaugcccagggggccaggacacagagagagcaugagaugugaaugcccacgcuaagacagaaucaguugaacacuaugaggcauuuucuuaaaaagguguuuucgguuuuccugcuuccaccaaaggaccaggacaggguggggcggagaagagacguucccaugcaacugucuuagcccaguccucuccuaguuuucuacugcaaauuaaaguugcaguggaugcuuaucugcaauggcagcagcacuuacccuuugccacacuugggguuaggguuauccgaaaggaacaugggcaggaaucucaugaagucuccccccugaggccucuguuugccuuccggagucagaggccugcagcgaacgcaggcagggucaaccacuggcggagacaugcagggaggacuguuagaagaauaggucuccagauuuuuuguaaaacauuuuaaaauacugacagugaggggcauuacuuucuucucuaucgauuacuuuccuuacuagugagggauaaucuuuccccuuaucuaaaagcuucagccacaugucacuuucacaguuuaaugaaucugaaauaccauuuucaucuuaggcauacuaugcaucauuuucugcccugaaguagaucuccuccuucaaguauggccuugacuggucagagcccggggcuucuauguuuuuauuaagaaaauuccagggcaaccucgacgcuccuacaaaaccacaggguaaagugauaaagaaaagcccuccucugagaagcuaaggccagauaccaauccugagaggcaaucgcuggaguuagaacaggaugagaaaccuuauguggaaaccacacuccgaacauguggaccuuguucagcuugcagccccgaggguggcugucugagccaggaacaacaugacaauuucagaaugaaugacugaggaaaggaaugaugacacagggagacccagcuuugauauacaaauagguauaaacugaggcacgaugcaaaugauuuuuaaaugauaauuugaaaauuuuucagcaaaacaggaaagauuugguaaaggagaagguaccugaagcauugcagaacuggucagugauauuguccacucgacagcaagacgacuguggcuucacccagucgaaauaaucgucgauccaggacgagggggcgaagccuauucggguacuagagaggacagacaggguuacugaccugcuccacagggaggaagucuuuaguuucaguacuuuuucuuaaaaccuaacuuccuuuucuacguuuuauacugcuaacagucaaaagaaaaacuacaugagcacuuaaugaaaaaagccuucaaaguauuaggugguaaauuaguccuuucaaagguuuuuuaagguaaagccagauuuaacauacauuuugcauaaaaacaacuuuuccaagaaagucuauuuucagugagacauuucaggccugagcugacugccuggcugagagccuccuccgcugcuucugaaguacaagacaaggugguacugacuaguuguccagcugcgccgcguuaaauaucugcugcaccagggaaucauuguugcagcccaugccgccgcacaccauguucugccccuuggaagaaguguagucgugcccuuccuccaggacaaaguacacaggcggacccgcaugcagguacugacugauggauuugaaauaauccaccauguaggaguccugaaagaaagauaaaagaauaggagagagugugaacacucugauaguaacuaagcaaggcgaggaucauggagaauaagagggugccaggagguuccuggcugagaugccuccagcuggacucaugauuccuaacaccaccagucuuccccccagggccccagggugcuccuccugcuagccccacaaucaggagagcaucucauaaaguaaccucauaagacuaguuauucguguucugcagcugugcccagaggggcucagucagaaugccagacagcccacaccagcagugcacugcgacaguucuccuaacccuggaaacccugucaccauuugcaguuagaagcaggcacuugcuugaaacaccuacgugcauguuuugaaaaauguauucaucaucagcuaaagaaguuaaaaaaaaaaaaaaaaggaagucaucuuacaucuggcaucgaaagagacugauccaauccaauaucuacuuuguucaggacugcgaugcugaaugacagaacacccacaaauauugcuaucuggaacaacaaaugaaucauaagacagagacugcuuaguaaauaagcuuacgaccagaaauaaaaucuuaagcacacacaaaaa

SEQ ID NO: 18478 - RNA, 5661 nt, Homo sapiens
uuuuugugugugcuuaagauuuuauuucuggucguaagcuuauuuacuaagcagucucugucuuaugauucauuuguuguuccagauagcaauauuuguggguguucugucauucagcaucgcaguccugaacaaaguagauauuggauuggaucagucucuuucgaugccagauguaagaugacuuccuuuuuuuuuuuuuuuuaacuucuuuagcugaugaugaauacauuuuucaaaacaugcacguagguguuucaagcaagugccugcuucuaacugcaaauggugacaggguuuccaggguuaggagaacugucgcagugcacugcuggugugggcugucuggcauucugacugagccccucugggcacagcugcagaacacgaauaacuagucuuaugagguuacuuuaugagaugcucuccugauuguggggcuagcaggaggagcacccuggggcccuggggggaagacuggugguguuaggaaucaugaguccagcuggaggcaucucagccaggaaccuccuggcacccucuuauucuccaugauccucgccuugcuuaguuacuaucagaguguucacacucucuccuauucuuuuaucuuucuuucaggacuccuacaugguggauuauuucaaauccaucagucaguaccugcaugcggguccgccuguguacuuuguccuggaggaagggcacgacuacacuucuuccaaggggcagaacauggugugcggcggcaugggcugcaacaaugauucccuggugcagcagauauuuaacgcggcgcagcuggacaacuagucaguaccaccuugucuuguacuucagaagcagcggaggaggcucucagccaggcagucagcucaggccugaaaugucucacugaaaauagacuuucuuggaaaaguuguuuuuaugcaaaauguauguuaaaucuggcuuuaccuuaaaaaaccuuugaaaggacuaauuuaccaccuaauacuuugaaggcuuuuuucauuaagugcucauguaguuuuucuuuugacuguuagcaguauaaaacguagaaaaggaaguuagguuuuaagaaaaaguacugaaacuaaagacuuccucccuguggagcaggucaguaacccugucuguccucucuaguacccgaauaggcuucgcccccucguccuggaucgacgauuauuucgacugggugaagccacagucgucuugcugucgaguggacaauaucacugaccaguucugcaaugcuucagguaccuucuccuuuaccaaaucuuuccuguuuugcugaaaaauuuucaaauuaucauuuaaaaaucauuugcaucgugccucaguuuauaccuauuuguauaucaaagcugggucucccugugucaucauuccuuuccucagucauucauucugaaauugucauguuguuccuggcucagacagccacccucggggcugcaagcugaacaagguccacauguucggagugugguuuccacauaagguuucucauccuguucuaacuccagcgauugccucucaggauugguaucuggccuuagcuucucagaggagggcuuuucuuuaucacuuuacccugugguuuuguaggagcgucgagguugcccuggaauuuucuuaauaaaaacauagaagccccgggcucugaccagucaaggccauacuugaaggaggagaucuacuucagggcagaaaaugaugcauaguaugccuaagaugaaaaugguauuucagauucauuaaacugugaaagugacauguggcugaagcuuuuagauaaggggaaagauuaucccucacuaguaaggaaaguaaucgauagagaagaaaguaaugccccucacugucaguauuuuaaaauguuuuacaaaaaaucuggagaccuauucuucuaacaguccucccugcaugucuccgccagugguugacccugccugcguucgcugcaggccucugacuccggaaggcaaacagaggccucaggggggagacuucaugagauuccugcccauguuccuuucggauaacccuaaccccaaguguggcaaaggguaagugcugcugccauugcagauaagcauccacugcaacuuuaauuugcaguagaaaacuaggagaggacugggcuaagacaguugcaugggaacgucucuucuccgccccacccuguccugguccuuugguggaagcaggaaaaccgaaaacaccuuuuuaagaaaaugccucauaguguucaacugauucugucuuagcgugggcauucacaucucaugcucucucuguguccuggcccccugggcaugagaaugaacgcagauuccugugcacauuccaagcggggcugagggagaggacggccugcugguaauccaggccugaaggaacuuggccuguucacuuguacugauggcagcuggggcgugaucuuagcuuuaguaacauuaucccacauuaagguugcgauucuuuuagccucgucaugcuccuugccagcccauccauguauaggguuaugggcuaucucacucccccauccagccaggcagccaguuacccacggaagccagauauauggcccaaaaauagugaugaugaccggaagucucuggccuugauuuggaagcuuugggagguggaagaugaguauccccauguauguuagguaaacccugaacuuagguuuuucauaagaacauacaucugaccagagucauaucagugaaucauuuauaucaugcaugugcuuugagaccuauucgagguaucaugggaugacuccuccuaaaaguuaaguagaaaugaaucuugcagcuugauuuacucacugacuggaugcuuuggccuacguaaaauaaguugaaguagauucaguuuuucugaaggcaguagccaccguuccuggggagccuccagggugccagcgucaugccaggcacucccugacauuauuccauuucucaucacgcagccuaugaguagguggugguauacccauuuacagaagaggagacuggggcucagagguggucauuuugcucgggguuacaugaccaguaaguggcagggcugagguuguucccagggcccuugcccuuuccugcuuccuauuacacaacaggacugaguaaacccuguaccuuugauuauacaugaaaccagguggagaaacagcagcuauguaccaaagaacccagagcaaucgagaaaagcccaucuggccaggcgaaguggcucacaccuguaaucccaguacuuuuggaggccgaggugggcggaucaccugagaucaccucaggaguucaagacuagccaggccaacauggcaaaacccugucucuacuaaaaaaauacaaaaguuaguugagcgugguggcaggugccuguaaucccagcuauucgggaggcugaggcagggagaauugcuugaacccgggagguggagguugcagugagccgagaucacgccacugcacuccagccugggcuacagagcaagacucugucucaaaauaaaaaaaaaaagaagccagucugggagagaacaagcuaaaccuuugguguucccuuaucugggggccuucuucaucccugaaauguacagcugggucugaccucugaguccagggucaggugauuuugcuuagccucaagugcucagauucugcugauauuuugcaagaccuggacucucuugacacccaggauucuuuccucaggggacaugcugccuauaguucugcaguuaacauccuccuuggccauggcaccagggucggagccacguacuucaugaccuaccacaccgugcugcagaccucugcugacuuuauugacgcucugaagaaagcccgacuuauagccaguaaugucaccgaaaccaugggcauuaacggcagugccuaccgaguauuuccuuacagguaaagccugcccuuuuucaaugggguuuacccagcaaagggccuacacugggugggaguggggaggguucccuuggcaagaugcugauuuucagguuggguucuggccccugcuccauucugagcacagggcaguauaucaaaggaaaugggugcugggcaaaggaguucagaaucuaaagucucugugaaggccugagggcuagagacgcaaaacuugaucucugcgccacugcacagcugcaagagacacacacuggaaaauggcuuaaggcagggggcgcuuggagagcaggcggcucagagcagggcccggcccacauucuuggccaacaaugaaccagaaucccuaacugcugguuauuugggaugcugccuguauguagacuuuuuauauuguuagggguuuuuuuucccaggaagaaaaguauuauguaugaacuacugaauuuagaaacuguagaaagguaggagaaacaagugauuuauuuuuccugccuccccaugaucucgcuuaaagcaggaaggccuggauuuguuuggaagaaguuaagagccgguuagcucuggcagaaaauaaaugaaagcauguuuuccucaggccuugcacggaccccgcugagccugagguagugucucaggauagaucaggauucuuuguuuuuuuguguuuuuucagaaugcuguggaaugcucucuguaaaugucuauaaaauagcauagauugggcuuauaaacagaaacuuuaucaaaaauauacauuuugcaucacugcugggcccuucucuggguggucaguggccaugagaggucaagugaguugcuuucggugagucuuguagacagccagcaagguuuucugcaagggauguuucccaaaggagucugaccacuuggcaguggugacaggaugaacacgcaguguucgggagugagagcgagcuuuaaugaggccuccccucuccccuccaguguguuuuaugucuucuacgaacaguaccugaccaucauugacgacacuaucuucaaccucggugugucccugggcgcgauauuucuggugaccaugguccuccugggcugugagcucuggucugcagucaucaugugugccaccaucgccauggucuuggucaacauguuuggaguuauguggcucuggggcaucagucugaacgcuguauccuuggucaaccuggugauggugaguccucauacagucucaguuugucccuagcuccuguuucacuugggggaauuggcugucuuagauuccauguaaacccuaaagauggaguaagauaccaagucuggcgcuugcucuuggcacacauggagaggcaggaugagugcuggaggagugcuggaugguggugggacagggcauagagggagcgagcauugaguuggacaucugggagcauaggcacauuacaggcaauuucuguucaauuuuuucucuugucccauuccuugcggcuauacuaguauaccugauggugccucugaccauggaaaugugauuuccuggccuaguucugggcuagucugccuguaauuuguuauucuuuagagauugcacaagccuguagccugaugacagcaggauguucacuuuuuacuuagaaaauugcaccccgccccaggagcucuccgaccagugccuuuugccuccuaugugguuaucagguacuuuuaaucauuaaagaug

SEQ ID NO: 18479 - RNA, 2143 nt, Homo sapiens
caggcucgcugcugccucaaaucucauccggucccaaagccagcugcccugcagagaggagccuaccggcaccgggcacgucugugggagggcgaggcugggagaaagugagagggggacugcgggcgcgcggggcgggcgcgcggcgggucccgggagggaaaggacaacggagccggggguaggggguggacgaggagauguggcagaggcgcauucccucuggcugaucuugccagggaggagaccugaggaccggaaucggugaccgacaggagggggagggggcucccgggggccgcaggucgaggcgcgugagccggacacgaggugcgcgcugcaggguuggggaaucggggacgcgugggucaccuguauuguuugaaaagcugguccgacucccugaagccguuguugagcagcauguugaugccggccagggccagcuccgcguccugcaggggcgccgccgccgccgcugccgcguccgagucuccgucgucccgccgccgcggccgcugcugcuccgagccggccaugggcgugcgaggcccugcgcugggccgaggcgagaucgggagcagcugcugcggccccgcgcgcgcccggagcccggcucuaccugcccggagccaagcggagccgggaggggaggggaggggaggggagaagacgggagggaagaggagggaaggaccgcggagggaggagccgcggcccggcugcggcgcggcgugggaggugggcguccggccgccgccgcggggauuacucagcagcacccgcccgcuccucucgcgcccuccgaagcacccaacucgcgcgggccccgaagcggaauccguuuccgggugucucucaccccgccaagccgguccccgagcggcggccgccuccacuuccugcagcccccgcgccccggccccucccggguccccaagccgcgccuucgcccaccgcccaggacugcucggacacacgcacgcgagacccggagacccgagcgccccacccucccccgaaggggccggacccaggagucgggaggagggcaaggcgcggagggagaacgagcgugcggauguggaaggaaagggaaagggaaggggaacuccgcccgggccgcuaugcuagcgcgcggcgcuuuguccacgaguaacugaaacuccacgaguaacugaaaccccacgcagcccgcgcccgcgaccccagacuucaucccgacccuggggccgcccccuaggaccagggcagccaauucccgaggaggugggcggcgggggcggggucucuggcaccugccccgcagcuccccggagccccgcgcugcgggacugcaaggcagagccccucggaucccgguaccacccacuccagcccgccaccaacauuugcgcaguggggcaggaggagaaauggaggccuauaugccaugugcccaaauauuuaaaaguuauaaauucagcugccaaaguguguucuauucucacacugccaauuauucuugcaaagcuuuggcguucauaugaccaaaugucagcaaaacaucaaaagugacugaauuuaaccauuaucacagaagucucacuguucugaugaugggcuggugauaucuggaugccuaauauucuagagacaagcaauucauaaaucaucuuuauguuuuuuccacaaauuuauuuuucucuaauuuagcaaaaucccuuaauguaguguugcaaucaagauuaugcucuaaugccaaauuggacaaccuuccuugagucgcugucguuuuuagaguguaguuuauuaauuucaacuugaagaaacuuugcugaaacauuuauaacagaauuuuuuuuaaaugaaagcaauccucagguuuagaaauaacuccugaauuuuaaacauuaugucauccauuaucaugggaccaauauaauaaguuauuacagaaaaaugcaaaauaauuuugucauguaaguugcuuuuacuuauuuuguaaauuguaccaucccuuauaagaauaucuaaauccauacaggauuuucaacuuuuauaaauagaaauuuuagaguaauaagaauuacugccacuccuuaagugucauguguaacuguugcaaagccaugcuaauucuugaguacaucuggaaccacaa

SEQ ID NO: 18480 - RNA, 4324 nt, Homo sapiens
uagccuggucugagaguuccauucaaaaugccagaaacugguuucuggaauuauauuuguuucuguaguuuuccuugccagaggaugcccuccucauuuuguguacuaucgagcuuccuugauguuagucauaccaauuuuuccaagguaagaacugcccauuuaaagucaguagaagcucacuuaucaaguguuuuauacauauuucauguuaaaucuccugacugcugaaaagcugugacccaacuguaugacuggaaugucauacaggcacgguggcucaugccuguaaucccagcacuuugggaggcugaggugguggaucaccugagguuaggaguuugagaccaaucuguccaacauggugaaaccucgucucuacuaaaaauacaaaaaauuagccaggcgugguggcaggcacuuguaaucccagcuacucgggaggcugaggcaggagaaucgcuugaacccaggaggcagagauugcaguaagcgagauugcacccuugcccuccagccugagcaacggagugagacuccgucucaagaaaaaaaaaaaaaaagagagugggacuaauuuugugguauaauggaaagauucagacccuacauuggaaccgucugaaggguuggaauucuguacugcuucuuuggacuggacacugguaucuuugaagagagaucauguguucauguggacuuacagcucuacaaagucaugaucucuuccauucauuucauuuccuuugcugucgggcaguccuguagucauuuugugacccugauaucuuuuguucccuaauguucuucacagcucuuuugggccugcacccgucucuggccuucugucucuguaguccccucagaucuccuuccacucugagcagaauuccuuuguuaaacaugagguagucacuguauauggcuccacucccuaccacucuucacuccaguuuuuaucugcaucugcucuuauacuuuccucuagccuuuugcuggaggcaucugucuccuuccauucugcuucucuggggaccuugcuucaaaaaauagcuccugucuuuggaauucucuacccccuuauuuauagcuuuugucuaucucccugcauccuuuuccaauuccauuuuugaaaaugugauacuuucuguuucuacuucuuaauuuucagcaaguccaccgaaacuguucuugccaguauuuccuuauugcuaaaucaaaggacauuuaaaaauugucuugcuuguccucugaagggccuggcaugugacuacuuccuguuuuuuggaauugcgcuguggcuuccacagugccgccucuuuuggcuucuccuuccuuuguagcagcucccccucagucaccuucuuuuuuuuuuuuaauuuugagauggagucuuacucuguugcccaggcuggagugcaguggugccaucuuggcucacugcaaccucagccucccggguucaagcgauucuccugccucacccuccugaguagcugggauuacaagugcacgccaccacacccagcuaauuuuuuuguauuuuaguagagaugggguuucacuguguuaaccaggcuggucucaaacuucugaacugaagugauacacucgccuuggccucccagagugcugugauuacaggcuucagccaccacgccuggccucagccaccuucuaaagcauuuuuucaucugccuauguauuaaauauuaguauuaccuagguuucugcgagugaccuucucacuccucauauucucccuggaugaugucacccauucuuuuaacuagaauucccugaggacucagaugucuccaccucagacuucuccugaguucugaucuaauauauccagcugccuuuugaacauuuacauaugcuuauaucagaagcauuucaaaaccaacgugucucaaacugaguuauccauucaacucauagacuugccacccauucaguaauucaggccaggaucaugggaacuggcuuugguucauccuccuucuuccucccuaucuuuaaucaagucccgucaauuuuuuuuuuuuuuuuuuugugaaggagucucgcucuguugcccaggcuagaguacagcgacacagucuuggcucacugcaaccucugccuccuggguuccagcaauucuccugccucagccuccugaguagcugggauuacaggcacacaccaccauacccugcuaauuuuuguauuuuuaguagaaacgggguuuuaccauguuggccaggcuggucuagaacuccugaccucaagugaucugccugccucggccucucaaugugcugggauuauaggugugagccaccgugcccgguucaauuugguuuuuuaauaucuugguugccuaucucccuuuauucugucuucccugacuccagcauacaguuccccauugcuguucugugagauaaauucucaaggcugcucuguuggaugacuguaaccauuuccucauacaggcuccacccuucaaaacuaggugaggugucccugcugcuccaugaguuccuggcugucauagcauuuaucauauuguaucauuauauauucacaaacuggagcuuccuaaggaagcaacuguaucuuaguuauuuuuguagcaugguacuuggcaugugguagauggugaauaaauauuugaaugaaugaauaaugaauguacaaaggaaaaaauucaggcuuugggaucagaccaaucuggaucuaaacucugcuaccucgaccuugaacaaaugaauauauguuuaggaauucuguuuccacaucugaaauugagcgcauauaugugcuauuuuaugugaggugcuucaguacaguaccuggcacauuuaggagccauguagauugccuuuuaaaacaagaagguaauuuguuguucauuguuuugcuaccuagcacuacuuuuauaaacugaauucauucucuaauuuucagggccuagggagagauucuguagcagggacuccucuuuccauacaugauuuuuccaaguacaguaacaguuauuauucugagugaaaaaaguaaaagaaaugaacugacuuuucaaagaugccaugaggcugggcgugguggcucacgccuguaaucccagcacuuugggaggccagggcagguggaucacuugaugccaggaguuggagaccagcaugaccaacauagcaaaacccccgucucuacuaaaaauacaaaaaauuagcuggguuugguggugcaggccuguaaucccagcuacucaggaagcuggggcacgagaaucacuugaacccaggagguggagguugcagugagcugagauugugccacuacacuccagccugggcgacagagcaagacucugucuccaaauaaauaaauuaauuaauuaauacaauaaaauaacaaugaaaacaaagaugccaugaaaccucacugacauucauucccaauuuucccagcauggccuggaauggucuuuaacacauucuaggucuguagugcaauuacagcuaccaccaacuucaaugggacuuaaaguaccuaggaucuugugaaagaaauauuuaauuuuguucauuuuuacucugaacucacuaaaguaugaggacagaguuaaacacuuuaguaaggugaaagguuugaaacauguugaaacaaaaagauuucuuucccuccaucagaguguuacaguuaaccauaaauuucauuaaccugaacaucccacuuaagugugguauuugggugguggguuuuccuguccucugaaccuuugcccuucaagccuggcuggaauaauuuuaccuaaguagguuucacgguaguaggauuaauaccguuguuuuccuuguugcucagugucccaacuaggguauaaacaauaaauaugugaagacugccuuucagucuugguuuuggaaccguaaacgcgaacgcuucagcgugagccggaguaagugacaggcaggacuggagagaagauuccuuugcuuuccagaguuucccaaggggcggguugguuaaaaaaaaaaaaaaagaaaaaagaaaaaaaaaaaguugccagggccggugucuccaggagagggccgagcgcacagcagcucuaggaccucgcaggcgccucggcgcggcacucacguagagcccaaggagcaguccccgaccucuccucggagggccgugcaggcuuccccggcggucccuaccugcgccuccgcccgccagcggcgcuggggaaggggaggagcggcccggacgcugcccgccgcgcgcagggagccgcccgccgcaggccuugccgccgcccgcccgcgcucuccccgcg

SEQ ID NO: 18481 - RNA, 1235 nt, Homo sapiens
uuuagaugcagcuuaauccaauacuccaaaugccauuagagccaucucucucccauguucacuucuccucuuuucuggguugauguuauucucaggcccaaagauaaacaccaucagugucuggcuuaugugguucuuacagcacaugcuuguguagcagaaggaaaauacucuuugucacucucugaaucuucauagcaaucccuagaaagggcucucauuggucuuacuggggucacauaguuguuuaugccgauaggccagccugacuugcaggucuaccauuugcugaggacaguguuuucuuuugauugacaacccugccagacuguagggaauaggcaagaggcagucuuacaaagaaacugauacaaggaaccaacaaaguaacaauguccaaaucgccccacaaaugucuucaccuuauagauacuuaacuaauguguguugauaaugaugaugaaguguuugcagaagaaggaagacuagggauccaaaaagggggauucugggcaucugggggcacaagaggcugccgcugggggugugggaaaggucaacggcacugaaaaugagaaaaauuuugcuccaaaaggaggcugggagcuagguacaguggcucacgccuauaaucccaucacuuugggaggcugaggugggaauucgagaccagccugggcaacauagugagaccuguuucuacaaaaaaccaacccaacccaaaccaaaacaaccaaaaagaggcuugagugagggauguugcucauagugaagauccgacguuuuuuauuucacacuuuugccuguggcugacgcugacugacgggaaaguauuugcugaaccaaaugacucuauaaagauaacaugcuuuccagcaguuuccuuuucggggggauggggugacauggcacacuuucugguuuugaugaaucaccccagauagcaggaggcuuucguuugcuuauauaauagaucaauuucaaggucucaaacuguguauuauaauuagcaaugcaaaccuccagagcaucaucucuuacucuaaagaaaauauuguguagaucuaguagaguauucucaugagcuuuauuuuuccucaccccucuacugaguucuuucaguguccaagcugacugagaaagccacucuuuagaaaguagaaucugauguugagaucucuuuauuaauaaguauaggcccaaugguugcagaauucucuucuauguuuaauggc

SEQ ID NO: 18482 - RNA, 618 nt, Homo sapiens
agcuuucugguucucuuuuuuuuccaccaaaaacuuuuuauuggccuuuuugauggaaacggguuuauuugucaggaaggaugaucccaucauacuuaugcuggaagcaacgcaucaucuccucuuugcugagucuguguuuggccccagugcagccuguccugugcuucuugucugugaugcugaaaccuggccuacccagcaccacagagaaguccaggccguagauaccaaugcuugggucauauaugauacccaaaucgauguguuccuggaucccaaaaccaaaguuucuaguaucugagaaguuauuuuuucuuaacucauacuucugcaccuuuagauccuucuccaggauuucuucugccuuggauccuugaacugugcaguggacagcaaucuuuucauuucucugcaugccagaggaucugauuguaucuagcucuggaaaacacaggacucugcccugugagcugcuccaaugccuuggcugcucggguuagucugucuccacucuccuccacacagauguugaggcagagcuugcagaugugaaguuucugcaugggguucuccuuuucaccuugauccgccaugauagagaacaggaagagcuca

SEQ ID NO: 18483 - RNA, 1165 nt, Homo sapiens
aacaaacaucaauuguuauacacuaacaucuucaaagcacauuguuuguacaagagauagacuaagaacaaaaauguguuuacggagauccaaacauaagugagugagagugccucucacacagcuuuccgaugguacucaggaggagccacuucauaaucgcuggcacuaaacaaaguugcagaauucuuugccagguacuuuaggaaaucgugaagauaauugaguaauaaagcaaggcucuucucauccagagguguauaggccaacauugcuccaauucguacaaauaaucucaggagauguggcgcuccauacaccugggacaugggugcaucgggaugaucugcaagaauuucggcauacuguggucucucaaauuuauagaguagcuggguacccaacauuacguugaaguauucuuuuaucccugccacaacuucauuaaccgcauacuccuuauuaucuguguuuccacgagauuucuuguaauuugcauaauccucaagaauggaauccacauucuucuuggcaggaagauaaaagagcuguuuuugccugguaauuaagucccagucaucaacaagccacgguuuuagcuauucaggaaucuuuacuuuaacuucaacucuguucaugaauguuuccucauuuucaacaguaggaucuacccgggcccuuuucuuccaaggaggcugaggggucucacugguacugccaccaucuccauuuccagguguuuucuguuuguucuuuuucguuuucacuucaacauuuuucuguugcagaccagaugucuucuuuccuggggcagccccucucaucuuccccucugcauacugcuccugauuggcuuuuugaaguucucgcuguuucugcaaauugguguccacguauuugaguacucugcucuccggaacccacucaucccaauuuuuauuccaaccacuguaauguaugaaguauuucacuuguuuguccuuuauggcaaccuuuacacacuuugcuucauaaagaagaggcccaugaaagcacagcacucgcucacccuccuggaauuuaggcuucggguccugcuuccgcgccauuuauaagugauuugccgccuccuccuucucccaccacccccgacuaccgcccccuacucucuaccccacccaacucc

SEQ ID NO: 18484 - RNA, 512 nt, Homo sapiens
aaaagugacauuguauuauuacuauccacagguggggccugcaugaugugguagguaugcugggcucaggggacaugugggcugugaggaggagaugaugacagaaaggcuggaaggaaaggggguggguuugaaggccaggcccaagggguccucaggucuacuucugggaggggacagccuugaggaaggagucauggcaagccacagcuaggccaccaaucagauuaagaaauuuugggaaaucuaacugcccaucacugcugacauccaguuucuucauguggucaaggacaccgggguccuucugguucuuuguaaaggcagccagcucuguauucaugaagcuuaggaacuccgucuuggagagauugcgguuguaaccauccuuuccagcauacuucuggaaaacagcaaucagggacucaaugcaccgcucagucucuguagggcuggagauuuuugccauguuggagcugagcaaggcaugggaggcuaugacugggaguggc

SEQ ID NO: 18485 - RNA, 512 nt, Homo sapiens
gccacucccagucauagccucccaugccuugcucagcuccaacauggcaaaaaucuccagcccuacagagacugagcggugcauugagucccugauugcuguuuuccagaaguaugcuggaaaggaugguuacaaccgcaaucucuccaagacggaguuccuaagcuucaugaauacagagcuggcugccuuuacaaagaaccagaaggaccccgguguccuugaccacaugaagaaacuggaugucagcagugaugggcaguuagauuucccaaaauuucuuaaucugauugguggccuagcuguggcuugccaugacuccuuccucaaggcuguccccucccagaaguagaccugaggaccccuugggccuggccuucaaacccacccccuuuccuuccagccuuucugucaucaucuccuccucacagcccacauguccccugagcccagcauaccuaccacaucaugcaggccccaccuguggauaguaauaauacaaugucacuuuu

SEQ ID NO: 18486 - RNA, 4631 nt, Homo sapiens
auauaaauuagaaugaaucauagucauauaguuaauagcaaacaaagcucaauuuaguucauguccagcuuucuucguguucauuuuacucaagggcauaccuuccuuuuucugcuucuuuuuuuucuuucuuucuuggacaccuccaacccccauugacaaccgaaaugcagggcuauaaacauaagggugcaauacaucaugagauaagucuggagaacauguccucuaccaaaaugcacaugaaucucugguacagcuaaaauuccagaaacaugcugggguuccuuuugcaugcuaagcagggucaaaaaugugagcacuaugugguugcccuuauauaucagaugagcucuaaaguugaaagguuacauuugugaaauugcggcuggguuuccuagcacuugauucuagcuccugcaaaucaaagacuccuaauugaaauacaaauccaacaauaugauaaucuuucaguaaaaaaaaaaaaaaaaaaaaaacgugacuucugcacccuuaucuguugaagagcugacagagaaguucagaggcaguuguuuaaccagacaaaaugauagagaaaauauguuuucaaauaagaucauaaaccuugaacagugccuugugggaagcaaauguaaagcaaagggcuguccucuauucugucuaccagcucuacucccccaccccgguguguauccucagccacucaccuuuuaggcaagggcuagugucuuucaggacagacccaaaccccaaauaccaaaacagaauaaaguagugucuuagcauacuuugagaucagacuguuucugcauuucacagugcugggggugggggggagguguggggggaagggaaaagcagcauaccaauguagugaaaucuggaaacaacagcauauauacagacacaaaaaaaguuugcauauugcacagagcacuugaagaucauaaaucuaugcaugagaaagauguaguggaaauuuugggggggauuagaguuuauuuuugucaucucugugagacagcuacucauucauccagaucacagcuaagaaaaaagcuggucacagaaauuagcaguuucagcucagcagcgaagucgccagccugugaaggcagagagaaauugacuaauuagcaaugcgcacuaaaacuugacgguucuuuauagagagagagaagagagagggagagagagggagagggagggagggggggcucgcuuuuuccccuucuuucuuccaaagauguuugaaaucgcagucauuuacgcucgacaauuuuuacaauagccuugagccauaauuuugcgagucucuccagcauccaucccccuguauggucucucucuacuggccaagcacgaccguuucucuccccaaccguggauuuccuauuacucucguuacgacucacugagccccaggcccaaggauaaugauguguuguuucuugguagcauaauuugucacacguacauuuuuucuucuucuucucuugcagaaagcucugcucccucucucucucccucucucuuucucucuuuucucccucuccuacauuuucuugcuguugcuaauucauggugaucaaaugauguacgacaaaauaaauuguaaagagugacugccuggaguugggaaccagaagguguuuucccccucccaaggagacagcaaaccuuuaaaaaggaaggacaauugauuuuuggggggagcuuaagugagccuugacuuugcagcugguugagaacagguaaguuucuggccuugugucugccuuguguguauuuuguucugucuuuuggauuguuggagggggaagggccggggagggagucuuucagagggguuggcggggggguaguuguauggcaaacgcucauaaagaaaaaacuccuauugcaagaaauaagcagaugaggaggaaaggcaagggagaagaacaagaaggaaggggaauaggaaaagauggggcggggggagacaacgaagcggagagagcuagagagagguaugaccggguccucuuaaagggagagagacucuguaagauguuucaggcaagccagagcuuugggggcgggcgugggggugcugccggcggagggagcgcgagggaggguaggguccaccuggaacgggaugguaaagugagucgaaaggagcccaguccgguauaaauaggaagccggcgauccaggaccggcgccaggcagggcagagugagccgcaguggaaggggcagguccgccgggaucccuccgagccgggcggcggcggcggcucucccccgggcgggcgggccggcgggccggcgggccggcgcgcgggcgggaugcaagcagagggucccuuucugcucagcccuggaaggugcaauuacagguuaaggaccuggcguaucgauuucgccucgccucccccacccugcccuccucugccuagaugcgggcggcucagacuuuuuacagaaguaguuccagggccggggaagugggggugcccgaguggggggccgcugggggcucuaccgagggggucagaagggagcugcggcugcaggcgacgaugcuggguggggcgcagagaccccgcaccccacugcucccccgcccccccgcucguucgacagcccccaccccucccccaacaccugccuucuaacuugaacuucucauaguuacuggaguuaaagcgacugcgccuggugcccgggaggggaaaccgugcacacgaaucccucccggccuccaggccucccggcucccucuccaaacgcguccucgcagccccacuuccucccccugaguccucggugccgccccucgcuggaaggggagauugaugccugaacuuccgcgcuuugaaaugagcgagacgggggagagggggccaccggguggggguggcggugguggaaggauucuccugccagguuuaaagccaucucuggaaaauuagccaaacugaguggugacggggaagccaacaguuugcgaagcggggaagcgggcagggccagguugagggaaaugagcucgaauugauaaggacagcucccgccucugccgauuccacugagcggguccucaccgcgcuccgcugcacuuucccgggagaagaaagggcuuuaucuccucccucagacuauuagccuaggaguuucucggggcagcauggauaaucgaagggggucccagcuuuuggagagcuaagauucgcacaccccgcacgcuggucgggccccuguuccuacccccucccccaaacugggccaacugcgaaaagcaaagcuucgggcacaaguugaccuggaaccuucgccgucggucgccucugagcuuucagggcacccccggcuccccacuucccggccuuucccuucaucuggcccggcauggacacgagcccacgaggugccucggccucagccgccacuuugccgucgcugcugccacugcuguugcugccaacagccgagcugaggugguugguuuuaggaaagugagggacgaagugugugggagguggcgagaggagccgcagggcgcagaaccggcgccgggaccccagacagggcccuucugguggcgcucacggauccagcgucuucggacuuuccuccuagggucgggguccggagcgcgccaggagggagucaagcugagccuugauucuuguucuucgcccuccccuccccuccacacccuuccccaccccgaccacaccccacccgcuccaccacccugcuccccucccucccaucccccaccccugucugccagguuggaggaggguuuaaagccaggugcaccgagucagcucgccauguccagauccggggacaggaccuccaccuucgaccccagccacagcgacaaccugcugcacggccucaaccugcuguggaggaagcagcuguuuugcgacgugacccugacggcccagggccagcaguuccauugccacaaggccgugcuggccuccugcucgcaguacuuccgaucgcucuucuccagccaccccccucucgggggaggggucggcggccaggacggccugggggcccccaaggaccagcagcagccgccgcagcagcagccgucacagcagcagcagccgccgccgcaggaggagcccgggacuccuucuuccucccccgacgacaagcugcugaccagcccccgggccaucaacaaccuggugcugcagggcugcucguccaucgggcugcgccuggugcucgaguaccucuacacggccaacgugacccugucccuggacacgguggaggaggugcugucggucagcaagauccugcacaucccccaggucaccaagcucugcgugcaguuccucaacgaccagaucucggugcagaacuacaagcaggugugcaagaucgccgcgcugcacggccuggaggagaccaagaagcuggccaacaaguaccugguggaggaugugcugcugcucaacuucgaggagaugcgcgcccugcuggacucgcugccgccccccguggagucggagcuggcgcucuuccagauguccgugcuguggcuggagcacgaccgcgagacccgcaugcaguaugcgccugaccucaugaagcgccuccgcuucg

SEQ ID NO: 18487 - RNA, 1671 nt, Homo sapiens
ugacucgcagucugccaccgccgccgccgccgccgcuccgggaguccacccgagagaguccggccagcgccgccccuucccgcgggugcgggugcgggugcgggugcaggugggcgccccacugggcagguccgagccgacccgccugaagacgcugucucaggccaaaggaagccaggcugaauucgugacagggaagaaagugccagcgggugaaauaaacuaagugguuugaccccgcucgagagggaggaggccggcgcggcuugcagagggggcuugaaaaggcgccgccacacugugaauuaauuaccugcaaacgggggcuugcacaccaacuggggugcaucugcuuuuuacacccaguguuuguacuccuaccuggagcacgauugaugauaaggggcaaacuaguuuugucaugaauauuacuaauuaaacuaggcaauucuaauacaauuaacaauuuaauaauagcguguuuuugggggguuucaaaucugcuuguugaugcuguugauauuuggguucuauuuggaaaauggagugcaggcuggagaagcgaacuccagaagucuacugaugugggcgcuuguccauuuggaacagcagcuauuuuuaaugaaaugagaaaauguucuggcuucaagacccagcucaagaucugcugcuuuuggaaguggucccgaccggugcugaucgcagugaucucuaguguuugaaacagcaaggauuugucugaauccuucuguuagcccuuggaaaacgcauuauauaccuucccuccugugcccuacacauugcuacucaggggaaagauuguccaugucucccccagcguucguuaaagccaagucuucguaguggagugauuuagcacagugcuucucaaaguuuaagagggaucaccuggggauauuguugaagccaaauuugagcgugucgagaguuaggccugagauucugcauuucuagcaaacucccaguuaauggcauugcugcuaguuugaggaccacacuuucaguagagagguguugaucgccgcuuuggcauuagccagccuauuuugaguccugacuacaccacuugcaagcuauaugaucuuaggcaaguuucucaacauuuaagccucacauacuguaaaauagggaugauacuaauuuccaccucauaggguugucuugaagauuaagugagaaaguccauauaaggcacuuaguguagugccuggcacacauaccuaggguucagaaaaugcuagcuaagucacuguagaggucauccuugcagggggaaagcuggcaccaagugcagcauggcugcagggggagcaaugugugaaaugggcacaagggugagguagccugcccaagaacaaggacugugcccuguagugccuagcaugugccagauguauaggauaaguuugaugaauaaauaaaugacucuaauguggaacagaucguauguguucaaaaaguucugcuucuccuuuaaaucaugauaaauuaguucugagacauugaauuaaaaaaucauuuugcuuucuauuacagauaauguccagcugcuugucacauggguaaucuauuuuaauaucugagacaguacauggauuguuaagguuuaguacauuuuuuauccucaguuaaaaaccuugaaauuuaaau

SEQ ID NO: 18488 - RNA, 1348 nt, Homo sapiens
uagcacuuccuuuccuccuucccuuuuagauuuuaaaggagccauuagguagcagugccaaaaggcagaaaacgggaggguggggagaaaaacguuugcgcuuaaccuggagagugugcaggaaagauggaauccucuagauuaagcugcagucugugauguuaaaccgccagauugauggagcuuuguaagaauucugcucgcugauuggugcagggauugacagcagaggugauagugucagacauucaccaaaauuuucuccauagaacccuagguuuauuagaaagagacuggacugcaaaggacuugaaaaaaacugggcgcuguuaugcauuuucuaaggaguuuauggccaccgcuugggugggggagccuuuccuucuuauuuacaguaggaaggugauuccuggucuuuugcugaggucuguuuugaggaugggacugaucuuggucauuguauugugagccuuuugauuaaugaguuggccuguacgguuggcaucauuuuuacauuaacauaucuggcaauauguuccaguagauaagcucauuaaaauuguuugcauuguuugauaaggauaacaauguaauggagaaugcagcuagagucuuaugcagcucaaggccagacuugaagggagacugauagcuucggucauauuuccucugaaguucuuuuguacugggguaguuauuuuuaaauguuaccuugauaaacgcuaacaaugcuuuugcuuugaggcagagcacacauaccucuaaagcgcauccucucagcugaugagcaacaggaaauaacucuuuuuuuccuuuuuagagccgucaucuaaacauucagaugguauuauggguagaauauuguguguguaaauguugcauaucacaaaauagaaccagaaaguacccuacuuccuuucucuuuggccaaagaaaugcaguauuuguugacucaaaaaaaaaaaaauuauaagcaaccuuugcccugucaucucuggcaguuacauaaauacuuggaguuaauuuuggcugugcccaugaggucaccaaaaucucaugccuuaugguuccaacuaauguguugauauggcauucuuacagauuucaagugcuuguuauucacuuaauguaaaucaaaauuccuccacaacuucuggagauauccuuucagagacccugugauuggaaauuugggccucuucuccucuuacuccuccaccuuuuuccucugugaccaucccaaagccuaaaaauagaauuuaaaaacaaaaaacuugaagugauuuuaaaucucacuaguuugaacuuuuuuuguagaaaauaaauuugaagccuucauuuucuaaau

SEQ ID NO: 18489 - RNA, 1348 nt, Homo sapiens
auuuagaaaaugaaggcuucaaauuuauuuucuacaaaaaaaguucaaacuagugagauuuaaaaucacuucaaguuuuuuguuuuuaaauucuauuuuuaggcuuugggauggucacagaggaaaaagguggaggaguaagaggagaagaggcccaaauuuccaaucacagggucucugaaaggauaucuccagaaguuguggaggaauuuugauuuacauuaagugaauaacaagcacuugaaaucuguaagaaugccauaucaacacauuaguuggaaccauaaggcaugagauuuuggugaccucaugggcacagccaaaauuaacuccaaguauuuauguaacugccagagaugacagggcaaagguugcuuauaauuuuuuuuuuuuugagucaacaaauacugcauuucuuuggccaaagagaaaggaaguaggguacuuucugguucuauuuugugauaugcaacauuuacacacacaauauucuacccauaauaccaucugaauguuuagaugacggcucuaaaaaggaaaaaaagaguuauuuccuguugcucaucagcugagaggaugcgcuuuagagguaugugugcucugccucaaagcaaaagcauuguuagcguuuaucaagguaacauuuaaaaauaacuaccccaguacaaaagaacuucagaggaaauaugaccgaagcuaucagucucccuucaagucuggccuugagcugcauaagacucuagcugcauucuccauuacauuguuauccuuaucaaacaaugcaaacaauuuuaaugagcuuaucuacuggaacauauugccagauauguuaauguaaaaaugaugccaaccguacaggccaacucauuaaucaaaaggcucacaauacaaugaccaagaucagucccauccucaaaacagaccucagcaaaagaccaggaaucaccuuccuacuguaaauaagaaggaaaggcucccccacccaagcgguggccauaaacuccuuagaaaaugcauaacagcgcccaguuuuuuucaaguccuuugcaguccagucucuuucuaauaaaccuaggguucuauggagaaaauuuuggugaaugucugacacuaucaccucugcugucaaucccugcaccaaucagcgagcagaauucuuacaaagcuccaucaaucuggcgguuuaacaucacagacugcagcuuaaucuagaggauuccaucuuuccugcacacucuccagguuaagcgcaaacguuuuucuccccacccucccguuuucugccuuuuggcacugcuaccuaauggcuccuuuaaaaucuaaaagggaaggaggaaaggaagugcua

SEQ ID NO: 18490 - RNA, 12260 nt, Homo sapiens
accggaagcagcccgcgccgggggcuucugggaaaaggcuugugaacggcguuucugcgucugccguggacagcgaagcugcugcgguuccugagccggagguuugcgccggugugcggggaacguuaugagagggaggggggacaccgggcuagggucugcggaccucuuagcaggagccggcggggaagccuguccgggaccuuccucagcuucccgggaggcgcggggaacaggccgcggucuccgcgccuagcaguuguggggcggggagggguaggcggcaggccugcuugggucuucggcauuugcagagagcucucuaacccccuguguccuccgagacccucaccuucccccucccccaccggccgguuuuguucuauuucgaggcccuggcgucucgcggaggguucugggagucgugaugggagggggugguagugggacgagacuugcgcggggcuucugggauuuguagucucaccggccgcaggcggaagugccgugguuccgacgcuguugucacaggguggccuuuggucaucugaaauccgcgguccugagugcugggaagaggggcuagaggacgucgggccggggccggggccggggccgggauacacagcaggucuaugcagcaguaaggugggcgauccaccugggacgagguacccugcccaaacauugucgggaccgugggccuucccuccauuucccacaagcgguaugcucuacagcauaaaaggaagagaaaauuauguagaaauacuugcaccguugauaagcagggucuuggaauaggaacgaaugaauguuggcuagaccuuauguauaaggccaccacacuccaggguauuuaauuaaaccaguauguauuacuugucugauaaggccuuuucugauucuagucuucaucuugcuuggguuacaauaaguuuuuuuaaguuguuauuguucagauuuugggcccugaauaaauaaauaggcugaauggcucauugcuaguaugugucguaaacaacagcacgggcaugaucgugcaaauaauaaagguccagaagcaguauacaguuucacugaagguagaagcuggggaaacugugaguccuccaguguaaggacaagacacuggaccacugcaggaagucaaggugcuuaugcgagugccuuuucuuaauagaaguuucugugauuaaugccuaucauuauaaauauaaauguacguauggugugguggaagacugaauauuuacguauuaugugcaagauaauuuuucaaaauuaugugauguuuuucacauaugaucuuuucaauauuaugugaucugcuacucagcaagugaacauuuuuucacauauaaguccaaggaguucuuaaacaccuuaaaaauauuuuuuaaaugguaaagaaaauuuuuuuaagcacauaauaauaaagcgaaccuuccuuuugaguugacuugugugugucaggaaacaccaauccugaauuggaaauaaugcguuccagggucaggcacauuuagaaagcacugaaguagucugguucuuacuuggauucuuuugauuauugacauaggguuugucgucuuaguaggucaugauuggcaaacuuuuucuguaagcggccauauaguaaauaaggucaugcauaacucaacgauagugcuauggucugagaaauauguuaggcuauuucauccuugugugaacgucauagaauguacuugcacaaaccuaaauggcguagccuacuacacacuuaggcuaucugguauagccuauugcgccuaggcuacaaaccgguacggcauguugcuguacugaauacuguagagaauuguaacacaaugcuaacuauuuguguaucaaaacauagaaaagauaagaguaaaauaugauauaaaauguuugaaaaaaaaaaaagauaugccuguacagggcacuuaccaugaauggaccucgcuggauuggaaguugcucuaagaagucagugagugaguggugaauuuggaggccugggacauuauuguacauuccuauagaccauauaaacacugaacacuuaggcuacacuaaauuuauuaagaaaacauuuuucuucaauaauuaaccuuagcuuacuggaacuuuuucacuuacaaacuuuuacauuuuuuuuuaacuuuuuuacucuuuugugauaacacuucacuuaaaauacaaacacauuguacagcuguacaaauauauuuauauccuuauucuguaagcuuuuugcuuuuuuuuuuuuauagacagagucucgcucugucgccaggcuagagugcaguggcgcgaucuuggcucacugcagccuccaccucgcggguucaagagauucuccugccucaaucuccccaguagcugggacuacaggcgcaauccaccacgcccagcuaauuuuuguauuuuuaguagagacaggguuucaccauguuggccaggauggucuugaucucuugaccucgugaucugccugccucagccucccaaagugcugggauuacaggccugagccaccgugcccggcacagcuuuuugcuauuuuuaaauucauuuuuuagagacagggucauacucuguugcccaggcuggaaugcaguggugugaucauagcucaguggagccuugaacuccuggucuuuagugauccuccugccucagccuccuauagugcugggauuacaggugugaaccauugcaccuggccaauuuuuuuuuucuuuuggaacuguuuuuguuaaaagcuaagauaaacacauuagcuuaggcuuacacagggucuggauuaucaguaucauugccuucuaccuccauaucuugucccacuggaagguuuucaggagcaguaacauacauggagcugucaucuccauaauaacagugccuucuguaauaccuccugaaggaccugccugaggccauuuugcaguuaacuuuuuuauuuaguaaguagaaggagcacacucuaaaauaauauaguauaaaaaguauaguaaauacauaaaccaguaacauagucguuuauuauuguuaucaaguuuuauguaccauacauaacuguauguguuaaacuggcaacacagcagguuuguuuacaccagcaucaccacaaacaugugaguaauguauugaccuuacaacagcuacagugucacuaggugaaucuugaauuuuucagcuccauuauaaucuuaugggagcacugucaucuaggugguccuucauugacccaaacaucauuuuguagugcaugacuguguuggguuuuuuuuaggccaucuagucuguugaaacuacucaacucugcuauuguagcgugaaguaugaguaaguacaauuauuuauggacacagucauguuaauuucauaucauuuucacgugucaugagguauucauuugauuuuggggagcuccauucccuaaauaucauuagguauucauuugauuuuagggaucuccgcuccguaaggcacugugaugaagaccacagccauuuaaaaaugugaaaauuauuguuggugcaaguguuguacagaaauggguggcaggcuagauuuggccgugaagcuguaguuugccaauuccugguguagguuauugauuggaauuuuuaacucaaagaacaaguaucuuuuacuuuuaccaguauaaguucaaauucuuaggauauuuuugcuuauuuauauaucuuuuauuucuuaugccucaggagugccugugaagaaaacgggguauugcccugaggcuuauauucugccucaguugucuuuucuugaaauauuauaaaucagaaugucugcacagucaguggaagaagauucaauacuuaucaucccaacuccagaugaagaggaaaaaauucugagagugaaguuggaggaggauccugauggcgaagagggaucaaguauccccuggaaccaucucccagacccagagauuuuccgacagcgauucaggcaguuuggauaccaggauucaccugggccccgugaggcugugagccagcuccgagaacuuugccgucuguggcucaggccagagacgcacacaaaagaacaaaucuuggagcugguagugcuggagcaguuuguugccauccuacccaaagagcuacagacuuggguucgagaucaucauccagagaauggagaggaggcagugacagugcuggaggauuuggagagugaacuugaugacccuggacaaccggugagccugcuugugucauuuccugugucagaagcacuggcauagguaguaggcaaagcugcugaauuaauuccacucaacuaaguuagaauuauguuuaugccuuuucccccauuccccuaccacuccuuguuaucugugccgcuuugccaucuaggcuucugcaguauuuguuucaugggguuucucuuacguguuuuuaguucugauucucauuacaguuccuucucugaaucaaaucuuucuguuuccagguuucucuccgucgacgaaaacgggaaguacuaguagaagacaugguaucucaagaagaagcucagggauuaccaaguucugagcuugaugcuguggagaaccagcucaagugggcauccugggagcuccauucccuaaggcacuguggugaggaccagaacucugugugggcuagagggugaaagagaguauaggccuuuuguucagaacuuugcuuguucucacugguggggggaucauaucacucuuaaucuaauaucucaguuuuuuucugauuaaguugauuuugcuggccucagaccuuuuauuccuagacauuaacaucuucagccuuuucuucccuuucagucuccuuccuaaaaagaguugcccaugucaggcuagcauuugccuuacuuugagccagcacccacccauggaccaagucccucuauuuugcauucaguauuacuugucaucuguuuuacauccuuuuacuuucaaucuccugccuaauuccauugguacaguaagcuuaccugaaaaccucuucuaaucucuuuguuguauaucacugaaaucuuucuaaauauuuauuucugauuuccuucaacgucuaccuagagucauuuucuucuaagaagcuucuuuuguagaaauauuuggaguaauuuuuuuccuuuuucuaaguauuuaugcaaaaaaagccuccuuagcuauaacaugcuuuaaaugcagaaaaaucuuuuuuaaaagcucaaaguuguauuaauucacgagaccagucuuucccaauauauuagccauuaacaccauauacuuauguguauccuuugauauggcccaguauauuccuaaaacugcuagauugcuuucucauguuuaugugaacuaaaaugaaauuuuguuugacucugcuuuaguaaucauuccuugaaguaguuggagauggugcugguaugccacugaaugaggucugagcagguuuucuucacaucugaggggacagugccagccagucaacuuuugggguggggcugaagucugcugaaaaucugcaguuuuacauguuucaugggacauucuucugugcaauaaaguuugagaaguaucauucuugauauauggggcugauauuuucaacuucucaucaucugaauuuuagagugacuuuucaccugcguuccuuauuucagcugucuagucucuuccacacuugggaauuucuguuuccugugugccguuugucuccacuuaaucuucacgcuccucuguuuuucaagucuccaagccucacuauccuccucuaaccuuucagucucucucucuuagccuuaucuccugacuugaucuuuuuguuaauuauuuacuguuuuccucuucgcugaaggcaguugcuaacccuauaugaacuggaucuuuacuccuuaaggcaugaaguuuuagaaaagucuuaaaugacacuugcuguuaucucugccugcgugugagugaugcuaacccauguugguaauucaggcuuuucuuucauuggacacguuucacugaggcuuagaaauaacgauuuuucuaaguaccaugacaaauaccacaugggagaagcugcuuuuauuggaaaacuuucauuuauuaggggcauacugaauuuuuaugucaugucuuugguuaacacaggaggcccccagcuuaucuucagccccuucuugucaagacuccuguguucugcuuuuaggcuaacauuggcugugaccugacuuggcuuguucauuucagaaauagccacuuucugacauguuuuucuaauuuacaucuuuguauuuugauguaauuucucccuuucucaaaguaaaagaacauuauaaugauuuccuaguggccaauuuuauuuuauuuuuauucuuacaaaguuucauccauaccuagccacaucauuuugacuaucucccuaaccaucuuagaaucuaccaucuuucugaccuuuguuuucugacuaccauuuguaaaccacuugccuauguuuuauucagauaucccuuauaucaugauguuauacuguuauucagaguaauuucauuuuuucuuuuuugagaauaggccuuaacaccagugucagagugguuuauagaugugugcuagcuauuuuaguucauuaaaaaaaaaauuuuuuuuagguuucuuuucccuuaauagauaaugaaugauauuuacauuuucuguuuauuucagaugaugaugguaggacugaaaauggagcacuagcuccaaagcaggagcuuccuucagcauuagaaucccaugaaguuccuggcacucucaauauggguguuccucaaauuuuuaaauauggagaaaccuguuuccccaagggcagguuugaaagaaagagaaaucccucucgaaagaaacaacauauaugugaugaauguggaaaacacuucagucagggcucagcccuuauucuucaucaaagaauucacaguggggagaaaccuuauggauguguugagugugggaaagcauucagccgaaguuccauucuugugcaacaccagagaguccacacuggagaaaaaccuuacaaaugucuugaaugugggaaagccuuuagccagaauucggggcuuauuaaucaucagagaauccauacuggggagaaaccuuaugaaugcguucagugugggaaaucguauagucaaagcucaaaucuuuuuagacaucagagaagacacaaugcagaaaaacuucugaauguugugaaaguuuaagaaauugaaaaaaaaaaaagaaucagcacucaggucuuuuucuucagaaaugaagacaaaauuuaaaauaugaaaugaugcagaauaguuuuuucccuauugacugucagaaaauccacugggaaauguaaaaaucuucacucaccauuaugauauuuaucuugaaagaaauggugucauaccugccuagaaacugaaauuuuaaacuuaauucaggucuuaaugccuaaauuuuccaugugauguuuauagucuguauuacuucuccaaauaaugaacuaccugauucauugucccuuucuugaaaguuucuuuuuuaagacaaauacauuauuucugcauugaucauugaaauguucuuuauauggauacauucccuuauauauuaaaaggcaacaggaauuacaaagucugaaaaccauuuuaaaccaucuuuuaaaaauuuacccuuauuuccuuuuaccuaauuugaauaugcauuugagaaaauaagaggauaaaggauggcuaagagccucaaaaugaaccauaagaucucagauaagaagugauggugauaaaacaucaaaaagugaauggaacaccuugauuggggaagauaugcaaauacuuugaucuaagaauugaaauguaucaagaauuuauauuuugccugcaggaaaauucaaaagcuacucauccucucuauaauuuggagucaucuuacuaaugaaaauaauguuuucccauauauuauuaaaaagcauacagucuaaauaauaaacaguuguaaaauaaugaagguagaaauuauaacacuagggaaaaauuuguagcggauggcaguguugaaggcaaauguaaacauaaggguaauggucugucauggcuuuuagaaaaagaugauagaguucaucauuauuuugccuucaucuuuguuaaggacagaaaauucccugacaggugggcaaguaucagguuaccuauuuuuuauuccuuugguacaaaaggguugaacgucaggcuaaaaaagcagccaugcauuuauuauuaaacauuuucuaccgacaaggcacugugcuagguacuguaauccuaccauaaguagguagguauuucuuccacuguaaaucauagggguuugcuguuuuaugugaguuagccucuuccccuugucugagcauuccucaggggaggucaccugugagguucccagaacuguaguuuuuuuuaccaggguguuguauuuggagggggaggaggacucggcucaaaagagcuagcuggcucuccaguguucagaggugaguccacgauacucuuaccacaauuuggaaguuugugaaucuuuuuaaagaacuaaucaaucucuaauagcauugagguuguaccuacauauuaaguugaauggacuguucuauuuaaaaaauaaacaacuagacaauuaacuaguuuauuaaccuaucacaauugaauuuuuuuuuaauuuucagucuuaacacauuuuuuaaaauguauuaaaguaauacauuguaguaguaggauuauauacuccuuggcugagaauuccaaguacugugguucuacuguuuaguggaaaacucuggaaguuaaaauauagaauaugagaggaggcuuuuuuauaaugggcaucauuguguggaaaaugacccaugugaauacaaauauuuccuaguucagagauuuugguuauaucuggugcuuggaucaaguuuaaaaauggaaggugagauuuugcaugagccuauuaaaaagcauaguaauaaaugcaaggccagcugguggaaaagugaggcagaauggagcuuguuuauagguuuucugauaacaauuauaaaaaaugugcuuuauagauuaagauuuauugaaguauaaauauguaguaaugauauaauguauuuuaaguuauacaagaaaauguagggacuuuuguuugggucuuuuucucuuuguggcugaggggaaacaagucaguguccaauaaagcuguaaacuccucugcucuaagauaaaugaugugauuuauuuauuuauaacuggcuucuuuccaaguagguuuucagguggcauauuuggaagacggcuggaaugacagaauucuuguaucagaguagguaagaagggagcaaccucucaauggcuauuaugucaugcuuuuuaagaucguaugcgguuccuauauacaaggaagcuucccugugguagauuugucauaaaugccaaagauauuugguaaugugaguguagaaaaaguaguaugaggguuggcaaauacuguuuuugucuuggcagcucuaauaucugcauuguucagaaaggauucugaggcuaaggcaaagcucugugggaaaaagggacuggaccaaaaaaaacuggaugguggcacacaagaagaggaaaugaugagauguguacuuucuaucucugguuaggcuuaguccccacuagacaaauugauuuuaaauacuauguagugauuuuuaaauuccauccacacauucauuacccacacagauaaucauagaaauuugggggagugccuagcuucugaugaaguggugauauggcagugccaagcaguggcaucgccagaguaucuguuugguuagcaaaugagcagucauuuuaggucaugcagauugcugauaucugcccaguagccacugagcauuugcugguuuuuucuucuggcuuucuuggagguuaagcucucuguagucauacccaguugguacuugaucuuuagcaauaugucucauauucauguaaauugaagggaggguuacauguacugaaauaaucugcaugcuaggcauuggcuuagacaccguaccuaucucacuuagauuuguggacuaggaaagcaagauucagagaucaugugacuugcauguggccuagagauaaaauucaaaucugguucuguagacuccagggacauauucaccaugccaugggugguggcuauuaaaccuugauaaauuuguguuuaugguuaacaaaugugaaagcuauuaaacauugcugguuugaauuuuuuacagugcagaaauguaaaaugaaaaaggauauuuccuuucacaguguuaccgagaagucaugauaauuucguuuguucuuccagauuuaggcauauacuuauuuaaucaauaauguguuaacagcugacaccugugguugcugugacaggcacuauuugaagugcuuuaucauggauuaacucuuaauccucagcuaccguauaaaguaggacauaaccccauuucacaugcacuacacugagacuugccuccucuccccccacauugaagauguucuuuuuucauaacuauauacuauuccauugcaugaauauucuguaauuuauuuaauccccuauggauugauaauuagguucauuauagauagaaguguaauuaacauuccuguacauguauuuugcuacuuguguggguauuucuguaggaugaauaacuagaaauuuauuggaucagguuucacauuugcaguuuugaaaacuacuaccaaaaagauuucaccaauuuacaacuccaucauuaguaagaaugccuguuugccuauagucugccaacccugaauccuuaaaaauuuuugccaaucugguaggcaaaauuucuuucuuuucuuugaauauuaaugaggaggaacaucuuuucauguuucuuggccauuugcauuuccuauuaugaauugcuuuugcccauuuuccuuuuuuuaauuaugaaagucuaaugacuaccuucucauuguauaaaaaacacaguucuuugaauagagagacccuuuucuccaaugcuaccaaucacauuccacuuaccacaguuuaacauacauccucuagucaccuuuccguacgaauauacauacacauaaaaacacuuuuuacauaaauaggaucucauauucuguagcuuuuuaaaauuuuggucucaaaaaaagauaacaggucuuuaaauuucuuuaaugguugaauaugauuaaauacuaugaaaaugccauuauuuauucccuuaauuuuuuuccucucgcuauuacauugccaaaguaaacauccuauucagaugucuuugugcaugugugugaauauuucuuuagucuggaguccaguaagguggauuuuuggaucaaaggguuuguucucuguccaccuucagucuucccaaaggccuucauaacuguauuuucaccaaguguauggagaauguucauuuccccauauaaccauaccuacacuugauaguuuuuaucuguugggcgaaaaagaaccuuuucuuauuuugcauuucccugauuauaaaaaaaaauggugagauugggguuauuuucauguuuauuggccauuuauaguuuacuguggauuguuuguaucccuuaccugcuuucuauuggguuauguguggauauauuguuuuuauuuguucagcaucuccuuccccaucuucugguaacacaaccuuuauuuauuuguggggaaccuauucccuguggcuuaggugagcaugugaccaggccuggccuccugagucccacagcuuccuagccacagugauaaaagaauggguauauaacuuaagccaggcuaaggaaagcccuuaacagaacuucugcuggaacuacuggaaagaaggcuuuauggagaucccaggaaccaaggaccauguaagccugaauuugugccauguggagagagucugucugaggagaaacucggaugcuagcagaaauggaaagagaacuaaguucugaugucauuuuucuggaggcccuagauccagcugugccuaaagccugcccuaccuccggacuuuaaaguuuugugagccaauaaagucccuuucuuguuuaagauaauugaauugaguuucuguucugauuaauauagguuauuuguauuuucuuauugauuuguagaaaaccuuuguaauuuuaaauucuagacuuuaugcacuauauaaguuaauaaaauuagcauggccuuccaugauuuggccugugucaac

SEQ ID NO: 18491 - RNA, 21253 nt, Homo sapiens
cugacgucaagcugauauaaggaauuuauuguguaaaaaagaaacaucuagagaaugccacagacaggccuaguauggcuacaguaccguauauaaaagacaauugcucacaaugauagcacugaagcacugagagauaucaaaguacuuucugaaucgaaucaaaugauacuuaguguaguuuuaauauccucauauauaucaaaguuuuacuacucugauaauuuuguaaaccagguaaccagaacauccagucauacagcuuuuggugauauauaacuuggcaauaacccagucuggugauacauaaaacuacucacuguacucaucugguauauacccgcacgaacauuuugaaauuccaauuucuuggucaagugauauauugcuugaauucauuaaauauauuuagauuucuguauuauacaaaguuaaauguacaacuaaauuaguauaugaaaagugcucacuacguuuuuacgggaaauaauccugacaaaaauguuuaaugaauguacucuauacuaauucugccuuuuuauacuuaauucuaaauuucuccccucuaauuuacaacaaauuuugugauuuuuauaagaaucuaugccuccccaauucucagauucuucucuuuucuccuuuauuucuuugcuuaaauucaguauaagcuuucuugguauuuuaggcuucaugcacauucuuauuccuaaacaccagcaguucuucagagaccuaaaauccaguauaggaauaacuguguuaguucuugaaaaagcauuaaagacauuuuucccugaaacauacagaacaugucaugccaaaucucuuguuuacauaauaaacugguaauaccggugaauugcacauacagauuuuaucuccaagauagaauaacuuaaauauuaaaacguaccuuuaacugacuuuguaacagacagcaauauucaauacaaaaaucacaaaacccacuaacuuuaaacgcugcauaguacagcauacaaacucaucucccuaugaccuacugaaacuaugacaacuuuuuaagcuacucuagcauuuaaaccuuaacuagaaauuuauacgaaacacgauuuuauguucaaauauggaaauaaguaacauaauuccaaaacccaaaagcaucccagcauucuguaaaaagaaauacccccagcggcuacauccauggucacuagcaucauugugcagcauuucagguaccuuuaaaaaaaaguaagggaaaauaagagugacauuuaaguuuuuagaacuacagauuaguuuuuagaaaaauuuauaggacaguauacuagcuuuauuuguagcuagauauacugugaguuaauuccuuaaaacaugauuacauacauacugacucuagcuaacaaugucacacagcauuuccuagcaguuuaacaaugauuacucaugauguucugggcaagaaaaaguuuguauugguuccaguuuccacuggaaaaugaaaagcgauauugauuuuccuacuucaguuacuggcugcauaucugaacuggauauaacauguaguuugucuuuaguucagagauagaaaaccuuauacuauauaagauacauauugucuuugauugcuuacaaaguaaaaaauaaaaauaaaauaauaaaauacaauuuuagcgguaagauugguugggauuguuuugaggacauuagugacaaaaagauaugacuccuuuguugauuaauaaacuaagcauucugaaguauacagcaugccaacaauaugcaucuuguccuagacuuccuacaaaucuauagaaaauucacugccugauuacugagaucauacccuaaaaugauacaucagaaggauguagauauuuuugugaaucuggacacauauuaagcaagauaaaggugugaucaacaauccaaaaaaaaaaaaaaaacucuaaagaaccuauauucuuauaugccacaaauuucugaauauagaaucacuucucauaaugacugcauuuaaaaucuuuuuuaaaaaaaugauuuuuuuuuugagacagagucuugcucuguuguccaggcuggagugcaguaguacaaucucagcucacugcaaccuccaucuccuggguucaagugauucuccugccucagccucccaaguagcugggacuacaggcgcaugccaccaacccugguuaauuuuuuuguaguuuuuaguugagacaggguuucaccauguuggccagccuggucucgaacuccugaccucacgugaucugccugguuuggucucccaaaauguuggacuaacaggcaugagccaccgugcccagccaaaaaaaaagauauuuuauugagccuauaguccuagcuacucaggaggcugagauggaaggaucauuugggcucaggaauuugagaccagccuggacgacauagcaagauuccacuuccugcucccccaaaaagagagaaaaaaaaugaggcuuuaccgaauauuuucucuauuuuauuguuggucaauaauguaauaagacuucuuaaaaacuuaccauaucaaccagagcaacauacaugaauaagccagcaguaagugcaaauauccacauagaaacauuuucagcauaaugaccaaugaaaauuccuguugccauuccaagauacgccagcauggcugacaaugcauuauaaaggacagccugcuuaacggucaugccagccuuuaguagaacagcaaagucaccuuuaacagaaaacaaaaaaggaggaaaaagucauugagaaaucauuuuuaagacacauaccaagauacuucccagauuuaagaaaauuuuccaguguuuuugagagggggaaaagaaaacaaaauuaagaaugaccuaggguuaaagcaguguuaguaaaucacccuaacagcuguagaaacuauuguuuuuccuuuuuauucuucaucauucaacuugauguacaaacuuuuuuuuuuuuucuuuuuuuugagacaguaucuugcucugucacccaggcuggagugcaguggcaccgaucuuggcucauugcaaccucugcuuccuggguucaagccauuccugugccucagccuccuggguagcuaggacuacaagugcaugccaccacaccuggauaauuuuuuuacuuuuaguagagacgggguuucaccauguugaccagggugguuuugaacuucugaccucaggugauccccuugccccggccucccgaagugcugggauuaaaggcgugagccacugcaccuggccagauaccuuaaccaaaaaaauuuuuuaaggcuuacacuuugucaaaaugauaaacacuaaaaauuuaauauuguggucuugcaguguuuucaaggagcuuggaauuuggccacaaagaagggaggaauggguggagaacacacaugagaugaucagcaaaugauaaugguaaugcauaaaaaacagcugaagaguucaaugcuacaauuauaaaaggagaaaagagacacaugaagauggaaauaagagaggggcuucaugggacuugaauguggaacauagaugcugaagaugauaaggaauggcugaacauauaacaaggaacaaaagugaaaauggcaucagcgguaugugugugaauauaucuccaaaacaagaaaaacaaggacgugaacugggauccagaacuugggaagguuuuaaugccuagugacaaagaagaacaauauugaaaacacaacucauccacuucccuucaauuccaaugagauucucuuucucaacuuuuguuaauggaagaugauuccuuuguauccuguagucuuauucaccuuguguguaugaagaugaucccugaugucaucaguaugcugguuagcagacuuaugagaaggcaugaaauugaugaagaagcuugcugaacuaccauuagcaaaagccagugacacuagaacauuucacccacuuggcaaauacaauuuaugugguucucuuaccuaauucaugaggcaacucaugacagaacacagcaacagaaguacuuaaaccacuugauaagccuucaguaaaagcagcaccuguguaaaaaucaaucagaaaaaguuuggcuacauuaauuuguguuuuuuaaucuuaucaguaugcaaaaugagguaacaagaaaaugguauuuuggcugugaaugaauagaaguuucccaaaccaacucuguaucuucuuuguaagaaaucuuagaguacauuccaugaggucuaaauuucccaaaggagcacaucgggcaugaaagagaagggaagguuuucuaggccuuagaaugagcggauaaaguuauacaaaucugaggaguaacugcuaccauauaaaaggcauauucaagaauauaaaauaaacuguuuaaaagguuuaggaaaaaacucuccugucaaggguauaaacauguuucacuugccucagaggaauuuacuauguaacuagauguuuacauuuauucuuucacuguuucagugagaaaacucuaagacaaauagccguccccuuuuaaaaaucugacauauuauacaaucaaucaauuauaaaccaugacugugcauauauauuuuuuuuuuucagagacaggguuucauucuguuggccagguuggaguauaguggugagaucauagcucacuagaaccucaaacucccgggcucaagcguuccaucuaccucagccuaccaggcagcugggacuacagguguguaccaccauaccuggcuaauuuuuuuuuuuuuuauuuguagagauaaggucucacuaugcugucuaggcuggucuugaacuccugggcuuaagcgauccuccugccuuggccacccaaagugcugggaauacagacaugagcuaccgcacccagccgacugugcaaucggacauuccuccuuugucuguuucagcucugcauaauauaguacaagaggaagagcacucgacucccagggagccaaggccaggccuagcuauaacacagcacagccuccuuggacaaguggcgucaccuugacaggccucagcugccuaauugcaugguuccuuccagcacuaaauuauuaaaauuuguaaguauucuguuaucucccaauugugguauaacaauuuauuagcaaaaguucuauaauucuucauaggauagagacugguaacuggacuuagauguaugaagauuccuuuagcauaaaagaugauggaaaauauaauuuuacuuuuauaaauauuauauuaucgauaagggaacuucaauguauagggagaaaaaaaaaucucauacaugcaccauacaaauuaaagacugaucuuaagaccuugcaauuuaagaacagcuuuugacaguuacaauuuagguaaugggcuagguacaauuccuagcauuuaaucauaccuaacauuuauugagcacuucauugucaaaguaguaaaagaaaaaguaacauuuuuauaaucuuggaagucacuaauauccucaucuaaacuaaucuauucuuuguuaaaauuugacuagguguuuaaugugacauuuucagaaucaaucaacaaggaacaaauauguagauauauaccaauugcuaggccaucgcugaaauugugcaggccaucacccauuaucaccauccaggccagaguggcgacgccggcaucuuucagcuccucccgagaguagcgcuggcugugacugugaggauggugguuuuggugguggugaugauggagaauaugaugguagucaugaugguggugaaugagaucgucugacuggccgaguguaucguggaaaugugaauggcauuuauucuugcacccucuggguacauauucauuguagacuuccuguggaugagcaugagcuaucaugaccucuucuucuuccaagacugcaggcugcugagaaucaaagugggagggcucuugugagucugcucguaaauagccuucaguuccuaggaauaaacauaaagggcauggggacaguuagaaggcuuuguuaauggacuuggagacauuucaaaccucauugaaaaagucaacagaagaucuuaaagcaugauaacuccuucauaucugcagaacuaaauauuaaaguauuacugaugaaaaacaucaaaagauuuuaaugaauuccagaaauggaauggucucaaauauuaagaauggauuuuaaauguuaaccuucaauaacuaccucucagaugcucccucaauuucuucugccucccuaccuuuuuaaaaaugacuuuuuuccucauccuaagagaagaaccugcuuguuuuagaaaacauguuauguuauuuaaaauauuuauuuuagaaaaauaucuuagagaaguaaugaaaauuagaaauaaaaaaacaugcauaauccugccaucugacuuccucuuuuuuggaaggcaaaauucaaggaaaaaacagagaauccgaauuauuucaucaucaccaagaagcauuuauuaucuaucugugcaaaggaaaauaaauugccacaauaagguuauuuuuuuucuccuguacauaguuaucaauuuucuuggaaccaucccugacacugcaguccauuucuagggcagguauuuccuccccaucauuacacauuucacuggaguccauuuaaaaaacugaagagggggccgggcgugguggcucacgccuguaaucccagcacuuugggaggcagaggugggcggaucacaacgucaggggaucgagaccauccuggcuaacauggugaaaccccgucucuacuaaaaauacaaaaaaaauagccaggcaugguggcgggugccuguagucccaguuacucgggaggcugaggcaggagaauggcgugaacccgggaggcggagcuugcagugagcugggaucgcaccacugcacuccagccugggugacagagugagacuccgucucaaaaaaaaaaaaaaaauuaaaacaacaacaacaacaacaacaacaacaacaaccauauaucaaaacaguguggucuaggcacaguggcucaugccugcugucguugggugcugagggaaggccucuaaaggagauaccugauuugagaccugcacaacaagaggaggaaugcauguaauggucucagagaacgguauuccaaguacaaggaauagugagugcauggcccggagacaagccuuaugugcucccagcgugaaaagagggccaguggggcuggagcacagugaacaaugcgggagaguggugggcucagcgggaccuugaagaucauggcaaggagcuggguugaaaacaugaaucuuaacucagucuguccgacaagauaugccaagcaaacagccaaguuucaggaaaaacaggagaaacaugguagauacaaccuuaggcaagugaucaaaauuaccaccaccaauaagugacaaagaaucauaucagguggcacaccaugugacagaaaaggacaaguaccauuuugcgguauuccugccaaaacugaucaaccuaaucaugcaaaaauacuaaacaaacccaaaaguagaggcaacuaaaugcaauauuugauccugaauuguacucuggaacaauauuuugguggggguugggggaguguuggcauaaaaagcacuauuaaggcauuuggaagaauaacgucuacagagaauggcacuguaucaguauaaauuuccugauuuaauaauuaaacucugguuauaugagagaauguccauuuuccuaggaaacauaaguauuuaggaguaaagaaacaucaugucuauaacuuacucucaaaugguuuagaaaaaaaguguguguagcuggcccuuuagucacuaaaaaauuaaagaaaaagguguguguguagacagagcuagagaaagacagugugguaaaauaacuggggaauaugagugaaugggauacaggaauucuuuguacgauucuuaaacuuuucuaugaauaugaauuuacuucaaaauaaaaaguuacagaaaaaauaaauguaaauauacaaaaacaauguacucacuggcaauauuuuacaaaguaugagauacugcaaaaaccaaaaccaagggacauggucccauuucuuccagauagucaaguugccugcaaaucauacagcaaugaacucccuccagcccuaaaauuuaugcauaagaacuuacgaucaucuguaucuacuuucuccucauuuguugaaaguugagauucauacuuggacaacugcuucuuaaucuccacaucaucaucauuuucagguuucuucugauucuaaaauagugagggaaaacaauacuuuaaaacaguaauuuguuuauauguacagcuuucaaucaauaaccagguaagcaaaacacacagaaugcccccacagucaucuacucuuaaguauguucccacacuagcagcacacuaucuccugggaacuugucagaaaugcauacucccggccaggcgcggcggcucacgccuguaaucgcagcacuuugggaggccaaggcaggcagaucaugaggucaggaguucgagaccagccuggccaauacggugaaacuccaucucuacuaaaaauacaaaaauuagccgggugugguggcaugcgccuguauucccagcuacuugggaagcugaggcacaagaauugcuugaacucgggagguggagguugcagugagccaagaucgugccacugcacuccagccugggugacaaagggagacacugucucaaaaaacaacaaaaaaauccagcuaggggcauuuccuucaggcaucuagugaucugguaaccaccugccuggcuucuuccaugccucuucugcacacugaaaccccaaacuucccauacuuuuuauaaccuaaaacuauaguuuuuuaguuauuaaaacacuuuucuuuaauaaaacaccauuaacaugauuucucuuuuaaaacaagccucuauuaacccugaauucaucacugggcuuuuuaaccaucccaaauaccauaccagagauauugucccuaaguccaagcagccuuuauguuguguaaaggucacuguuugaacaauggugucuguguaucaucuacuuauacagaacauuuaaaauaaaaguuaucacauaaauaacagauuucuuauuugcaguaccuuugaauaugaugaucaccaccauaccuaagauuucauucaagcucuaauaccauaucaagugucuauacauucuuagauuuuaagagcuuuuaaaggcaaacacggccgggcaugguggcgaacgccuguaaucccagcacuuugggaggccgaggugggcggaucacaaggucaggagaucgagaccauccuggcuaacauggugaaaccccgucucuacuaaaaauacaaaaaauuagccgggcguguuggcgggugccuguagucccagcuacccaggaggcugaggcaggagaauggcgugaaucugggaggcggagcuugcagugagcagagaucgcgccacugcacuccagccggggcgacagagugagacuccaucucaaaaaaaaaaaaaaaggcaaacacacacacaaaucuuuacacuuauccugaauauaaugccucaaucagagaaaguacuuaaauauuuguaaaaauaaaugaacucaggguaucuuaaaucauuuaugcuggugcuuuauuucucauugggcaauuguucuagaaaguaguuuaaccaauucuuucauuccauaaguauuaagggcccacaguguucccuaugcuaaaugcugggagcagaacauaaaauaagccccacagucucuguucucauggagcuuacuauccacagggagaggguuuuacacagguaaugauuauauacuucuuugacuauaauuuuugacacauuuuacaauagaaaagaacagagugcuauuaagaauguauaauaacaugaccucaauaauuuccagauggccacugaaaaaauauaacuuauaccaagaccuaaagauagguaggaauuugguggggaagguuggggaggcagcauuccaggcagggaguagcaccaggaaggggccagcacuguucuggaacucaaagaaguacaagguggccggggccuacuaggucagagaggguggccagagaugaggcugaggcaacuaaaggagaucagacaauagaacucuguugagaauagugggcuuuguccaaaaacuaauggagccacuggaggaaggauuuuaaguaguggugugcaaccucaucauauuuucauuuaaacaaaucacugcccgcucugugaaaucuagauugggaaaaggaggaaaacaaaauaacguggacaggcuccuauuaggaggcaguaacugucacucaggugggaaguaaccauggccuggacuagaaugacagcaagaaagauggagaggaauggagagaccauggacauauuuauuaaaacuugguuggauguggggaugagggggauaucagagaugauucucuaguuuucggcaugaacaauaaccuucacuagcagaaggugaaccuuaagcagcagaaggccuauaaccuaaaaauaugauauacagaaucucccagggaugcaggauggaucucuuaagaaaaauccuaaguaaaaugcccuguuacgagcuugaagaacuccccauacucacaauauaaugaguaguaguuuucuuuuugagagaauuagauuaaaaauuauuaaguaaguaacuuuaauaucuggaugccuuuaacaaaagauaaacucagcauauuccaaaaagggaagagaacauguaacauuugcaaaacuccuaugggaagucuucaucuagaaauuaugcuuauuugcuguuucaugcuccuuaaacauucaauauuuacuaccaucgauuauguaccagacacuauucuacacauuggagacagagcuguaaacaagacagagagauccuggcuuuuaagagcuuacauucuaguagauacuauuuuaaagcagagugcaucaaacuacucugacuaugacccacauuaauauauguaauguaaaauaguaauauauaauauuauuguugcauuuaaaaauauugguuaugacauacagauugauuuuacaacucacuaacaaucuagaguuauaaccuagaguuaaaaaagaaaaaauuauucugugucagauaacagagggccuauuucuuggaguccuagguuaaagagggcuaaguuaaagaaaagcuauccuuagcugggcaugguggcaugagccuguagucucaguuacuugggaggcugaggugggaggauugcuuaaauccaggaauuugaagcgcaaugagcuaugaucaugccacugcacucuaaccugggcaacagaggaagaugcugucucuuaaaaaaagauacuguuuucuuaaaaaaagaaaaaaaaagaaaagcuguauuuagguaaaauuuggaaaugaaauugaaaugagaauguuaaauaaauuaugacauuuugacccagauguacaguuaaaaaaagaagaaaacaacccaauccccaagucucccagaaugaaaacugaucuuuuuuuuaaauguaagaaaaacugcagaagacuuaaagaaguaggaauaaacuaguccauauauggcagauaaccuaaaacuaugauacaugggaucucccagaggugcaagauggcucucuuaaggaaaauucuaaguaaaaaaugccugaagagcucccaguacucaccauauaaugaguagcuuuuuuuuuucuuuuugagauaauuaaaugagauuagaaacuauucaauaacauuaagaaacaguccaagggaagcaauugcgucaaugggaacacagaagaugacuuccuugauuaagaauaaauaagcuauucuuauuuuacuucuucccucuauauuuagguccacuaaagagaaggcucaaaauuuuuaauuugagauuucagugaacguaaaaucccuaagagcaaauacuccuaguauguaaacacucuccuguuuacacaugcauuuguuucccacagugagcucuaugcucagcaaaaaucaacuguguuaguuuugaaaccucuucacgccaguuauacuuauuacuguaauugcacaauuuaauuacacauugcucaaacuaugaaaugaugguaaggaguuacuucuuuuuugggggguagagacagugucuugcuauguugcccaggcugcucucaaacuccuggccucaagcaauccugcugcuucagccucccaaagugcuaggaucauaggcgugagccaccgugccugguaggggauacuuaauuccgugaacacaaaagcugaauacuuggaagauucaaaggcaaggugcuaaaaaaagauaucaaauuacguaaggcuaccacugaauaaauuuuuuuuuuaaauuuccaaaaccuagauucuacauucagaauagcuuuaaguguguaaucucuuguucaauuuuagagaaaccaaaauuggaaaucauagaugaagcagcauggcugauaaagaaaaaaagaaacgauacagaauacggaacuccaacuugaagaaaauccuggucaauaucaagugaccagaauaugaguguacagauguauuagguuagacuaaaauguugagauaugaacacaucacuuuucuuuucuuuuuuuuuuuuuauuuuuugagacagagucucacuauugcccaggcuggagugcagugguauaaucucagcucacugcagcauccgccucccaaguucaaacaauucuugugccucagccucccaaguagcugagauuacaggcaugcgccaucucaccugauuaauuuuuguauuuguaguacagaugggguuucaccauguuggccaggcuggucucgaacuccuggccuuaagugaucugccugccuuggccucccaaagugcugggauuacaggcaugaaccaccccaccugacccacaucauuuuuaagagucuccugacagucuucugaaugacuugccugaucacaucaaauaaaaaguggcaaauuaccauaggcgacucaaaaggguuuuuuuuggccagaaagaaagagccuauuguuugacuucauaccauuucugauccaauuugcaaagggcaagucuguaaaagucacauacccuuuaaaagaaaacagaacauuuagcuacugggugacuggaaauuaaugacauuaguuaaucguaacuacuaauaaauauugauaguguauccauguauacacgaugcuucuggucuucaaggcccugcugguaccuugucuggucacuuauacagauguucauccuugcuuuucuuauccugucaugaguuucaaaagaauagcaaagacagaaaacuucagagcuauuaagauauagaaaugcuccucauaaauaucucugggaccaaaaaguacuucaaggguacugaacucccucucaaauaaagcucauacaaccugggcaugcuauucuaacaaucuaguuagaguacuacuauaaauaaauaucugaagcauaguaaguacucgguauacuuuuucuuaccuuuuucuucuuaucuuuaaauuguuugaucaaugugaggacauguucaacaagaaacaugaaauacaggccuccuagagcuguuagacccuuccacguggaaucaaaauaggcacuuucuucuauguuuugagaagacagaugacugaaaagugguccucuuuucauuuccauugcugguucuucauggcuaugacuaugguggugacuugcaugagacugaaggcaaaauaauuuguuauuuauaaauucaucaguuucacacaccgagucagaaaguuggcuagguaaggucaaaauugaaaucauucaguuaugcaauuauucagauacuucagagaugaggugaaguuuaggacauuaaaaauaaaaugaccaaugagcagcuagcuaucuagaacuuaaugcaugucauguacuucagauacauucccagugacccccauaauauauaaauagugagcauuuucaaugcuugacgaauuaccauggccacaaauaacaggaauacuagacuuaaugugcacaguuucuacugcuuauuuucccaacugaaaagcccauaccaaugucaucacacuagcauuguaagaagccuaguguguguguguguuggguccuggcauguacccgagauccaggugcacugcccuagcagccuguaacugaguggaguaguaacuacugcuauugcacauuagggaaucggguguggaacacacuaagauacugggggaucacagaguacaccccauacacacgccacuuucuaucaguagguauucccgaaugucugccaucuggugguccgagagcuugucagagcaacauaguuuucuuuaacuacugaauggaacaugagauuuguagugcucuagguauggugugauuuccuuuucccacauacuugaaaaccuuuaaugggaauuuaaagaaugaaacacgcauauuuuuuaacugagcaucuauuccaaauaucugauggaaaaguaaauucacuuuaccaaacuuguuuuaugugucaugaaguguaaaucuuuaaauacauacauaaacauucaacucugaagaaaaccuccaaguuucuuggguacauaaagggucacauauuuuauuucuuggcaauuacacuaacagauaaagcagauaacucacauugcugcagucuaucacaguacuaauagccaggcagaauuugucucuuuuuauuaaguggguuucaaaaaguuaaauuagucuguguuuuguaaaaggaaagcaaaauucacaaauguauuaagaucgagcagaaaaauacagcuuucacuuaccaaauauauuuuaaaauaagcuuuucuaaaccaaauuucuaacauuuuauacaaaaaauucuagcauaaaccaaaacauuuuuuuuucaauguugaauaaucaaacacuaacaggacaaauuacuauacuuacauguggaagaagguguaaaaaagcaucaccacucaaagucccaacggccagugccacaaggaaacucaggagaaauuugaaaaacacccgauucaugagaggcacuaagauaacccccagcagagacaggaaacugaugauggaaauggcuauaaaaccaccaacccaggcugucaaacaaaacaaaacagagcaaagaaaaauuauacaacuaauaaacucuacaagaaagacuuuuggagaguagcauaaagcaacacguaaaaggagagaagcuaaaaacacacaaauucaaugcaaauaggaccuacuguggcaauagcacaauaaccaagaaaucuguuguuggcucaaaugaacaaccugacugguacuuaagaacucuccagguaaggagcauagcucuaaugggaaauucuucaggucggggugaaagaggaaaaaaaaaugguuaccaaggaugaacuguagcucacuuaggaacugagcuuucagacucccauaagagcuaaaugauaaaagaauuuuuuuuuuuuaagaaaaaaggaaaagaaagaaaagaagaggaagaaaccaggaauucaauaauguccucagaaaacaaagcagugauuccuuccucauuacuuuugagcaaugagacccuacgcuauagcagagccuauccuagcuucacuuaucaauaagaaugcaucaguauuagguuucuaagcagcauaaaugaacccaagaccucuucccaagcagugugacaugauauaaaaaucccaaauuucaggugauccugacaccuucuuguaggaugaacccagagaagucauaauugaaauuuuauuuucugggauuuuuuuuuaaagggcagggcuaacacccuuccuugcuuucuucacauucaaggcaaagaacaacuaagaugacauauucagaauuguacuggaaaacaaauaggcugaugcaaaucuaaggaaaagcacaauauaaaugaaucuacugaaauuguuuuuacauaaaaaaggcaauuuuaccuauuuguaaugaauaggucuuuggagggauuucagccuucuuuucacuuguaugaaucagacaagaucuagcaucaauuugguugaugauggcuggacagagauaguugaacucuguugcauucagcggaaccuggaugcccaugccaugagaugucaguagcuuugaugcauugaaacacugaaagaaacaaagcagugaaaaucaccaaaagccauccccauuagaguagucugaugacacaauacccuuuuuuacuaaugcuacuucguuuucucgaguuaaugaaaauuaaaaucaacuucuguuuugagcacuuuggaacuugccuccagcuaccuggcgauacuaugucaccacagugguaucccaccucuucuaccucaucagagaagcaguacaucacgagucaccuagggagaaagccucagguggaacaagcaugaggauaaauggagauucacaagccuguuaacucacuguauaaacguauuaaggaaaugagcuuuaauuucaaaauggggcucaucagagauugagaaauauguugcuucaguacuaacgcuauccuacuuggccuaaacaaguccaagacaugccucucuucuaguaaugacucuacuugcaaaaacucaguucugucuacauaccuggcaaaguaaugcucugcaaugagaggauauuaaauuaugcagauuauucuuguggagggcaaggcugguuaauaaaacaaaccuguaccggcaggcagauguuuucaacuauuuaauuagaugacaaacuuaguuugaagauacuccucugugcaaucucucccccagccaaaaaagaaaaaaaaaaaaaaacaacaaaaaaaccccaaacuggcuuuaguaccaguuucucaucuucuguaaagacauuuucaacucccaccacaauucucaguugguacaacucagagcaaacuuuaucaccagggcugcuauggcuauggccacuacuaggauuaguccagaauuaguacagucacaugcugguuugaaugaaguacuaaaguuuugcuuauuaaacuguaucaacuaauuccuuguuccuuuuuuuuuugacauaauucccuguucuugacaucucucagccaaggugaauuacguacagucuggaagucuacucuagaaaaaccacaugaacucagaaccucacugucccaacuuuucccuuguccagcaugacauucauggaaacugcuccaauuucaaucauuccucaagucaugguggaccuucugucaaggaggcagcagugguauucucaguagucuucagccccuucagucacaccuuucccuacaauauggauucuaacuccugcuuucaaccccucauuuucuauuuuuuauuaauaauguucaccuuuauagacuuucucuaaagauagccuugauaucuuucucuacauauuuuauauucuguauuagaaaaaauuguaggaggcagcacuacgcucaccaaaagaacuguucccuaaguucugaauugggaauguuuacaacauagcaggcaugcuuuguggcaagugccuugcugagaagguggaaauucccuuuucaauaacuucaacauuuuacuuuuacuuuaaacuccucauaacuagagauagaguagcagagacaggacagacacacagguauauuaaaauaaugaacagcacucaucuuaccuccugaggauuuucauuuguguuucuggaauacauaaagccuuuucggggcucacucacagauucauuuguuuuccuaccagccagccggcucacccggcucuuugaugugacacuggguggaguggagcugcuuacaucuuuggggaagaguuuuccaggucuuggagucucuauugucucuagaaagugaguuccuucagagacaguguuguacacaguugaggucacuucacuagcacuaacacuguccuugacauuccuucuaccacuggcauguucuggucggugagcuccuuuccccuggcuguuucuaggaucuuuaccugaacuaucugagucauggucugggcaaagagcuuuucgcuuauuuuuaccagaagcagcaugauuauggugagagugaugaucauggucagagugaugcucgugcucugagugaugcucauggucugagugacgcucauggucugagugaugcucguggucugagugauggucguggucaugguguauauggauucuuuuaaucuuaucuaugccuauauuuugaaguaauuuucugaacccuucaacugacaaagaauuauuuucuccauagcgguagaaaagcuguuguagaugauauugccguguggaaauugccaagucaacauuaaugccagauucccaauucggacuaauuuucucaguggucugggggaaagcagcugcuuuuaguucaugaaggggauuugugacagagagggcaaaggucaggaucaagauuacagauaacuuccucgccauugcgccuuccuagaaaagacaggaaaaaaaaauucuugacucacuucuaaaacaaauugaauuaagaaaccucauacugaaaauuaauguguaaucaaauaaucaaaguugccagagcaucauguggugugaccagugugacgcuagguacugugaagauggaaagaacuagaguccuaggcucuacccuugcauuccuaaaacacaugaaacaacuggagaagagcugagugcuaagagacugccauuagcacuguaaaagcaauaguaauucagagacaagggagauccauguggccacagccaucaacugcuuacugaaguugagaauuuauuugaacgauuauuugaaucauugaggccaaugauucauaauuaaaucuaggcugggugugguggcucaugccuauaaucccagcacuuugggaggcugaggcaggcagaucaccugaggccaggaguuugugaccagccugggcaacauugugaaacccugucucaaaaaaaaaaaagaacgaaaugaaaucuagcuaccuugaucaucaccaucauuucauaaaauaaccuucaaacaccaaaaaauagaaauaauaaucucagaauucacauauuuaaaaaauuuuaaacuaauacacucuccuuacauacaagcccauuuaagaccccuuuccccaaucacaauccucaaaggugcucaauuuugccaguguaucccucaggauauuuucuaugcauacucaaauacauguauacuuaauuuuuuuuuuaaaguuuuuuuuuuuuuuuucuagagacgaggucucacuauguuguccggguuggucuugaacuccuggccucaagagauccuccaccuccaauucccaaagugcugggauuacaggcgugaccacuacgcccagccucaaauaaguguauacuuuaaauacacauugaaucuuuuuuccgacuugacaaugaaucagacacauuauguccauacauagaauucuuaaaguaaacugaacuucaugaaaaacucacuguagcauccuuguguuacuacaaaccagucaacauuuaaucacaggcuguuaaucauccacaguaguguuuggaaccaaaggccugugccccaaagaggaggaagcaauugaguuggagcuugaaaagcagaauucaguuaagcagagccagaauucaguuaauucagauccagcaggauguccagcaccaacgguggaggugaugguggucaaacucacaucuccagcaaaagacgcagacgucaaguuuacaacuaagcaagagcauggggcuauccagcucuaccacggucagcuguucuuuggacagggcucucgcauucauuaccuuaucuaaaauaccgguaaaaccuauuuugcaaggcgaaggaggaaaacacaugaaggaauguauauuacaaguacucguuaaacucauguguugcacaagugcgagguaucauacagggaacagugggaaauggagguacggcguagaacgaggcuccugaaagaggaaucuuuggggcuugaaguuucgggaauucuuuuacuagguaaaagauaaacauuuagaaaucauucccaggagagaggcgaggagcggggugggaggggacuagcacaggggacagcuccgagccuuucuccagggaggaugcugagcgcggucguggacccguugaaggaucuccuuuccugcaaguuggugugugcuggaggaaaaaggaaagcagaagggaagggccuuagagaaaaaggcgaguacagaaaacggaaaagagggcacaaagcucucuucuaaaagcuuuuuauuucuaaacacgucagucccuucuucgaauaugggaugaaaaguacggaucuuuuccucaaaaaauccuccguugcaccccgaagcccaucugagcaccuuaagaaguccggcucucuagggugagugggcgccugcggcgggcuccccccagcauccucuuucuguagccccccugcccgguccgcaggauccgguucuccgcagaaccaccccuaccccgccacgccugucuggccugaggagcuccccucccagccgcccugcucccggaccugaaagacucacgucuccgcggccucguugucccacggcccggccacgcgcgcagguuugguuccacacgggcgguccagagggcucggaacgggcccacuggugucuucgagaaaucucuaccaggcgcgaacacgcggugguuucauuggguuggcugccccucgguccgggggcagcgccgcgcagccacccggcagccgcgccccuagccuucgcgaagcuggaagacaaucacuaauuaccgccgcgcgcagcgccgcggggaaccaccgcccccuucgcccaggacugcagggcaugcgcagugcgaccccggaacccggcuccgcagacggauccgcuuuuccguguguucgccgacgccgcgggggcguggcgcggcccuagcgcauuguaagcaguugggggucauuuccucgaggcccuacucgcuagccagcgcccccggggccagcccuggcugcugcugggagccgggucguaaggggcagcgagauguuucugacgcugccccaggcacaugagccccggguccuucgggagggucccgagccacucgggucggauuucgcucuugagacaaaggccuggcucguucgcggagcggggccacgguccaagagcagagcuagcaaagcggcggccuugcacagggguuccagccugcgguggg

SEQ ID NO: 18492 - RNA, 21253 nt, Homo sapiens
cccaccgcaggcuggaaccccugugcaaggccgccgcuuugcuagcucugcucuuggaccguggccccgcuccgcgaacgagccaggccuuugucucaagagcgaaauccgacccgaguggcucgggacccucccgaaggacccggggcucaugugccuggggcagcgucagaaacaucucgcugccccuuacgacccggcucccagcagcagccagggcuggccccgggggcgcuggcuagcgaguagggccucgaggaaaugacccccaacugcuuacaaugcgcuagggccgcgccacgcccccgcggcgucggcgaacacacggaaaagcggauccgucugcggagccggguuccggggucgcacugcgcaugcccugcaguccugggcgaagggggcggugguuccccgcggcgcugcgcgcggcgguaauuagugauugucuuccagcuucgcgaaggcuaggggcgcggcugccggguggcugcgcggcgcugcccccggaccgaggggcagccaacccaaugaaaccaccgcguguucgcgccugguagagauuucucgaagacaccagugggcccguuccgagcccucuggaccgcccguguggaaccaaaccugcgcgcguggccgggccgugggacaacgaggccgcggagacgugagucuuucagguccgggagcagggcggcugggaggggagcuccucaggccagacaggcguggcgggguaggggugguucugcggagaaccggauccugcggaccgggcaggggggcuacagaaagaggaugcuggggggagcccgccgcaggcgcccacucacccuagagagccggacuucuuaaggugcucagaugggcuucggggugcaacggaggauuuuuugaggaaaagauccguacuuuucaucccauauucgaagaagggacugacguguuuagaaauaaaaagcuuuuagaagagagcuuugugcccucuuuuccguuuucuguacucgccuuuuucucuaaggcccuucccuucugcuuuccuuuuuccuccagcacacaccaacuugcaggaaaggagauccuucaacggguccacgaccgcgcucagcauccucccuggagaaaggcucggagcuguccccugugcuaguccccucccaccccgcuccucgccucucuccugggaaugauuucuaaauguuuaucuuuuaccuaguaaaagaauucccgaaacuucaagccccaaagauuccucuuucaggagccucguucuacgccguaccuccauuucccacuguucccuguaugauaccucgcacuugugcaacacaugaguuuaacgaguacuuguaauauacauuccuucauguguuuuccuccuucgccuugcaaaauagguuuuaccgguauuuuagauaagguaaugaaugcgagagcccuguccaaagaacagcugaccgugguagagcuggauagccccaugcucuugcuuaguuguaaacuugacgucugcgucuuuugcuggagaugugaguuugaccaccaucaccuccaccguuggugcuggacauccugcuggaucugaauuaacugaauucuggcucugcuuaacugaauucugcuuuucaagcuccaacucaauugcuuccuccucuuuggggcacaggccuuugguuccaaacacuacuguggaugauuaacagccugugauuaaauguugacugguuuguaguaacacaaggaugcuacagugaguuuuucaugaaguucaguuuacuuuaagaauucuauguauggacauaaugugucugauucauugucaagucggaaaaaagauucaauguguauuuaaaguauacacuuauuugaggcugggcguaguggucacgccuguaaucccagcacuuugggaauuggagguggaggaucucuugaggccaggaguucaagaccaacccggacaacauagugagaccucgucucuagaaaaaaaaaaaaaaaacuuuaaaaaaaaaauuaaguauacauguauuugaguaugcauagaaaauauccugagggauacacuggcaaaauugagcaccuuugaggauugugauuggggaaaggggucuuaaaugggcuuguauguaaggagaguguauuaguuuaaaauuuuuuaaauaugugaauucugagauuauuauuucuauuuuuugguguuugaagguuauuuuaugaaaugauggugaugaucaagguagcuagauuucauuucguucuuuuuuuuuuuugagacaggguuucacaauguugcccaggcuggucacaaacuccuggccucaggugaucugccugccucagccucccaaagugcugggauuauaggcaugagccaccacacccagccuagauuuaauuaugaaucauuggccucaaugauucaaauaaucguucaaauaaauucucaacuucaguaagcaguugauggcuguggccacauggaucucccuugucucugaauuacuauugcuuuuacagugcuaauggcagucucuuagcacucagcucuucuccaguuguuucauguguuuuaggaaugcaaggguagagccuaggacucuaguucuuuccaucuucacaguaccuagcgucacacuggucacaccacaugaugcucuggcaacuuugauuauuugauuacacauuaauuuucaguaugagguuucuuaauucaauuuguuuuagaagugagucaagaauuuuuuuuuccugucuuuucuaggaaggcgcaauggcgaggaaguuaucuguaaucuugauccugaccuuugcccucucugucacaaauccccuucaugaacuaaaagcagcugcuuucccccagaccacugagaaaauuaguccgaauugggaaucuggcauuaauguugacuuggcaauuuccacacggcaauaucaucuacaacagcuuuucuaccgcuauggagaaaauaauucuuugucaguugaaggguucagaaaauuacuucaaaauauaggcauagauaagauuaaaagaauccauauacaccaugaccacgaccaucacucagaccacgagcaucacucagaccaugagcgucacucagaccaugagcaucacucagagcacgagcaucacucugaccaugaucaucacucucaccauaaucaugcugcuucugguaaaaauaagcgaaaagcucuuugcccagaccaugacucagauaguucagguaaagauccuagaaacagccaggggaaaggagcucaccgaccagaacaugccagugguagaaggaaugucaaggacaguguuagugcuagugaagugaccucaacuguguacaacacugucucugaaggaacucacuuucuagagacaauagagacuccaagaccuggaaaacucuuccccaaagauguaagcagcuccacuccacccagugucacaucaaagagccgggugagccggcuggcugguaggaaaacaaaugaaucugugagugagccccgaaaaggcuuuauguauuccagaaacacaaaugaaaauccucaggagguaagaugagugcuguucauuauuuuaauauaccugugugucuguccugucucugcuacucuaucucuaguuaugaggaguuuaaaguaaaaguaaaauguugaaguuauugaaaagggaauuuccaccuucucagcaaggcacuugccacaaagcaugccugcuauguuguaaacauucccaauucagaacuuagggaacaguucuuuuggugagcguagugcugccuccuacaauuuuuucuaauacagaauauaaaauauguagagaaagauaucaaggcuaucuuuagagaaagucuauaaaggugaacauuauuaauaaaaaauagaaaaugagggguugaaagcaggaguuagaauccauauuguagggaaaggugugacugaaggggcugaagacuacugagaauaccacugcugccuccuugacagaagguccaccaugacuugaggaaugauugaaauuggagcaguuuccaugaaugucaugcuggacaagggaaaaguugggacagugagguucugaguucaugugguuuuucuagaguagacuuccagacuguacguaauucaccuuggcugagagaugucaagaacagggaauuaugucaaaaaaaaaaggaacaaggaauuaguugauacaguuuaauaagcaaaacuuuaguacuucauucaaaccagcaugugacuguacuaauucuggacuaauccuaguaguggccauagccauagcagcccuggugauaaaguuugcucugaguuguaccaacugagaauuguggugggaguugaaaaugucuuuacagaagaugagaaacugguacuaaagccaguuugggguuuuuuuguuguuuuuuuuuuuuuuucuuuuuuggcugggggagagauugcacagaggaguaucuucaaacuaaguuugucaucuaauuaaauaguugaaaacaucugccugccgguacagguuuguuuuauuaaccagccuugcccuccacaagaauaaucugcauaauuuaauauccucucauugcagagcauuacuuugccagguauguagacagaacugaguuuuugcaaguagagucauuacuagaagagaggcaugucuuggacuuguuuaggccaaguaggauagcguuaguacugaagcaacauauuucucaaucucugaugagccccauuuugaaauuaaagcucauuuccuuaauacguuuauacagugaguuaacaggcuugugaaucuccauuuauccucaugcuuguuccaccugaggcuuucucccuaggugacucgugauguacugcuucucugaugagguagaagaggugggauaccacuguggugacauaguaucgccagguagcuggaggcaaguuccaaagugcucaaaacagaaguugauuuuaauuuucauuaacucgagaaaacgaaguagcauuaguaaaaaaggguauugugucaucagacuacucuaauggggauggcuuuuggugauuuucacugcuuuguuucuuucaguguuucaaugcaucaaagcuacugacaucucauggcaugggcauccagguuccgcugaaugcaacagaguucaacuaucucuguccagccaucaucaaccaaauugaugcuagaucuugucugauucauacaagugaaaagaaggcugaaaucccuccaaagaccuauucauuacaaauagguaaaauugccuuuuuuauguaaaaacaauuucaguagauucauuuauauugugcuuuuccuuagauuugcaucagccuauuuguuuuccaguacaauucugaauaugucaucuuaguuguucuuugccuugaaugugaagaaagcaaggaaggguguuagcccugcccuuuaaaaaaaaaucccagaaaauaaaauuucaauuaugacuucucuggguucauccuacaagaaggugucaggaucaccugaaauuugggauuuuuauaucaugucacacugcuugggaagaggucuuggguucauuuaugcugcuuagaaaccuaauacugaugcauucuuauugauaagugaagcuaggauaggcucugcuauagcguagggucucauugcucaaaaguaaugaggaaggaaucacugcuuuguuuucugaggacauuauugaauuccugguuucuuccucuucuuuucuuucuuuuccuuuuuucuuaaaaaaaaaaaauucuuuuaucauuuagcucuuaugggagucugaaagcucaguuccuaagugagcuacaguucauccuugguaaccauuuuuuuuuccucuuucaccccgaccugaagaauuucccauuagagcuaugcuccuuaccuggagaguucuuaaguaccagucagguuguucauuugagccaacaacagauuucuugguuauugugcuauugccacaguagguccuauuugcauugaauuuguguguuuuuagcuucucuccuuuuacguguugcuuuaugcuacucuccaaaagucuuucuuguagaguuuauuaguuguauaauuuuucuuugcucuguuuuguuuuguuugacagccuggguuggugguuuuauagccauuuccaucaucaguuuccugucucugcuggggguuaucuuagugccucucaugaaucggguguuuuucaaauuucuccugaguuuccuuguggcacuggccguugggacuuugaguggugaugcuuuuuuacaccuucuuccacauguaaguauaguaauuuguccuguuaguguuugauuauucaacauugaaaaaaaaauguuuugguuuaugcuagaauuuuuuguauaaaauguuagaaauuugguuuagaaaagcuuauuuuaaaauauauuugguaagugaaagcuguauuuuucugcucgaucuuaauacauuugugaauuuugcuuuccuuuuacaaaacacagacuaauuuaacuuuuugaaacccacuuaauaaaaagagacaaauucugccuggcuauuaguacugugauagacugcagcaaugugaguuaucugcuuuaucuguuaguguaauugccaagaaauaaaauaugugacccuuuauguacccaagaaacuuggagguuuucuucagaguugaauguuuauguauguauuuaaagauuuacacuucaugacacauaaaacaaguuugguaaagugaauuuacuuuuccaucagauauuuggaauagaugcucaguuaaaaaauaugcguguuucauucuuuaaauucccauuaaagguuuucaaguaugugggaaaaggaaaucacaccauaccuagagcacuacaaaucucauguuccauucaguaguuaaagaaaacuauguugcucugacaagcucucggaccaccagauggcagacauucgggaauaccuacugauagaaaguggcguguguaugggguguacucugugaucccccaguaucuuaguguguuccacacccgauucccuaaugugcaauagcaguaguuacuacuccacucaguuacaggcugcuagggcagugcaccuggaucucggguacaugccaggacccaacacacacacacacuaggcuucuuacaaugcuagugugaugacauugguaugggcuuuucaguugggaaaauaagcaguagaaacugugcacauuaagucuaguauuccuguuauuuguggccaugguaauucgucaagcauugaaaaugcucacuauuuauauauuaugggggucacugggaauguaucugaaguacaugacaugcauuaaguucuagauagcuagcugcucauuggucauuuuauuuuuaauguccuaaacuucaccucaucucugaaguaucugaauaauugcauaacugaaugauuucaauuuugaccuuaccuagccaacuuucugacucggugugugaaacugaugaauuuauaaauaacaaauuauuuugccuucagucucaugcaagucaccaccauagucauagccaugaagaaccagcaauggaaaugaaaagaggaccacuuuucagucaucugucuucucaaaacauagaagaaagugccuauuuugauuccacguggaagggucuaacagcucuaggaggccuguauuucauguuucuuguugaacauguccucacauugaucaaacaauuuaaagauaagaagaaaaagguaagaaaaaguauaccgaguacuuacuaugcuucagauauuuauuuauaguaguacucuaacuagauuguuagaauagcaugcccagguuguaugagcuuuauuugagagggaguucaguacccuugaaguacuuuuuggucccagagauauuuaugaggagcauuucuauaucuuaauagcucugaaguuuucugucuuugcuauucuuuugaaacucaugacaggauaagaaaagcaaggaugaacaucuguauaagugaccagacaagguaccagcagggccuugaagaccagaagcaucguguauacauggauacacuaucaauauuuauuaguaguuacgauuaacuaaugucauuaauuuccagucacccaguagcuaaauguucuguuuucuuuuaaaggguaugugacuuuuacagacuugcccuuugcaaauuggaucagaaaugguaugaagucaaacaauaggcucuuucuuucuggccaaaaaaaacccuuuugagucgccuaugguaauuugccacuuuuuauuugaugugaucaggcaagucauucagaagacugucaggagacucuuaaaaaugaugugggucagguggggugguucaugccuguaaucccagcacuuugggaggccaaggcaggcagaucacuuaaggccaggaguucgagaccagccuggccaacauggugaaaccccaucuguacuacaaauacaaaaauuaaucaggugagauggcgcaugccuguaaucucagcuacuugggaggcugaggcacaagaauuguuugaacuugggaggcggaugcugcagugagcugagauuauaccacugcacuccagccugggcaauagugagacucugucucaaaaaauaaaaaaaaaaaaagaaaagaaaagugauguguucauaucucaacauuuuagucuaaccuaauacaucuguacacucauauucuggucacuugauauugaccaggauuuucuucaaguuggaguuccguauucuguaucguuucuuuuuuucuuuaucagccaugcugcuucaucuaugauuuccaauuuugguuucucuaaaauugaacaagagauuacacacuuaaagcuauucugaauguagaaucuagguuuuggaaauuuaaaaaaaaaauuuauucagugguagccuuacguaauuugauaucuuuuuuuagcaccuugccuuugaaucuuccaaguauucagcuuuuguguucacggaauuaaguauccccuaccaggcacgguggcucacgccuaugauccuagcacuuugggaggcugaagcagcaggauugcuugaggccaggaguuugagagcagccugggcaacauagcaagacacugucucuaccccccaaaaaagaaguaacuccuuaccaucauuucauaguuugagcaauguguaauuaaauugugcaauuacaguaauaaguauaacuggcgugaagagguuucaaaacuaacacaguugauuuuugcugagcauagagcucacugugggaaacaaaugcauguguaaacaggagaguguuuacauacuaggaguauuugcucuuagggauuuuacguucacugaaaucucaaauuaaaaauuuugagccuucucuuuaguggaccuaaauauagagggaagaaguaaaauaagaauagcuuauuuauucuuaaucaaggaagucaucuucuguguucccauugacgcaauugcuucccuuggacuguuucuuaauguuauugaauaguuucuaaucucauuuaauuaucucaaaaagaaaaaaaaaagcuacucauuauauggugaguacugggagcucuucaggcauuuuuuacuuagaauuuuccuuaagagagccaucuugcaccucugggagaucccauguaucauaguuuuagguuaucugccauauauggacuaguuuauuccuacuucuuuaagucuucugcaguuuuucuuacauuuaaaaaaaagaucaguuuucauucugggagacuuggggauuggguuguuuucuucuuuuuuuaacuguacaucugggucaaaaugucauaauuuauuuaacauucucauuucaauuucauuuccaaauuuuaccuaaauacagcuuuucuuuuuuuuucuuuuuuuaagaaaacaguaucuuuuuuuaagagacagcaucuuccucuguugcccagguuagagugcaguggcaugaucauagcucauugcgcuucaaauuccuggauuuaagcaauccucccaccucagccucccaaguaacugagacuacaggcucaugccaccaugcccagcuaaggauagcuuuucuuuaacuuagcccucuuuaaccuaggacuccaagaaauaggcccucuguuaucugacacagaauaauuuuuucuuuuuuaacucuagguuauaacucuagauuguuagugaguuguaaaaucaaucuguaugucauaaccaauauuuuuaaaugcaacaauaauauuauauauuacuauuuuacauuacauauauuaaugugggucauagucagaguaguuugaugcacucugcuuuaaaauaguaucuacuagaauguaagcucuuaaaagccaggaucucucugucuuguuuacagcucugucuccaauguguagaauagugucugguacauaaucgaugguaguaaauauugaauguuuaaggagcaugaaacagcaaauaagcauaauuucuagaugaagacuucccauaggaguuuugcaaauguuacauguucucuucccuuuuuggaauaugcugaguuuaucuuuuguuaaaggcauccagauauuaaaguuacuuacuuaauaauuuuuaaucuaauucucucaaaaagaaaacuacuacucauuauauugugaguauggggaguucuucaagcucguaacagggcauuuuacuuaggauuuuucuuaagagauccauccugcaucccugggagauucuguauaucauauuuuuagguuauaggccuucugcugcuuaagguucaccuucugcuagugaagguuauuguucaugccgaaaacuagagaaucaucucugauaucccccucauccccacauccaaccaaguuuuaauaaauauguccauggucucuccauuccucuccaucuuucuugcugucauucuaguccaggccaugguuacuucccaccugagugacaguuacugccuccuaauaggagccuguccacguuauuuuguuuuccuccuuuucccaaucuagauuucacagagcgggcagugauuuguuuaaaugaaaauaugaugagguugcacaccacuacuuaaaauccuuccuccaguggcuccauuaguuuuuggacaaagcccacuauucucaacagaguucuauugucugaucuccuuuaguugccucagccucaucucuggccacccucucugaccuaguaggccccggccaccuuguacuucuuugaguuccagaacagugcuggccccuuccuggugcuacucccugccuggaaugcugccuccccaaccuuccccaccaaauuccuaccuaucuuuaggucuugguauaaguuauauuuuuucaguggccaucuggaaauuauugaggucauguuauuauacauucuuaauagcacucuguucuuuucuauuguaaaaugugucaaaaauuauagucaaagaaguauauaaucauuaccuguguaaaacccucucccuguggauaguaagcuccaugagaacagagacuguggggcuuauuuuauguucugcucccagcauuuagcauagggaacacugugggcccuuaauacuuauggaaugaaagaauugguuaaacuacuuucuagaacaauugcccaaugagaaauaaagcaccagcauaaaugauuuaagauacccugaguucauuuauuuuuacaaauauuuaaguacuuucucugauugaggcauuauauucaggauaaguguaaagauuuguguguguguuugccuuuuuuuuuuuuuuugagauggagucucacucugucgccccggcuggagugcaguggcgcgaucucugcucacugcaagcuccgccucccagauucacgccauucuccugccucagccuccuggguagcugggacuacaggcacccgccaacacgcccggcuaauuuuuuguauuuuuaguagagacgggguuucaccauguuagccaggauggucucgaucuccugaccuugugauccgcccaccucggccucccaaagugcugggauuacaggcguucgccaccaugcccggccguguuugccuuuaaaagcucuuaaaaucuaagaauguauagacacuugauaugguauuagagcuugaaugaaaucuuagguaugguggugaucaucauauucaaagguacugcaaauaagaaaucuguuauuuaugugauaacuuuuauuuuaaauguucuguauaaguagaugauacacagacaccauuguucaaacagugaccuuuacacaacauaaaggcugcuuggacuuagggacaauaucucugguaugguauuugggaugguuaaaaagcccagugaugaauucaggguuaauagaggcuuguuuuaaaagagaaaucauguuaaugguguuuuauuaaagaaaaguguuuuaauaacuaaaaaacuauaguuuuagguuauaaaaaguaugggaaguuugggguuucagugugcagaagaggcauggaagaagccaggcaggugguuaccagaucacuagaugccugaaggaaaugccccuagcuggauuuuuuuguuguuuuuugagacagugucucccuuugucacccaggcuggagugcaguggcacgaucuuggcucacugcaaccuccaccucccgaguucaagcaauucuugugccucagcuucccaaguagcugggaauacaggcgcaugccaccacacccggcuaauuuuuguauuuuuaguagagauggaguuucaccguauuggccaggcuggucucgaacuccugaccucaugaucugccugccuuggccucccaaagugcugcgauuacaggcgugagccgccgcgccuggccgggaguaugcauuucugacaaguucccaggagauagugugcugcuagugugggaacauacuuaagaguagaugacugugggggcauucuguguguuuugcuuaccugguuauugauugaaagcuguacauauaaacaaauuacuguuuuaaaguauuguuuucccucacuauuuuagaaucagaagaaaccugaaaaugaugaugauguggagauuaagaagcaguuguccaaguaugaaucucaacuuucaacaaaugaggagaaaguagauacagaugaucguaaguucuuaugcauaaauuuuagggcuggagggaguucauugcuguaugauuugcaggcaacuugacuaucuggaagaaaugggaccaugucccuugguuuugguuuuugcaguaucucauacuuuguaaaauauugccagugaguacauuguuuuuguauauuuacauuuauuuuuucuguaacuuuuuauuuugaaguaaauucauauucauagaaaaguuuaagaaucguacaaagaauuccuguaucccauucacucauauuccccaguuauuuuaccacacugucuuucucuagcucugucuacacacacaccuuuuucuuuaauuuuuuagugacuaaagggccagcuacacacacuuuuuuucuaaaccauuugagaguaaguuauagacaugauguuucuuuacuccuaaauacuuauguuuccuaggaaaauggacauucucucauauaaccagaguuuaauuauuaaaucaggaaauuuauacugauacagugccauucucuguagacguuauucuuccaaaugccuuaauagugcuuuuuaugccaacacucccccaacccccaccaaaauauuguuccagaguacaauucaggaucaaauauugcauuuaguugccucuacuuuuggguuuguuuaguauuuuugcaugauuagguugaucaguuuuggcaggaauaccgcaaaaugguacuuguccuuuucugucacauggugugccaccugauaugauucuuugucacuuauugguggugguaauuuugaucacuugccuaagguuguaucuaccauguuucuccuguuuuuccugaaacuuggcuguuugcuuggcauaucuugucggacagacugaguuaagauucauguuuucaacccagcuccuugccaugaucuucaaggucccgcugagcccaccacucucccgcauuguucacugugcuccagccccacuggcccucuuuucacgcugggagcacauaaggcuugucuccgggccaugcacucacuauuccuuguacuuggaauaccguucucugagaccauuacaugcauuccuccucuuguugugcaggucucaaaucagguaucuccuuuagaggccuucccucagcacccaacgacagcaggcaugagccacugugccuagaccacacuguuuugauauaugguuguuguuguuguuguuguuguuguuguuguuuuaauuuuuuuuuuuuuuuugagacggagucucacucugucacccaggcuggagugcaguggugcgaucccagcucacugcaagcuccgccucccggguucacgccauucuccugccucagccucccgaguaacugggacuacaggcacccgccaccaugccuggcuauuuuuuuuguauuuuuaguagagacgggguuucaccauguuagccaggauggucucgauccccugacguugugauccgcccaccucugccucccaaagugcugggauuacaggcgugagccaccacgcccggcccccucuucaguuuuuuaaauggacuccagugaaauguguaaugauggggaggaaauaccugcccuagaaauggacugcagugucagggaugguuccaagaaaauugauaacuauguacaggagaaaaaaaauaaccuuauuguggcaauuuauuuuccuuugcacagauagauaauaaaugcuucuuggugaugaugaaauaauucggauucucuguuuuuuccuugaauuuugccuuccaaaaaagaggaagucagauggcaggauuaugcauguuuuuuuauuucuaauuuucauuacuucucuaagauauuuuucuaaaauaaauauuuuaaauaacauaacauguuuucuaaaacaagcagguucuucucuuaggaugaggaaaaaagucauuuuuaaaaagguagggaggcagaagaaauugagggagcaucugagagguaguuauugaagguuaacauuuaaaauccauucuuaauauuugagaccauuccauuucuggaauucauuaaaaucuuuugauguuuuucaucaguaauacuuuaauauuuaguucugcagauaugaaggaguuaucaugcuuuaagaucuucuguugacuuuuucaaugagguuugaaaugucuccaaguccauuaacaaagccuucuaacuguccccaugcccuuuauguuuauuccuaggaacugaaggcuauuuacgagcagacucacaagagcccucccacuuugauucucagcagccugcagucuuggaagaagaagaggucaugauagcucaugcucauccacaggaagucuacaaugaauauguacccagagggugcaagaauaaaugccauucacauuuccacgauacacucggccagucagacgaucucauucaccaccaucaugacuaccaucauauucuccaucaucaccaccaccaaaaccaccauccucacagucacagccagcgcuacucucgggaggagcugaaagaugccggcgucgccacucuggccuggauggugauaaugggugauggccugcacaauuucagcgauggccuagcaauugguauauaucuacauauuuguuccuuguugauugauucugaaaaugucacauuaaacaccuagucaaauuuuaacaaagaauagauuaguuuagaugaggauauuagugacuuccaagauuauaaaaauguuacuuuuucuuuuacuacuuugacaaugaagugcucaauaaauguuagguaugauuaaaugcuaggaauuguaccuagcccauuaccuaaauuguaacugucaaaagcuguucuuaaauugcaaggucuuaagaucagucuuuaauuuguauggugcauguaugagauuuuuuuuucucccuauacauugaaguucccuuaucgauaauauaauauuuauaaaaguaaaauuauauuuuccaucaucuuuuaugcuaaaggaaucuucauacaucuaaguccaguuaccagucucuauccuaugaagaauuauagaacuuuugcuaauaaauuguuauaccacaauugggagauaacagaauacuuacaaauuuuaauaauuuagugcuggaaggaaccaugcaauuaggcagcugaggccugucaaggugacgccacuuguccaaggaggcugugcuguguuauagcuaggccuggccuuggcucccugggagucgagugcucuuccucuuguacuauauuaugcagagcugaaacagacaaaggaggaauguccgauugcacagucggcugggugcgguagcucaugucuguauucccagcacuuuggguggccaaggcaggaggaucgcuuaagcccaggaguucaagaccagccuagacagcauagugagaccuuaucucuacaaauaaaaaaaaaaaaaauuagccagguauggugguacacaccuguagucccagcugccugguaggcugagguagauggaacgcuugagcccgggaguuugagguucuagugagcuaugaucucaccacuauacuccaaccuggccaacagaaugaaacccugucucugaaaaaaaaaaauauauaugcacagucaugguuuauaauugauugauuguauaauaugucagauuuuuaaaaggggacggcuauuugucuuagaguuuucucacugaaacagugaaagaauaaauguaaacaucuaguuacauaguaaauuccucugaggcaagugaaacauguuuauacccuugacaggagaguuuuuuccuaaaccuuuuaaacaguuuauuuuauauucuugaauaugccuuuuauaugguagcaguuacuccucagauuuguauaacuuuauccgcucauucuaaggccuagaaaaccuucccuucucuuucaugcccgaugugcuccuuugggaaauuuagaccucauggaauguacucuaagauuucuuacaaagaagauacagaguugguuugggaaacuucuauucauucacagccaaaauaccauuuucuuguuaccucauuuugcauacugauaagauuaaaaaacacaaauuaauguagccaaacuuuuucugauugauuuuuacacaggugcugcuuuuacugaaggcuuaucaagugguuuaaguacuucuguugcuguguucugucaugaguugccucaugaauuagguaagagaaccacauaaauuguauuugccaagugggugaaauguucuagugucacuggcuuuugcuaaugguaguucagcaagcuucuucaucaauuucaugccuucucauaagucugcuaaccagcauacugaugacaucagggaucaucuucauacacacaaggugaauaagacuacaggauacaaaggaaucaucuuccauuaacaaaaguugagaaagagaaucucauuggaauugaagggaaguggaugaguuguguuuucaauauuguucuucuuugucacuaggcauuaaaaccuucccaaguucuggaucccaguucacguccuuguuuuucuuguuuuggagauauauucacacacauaccgcugaugccauuuucacuuuuguuccuuguuauauguucagccauuccuuaucaucuucagcaucuauguuccacauucaagucccaugaagccccucucuuauuuccaucuucaugugucucuuuucuccuuuuauaauuguagcauugaacucuucagcuguuuuuuaugcauuaccauuaucauuugcugaucaucucauguguguucuccacccauuccucccuucuuuguggccaaauuccaagcuccuugaaaacacugcaagaccacaauauuaaauuuuuaguguuuaucauuuugacaaaguguaagccuuaaaaaauuuuuuugguuaagguaucuggccaggugcaguggcucacgccuuuaaucccagcacuucgggaggccggggcaaggggaucaccugaggucagaaguucaaaaccacccuggucaacauggugaaaccccgucucuacuaaaaguaaaaaaauuauccaggugugguggcaugcacuuguaguccuagcuacccaggaggcugaggcacaggaauggcuugaacccaggaagcagagguugcaaugagccaagaucggugccacugcacuccagccugggugacagagcaagauacugucucaaaaaaaagaaaaaaaaaaaaaguuuguacaucaaguugaaugaugaagaauaaaaaggaaaaacaauaguuucuacagcuguuagggugauuuacuaacacugcuuuaacccuaggucauucuuaauuuuguuuucuuuucccccucucaaaaacacuggaaaauuuucuuaaaucugggaaguaucuugguaugugucuuaaaaaugauuucucaaugacuuuuuccuccuuuuuuguuuucuguuaaaggugacuuugcuguucuacuaaaggcuggcaugaccguuaagcaggcuguccuuuauaaugcauugucagccaugcuggcguaucuuggaauggcaacaggaauuuucauuggucauuaugcugaaaauguuucuauguggauauuugcacuuacugcuggcuuauucauguauguugcucugguugauaugguaaguuuuuaagaagucuuauuacauuauugaccaacaauaaaauagagaaaauauucgguaaagccucauuuuuuuucucucuuuuugggggagcaggaaguggaaucuugcuaugucguccaggcuggucucaaauuccugagcccaaaugauccuuccaucucagccuccugaguagcuaggacuauaggcucaauaaaauaucuuuuuuuuuggcugggcacgguggcucaugccuguuaguccaacauuuugggagaccaaaccaggcagaucacgugaggucaggaguucgagaccaggcuggccaacauggugaaacccugucucaacuaaaaacuacaaaaaaauuaaccaggguugguggcaugcgccuguagucccagcuacuugggaggcugaggcaggagaaucacuugaacccaggagauggagguugcagugagcugagauuguacuacugcacuccagccuggacaacagagcaagacucugucucaaaaaaaaaaucauuuuuuuaaaaaagauuuuaaaugcagucauuaugagaagugauucuauauucagaaauuuguggcauauaagaauauagguucuuuagaguuuuuuuuuuuuuuuuggauuguugaucacaccuuuaucuugcuuaauauguguccagauucacaaaaauaucuacauccuucugauguaucauuuuaggguaugaucucaguaaucaggcagugaauuuucuauagauuuguaggaagucuaggacaagaugcauauuguuggcaugcuguauacuucagaaugcuuaguuuauuaaucaacaaaggagucauaucuuuuugucacuaauguccucaaaacaaucccaaccaaucuuaccgcuaaaauuguauuuuauuauuuuauuuuuauuuuuuacuuuguaagcaaucaaagacaauauguaucuuauauaguauaagguuuucuaucucugaacuaaagacaaacuacauguuauauccaguucagauaugcagccaguaacugaaguaggaaaaucaauaucgcuuuucauuuuccaguggaaacuggaaccaauacaaacuuuuucuugcccagaacaucaugaguaaucauuguuaaacugcuaggaaaugcugugugacauuguuagcuagagucaguauguauguaaucauguuuuaaggaauuaacucacaguauaucuagcuacaaauaaagcuaguauacuguccuauaaauuuuucuaaaaacuaaucuguaguucuaaaaacuuaaaugucacucuuauuuucccuuacuuuuuuuuaaagguaccugaaaugcugcacaaugaugcuagugaccauggauguagccgcuggggguauuucuuuuuacagaaugcugggaugcuuuuggguuuuggaauuauguuacuuauuuccauauuugaacauaaaaucguguuucguauaaauuucuaguuaagguuuaaaugcuagaguagcuuaaaaaguugucauaguuucaguaggucauagggagaugaguuuguaugcuguacuaugcagcguuuaaaguuaguggguuuugugauuuuuguauugaauauugcugucuguuacaaagucaguuaaagguacguuuuaauauuuaaguuauucuaucuuggagauaaaaucuguaugugcaauucaccgguauuaccaguuuauuauguaaacaagagauuuggcaugacauguucuguauguuucagggaaaaaugucuuuaaugcuuuuucaagaacuaacacaguuauuccuauacuggauuuuaggucucugaagaacugcugguguuuaggaauaagaaugugcaugaagccuaaaauaccaagaaagcuuauacugaauuuaagcaaagaaauaaaggagaaaagagaagaaucugagaauuggggaggcauagauucuuauaaaaaucacaaaauuuguuguaaauuagaggggagaaauuuagaauuaaguauaaaaaggcagaauuaguauagaguacauucauuaaacauuuuugucaggauuauuucccguaaaaacguagugagcacuuuucauauacuaauuuaguuguacauuuaacuuuguauaauacagaaaucuaaauauauuuaaugaauucaagcaauauaucacuugaccaagaaauuggaauuucaaaauguucgugcggguauauaccagaugaguacagugaguaguuuuauguaucaccagacuggguuauugccaaguuauauaucaccaaaagcuguaugacuggauguucugguuaccugguuuacaaaauuaucagaguaguaaaacuuugauauauaugaggauauuaaaacuacacuaaguaucauuugauucgauucagaaaguacuuugauaucucucagugcuucagugcuaucauugugagcaauugucuuuuauauacgguacuguagccauacuaggccugucuguggcauucucuagauguuucuuuuuuacacaauaaauuccuuauaucagcuugacgucag

SEQ ID NO: 18493 - RNA, 2214 nt, Homo sapiens
guggggcccaggaaccugcauuuucaauaagcaagacagaugauuccaauggacagccucacuuuacucaucuaguuaagugguucccaaacuugacugauucucagaauuaacuggggaguuuuauuuuuaaugaaauucuguuggauaguuuaugucccaugacuuguucuggguuggcaguacaugcacccaggaagagugaaaagucagauucucacuccccuguucuccaagugugcauccccaguggcagcugcuauuacgaguuuccuguacgcccuucccaagauacucauugcacauaaagcaugcaugcacacuuuugguguuccuuuuuucuaaaucucaaguguaauguacugucaacaugauucugcaucuuguucuuuucacauaacacuccaucuuggggcuuauucccuuucaguacauuuagggcacuuguccucuucaguggcuacagaguauuccauugugugggugugccucauuuauauuacaggucuggucaccauuucaggcauacagaugccagguauacaaccugguuugaaaacaccaaguguggcuggaaaaacuuuugacuagaaugagcucaucugggcuccuucguggugguuucuugcagcuauaaauuagcagcaaauuaggaacucagcuccagcucaccuuacuguguauguauucaucuaguaggcuucauuuucuucaaaugucacauaauuauaacauuuaucuggucaacauugagaggcggcugugauuuaaaagguaaauaaauguggaugcccuuugcccucagcugccaaaaaaaaaaaacaguaggaaacagaacaccaacaagauacagcaucccucagcagaggcccacacuagccucugucuccugccuuuccugggggaauggugcugccagaauccaccugauggggaguagcugguuugagggcagaacaauagacgcuguccucuagugcuuugggaucuagcaucccaggcucaggacucacuaaaucagaaggaggugugcucagauucuuaguuuucauacugcauuuaucuuaaagguccugagaccucauaaagcaaugugucuaucuuaccagagguugaugggaucuguuaucaccuccacuuaaaggaagagcaaauagauuuuuaggcaguuuuucaugaaaauguaccucugccuccuguucccaacucuccugcaucccacaaaaagagcacacagaauggcauuuuuccuuugaauugugaccuugucuuccaauucugccuuacagcaaugguucagcauguauaaaccuaucaccuacaacacaaaccugcucacagaagagaccgacuccuuugugaauaagcuagaucccagcaaaguguuuaagagcaagaacaagaucguaaucccaaaaaagaaagggccugugcagccugcagguggccagaaagggcccucaggacccuccggucccuccacuuccuccacuucuaaauccuccucuggcucuggaaaccccacccggaagugagcaccccucccuccaacucccuaccagcuccagaguggugguuuccaugcacagauggcccuaggggugaccuccaguuuugcguguggaccguaggccucuuucuaguugaaugaccaaaauuguaaggcuuuuagucccaccgacauuagccaggcucguagugaggccuccagagcagguugugcuguccccugccucuggaagcaauggggaauuuggaaucuuguguaagugcccaaauaagucugagugcuuuccucuucuucaacacucaacccucaaucccuuagcacugauugauuagagaggucccccaaagaaaccacugguuuugacccaugaagcauuagaacugcauuguucauucaggagccacuagucacauaugacuauuuaaauuuaaaguaaauuguaugaaaaauucauuucuucaauugcauuagccacauuuugaguauucauguggcugguagauucuguauuagcacaaagauauggaacauuuccaucaccacagaaaguucuguuggacagcacugcauuagaauauuuucauacugcucuuccucaauuaauuuuuguuguuaauguugaugucuucauuggaugggucauaauguuccaugaaaccucucaaguacacaauuguauguucuuuguaucccuuaccacaaau

SEQ ID NO: 18494 - RNA, 4508 nt, Homo sapiens
uugucauuucauucaagagaauuaaaucguuuauugauuacacaugauaauggauacacaagcuucauucccaucuauaauuuuaucugguaccauuauucaauuuagauauauugcauaggaugugccaacaaucacuuuuauaaccauuccaugauuuugcuuggguaaucccuuuuaauggugaacuucaggucacaacaguaacuaucaguucaacuacaccaagguuuccgaagacaauggcuucuccacccaagcagguuguauauaaauuccaaauagaaccuggcaucacccugaaggaauucuaacuucacacuguuggggaaauuuaccaagauggcuuaagaguagacuaacuuuacacagcacauuaaaaaaaagacauuuauucagcgucacgaucagacuguuacauuuagcaaucaacagcauggggugcaaaaaaaaaaaucuacauuaaaacccuuuguuggaaugcuuuacacuuuccacagaacagaaacuaaaauaaccuguuauacaauuagucacaaauacaguccucgaguuuuuugcccauacacaugaguauuugucuaaaacaugucuucuuuguagcagcuaggcccugccaccacugugcuuggcugaguucacaaaucuguuguaaccuguagcuucccugucacuucucuggcucuccucuccugcuaagcuuuguuuccuguugaacaauauggaauaaaguuguuaaucuaaacauauuaagacucaaggcuacaauccaauaucaaguuuguuucccacaaauuuugcugaucugaauauuaacuuuauauccacaauuacugcaauuauaauguuaacuauguugcacugcucagcuacauuaggguuauuggguucaucagcaauuuaaaaaauuaugucaacacacaaaaaggugcuuacuuaccuaauuaaaaucuucugccacugccauagcuacugcugcugcuggaaccgccauagccaccugaaaaguacaauuuuucuuuuaaaguuucaaagugccaacaguaauguuuucauauuugggauaauaaaaguuaaauucaagugucuggccauuuaaaaauggcccuacuacaagggaggugguaaagaggucccaugauuuuucuaauuugugaucaaauuaucacuuucugaagguucuaaacuauaaacguuuugcugcccagacauagcaguuaaagggcuuucuucccagcaguagcuacagacacucuuuugacauuauccaaaauuacauagauaccauaccuugguuucgugguuuugcaaaguauuggccuccaccgccauaggggccagagcuucugccuccaaaauuuccucccuucauggguccaaaauuugaagacugauuguuguaauucccaaaaucauuguagcuuccaccaccuccaaaauugcuuccuaugaaugggaaagagggccuuuaucuguuaccugaggaugauguuaguuuccaauucuguuuagcagucagaauaaaauaagguugaguuaucagccuuccuuucucccaaacuauggugacuccaaucuuugcauuucauucucugggaaaggcauucaguugaauaauccaguaauacaaagaaaacuggccuaacucaccaugacauaaaauaaagagauuuucagaguggcacaagcauacccuucagccuugaaggccuucacggauccagggccacagcaagcagaaguaucuuggauacaucaacuaagcgccuaaggucccaaaggaguuaaaauacuaaauccuucuaugauacuaaucuaacucaaagacaacacuauccacuuaucucuacuauuugggagugaggcggccccagcuuaaagcuaggaggagguagcauagcaagcccauuuguuuuuaauauaccaugcaguguaccacacaaugcuucaacagcaccagaacccaagcucuaaaaggcuaaucuagcugucacaccaaguacuuggaucacuggauaccuaccacuaccaccgccaaagccgccuccgccuccguuguuauagcugucauagcugccacucccgccauagccacugcccugguuuccauaacccuguccaccacuuccauagccucugcuuccuccagaguaaccagggccgccuccuccauaaccaccuacaagaauacaauucuucucaauaagacaaaaguauuugacaaugaaaacuugugcaaguguaacggcugaaggccugcucacagcaugcguguuaugggcaaaguugaguuugacaugcaccagaauuuuagucucuacuaaccuauucuaaagauccagguugccaggaauuuuucucuacuuauuccuaaaaaacuuaccaucauuaccaaauccauuauagccauccccacugccaccauauccaccaccaccacggcugccaccaaagccaccuguaagaaaaaguuucaaguuuuaaguaugacuuggacuuaaagugacauucugaaugcaguucccguacuguaaaaucuucauagcaaagauggugagaagucagaacuacauguagauaaaccauacauaccacgaccacugaaguuuccuccacgaccgaaguugucauucccaccgaaaccaccuccacgaccaccaccaaaguuuccagaaccacuucgaccuuaagacaugaaguuuaagcauuaaaucauucauacuggaguaacucaaaguuaccuuuaagguuuaauuaagcaacaagcauaccucuuuggcuggaugaagcacuagccaucucuugcuuugacagggcuuuucuaacuucacaguuguggccauucacaguaugguauuucugaacuaaaaaaaaaacauagauacaacaugguaucaggguuuagaaugccauacagauuguggaacccuuacuaaaugccacuaucugauacuuacugacaaucuuauccacggagucauggucgucaaagguuacaaaggcaaagccccuuuucuugccacugccucggucagucaugauuucaaucacuucaauuuuuccauacuguucaaaauaaucucuuaggugauguucuucagugucuucuuuaaugccaccaacaaauaucuuuuucacaguuaagugggcaccuggucuuugagaauccuaauaggagaaaaaccauagguuuagauuagcaaagccuauacucgaauaaaaaauuuugguaaguuuagaaaacucccgaaucuuaaguccauagcagcacauauccaaguaaguuuaagaagaagaagaaaaaaaacccacucacuucucuggagacagcucucuuugguuccacaacucuuccauccaccuuguguggccuugcauucauagcugcauccaccuccuccacaguggcauaugugacaaacccaaagccccuggagcgcuugguguuuggaucucucauuaccugagaacaguguuaauuuauguaacacaaagucugaccgcaaaagcuuuugucauuuuaacuuugaauagggcaauaggaaacuuuacaccagccuuuuauaaaaagucguccaguuucccacuacccuagauuuaagagguagcuuuuaaaaucaaagcaggacguuccuuugccaacaaagcucuaacuauaaugcuauuaacuacuuucauaagcauucggagaagacugcaccaagauaagccaaggaaaucggcuguuuuacugcuuugucccuuccaaaucuuaccacacaguccgugagcguuccccauugcucaaaauggcuccucaggcucucaucaguuguuucaaagcucaacccuccaaugaagagcuuccucagcuguucgggcucuuuaggagacuagaguggggggagggggaaguguuaaaugggcuacaacacgaaacaauuuccaucgaggaaaagaaaaacuagacaccaacuguguaccuagcacuuauuguucguucaggucgcaacaagacacgugcuucugccuaucaagggaggccguaugcuggaguugggagugcuaggaaaucgcaagcgcaugcgucccuagucgccuuccgacgcacgcgcaacaaaggcuugggcgguaggggugcaucuccacaaugggacuaaucgcucuuuagaaaacucgcucaccaaggcaagguuuaaaaaaagacaaagauccugugugccuaagaauuuugcuacgaguaacgagucccgcaugauaacucaugguuggcggagagcggccucauggcgaucaagaggacaaaauggcgacuugaacuuugggagggguaggccguggcagcgaccgaaggaacuguagaaugggcuggugcaaggaacgaaacccagcagcaucuuaccgauucaggaaagggagaggaaaaaauucaagugggaaagcgcgccuaacucaccucugacuuagacaugacggcagggugaagagagacuuuaacgaugcuucuucggcggcguccacgggcagaa

SEQ ID NO: 18495 - RNA, 487 nt, Homo sapiens
gacaucuuugcaaggcugcggugucugcugcuacucuccgagcuucgcaaugccgcccaaggacgacgagaagaaggacgcuggaaagucagccaagaaaaacaaagacccagugaacaaauccgggggcaaggccaaaaagaagaagugguccaaaggcaaaguucgggacaagcucaauaacuuagucuuguuugacaaagcuaccuaugacaaacucuguaaggaaguucccaacuauaaacuuauaaccccagcuguggucucugagagacugaagauucgaggcucccuggccagggcagcccuucaggagcuccuuaguaaaggacuuaucaaacugguuucaaagcacagagcucaaguaauuuacaccagaaauaccaaggguggagaugcuccagcugcuggugaagaugcaugaauagguccaaccagcuguacauuuggaaaaauaaaacuuuauuaaaucaaaaaauaaaaauaa

SEQ ID NO: 18496 - RNA, 3661 nt, Homo sapiens
aacggaggcuuguguuuuauucaaggcuugucagccucccuccuucccccugcgggugagguaggagggauaggguugggggagggaacaggggcuaggaaggggcagacugcagcugcccuuuguagacauauuccagugcaguggcaauggugcgcauguccagcucgaugcuccgagcccaguucuccacauccccaauuuccugggaagggggagaggaggugggagcccaggaaucagaauggguagaguauggcuuccagucuggggaauacguuuuauucaucuccuggaaaaggcuuuacuuggacccaccaacugcuuuucuuucuuucucuaccuuuucugacacuggggcuauagaugggguuucugggaccacccuacuuccuccuuaaccuaaaccugagguaaccugacuggaggcagccaaugggggcccaggauugggguggugagguagggaguauggcccaccuugagugccugguugaaguucuccaccauuccgauccacuggccugucugcuuggcaaauugggcagccuggaccuguagggucuucaccucaugguccagcuuucucugguucauguaggccugggccacacugggggguuggaggagggaggagaucagcuccagcuaguuggggguggucuccgggacuaauauuccauugcagcagugggaguucagccaagaaucagggcucauaauuuuggccauuuuuggaugugaugcaaaugacuaccaguacaugcaaauaaacccagcuccuuccuuucacucccaggauucccaggagagccaagcucggagcugacuagaaacauaccagcuccaaaccccaaaaaggaguuccugcagcugagugggggaagggagggaaaaccuggggugauaucccugaggaaaaagcugggagggaaaaaggggcauggaaaaacugggaaaauccagcaggaggaacacaucuggcagugauuggaagccuagggaucuaugcaagaaguuggagagggaaauugggccccucccugaagccggguuaggaugggaguacaaacccccuccccaggaacccugggucaaaagaggguaucccagggguuucuucucggcucucaguugcucucccaagccuucgcuuuugcccacacagaucaaggaacacacacaaacacacacacacacacacacacacaugcucucccucccuucugccuuaggcacuaguuuuucuuuucaaucaagguaugggcugugguuaccauuacuaccaugggguugguguccccaaccuucugccaguguuuuuugcccuccccaaccccugcaauaauuguucuccuuuauuggcuguugaauuuuucacuucccaccccagagcucuacucagccaggagauuccacauccggugcccccacccacuggaaugugugggggcuggagcggggaagggguuggugggggcugagggagugggcaggacaccugacaggggccaagauagacugagccuuuguuuuccuuuccggggaaugagaggaggcgugggcagcaacacaaaacccuuucuaaucuggcuuuggcuuagcugcccucuaagcugaaagugggguggcaucuagcaaaggaaaagaagagggaaaggccugggccaaucucacaaaugaugggcacagcagagcccaggaggugccaaugugggagggaggaaaugggagggcagacccuguuccuucuuuuugggagacagcugggucacugucaagggucggguaggaacugaaacagacuccccugagaauuccugaacuucugguuuuccccauugaccaccugcuucuauauucacacugaguaaagagagcugccuggagagaagggagaucagaggccccagccacaacuuucuuucucucaaccuucccccaagaugaguaacaaagaugaccccagccccugcauggcucacuuggaugacucagucucuggauucacaccgagcuguucuacuugaccugggguggaagguaccauacugccuuucuuccaauaggcagacuagcaaaucaucaucucugcacgcuucugggucacuuagggucaagagacaauguucuuugcuuuuucccaagucuuuggcuguuacuugcauucucauuuagggcuggggcaggguguggucccuagagacccaauaggaagguaagagacagccuggcucugccauagcucccggaacagguucuacucucaccaccaccagcucugccaucucuuuccugccagcugcuccccaggcuugccagagggugggaggcagaggagagggugguaagcuguaaugaaggagggugcucucccuccugcugaagugacagcuggacuuggaagggugaagggaggugggcagauggcaucaaguuguaaaugccagggaaguuaacguggggaaggggaaaucuggcugcuucucuaaccacggcagcuguuccucccuugcccagugcuaggacucagaguugacucaaguugcucuacaaagagcugggaggggcgggguaggauaggggaauuaguggaacaucccaccccuucaacagcuauuugagggccagacuggccagugccuaaacuugggcgggguggggaaggaggaaacugauguugauaagagguccauaccccacauugaggugauccaccaaagcuucugucaggcaggucgcugcagugauagccucucgccuccucuuuucuggggagagggggaaaaggaauuggaggggagacuugguuuuuugagggguaguguuaaagguucccuacccauccauuacuauucugcuaguugccgaaauuucuuaacuaaucucugaaugccggagcugaaaaggaccuugcaaaacauagcgcaaccucuuucauuuuagagaugaggaaacugguacccugggagggaaauggacucacucagggacgccaggaagucagcggcagcgcccaggacuccugacucccaggcacucuuucuccacuacucggccgcagaaucgguaacuccgagauuuccagcccggacucaggaaacaagugccccaccuccguuccggugguuucaggccuccaagaagcccaucucugggggguuccccacacccuccucccuccagagucgcuccuucccgccgccaggacgagaggcucccagggccaauaggcagggcgcuccggggcaggggcggggcuaaggugcggcaggucggggauugggggcguugccgaggggaccggaguauugcccaagggaccggagccaguuggcaagggaaaggaguuucaaaaaaagccucucugaaauucccucucccccaugcccguugcccgcuagcuggcgucuuucccuggauaugguuaguuacucgagauccaggcuccgggcugaagcuaggccgcggccgaagagaaaacggccgacaggauauuuggcucacccugcagcuccuugcguucauucugcuuggccugguguucuuuuaggaggcgggacagcauggucacgucgggcugggggcuggguacgccgggcccccuccggcuccggaagcuggaacgcucaccucggcuccccggggccaugucacguga

SEQ ID NO: 18497 - RNA, 9756 nt, Homo sapiens
ugaauccucaagagaggagggaggaagcaagaaggaaagcuugaagggaggaggggaggggggcaggugcugauuucagcccuguagcgucaggauugcgucaauucggguuccagccacgucuggagucucggagacgagcuucucagaagagccaaaacaggaaccgagguggcaaaucacugugcgagggcgaguggaccucccucuuugccuccucccuguuccaggagcuggugcccugggcucugcgcuguuguuuucagcgcuccgaaagccggcgcuugagauccaggcaagugaauccagccaggcaguuuucccuucagcaccucggacagaacacgcaguaaaaaauggcuccgaucaccaccagccgggaagaauuugguaagcaaguuacugaacuuaugacugcgguuauuccuugaauacucugggguggacuguuuauucauuuauuuuuugcccgguuguugaauacagauuuccuagguaguuaauuuaaaaggaaaaugagaauggcagucaggcaauuguggcuuauuucugcagcuucucucccuuccuugguaucucucucccugaaacugucuucuguuagggagaauuuaccuucaggaaguucuuaaauuuucagguacuucuguaaauugcagcauguacugaguaaagaaaaaggggucuguuuuucccauguugguuucaucuauuuuguaggugauucuuauuuguagguaaaucuauauuuuauuaggagaagauaaauauaucucugguuacauugggguuugaucuugguuaaaaaaagcaacuugucuauugggguuuggcaauguauauuuuauuacagggcguaccauauggguguuuuucucugcuauguuuuucuuguauccuugaaauauguugcuagugaaagacagaaucauaugguagcaggguuaaagagaguuucaaaaugaacuggcucagcccauuucauuucacugcugagcuaaccaaagcccagagagaugagggaaguauuauagguugcacaauuagcuaaaagcugcuggaaacuugaauuagggcuccaauuuucccguucaguuuuccuuuucucacaccaaguuuuugguuucaguacauaaaauuagacguacuucauagaguaaaaaaguacuauuuuuagaucucaguauauuccaaaggaaaaaggucagaauuuuacuuacacguauuuuuuaaaucaugaaauuucauagaagguugugaagaggagugauaucuacagaugugugauaauuguuauuaagcugaguaaaauaacuaugaucuugacuuucaagauuguaagaccuuaucaguagagaauacauagggaguagauaaguguuuccacguuauagaaaauguuugccauuugacauaacuauucaauagggacaauuugugauauuauguucauaaaugaauuucuuucccagccuuccauuuggguuauuggguuuauuuugguaugacauuuauucccaauucuucauuugaaaccugaaugauuuucuaauauggaggaauuuuuagagacugugccagugaaaauauguucuagcauggacuaucagucuacuuuuaaaaaaugauuuucuacuguuuuuauuguuuuuacauuggcuaaagaacucucucaguucaugacuuugcuuuugcucccuggccuuggguuauuaugguccaggaaugugggugcauuuuuuuuucacaaagacuugaauagaaggaaaaacugaaaagcugauaccaaguuuagcugauuaucuuuagcucuugcuuuauacuguaguagucacuguuucuuuuuuccaccuggagaagucaaagguuuauuucaucuuuacaugauucaguuucuguacauuaaaauacaggauuuuuauugcgauuuuauuggccuuuuuaucuucuauuucauuugucuuuucuuaaccuuacauucucugaguucaguuuuauaauugugaaguagauuggcagaagauuuggggggauggggaagggaaguaacaaaagacuggauuucuugugguuauuuagaaaaguuuuaacccuuucugggcuggaacuuauaacuuuauuauuuacuauucaggauaaaagcauauugcaauggaacuaaauguauauaauauuacauuaguuauuuucacuuugaugauauuaagcauugacucuauggauucacuauguauagauguaguaauacugcuuuuacuuccauaguguuacuaaccauuuguucaagaaagaugcuuacauauaaaauaggauaagccuuaugcauaauugauauuaccuaaugucaguaauuuaaugugccaucauucaagaaaauaaugacaauuucaguuugauuaucauuugccaugccaugugcuagaggaagagacaguuauagauaaaauugaacucuaaaucucacuguucucauuacauguuaaagaaugcugauucacuuauaaccauuguucuguuuuuaucuuauuuaaguuuaauuaauuuauacuuuguauaauucaguguuugacugagaaauuugggauugucauacaaagggaugauaguguuauaaguuacaaaauaucgguaccuuguugcucuucuguuuuuguuuuacuuucucuaauauauguauauuucuuuuaccacuguuccauaauugggaugaaaauuauuaaugaguuuguggcaauggcaaauaucauuucacaaucaauuuccuacaauugagugaaccacugagucccuaaauguuugcugcuugaauucugaguaaagaacuacuuagaauuccaguaaaaagugaugcucuggaaagccucaaaaugacaauaaaaaauaaugaaguuaguacugauccaucauauuguagcugucucauguuaucugagaaaacaaagauaggucagagucauuaagcauucccccauaucugauucaggaccauuuucaucuuuuuauuucauuaaugaaaaaccacugaaaugaaggaauuucuagcacacuuuauguuuuuccuguggggauguauuuguacccgaaguuagugugaaauauacacuuaacucauacccagaacaguuggaaaguaauucaaucuauccaaccuauagcaauugcuagcucuauuaggcuuuucaaaaggcucauaucuccagcucugcuucuuuaauguauauuauuggucauuugauuuuucagaugaaauccccacagugguggggaucuucagugcauuuggccuggucuucacagucucucucuuugcauggaucugcugucagagaaaaucauccaagucuaacaagacuccuccauacaaguuugugcaugugcuuaagggaguugauauuuacccugaaaaccuaaauagcaaaaagaaguuuggagcagaugauaaaaaugaaguaaagaauaagccagcugugccaaagaauucauugcaucuggaucuugaaaagagagaucucaauggcaauuuucccaaaaccaaccucaaaccuggcaguccuucugaucuggagaaugcaaccccgaagcucuuuuuagaaggggaaaaagagucaguuuccccugagaguuuaaaguccagcacuucccuuacuucagaagagaaacaagagaagcugggaacucucuucuucuccuuagaauacaacuucgagagaaaagcauuuguggucaauaucaaggaagcccguggcuugccagccauggaugagcagucgaugaccucugacccauauaucaaaaugacgauccucccagagaagaagcauaaagugaaaacuagagugcugagaaaaaccuuggauccagcuuuugaugagaccuuuacauucuaugggauacccuacacccaaauccaagaauuggccuugcacuucacaauuuugaguuuugacagguuuucaagagaugauaucauuggggaaguucuaauuccucucucgggaauugaauuaucugaaggaaaaauguuaaugaauagagagaucaucaagagaaauguuaggguaauuuauuuucagugcuuaaaguauuuauaaacaaucuuuuauguagcauuuuggugucuaaggaauuuuuauuaauaugauaagcuuguacauaucauccuuaccauguuuaauuauuauuaauuauaaucuaauggagaucaagggaauagaacagaugaaauaaaauuuaauccauaacugaaauacucaaaguguuuuaaugauguaaaauaaauaggcauucuuuauggauauuuagauaucaccuauauaaauacuuuuguuaaucucuaucauaaauauuuugacagacacugcuacuuuaaaauacaggugaauauuucuuauucauaagcaaguuaacaaagagauuucaaggucaacauaauugaauuuaaaauugaaauuuaaaauuaaaucaauucuuccugaagauuuggaaauuguauugacuuuccauggaauugccuuucaaggaagaggcaucacgucauuuucaauuauaaaugcucaucucuaaauuguauaguaggaaaugagucccgcuauuuuuguaguuacacuacucugguaguucuggguuuauuagaaaauaguaagacaucaaugaaacaaauuuaaccccauuuucacuuuaaauuugaaacucgauuucaacagugguauaucagaauaacuucucucuauaauacaaugauuuauaaaaaucaauagacauacuaauuuguguuuuuuaaacaacauaguguuucagagcugaaaaccugagagcucauuuugacugucuccucuccuauugaaauuaaugacggucaagguucagauacauuccacagcuuguuugagacacccggcugguuaagugauacagugggaauaaggaucuuucuucuacucuuauucuccuuagagugccuacuuauacagcugucccauauuaguuuuuguauaaauauauugcaguuuuaguuuugugucagccaucacucucaguugcaaacaaacaccaaguuaauauauuguuacuuucagucaaaacuuuuacuuugaauuauuguauaucuuaucuauugucuuuaaaguacaaaugaaaucuaaguagcacgcaaagaaggacgcuaugacacuguccaaaaacaaugcucuccaaugcuuaagaucaauucauuccuuggcuuaaauggaaacuugcuguugugaaagaggcagagaauuuuaacuccauuaucccucugggccaggaauguaguugggaucagaauaauucucacugggucugaguucaaauuucaauaugucggugcuaaagaauuugaaaucaaaucaaacuuaucuaauuuuuugcaugaguauguguagucauuugacccaacacauacucaugcaaagaauuagauaagcuuuauuacuauuaauaacuuugaaaaguagagauguuauuaaaaaccaaaagccaaaaauaauccuguguaggauauaauuuaaauauccuuuaaacauuucuaaguaauggguguggccaauuuauugccaauuuuaacuuccuguaguaccaaacaagaccacaagauggcaggcagugguuuuucaagcagcgaugguacugcucaaaagcuuuuaguuacucuucaauuccuuagaauauuaaaauaaaaauaaguaagauuauauuuaaaugacgauguuauuuaaacuuuaaugaaaguacacacuucaaaguuaaaaagauagaaauacuuauaucacauuucucuuucugcagaagucuucaggacggggugaguuacugaucucucucugcuaucaguccaccacaaacacucuaacugugguugucuuaaaagcucgacaucugccuaaaucugauguguccggacuuucagguaagaaugcuucugaaauauucagauucacuguaugauuggaauguauuugacugcaaaugagcccaccuacucuuacucuucuaucuuuucucuaauaccuuauguaucugcuauaaaaguuagcuuuuaguuuuaugacuagcuuuacaaaaaaugaaacaaaacgccaauuuuauguuguauagcacaaugagaaacaaaauaagcuacaguuuaaaauuaccugaguucaaauccuaacccuuccauucacuagcaaaauaugauuggguauguuucuuaaacuguacaaacuggacauaaugcuacucauccugaggggccuugugagaacuagaaauacauacuucuucagauaucaucuaauaauauuauuauuauuuaaugaugggaguugaaaacauggucuuaaaagauuagauugugaagcuaaaauuaacucauauggugccaccagaaaaaggcaaaaguaauugugauaaaguagcaugaacuuaaaaucuacauacuaacaaugacacagagaagcucaacacuaggaaacagaaagcaaauccagccugugacuaaagaaauucauaaaaguuaaaacuaaaaagaauauugccauuguggacucuaaauccucauucgauggaaaacacagccaaaagucagggaaauagacucacccaaagucauacaagucaguaaagcuacauguugucuaauauauuuuuuuccuucuauccuauucucuggaguaaguuaauaguaaucagaauggguccauagaacauucuauuuucuuuccuuuuguguuacuucuuuuccuaucauuaauuuuuucccuuauucucuaauuuagaacuuuuuucucuuauuuuccauauucuuccuuauuuucaauucuguugacaagagaaaugccaaguuuuauccauauuuuucuguuguuuugacuuauuuuccugguaaccacaugucauuggcaugccaugaucucuaagggcacuguuaucuugauaucagcucuccagcccaguuaugccauuguaaugccuguuauguuccacugcagaucccuaugucaaagugaaccuguaccaugccaaaaagagaaucuccaagaagaagacucaugugaagaaaugcacccccaaugcaguguucaaugagcuguuugucuuugauauuccuugugagggccuugaagauauaaguguugaauuuuugguuuuggauucugaaagggggucccgaaaugagguaaucgggcaguuagucuugggugcagcagcagaaggaacugguggagagcacuggaaagagaucugugacuaccccaggagacaaauugccaaguggcacgugcucugugaugguuagcauccuagccgugaguuggaacuuaaagguuuuuacuaggcaaggagaaauuuucuuucuuucuauauuggauugcaagcuugggaaaucaagcuaccuuuuuguuguuguuguuguugcuagaaauggauugaauuaguagaccagaaaguaacuucaaauguguauuaugauaauuucccuauuuauuagaagaguuggauaaauuuucauaagauauucaauaucuccuucagauuaccagugauauaacuaggaauagucagacauuuuaugaauacugugccagaaucccaaauuauaaaugugacaaucucauuggaacaugucacaaaaaguuaaugugauuaagauuuaaaaacgaaaaguaugccuugccuugugaaaauuuauccauuuaucuucagguuggggaaaucaauuuuucuuuaaauccaaagauacuaaaaaaauguccuccaguuuguauuuauuaauucugucaugugcaaaugguuguccugcauauaaaaguaucuggucauuucaguuugguuuguaauuauuugaugcaauuuuaucauaagaguaacucagauucauuucaaaaggacagugaacaagcugagaaauuauuuuaucaaagggcugaguugagaacacuguggcugaaauauaauuuuucuccccccuaagguuacaugugagucaaaauuuuguaaaauauaaccucacauaagaaccauggccuuggauuauucacugccugucacaagccucaguguggccugagaaaucccuauguaccuuugugaaauuguugaauuaguuagugaauaaagaaauaaacuucaacuagaaauccaguuagaagugcaauuuucuuauaggaaauagguauagugugcaaguguacuuuuaaggccaucguuuguacccagagucggcauggccaccuaagucuucauuuaauuuauugucccccagaaaagauuaagaugcuacuugaaaagacugugaagauuuuuuacauugccagauaaaaaguguuacuuaaccaacaaacaaauguaagacuacaaaaucguucaagagcaauucuaauauaauuuacauauguucacgcaaaauaugcuuaggcugucaaauuagcacaacaaagaauguguuucacuaucuuuucuaggcuaauuugucuugagcuguugucuauagagcaguuuacagacuugugucuuguaucauuuuccagugccaggguucugaaauucauucagaaccuguuagauuaaagcugcacccugugauuauuugaaaagaauuagcuugagaguaaugucacuauauuugaguucuuagagaaguaugaguggaacuugaguacaguugaauuauuaaauaugcaaguuagaaauuaagucuacugaaaaauuuacauuuugagucagguuuugugucaguacuuuagcaguuuuugagaauguguuugauaucacaguguuuguaaauucuaugaaaaaugcauuuuccaaacaacuuauacaugcuuuuuaugacuaugccuaauguaaagaaaauguauuacauucuguauguacaaagauuaaaaaucaaccucuuuuuugugcuuuaaaaugacuuugggauuaaaaaagcauauuucccaaucauugucuucauuccacuacaaagucaccucacagcaucuugcuccacucggcaucucugugaaagcaacaugaaaugaacuguaguagguguguaguuuggggaagucaaauggccauuuuauguaugugcauuugguaucaugggccguggaacagaauauauguuggaccucugaaaaguuguaaggggccaauucuaaguauucuucacggcagccagaaguuaauggugguagcagcugagguaugguuguuggacgaggccgauuuuuuuuuuuuuaacauggaacaaugaaaccaacaacaaacauuuuuaaaauuaaaauggauaauuuguaaauaguuuuuagcuuuuaaaauuuaaaguguuuuugagugugaaaaguugaguaaaacuauuugcaacugguuuucagaaaagagaaaagaaacaacaaaggaauugaaacaggcagggagaucuuaauaccuaauuucaucauuucugaaaauguacuguuuuagaauguauuacaauaucaaugugaauaucuugaauccuguuacaaauccugcacuguauuaaacauguaaauuaauuguuugucugauuagccaaucucaccacccaaauggggagguauacauguuugaagaacuguguaacucaguaauugauuuguucugauguuguaacucaauagaaguguuuuggaaggaagcauggugugugagacagugucuguucuuuugugccagcucuguaugauguuuguaagaccauguuuguaagacaugaauaaauugcugcuuuugcccaacccguuucaa

SEQ ID NO: 18498 - RNA, 8829 nt, Homo sapiens
auuaauaacaguucuuuucaguuugcuuauaaagcaagcaaugaaauaguuacuuaguccacaauagcauuagcucugggcaagagguaaucuuaucacgauguuuccucagaugucagacagcaaaggaugggguggguuccguagaaauagaguuuaaacaaucuguacaguuuacagauaacaacauuauaccaucugaagguaaaauuaaugagauacuaauuuauagaacaaacacauaagguauuuauguuuacaacaaaugagcuuaaacauauguuagcaauaacuuagcuagaaaauauauacuuuaguaaacaucacaccauguauuugguccaccuaugauaugcaucacaaauaaaugccacuuauucuuuaaccuaauggauauuuguuucuagggacaacccuacagggugcaugcaugcauaauuaaggaaauagguaaucugaauaaagugaaaugauaaagacacaaccacagacucugccagcagaaaaauuaaauacagcaaauuaguuuguguguuuucaaagcaugaagauauaaaguuuaaaaaaaucuguuagaggaacacuccaaugccaaguaugugggagcaaauagaauagcaaagaaaaaagacugguuuauaaaauuuuccaugaugcaaagaacugaagccaauuucuccccagacagagcccugaugcucugggcugcugcuagccaaugugcagggaccugucacuugcacaguagcuuucugagacucacccuguaucccuucucccacaucccagcacacacugaaugccauuuccuuauuaacuccagagcaaagaaauucuuugcagagcaauaauugacaguuggaguuacagcuugacuucuuuccuuugaaaaauugcuaagcauuuguuuuagaaaggcacacucuucagauuccaaugaaucagaauccgacaccauauuuuucacaguuuuucaccuccgagaauaucaucaguuuagaaaaaggaaugcuuuccuuugaaauaaccaauguuaccaauguuacuuuagauguuggccugauuuuggaaacuauuuuguacaaacguacuagaagucaggccuuuuaaccauaaaugucauuucagaagcgccuuauuauuugcaaaagucauaacugagagugacucugaauauccaaggaauuauccccaucuguuccuaagugcuuuaacuggucaaaugucagauauuaaagggaagagagcugagagaccaggaaagaucaacuguuccagcaaaauauuuagacuaauaauuuauuagaacauaaaggauuauacugggaaaacuaucuuauaucaaaugcaucaauuuguagugaaucuuuucuaaauguaauaaguaucauagguauaacaugucaaagaaaaaaauuaaaaagcaagaaaacauguuuuugcauguuaaaaagaguaauuugaagcagaaacuucuccucuguaaguuacguuauucugaaaacucagaaacauauuuuuauucaucuaggugaucaggagauuuuauauuaggaacugacagggaucaguuucggggcuuaucucggugagccucugagcccccacaaaacagcaaagcuaaucucuagugguccaacaguuaaaauaauugaugagcauguguugaauccucaagagaggagggaggaagcaagaaggaaagcuugaagggaggaggggaggggggcaggugcugauuucagcccuguagcgucaggauugcgucaauucggguuccagccacgucuggagucucggagacgagcuucucagaagagccaaaacaggaaccgagguggcaaaucacugugcgagggcgaguggaccucccucuuugccuccucccuguuccaggagcuggugcccugggcucugcgcuguuguuuucagcgcuccgaaagccggcgcuugagauccaggcaagugaauccagccaggcaguuuucccuucagcaccucggacagaacacgcaguaaaaaauggcuccgaucaccaccagccgggaagaauuugguaagcaaguuacugaacuuaugacugcgguuauuccuugaauacucugggguggacuguuuauucauuuauuuuuugcccgguuguugaauacagauuuccuagguaguuaauuuaaaaggaaaaugagaauggcagucaggcaauuguggcuuauuucugcagcuucucucccuuccuugguaucucucucccugaaacugucuucuguuagggagaauuuaccuucaggaaguucuuaaauuuucagguacuucuguaaauugcagcauguacugaguaaagaaaaaggggucuguuuuucccauguugguuucaucuauuuuguaggugauucuuauuuguagguaaaucuauauuuuauuaggagaagauaaauauaucucugguuacauugggguuugaucuugguuaaaaaaagcaacuugucuauugggguuuggcaauguauauuuuauuacagggcguaccauauggguguuuuucucugcuauguuuuucuuguauccuugaaauauguugcuagugaaagacagaaucauaugguagcaggguuaaagagaguuucaaaaugaacuggcucagcccauuucauuucacugcugagcuaaccaaagcccagagagaugagggaaguauuauagguugcacaauuagcuaaaagcugcuggaaacuugaauuagggcuccaauuuucccguucaguuuuccuuuucucacaccaaguuuuugguuucaguacauaaaauuagacguacuucauagaguaaaaaaguacuauuuuuagaucucaguauauuccaaaggaaaaaggucagaauuuuacuuacacguauuuuuuaaaucaugaaauuucauagaagguugugaagaggagugauaucuacagaugugugauaauuguuauuaagcugaguaaaauaacuaugaucuugacuuucaagauuguaagaccuuaucaguagagaauacauagggaguagauaaguguuuccacguuauagaaaauguuugccauuugacauaacuauucaauagggacaauuugugauauuauguucauaaaugaauuucuuucccagccuuccauuuggguuauuggguuuauuuugguaugacauuuauucccaauucuucauuugaaaccugaaugauuuucuaauauggaggaauuuuuagagacugugccagugaaaauauguucuagcauggacuaucagucuacuuuuaaaaaaugauuuucuacuguuuuuauuguuuuuacauuggcuaaagaacucucucaguucaugacuuugcuuuugcucccuggccuuggguuauuaugguccaggaaugugggugcauuuuuuuuucacaaagacuugaauagaaggaaaaacugaaaagcugauaccaaguuuagcugauuaucuuuagcucuugcuuuauacuguaguagucacuguuucuuuuuuccaccuggagaagucaaagguuuauuucaucuuuacaugauucaguuucuguacauuaaaauacaggauuuuuauugcgauuuuauuggccuuuuuaucuucuauuucauuugucuuuucuuaaccuuacauucucugaguucaguuuuauaauugugaaguagauuggcagaagauuuggggggauggggaagggaaguaacaaaagacuggauuucuugugguuauuuagaaaaguuuuaacccuuucugggcuggaacuuauaacuuuauuauuuacuauucaggauaaaagcauauugcaauggaacuaaauguauauaauauuacauuaguuauuuucacuuugaugauauuaagcauugacucuauggauucacuauguauagauguaguaauacugcuuuuacuuccauaguguuacuaaccauuuguucaagaaagaugcuuacauauaaaauaggauaagccuuaugcauaauugauauuaccuaaugucaguaauuuaaugugccaucauucaagaaaauaaugacaauuucaguuugauuaucauuugccaugccaugugcuagaggaagagacaguuauagauaaaauugaacucuaaaucucacuguucucauuacauguuaaagaaugcugauucacuuauaaccauuguucuguuuuuaucuuauuuaaguuuaauuaauuuauacuuuguauaauucaguguuugacugagaaauuugggauugucauacaaagggaugauaguguuauaaguuacaaaauaucgguaccuuguugcucuucuguuuuuguuuuacuuucucuaauauauguauauuucuuuuaccacuguuccauaauugggaugaaaauuauuaaugaguuuguggcaauggcaaauaucauuucacaaucaauuuccuacaauugagugaaccacugagucccuaaauguuugcugcuugaauucugaguaaagaacuacuuagaauuccaguaaaaagugaugcucuggaaagccucaaaaugacaauaaaaaauaaugaaguuaguacugauccaucauauuguagcugucucauguuaucugagaaaacaaagauaggucagagucauuaagcauucccccauaucugauucaggaccauuuucaucuuuuuauuucauuaaugaaaaaccacugaaaugaaggaauuucuagcacacuuuauguuuuuccuguggggauguauuuguacccgaaguuagugugaaauauacacuuaacucauacccagaacaguuggaaaguaauucaaucuauccaaccuauagcaauugcuagcucuauuaggcuuuucaaaaggcucauaucuccagcucugcuucuuuaauguauauuauuggucauuugauuuuucagaugaaauccccacagugguggggaucuucagugcauuuggccuggucuucacagucucucucuuugcauggaucugcugucagagaaaaucauccaagucuaacaagacuccuccauacaaguuugugcaugugcuuaagggaguugauauuuacccugaaaaccuaaauagcaaaaagaaguuuggagcagaugauaaaaaugaaguaaagaauaagccagcugugccaaagaauucauugcaucuggaucuugaaaagagagaucucaauggcaauuuucccaaaaccaaccucaaaccuggcaguccuucugaucuggagaaugcaaccccgaagcucuuuuuagaaggggaaaaagagucaguuuccccugagaguuuaaaguccagcacuucccuuacuucagaagagaaacaagagaagcugggaacucucuucuucuccuuagaauacaacuucgagagaaaagcauuuguggucaauaucaaggaagcccguggcuugccagccauggaugagcagucgaugaccucugacccauauaucaaaaugacgauccucccagagaagaagcauaaagugaaaacuagagugcugagaaaaaccuuggauccagcuuuugaugagaccuuuacauucuaugggauacccuacacccaaauccaagaauuggccuugcacuucacaauuuugaguuuugacagguuuucaagagaugauaucauuggggaaguucuaauuccucucucgggaauugaauuaucugaaggaaaaauguuaaugaauagagagaucaucaagagaaauguuaggguaauuuauuuucagugcuuaaaguauuuauaaacaaucuuuuauguagcauuuuggugucuaaggaauuuuuauuaauaugauaagcuuguacauaucauccuuaccauguuuaauuauuauuaauuauaaucuaauggagaucaagggaauagaacagaugaaauaaaauuuaauccauaacugaaauacucaaaguguuuuaaugauguaaaauaaauaggcauucuuuauggauauuuagauaucaccuauauaaauacuuuuguuaaucucuaucauaaauauuuugacagacacugcuacuuuaaaauacaggugaauauuucuuauucauaagcaaguuaacaaagagauuucaaggucaacauaauugaauuuaaaauugaaauuuaaaauuaaaucaauucuuccugaagauuuggaaauuguauugacuuuccauggaauugccuuucaaggaagaggcaucacgucauuuucaauuauaaaugcucaucucuaaauuguauaguaggaaaugagucccgcuauuuuuguaguuacacuacucugguaguucuggguuuauuagaaaauaguaagacaucaaugaaacaaauuuaaccccauuuucacuuuaaauuugaaacucgauuucaacagugguauaucagaauaacuucucucuauaauacaaugauuuauaaaaaucaauagacauacuaauuuguguuuuuuaaacaacauaguguuucagagcugaaaaccugagagcucauuuugacugucuccucuccuauugaaauuaaugacggucaagguucagauacauuccacagcuuguuugagacacccggcugguuaagugauacagugggaauaaggaucuuucuucuacucuuauucuccuuagagugccuacuuauacagcugucccauauuaguuuuuguauaaauauauugcaguuuuaguuuugugucagccaucacucucaguugcaaacaaacaccaaguuaauauauuguuacuuucagucaaaacuuuuacuuugaauuauuguauaucuuaucuauugucuuuaaaguacaaaugaaaucuaaguagcacgcaaagaaggacgcuaugacacuguccaaaaacaaugcucuccaaugcuuaagaucaauucauuccuuggcuuaaauggaaacuugcuguugugaaagaggcagagaauuuuaacuccauuaucccucugggccaggaauguaguugggaucagaauaauucucacugggucugaguucaaauuucaauaugucggugcuaaagaauuugaaaucaaaucaaacuuaucuaauuuuuugcaugaguauguguagucauuugacccaacacauacucaugcaaagaauuagauaagcuuuauuacuauuaauaacuuugaaaaguagagauguuauuaaaaaccaaaagccaaaaauaauccuguguaggauauaauuuaaauauccuuuaaacauuucuaaguaauggguguggccaauuuauugccaauuuuaacuuccuguaguaccaaacaagaccacaagauggcaggcagugguuuuucaagcagcgaugguacugcucaaaagcuuuuaguuacucuucaauuccuuagaauauuaaaauaaaaauaaguaagauuauauuuaaaugacgauguuauuuaaacuuuaaugaaaguacacacuucaaaguuaaaaagauagaaauacuuauaucacauuucucuuucugcagaagucuucaggacggggugaguuacugaucucucucugcuaucaguccaccacaaacacucuaacugugguugucuuaaaagcucgacaucugccuaaaucugauguguccggacuuucagguaagaaugcuucugaaauauucagauucacuguaugauuggaauguauuugacugcaaaugagcccaccuacucuuacucuucuaucuuuucucuaauaccuuauguaucugcuauaaaaguuagcuuuuaguuuuaugacuagcuuuacaaaaaaugaaacaaaacgccaauuuuauguuguauagcacaaugagaaacaaaauaagcuacaguuuaaaauuaccugaguucaaauccuaacccuuccauucacuagcaaaauaugauuggguauguuucuuaaacuguacaaacuggacauaaugcuacucauccugaggggccuugugagaacuagaaauacauacuucuucagauaucaucuaauaauauuauuauuauuuaaugaugggaguugaaaacauggucuuaaaagauuagauugugaagcuaaaauuaacucauauggugccaccagaaaaaggcaaaaguaauugugauaaaguagcaugaacuuaaaaucuacauacuaacaaugacacagagaagcucaacacuaggaaacagaaagcaaauccagccugugacuaaagaaauucauaaaaguuaaaacuaaaaagaauauugccauuguggacucuaaauccucauucgauggaaaacacagccaaaagucagggaaauagacucacccaaagucauacaagucaguaaagcuacauguugucuaauauauuuuuuuccuucuauccuauucucuggaguaaguuaauaguaaucagaauggguccauagaacauucuauuuucuuuccuuuuguguuacuucuuuuccuaucauuaauuuuuucccuuauucucuaauuuagaacuuuuuucucuuauuuuccauauucuuccuuauuuucaauucuguugacaagagaaaugccaaguuuuauccauauuuuucuguuguuuugacuuauuuuccugguaaccacaugucauuggcaugccaugaucucuaagggcacuguuaucuugauaucagcucuccagcccaguuaugccauuguaaugccuguuauguuccacugcagaucccuaugucaaagugaaccuguaccaugccaaaaagagaaucuccaagaagaagacucaugugaagaaaugcacccccaaugcaguguucaaugagcuguuugucuuugauauuccuugugagggccuugaagauauaaguguugaauuuuugguuuuggauucugaaaggg

SEQ ID NO: 18499 - RNA, 2531 nt, Homo sapiens
gggagccgagccucgcggcccggggcacggcgccgcccgccccuccccggcagugccucccgacccccugcccuccgcugggacauggccugaggccccgcccgccgcccgggacuccucccccccgcugcccccggacccucgccccaggaccgcggggucucuucccggccccgccgcccgccccggcgagaacaggcccggcgggcaaggcggcggcggaccgagggaggccuggcccggcagcggggagaagggugcggcgcagcccgaguuucccaccuuuucuccuggcccagacgcggcuggggcggacgggaccucucgcgcucugccuccuccucuugcuucauggagccaugcgccugggugggggcucccgagagaagcuggccugcgggcgggccggacgcgcugcgcggacggggcggggcgaaggaggccggcgggcggaggaggaagcggcggggcggcggcggcggcggcggccgggaagaacuagagguauuccccgggcggcuggaggacugagucgagccgggacccgaguccuccgguaucccagcagccaccggaggcagugagguaauggaggaagaauguagggaguccuccaguggaccacacuccuucuagcgagccgcggaaaccauagagaucagggcucagccggagggccggcccacugcugucacguggccuccauccgugcgcuuuauuggcuggugcuggcuuuacgggguugaauuuuggacgcugccugccauucgugggaccgaguuucaggcagcuggaauaaagagagacaucgggggaaagccgcgagaaggccagcgucccuggcugggagcagagcuagccgaguagggcgcccggcugucaaaacuggccggcgcagugcacgcugggccgccccggagcggucgcagagcccgucgggagucguaguccgggacgggcccgcagcauuguccgcgacgcagcucgggauccgcgucggguugucggccggguugcugccaggcaccgucgagcguuagccacccagcauugagcugccagcggcuguucucccuaagcacccucgcucacgucgccucgccucgccucgccugaccggccgcagccuuggauaccagccuuaaaucgagccgacuacggcccagccccgcccgcggcgaagugcgcgggguucggugccagccgcucgccccuggccgggccagccucuugaugcaccggggacgggcgcgcccauccgacucuucgaggggcggcagggccccaucugugucuuucgcucucgagcccccagcuagaguuggcuucagcggaauaccuacugugcaggauuauucaacaagccgauugaucacauucuucagcucuagcagugcaaaggcuucacugaaaaagaacauuacaaauuuuuuuugaaagaaauuuggggguaaauuuaauuuuaaauacugauuuuugauaacauuugaucuuaugacagcauuuguauuuuuaauuacagauaggauuacacuaaaagucauuucugaccugcucccuuacccuuauggcuaaaauaaacugcuaggcccugaagcaaaggcgagccauguucuagagcaaugucuuucuuguauuaaaauacggccccaugcucacauauaggcuguuuuguguuuugcuuuucuguugaugcacaaaggaauccuugauauguuuguccucaaagaccaaagacaaguaucuaguaaaaaaugcaaaucauaucuaacagugaagcuuuccagcaaaaaccuucugcucuagaaugcauaauuaugcgagcauaagaucuacuacucuagacuuuuagcauaauuaccuauaggcagcaaaacccuagucaauugagugucuggugccucuuggaccuggacuucuccaagagaaugggcaaggaggacgaaaaggaagagacagcuaugcuuugugaaacaggaggugacuuaaaaaaaaaauucuauagcagucuucuuaauuccuguuacagacuugauacgcuuaucugcuguugaggacacgguugccaguuucuaaccuucucugucugccugaaaaacuagaaauuagaugaucauauggccuagagccagaagugcaggaggcagaaagccaggggccaguuuuuuucuuuuuguuucugaauaagaaggccaaauccugacuuaaaauaaucaaaauaaauuuuacggagugacggucuuuccagcugaaaaccuuaaaacauggcaucuggaagaaggccuuagucuauugcucccaggaugguacuauauagucauuaaauagcccacagauaagggaguuauugcccccucguuauugggcugccaggaauuaaaugauggaacuaaguuucacuugaaacauucccaaauuaaaacaaaaacaagccuugcuuugagcuguugaaaaggcauuuuacugagaagauccagaugcuauugcuguucuuaaaugauguugaaaggcaaagggucaggacuuucaaa

SEQ ID NO: 18500 - RNA, 3789 nt, Homo sapiens
aguuuuggcaucagucaaauuuauuuggcaaauuuaguggugcuggaaguuucuuuuuuucuuuuccuuuuuugacagagucuugcucugucacccagccaggagugcaguggugcaaucacggcucacuucagcuuugacccugccucagccucccuaguagcuaggacuacaggcauaugccaccaugcccagcuaauuuuuuguguguguguuuuuuguagagauggaguuucaccacuuugucuaugcugguuucaaacuccugggcucaagcgguccaccugcuguggccucccaaagugcugggauugcagaucugagccacaguaccuggccgcuggugcuggaaguuucaaugguugcuuagaaaaggcauacugauauaguuuaacaggauaugaaaauuuaacugguucucuaugaauguaaaaaacagcaaaagcuaauugauuucuguggagugagaaaaugucagccauauacacugcuuuucaguguuagaaucuagagacuauuuuuuuuuuaacuuugaaauuacagcuuauuuaaucagcgcuccaccauaaacaugcuauuaggaggcucaagauugcuuuagguuauggguauuucuucacucacccccaacugguauagcuuaaagagagagaaacuguaaucaaauuucaugaagcuaaaaccggauccagagaccaaacccauaucaagauuagacuuuuuuucccugagauucuaguggaaaaauuuucauuauuuugggcuuuaacuuuagaaacauaguaucucaguaagcagauaaccagaucacauuuaaaaauuuucauuuuaccuugaagcucuacuggacuugacagaucacauuuugagagugaauucauuuaaacaauaaaccucuacauuauacuuauuaaauauauauggcauuuaaaaacaucacugucagcauacauacuagauguugugauuugaagcuuauaaaaaguagauuuucaaugauguuugauuugagaaaaaauuuuugagacaaggucucgcuguugccuaggcuguggugcaguggugugaucacaguucacugcagccucaaccuccugggcucaagugaucuucccaccucagccccaccccaaguagcugggaucacaguugugugccaccauaucuggcaaauuuuuugaagauuuucuguggcgaugggguuuaacuguguugcccaggcuggucuugaacuccuggccucaagugauccucccgccuuggccucccaaaaugcugggauuacaggugugagccaccagcugagaaauguugaauuuuuaaguuuuuauuuaagaaauaaacauuguaaaacaucauuauaaaacccccaacuauugcaaguucuagagaaauuuaaaacuagaacagaaauuuaggggacuagaaagagcagccaauggcacaagucuuuacaauuaauuaaaaaaauaaaucauucugaagauacugcauuugcucucucacaagcagccuccugagguagguaaccuuguuuacugauggggaacaaggcaguguucuuuaccaaaucucagggcggguagccugcaagccuacaguguggauguuggccacuugugucacuucuugggacggggcuuagggaccugacuuacuuaggaacauaaauuuugggguuggaggaagcagcagugcucuacugcggcacgacagacacccuguuaaggcaacacugggauccagcucaggaaaagcauuacuuucaaauugugcaagccaaugcacagaaaagugguccucaaacuuggggaacguagaaucacuuggggagcuuuaaaaagguccugaugucugggaccuacuucccagguucugacugcauugaucugagguguggcucuucaaguaacugaugugcagucaagcgcgaggaccacuggcacacaauguuuaaauucuaaauauauuuuacuuccuaguguauugcuacugacaaaacguaguuuucuggacucaucagaauguuaggcucauaccuucuggcaauaaauuaagguaguuaaaaguaacugcugaaccuaaaaugaaggcagcagcaauuagauauaaaaaaaucuuaagaucagccugcaaauuguaaacuaguuuacaaagcaggcuauacaaugaggaauaauucgagcuuguagaaauccaugguuuccaccagauacagguauuccggaucuagaauuaucuuucuauuugcaggauuuccgaagagaccguuaagcaucuacgcgccccuuccuggaucccaugcuucuuggggcaggaaauuucuuuugguccgucgcuuucgucgugaaauacacaacuaauuuuccuuucauguuauaaggcaccauauuuaugauuuuguuaacugaagaaaaaacccgagauaaaccaucuuaaguacuuuuaaaaguccaguggcugaauucgguguuuaaucugauacccuucuggauucgcugacacuggagagaauaauuuccaagucuuaguauagccaaaacaaaaaacuaccgucgcuaagcuacaucuaccacuggauuuuaaaaugacaaaacagccugagaaaaaucacaagagcagcuaacucgaagaaaaauccuuuuucuuuacucagccgaaccuaagaccacaguuacuucgaaagcaacuucuaauaaccgucucacauccugucaccaguucaaugacaaaaucucaguuuucagagcgugugccaaguccagcacaaaaagcugacaucgaggagcucccaacgcugcugucgccuccgcuggcagcagccgcucccggauuagacucgcaggcuguuagggcagggccuucgccacgggcuuccgcacagcggcgugcaguccucagcucggccggcgcggucuccgacggcgcuggcuccgcguacuuccccagcggcgagggcgcgagguccucacacgggcagcaccuuggcgaggccggcgccgcggcccaggcgacccagugcgaggcgcagcgcggugccgccgccccagggcagcagcccaaccagcgcggccagcagcgcggccaccugcgcgcccgcgcccagcaccgugagcagcgugcugcgaaggcccagcgcggcgaacagcguggcgcccagcgcugccauguagagcagcgcgggccgggacggcgcuucuucgcagcgcagcaggcguccgcacgccgcgccgccccgcagcagcgcgcuucccgccaacgccagcgccgagcccagugaccagagcagcgcgaacuugcgcgcgcgcagcagcaacaccggugcguagagcgcggcuaggccgaaacacagugcagccagcagcaggcacccgccgcccgccgccagccgcugcccgcgcgucacgcucgggaggcacgucaggccggccgcugccgacuccgcagggcuccgcgcccacguccagcgcaagcccgcgcggcccagccacuccuccgccggccgguccccgggcuccuccgccuucuccgcggcgagcagcggcuccgcggccgccgggccgccagcuuuccccugcgccagguacuccugcagcuggcgguggagguccgccaucuuggacaaggcgguggcagaaaggaaaagcugcggcucacuuccggcccuccgcugaagcgguucggucuucgggcggcaauuggucggcgacggcgaaaggggcagggccugcggcgcucgcggaagugccgcggugccugcucugcggacuuuugugguguccccaagua

SEQ ID NO: 18501 - RNA, 8386 nt, Homo sapiens
uuagauccuaaccucugucuaccaaccuuuuugcucaguaggagucuugauagaagauaugaaucucugagagguauguuuauuuguuaauccuaaccaguauaauaagcaaauacacuauaauagauccacguuacuggaaucuguaaaccuugagggauagcuuucugcuuaaaaacacacacacacacacacacacacacacggaaaaccuuuauuuuaaagucaaguugugagcaaauagaaauaaaagacaaaaggacaucacucuuaucaaaugugugagcaguagaagagaccacauuuacagucaauagaaauaaugaaaaaaaauuagguguuuaguguauuuuaaacaguuuuguuuuguuuuacuugagggggacgucccaaaauuaaaggaauggagaaauaaucaaaaucauguauaccaucuucuauuuccagcuccugauuccccauagguaacaucccuuaggagcgaagaguucaauuaguaauguuuauguguuaugucaggagaugaaacccuuguucuuaggaucacagaauacuaaagcaccucaaaaaaacagguaucaugugaaacagugguugccaaaaguggagcgaggaugauuucacuaggcauuuggcaauucuuagagacauuuccgguugucacaauuggagggauacuaguaacaugaauuggguagaggccagggauguugcuaaauagauuauaauacacaaggaaagcagccucaaagaauuaccccucccaaaaugucagaagugcugaggcugagaaacccugauguaaagaucagucccaguuauaaacugaaaacagcuauuuacaaagcaguaaaugcaagaaagaaaaggaagucgcaaagagaaagugauguaaugcaaauugaggauuuuacaagaucagauacugcugcuuuaagucaagggugaauaaucucaacaaacagcaaauagcaaucacuuuaccagcugcauauugcacccacauagguaacucuucauuuuaggaacaaacugaauuugaacacugagccuuuugaacucagccaucucuauauauucuuuccuuaaaauucaugauuuugggcaaaaaaaaaaaaaaaagcauaucaaaacaaaauuuuaacuacuaaugggaagguuaaaaagcugccacguauuucuaguacaauguauccaauaagagcaaggacauuguuaaauggaacaagacagcugggaaaggccccacuaucucuaauagaauugugcuacuauaaaacaugaagauaucagcaauuuggccacuugcaguuuuuuucagcauguuaaagcaagugcuaaguacuuuauuaguacuuuauuuaguacuuuauuuuaaaggucuagaaaacaacagucuuccuggaggccccagaaucccuuucaugggauucauaagggacucagguauucuuauuuucugccaaaaggugugcuuauuuagggacucuuuuacgauacuuuguuucugaaguuagguagaucuugguuuacugugccaagguccuaccuagcauucccuguaggaauauuugaaauuccacuagcuagucuaagaagucaaagcacaaaauuaauugucaacgcuucucucauauucuuaaaauugaagcaguuugcagggaagaacaagaaugaggugucccugccuugguaaagcaacugccaaauuuuguucuagaaagaauccccaaguguguggaucuauuauaauuucuuuaucuuuuaugaaugagggcaucuuuucuacuugagcaagaucaugguccuugaccagugggcuuuuccuucauaucugucuuguguaguugugcuuuuccuuuggcucguuuuuggucugucaggguaaccagcagugcacaauaugagacaaaugcucuuuagagagaaaucuggugagacuguagaacccagagcaaaacuguuuuuuuuucagucucuguuuucuuuucuaaaugcuauagaaaauaaaggcaccugaaaagaaacuacuacuuuaacacugcuguggaaggccuuugcuuuauaagaaaaauauuauuagcuaugggaaaguaauguucuuuauguaaagacuuaaaaauagacuaauaguuuacagaguuauuauauaaaauacgaugugaauuuauuucaaacaaguugugaagguaccaaaaaccacaauaaaaguuaauauauauaaaaacuacuagaacaaaaaagcuugaagguguggggguggaggguauggaagaccaaaaguaaauuuaaaaaagaaauuuuugaaaggaaacagcuuuaucaggggaaguuaaauauaacacuccguuuuuuucuucuuucuaauaaugauauggaucaacaaaugcaauuugaacuuuuuaagauaacucuaaauguguuuuguuucuuaaaugcacaauugauucuucuauacuguaaugcuucuuugcugacgcuggaaaauggucagacugcugacuuugugccuuuaaaaugcauucugcuuugacaguggcagacuuuuuggugcuggagaagauucacuagcagucuuauaugugcuuuucaggaaauaucuuucuacuuaaggccuugagagauucaaaguggcaugacuuaggcuuggaccaaauauaagaucuuuuacauugcaaacaaaauguuguauugaauaaaaggguuaaaaaaaucauaaugacuaguggaaauuuugauggguuguuaauuauuuaaaauguauuugaaaguauacagacugaaaauuucaguaugaauaucuugaaaauuuucagcacuuuuccuuguuuacaaaacaucuuucuaacuuaaaaaaaugacuauugccuuagaaaguuuuaaaaggcacaguuacccuuacauaacauauauaaggaauuaaaauauuaaugcauuugcugaacuguaaaagaaaauuuuaaaccuugauuucagagugaauuggauuggcuuucacuugagagagucuuuaccuuauucccaaagaaacugcauuaaaaagaugaaacuauuucuuuagacuaagucucugcuacuccagcucauauauaugucagaucugcucuguaguauuucugacauggaguuguuauaagauaugugaaaucacuuagaaaauaaaaucagaugugaauaguuuagcaggaugaccaagccagaugcagacuccuuggccuauggcaaaguucugugccagugauuuuauuuggagucugggaacugauagcuugauauaaaaucaccuggugucaauuaaauauacaaaucuaucuuuuuuaauagaaugaaucuucuuuguuuguucaauaauuguaacuuauuaugucagguacuaaauuaacauccuuaaggaggucacaaucuaggaggaacaugggcaaacaguuacuuauuuuauggcauacgcuaacucugaaaguucagcaaugauguuuuaaaauguuauuuuuuauuaagggaaaagcaauuuuagguaaucauuggcuguuauaaacggaaaugucacugacaacagggauuagaguaaaaguaucuccaaacuagagggauccccuccccaaccaggucacauagcaucucucucaggacccccucuuacugcaaaacccagccucuacucaacaguucuggugauggggagcauuuauuccauaacaguguuuuuuuguucuuuuuuuuuuuuuuccccagugucucuuuuaaagaaaacauacuuuauuuuggucuaaauugugaaaauacccaaaacauuugauagaaauugaacucugucaacaguguuauuuauacuaagaucaggacaguuccuugagaucauacuguuuuauuacuaaguuuggccuuuguuuuacaaauguaauguucauauuuauuugaauuuuaagauugguuaaauguuaaugaaaagcaauccaauuguuaauuuuuaguagugccuuuucucuguaugccuuaauuuuauuuuauauuaauaauucaaguuacccaccaaaaugaagauuuuuuccaaaaucaguaggcuucacaaguucauuuggccuuagacuguguauugguccuuaaauguuucuuaaugccugccuccuccuacccuuuucuaccuccuuuuuaaaaaaauaaauaaauaaauaaauaaauguuaggagagaaacauuaggauuugucugugauagacaugcugcagcuuccacuagacaugaauucccaacacaagcauagaaagagguauucucguucuaaagagacauguaaauguuuucuggguugaauauuugauuuucaaucacauuggcacuguccaaguucuuggcauauuauaguucaguuaugauuuucaugguagaguuacaauacuuguuuuugcccuaaagaagucauucacaugguuuacaaauguuaaggcaaugagauaggacagugaguaggaaauccagggauagcagauucuaguccuuaauucucagcuaacauuuuggguaauacucacagaaaaguuacuuuucugugaagugugugcaugugugcauguaugugugcguuugcaugcaugugugugugugugugugugugguuagaguuggaggcagggaugggaaggaagaaggggaaagguaugaguguucaauuaggucaguuucugguuuuggaagaacaacucaaauguaugaccuacugaugacauacagugaguguagucauccuuggguaggaacaccaguacauuuuccagaaguagcuaguacaaaugauuguauaauaauauugauuguaaauugccauacucuugguugcuaaagguagauuaaaauucaauuuguguauauguaaaauaaucuuauauauaauucuuaaauagaaaguaauugauuuuacauaguucuuccugaacuuuuuggaacugaaauucugccaaacauuaucaaaauaagcuuccuuagcuuaccaaguauucacaaggaaauucucuuguaccucuuuuugguuggcuaggggaagcaugcugugaagcagcuauuccuacuuauaguugucuuuggcuuggcuuugacuucugccaugguuuggacaggaugccaugguaggugugggaaguaucagggccucccaucuucccauacucaccuuccagagcuguugauggaaaugagcucuugggggagccuagagauucuuuuuucagugguccuguaagcauucaagguugagcuucagaaagaugagggaggagucauagcuacaguaaagaaaagaauagauuuuaucuguugccuguauacagucucauagaauucuuauuuuucauaauugugcauuuuaauugauagucauaugguauuuuuguuaauaacagcaaaggcauuaaaucaguaccauuguuccuucugccugaugacuucuuguuuguaacacaaucuguauuaucagaaucacuuuaaaccaaagcuuuuauauucccuguacacauagccaaaauaauuagcacuguuacuucuguccacuuguaagcuaauaguauaaaaauuauaaagcagauacuaguagaauuuguauucugguauauccuucaaggaaaaggacaggugaucagugcauuuagacauccagaaguuacuuccacuauugaggaacuauguagacaugaauuuaagcuuguacaugugccaaucuuguuaaugucacuugaccacugauucacauagacagacauuaacgucugaugccucagguugauggcgaacuuucuuccuagugucuuaacauuuaugaacuuauguuugacuugaggggcauuucagcaaagcugugaggaaaaguagguucuggacugaugucugcuuugugccauagacauuuuggaacauaaggaaguaucugcuucuacuauauguacaggacuuguccccaaauaauuucugaaucccuuaaugcaguugagaaucccuuaaugcaguugagaacaguaaaguucaugaccauaccgaaaagcacuuuuaaguucacuucuuuuuaaauauuuuuuuagaauuuauuuuuuaaaagcauauguaacuagugaugauuuuagcauuagcuuuacuuggaggggagaagaaacaaaauuacaccuuaaacucuauuagauagacuacaaaauggauuugauguauucuuacuuuuccaaagaauuuuuuccaccuggaauaagaagagaggacuaguugaaacauuugagcuggagaggcuuaugggcaauaugaagugggccaaauucuugcaauacacccuauucaauugaaaguacagugucuaaggauaagaauacuucuuuaaagaccaacaauuguuuuaaugcaaucuuaauuaguaaaugguuuacauuuuuucuauuguuauugguuuuaaaauuugcuacccugaauucugaaauauuauaagaguuaauaccaaaaauacuuuuaaugucugacaucucuuacauuucacaugguucuuuuuauucauuguaaauaaaaguaaacuuggauaaauuugagaauaaacuuugaauuguugcaaacuaugauuaucaauuuguaaauuuacccuuugacauaauaauguacauuuuuaaauguagccauuaaauucucuauauuuaaccuauugguuucucucuaaauguuuuuaaucucaguugaaugcugggcaguuuauaauuauguacaaaggguuuuuuuccuauuaagauugacauuuuugcacauuuuuggaaauguuuaauuuguacacugauuuacuacucugaccaauaauuguugaugaguguaugagcaucaugaaugcgugcauugaacuacugucugugucuuuauguuuuaacuucuuucaagauguagccaucaguuacugcacugcuauuacugacuuaaauggaccuuuuugcuuuuacaaacuauacuuaucuaugguucuuuguugaagaacucaggaguucgacauuaauagaaauuagaaaauuuuauaauguauuauaaaauccauuacuaaguugaaaguaugcuuuuaacuguguaucaggggauguauguuuguguggagauguuuuuuucugucuguaggcacauguauauaucccaguaaguucuuauuuucauuucauuucuacauuuuuaugaacuuguuuuauaaggguacuguuuaguugugauaauuaaauauauauaaaagcuuucugagagauuauuuacuauaugaauauauuuucagcuggcugaucaaaaguauuuuuaaaauuuuguuuuuagccauucaaaauguauuuguauuuucagaauugaaugcaagucauacuuagagcucaauuaaaauacucuugcaagaaaaagcauuaaauucucuuugagaauuccgugaaaugcaaauuaagggaaaaauagguuuuaagcaguagcaaaaacacaccgcuaaaaauggccuuugaauucucagagcuauggaaaaaugugagaaacuaaauugucucgagaugucaagauuuuucuaucuccaguugcuauuggccuguccuacuguugucuuugaauauuuccuguauuccaccccaaaagauuucaacuuuuaguuuuucuaucacugggcaaggucagacuggguuuauaaaacaauauauuggcauauugugauucuuuguaauugacuauaaauugguuuugaaauguccaaacauacguugugugucuuuauauuguacuguguguuuuaaguaacuggcagaaaaagaauuggaaaugaaauuuccaaucagacaauguaguauuaaagaaaacuuuguuuuaaauaugcgguaccauguaaaauuacucguguuaggaauaaaguccacuguugaaguugaaugucacuaagcuuauuauguuaaaaggaaccagugugauuaggaaaaccuaccagaagccagauacagugugguacgugcaacauuucaugcacauuuugauuuuguuugucauucaaaauugugcuuguaaaaauguauacaauuucugaguuuuauaauuucuagguacuuguuuuuucuugcugguaaauagcuuuuuuuuaaaaaaaaaucuaauauaaaagaaaccauguuuauauuuuguuagugaucaaugacuuuguuuauauggaaauuuguauauuguuggcacacauuuuguugagguuuacgugcaugaaggccugcaauaauuagcacaaugaaaacugcuuuuucuuacauguucauuuuuuugaaagauuguggugcaaaggcuuacucuaauaaguaaccuucuggacuauggaaugaauauaaaugaauggcacuuugaguguuaauaaagcuaauauuuauuuccacugugau

SEQ ID NO: 18502 - RNA, 36882 nt, Homo sapiens
gggagaacuuuauguguugcacugagggcagucuccggaaacgcgauucgcagcgggcgccggaagcgguguugugucugcagcucuggcagaggacuguuccacuagacacgcugaagggacuggguacguguuuuccuucaggaccagagcugagaggagcugggaucgcggcggcaauggaacgggccucagaaaggcgcacggccagcgcgcuuuuugcgggguuccgggccuugggacuuuucagcaacgacauuccacacguggugcgguucagcgcgcucaagcgccgguucuauguaacaaccugcgugggcaagaguuuccacaccuaugacgugagugacuucuuuuguuagcuucccaggaaaaccacccuccuuggccucuaacucuguccuggagcaguccgguucucccuucccauuuaccacgggcuucccuucuuuaaccccucccuguccuauuaauauuucgccauccggucacguccacgugcugauuuggcacuugcaguccuccuggggcguguuucagaggcagccuggccaaggggaaacugcuagagaacaucucaguuguauggcaguaauauuuguucagugaauauuuauugaccuucccuugaagguggaaacauaauuaagacaaaccucuaccucuugcauucuuaaugagagagaaaaacaugcacgcuauuacguuauuggugacacgagcugaguuagaaauucacucuagguagaauacauugggagaaccggagauggugagauuaauuaccguuagggaaaauaucuaauagcaaucaguuauuuucaacuaacgcaaagugucuggcacugucacucuaagccuugcagccguuucuuugcaacauaggugucauuauaccguagcaccuuuauauaaucuauuaaaguaaauuucagauaaaucacuuguuagugaugauuuuuucuccuauaacaguucaucgaucauuguaauagugucucuuguuuacuuguuucuuuugucuucuccgaaagaauguaaccucugugagaacagaaaccuugaugaggaggaugauaauagucaguguuaauuaaguacuuucuuuucuggaaaacagguagaguugucucucuuggaggauugugaauaucaaauggcuuauuagcaaaaagagcugggagguaggaacuaguugaguuaguggaaaaggaaagugagggcagagcugaggugaagagcaauuggguuucucagagucugagcugguaauggagacaggguggguuagaaccauauuaaucaugugaaaguauuuaguguuaccauucucugcacuuguuccuugcuugcuaacuuuugcuuuugcugguuaauguuuucuuccuugaaauguaauuuuucugaguuuauuacugaaauaacucuugaaaucuugucuuugguacagugucuuuccugacacugcauuacacacagacacagguguuuuucccuauauucuacuuccaaagaaacccuguggugaggagaguaacauauuuguacauuuuauaaaguuaacaauuuacuuacuguguguugacauuuagucauaauaaagauggcuuuuaaguucuccucuaguucuaacacugaugauacauucguaacaucauggcauguaaauguucuuuacccagacuguacacugcucagauuaaccaaugcauugggcugugaccucuaaaacugaaaauacuugggaguaaaaagaaaaaaaaaaggagcuaaugaaccuaagucacuaauugggucuacaagugcucuaucccaugacuauggcuauauaugcuguccccagucagacuuccuacaguccuacagauuaguuucuucuacaggggaaacuagacaaguugugaauagguggugguagugaugguaguagcuaucauguauugagcaguuacuauaugacuggccccauucuguuuuacacaaauuuacucauugaauccucauaacaaucccauaaaguaaauaaauaccuguuuuacagaugaagaauuugaggcacagggagcuuauuuuuccagggucauacagcuggaucaguagccaugauuggggucagcaaauuacagucuguaagccagucuagcccacuguuuguuuuuguaugacccaggaguuacgaaugauuuugacauguuuaaauguuugugggggcaggcuggggguagggagaaggauauuucaugacaugaaaacuaugugaaaaucaaauuucaguaucuauagauaaaaguuuaauauacccaugcacauuauuuaucuauuacguauggcuguuuucaugcuacgguggcagaagugaguaguuggcaacagagaccacaugcauugccugcaaagccuaaaauauuuaauauuuggcccauuauagaaaacauuugccuaccccuuccaucaccacuccuggugaaauacaguugaaaauauaaacuuuccuaauaaagaaaauuagugucaguaagugucuuucuuaugaaggacagcauagcaaauauacguaugagguuauaucuuaaucuucagguguuagguuauuaugauuauguuuguuaaugaaaauuuaaccuuuuuucuuuuuuaaacagguucagaaacuuagucugguugcaguaaguaaguauggacuuuauucugaauuuaugcacaucuaaacuuuuuuuuuauuuugacauaaaugugagacuuacagagcauauaaggaagccaagguaacauguaugucuuauaaacuuacauuaucagcaacaaaaaagggugccaggauaaaucauguuuugcuuuuaguuguuauguaucuuuauuuucuuuaaucuggaacuguucuuuagacuuucuuugugcuucaugacauugacacauugacauuuuugaagaguacaggcucauuuagaauguccuucaguuugaguuuuuuugacauuucuucaggauuagauuuagguuguaccccuugggaggaaucacagugaauuguaucagaaggcacaugcuguuaguugguucuguuccugguagugauugguuaggaggcucuauuuuuaaguuaguguuuugucauuuguaacgaauaaguaucuuuugguaguaugcacugggacuauguaaauaucuuaguacucuucaaaguuauuaccugcugcuuuuauauuuuaugaugauacuugccugaaucaguuauuaguaugaugguugccaaaugcauguugauuauccuuaauccaaaaauuugaaacccaaaaugcuccuaagucugaaacuuuuugagagccaacaugacguuaacagggaaauauucauuggaacauuuccgauuucagauuuucagauuaggaacauucaccugguuauacauauaguccaaaauccaaaaaaauccggaaucugaaacacuucuggucucaaacauuucagauaaagcauagucagccuauagugauuuucuuuugccaucauuccuucuacuguaaggagaaguuuucccuuuucucacauuuugguauuucuuuccaauggaaggguuuuuuuuuaaacuaucuaauagaauaaaacauuucucagggcagagagguacuuguuuuaccaucaaauaugguucuugugagagaaacagaagaccuacaaggacuguaauguguauguguauuaaacuuauauuuuaauaauagauuagaaggcagaagaaaggcauuggaacuuaaguugaauacaaaagugaaugauaaacuuauaaaacaggguuaugcaaacaaauacuaauauggaauuugcagcaugaaaaguacaacaauccugugucuacuaacccuccugccccaaaagaggaaaugaaaaggucagugugaccaggauacugagagaagaaucauaugucacgugagaaaugcuaaagauugauaggcauauuucccuuggagaagacuguagaaacaauauugucuuuaaauguuuuaggaauaggcauauagaauaccauauguaauauuuuuggguugguccaaaggguagaguuagagauuuagauuuugaguuacuuuuaaaauuuuucuggaguuauuagugaacuugauguuccagaagauacucacauggguuaggcauguggcucacgccuguaaucccagcacuuuggaaggccgaggugggcagaucaccugaggucaggaguucaagaccagccugucuaacauggcaaaacccugucucuucuaaaaauacaaaaauuagccgggugugguggugcacuccuauaaucccagcuacuugggaggcugaggcaggagaaucaguuaaaccugggaggcggauguugcagugugccaagauugcaucacugcacuccagccugagugacacagcaagacuccgucucucaaaaaaaagaaaaaaaaaaagauguucacgugaagacuggaugacuaucugucagagcuuuguguuucaaaugacaguuuuuuccaaauaaccucaaaaagcuuguuuucauuucucuaggauuauguuuuuauuucugcaaauccuagacauucucuuagggaaggacaaggugauuuccuauccuuaguuugauaguuacuauuagauaucuaaaauauuuuaguuaaaauuuuauacacugauucucaacuuugaucuuuauuuauauauuuuuuuaaauuauagccaugaaaaauguuauauguauacuugagguuucucuuuaacaucuuaaaaaucccuguuucuuucauuuuguauuuucugcuagguaauucuguuccacaggauaucugcuguauggcagcugauggcagauuagucuuugcugcuuauggaaauguuuucucugcauuugcccguaauaaagagguugguaucgcuaaacuacuuguuugucagucaguauuuguuugucaugauaguggagggaacuuuaauuuugucauucuuuacccagcacacucuggaacuauacaguauucuuuuuuuucuaauguauauucaguuuucuggaggaagauaaauuuucagaaaaggcuuacuuaaaacuggugcuuuacuucaguuucuuugccagagaugaauaucaaaauuacuuggagaccuucuucaaaauuuuuuaugccguuaguucccaucucaggaguuuucuauuuuguauauuuguugagauaggacauaauguguauuauuaaguguaguuuuaaaauacuuuccuagaaaauucauauuugcaccaccacuuuauguggauugguuauuuauuauguauaacuuagcuuauaacucuuuuucuaaaaaucagaugccuguucgcuguuuagagaaagcuagauucuauguuuucuccacugcuaaggaaagaucuuuucuggucuaaaucuaccaguugguuucugaauuuguccuggaacaacuagcuugagaagugaccuggccuuaauggucuagaaugaaaggaaauguaggaauggggguacaaagauagccaaaugauaguaucacuguacuugucagggacuuggagugaggugguucccacagucuuucaucaucacuuccuguggcagaggaagguaacuuaucuguagaguucuuuaauggaagguguucagauuuuuagaauuggaaaaaauguucauuuuuguauuguuguuuauaguuuucccagggagauauaugugauuuacaugaggagacuuuauccuauauguauaaccuauaugugguucagauguggagacuuuaauaaaggaccuuuaugcacagguguggucaggguuaggggaacaaaauagggguggggaggcgucagacacugucaacuguaggaaguuguuaccaccccuaaggccaaagggccaaggagaggaaacaguguuacuggaaucuagugagaacugaaaccauggagaaggggcuauacuuauggagggaucagcuacuguaaggaucucugucaaagcagaaggguauggggaagaagacccuauaucccccuuucccaucucaucugaaagccaguuggugauggagucuuuagagaucagccuucuggaauauaccaucucgcuaggauauauguaguugcacugauugaauugggugagggaacuaggugugugugcaugccuccucucuaacccaagauggaaggcagagccucagaggucucauuucuuuguucuuaauggacaguuuacuuccuuauuguugaacuggcugagggagcagaugaacaugccuggucccuuaauauuuauguguucauccuaaccuugaauaaucaaaaguugggguacauuucuuaacagaagcaucucaggauuagcauguuuuugggauaauaugaauaauaugacaugaugacugaguaauaauaugaaauucuuuuaaacuucgauguuuuagauaguacauaccuuuaagggucauaaggcagaaauccauuucuugcaacccuuuggagaccacauuaucucuguugauacugauggcauucuuauuauuuggcacauauauucagaagguaagaguuaacucauuuauuugcuuuaucuuaggguaguauguguuuaauuaaaauuuaaaaucuauguaaacaucuaugccagagauuuugccuguaaauaguaagaaauuaaaaaaaucaaaaaucuuuaacguguaagaaaaaaaguucuaaguaagaaagagauaaacaacuuuagcaaguuaacuacuuauaaacuguuuaaugugcuuaccucaacuaauguauuuuccauugcaguucuccaacuuuaaugauuuguuguauuguuuucccuguggagugaauauugauguauuuucauaccugaguaauucuugguuuguauuuucaccuuuuaguaaaggagacuguaauaguaaacuugaucuuguaaucugaaggaaaauauacauccauuuccuagggauaugagucaguuucuuucaacugugauagcuuagacaguggcuauguuuaugggauuauguaucuuuaaacaugaagaauuuaucccuaggauaucuacaccuuuccucaauaaaauacuggguucaucaugaauugaaucuuuuaaguucuuuaaucugguuacauuuuuagcuuauauugccucuugguuuuuuuuuguuuuuuuuuuuguuuuuuuuuuuuuuuuuuuuucaguaaauauccugaagauugcauuucugggaauuauuccagguucuuguuucagauuaguaacccuuuucuuguuuuguuuuugcucaaguagagggagggaacagaauuccaaaaguauucccugugcagauagaaguuaaaagggcuuuuauuagguuacaggaucugguucuuacauuccagcagacucucuugaaccaguauauucagggagccauuuguagugacugacgaauaaaggcaaggaucucuuaaaauagcauucaaaguaaaguuuauauaauuuucaccuauaccuguacauccuaaacugugguacccauacccugggauuguacaguagugugccagauaguaugugaaccuaaagauuaagugaaauguaccuucuuugauacacaaauuuacuggaaaauagaguggaacauuguuuuaaucauggaggaacuguaaagugaaaagcagaauucaaacauagaaauuuugaauguaaccaaagauuucagagaauuuuuuuaucuuggagcaagugaccacuggugaugccaccccccacuccacaggguuauacguuuuuuuuuucuccuuuauuagagauuauuuuguggaaaugugugagaaguacucuuauuucacugaggugugucuuuuauuuuuggcauuuuuugaguggcccaucaaacuuuccagauaauuggcucuucguucccugaaagagcuaaguauaagcacuucacuuggaauauucacuccugucuguugaucaaauuacagaaacaugaaugcuaauccuuaggaucuuuuuuuuuuaacuuuauuauccuuuucuguaaaguaauucaaaagugaaugaaacuuuuaauaguauuuuuauuagaaguuacagaaaauuuuugacagucuaaauuaaauuacauuuacaaguugccucucauuuauuuuauuucucaagggaauguuuauagauuaguaucuaagucugugguuuauuuuaacauauaaaucuuugaugugauagacuuacuuuaagugauaaauauaugguuacauaaaacauuuuaaacuauuuuauaaaaaauauuuauaacuuucacuuuuguagaagaauaccugcaguugacuuuugauaaaucaguauuuaaaauuucugcaauuuugcauccaaguaccuacuugaauaaaauacuucugggcagugaacaaggaagccugcaguuguggaauguaaaauccaaguaaguauuuuaguuagaaaauaauauagcugucaccuuauccucaucuacuacuuccuaauguauacuuaagucucauuucucccugcccuuguauauuuauuuggaggguugucuauaaauaacaguugguccccuguaucagaggagucaauuaaccugggaucaaaaauauucaaggaaaaauaaauaaauaauaauacaacaauaaaacaucacauuuuaaaguaguacaguauaacagcuauuuacauaguauuuacauuauauuaggucuuauaaguaagcuagagauuauuuaaaguauaugcauaaaugugugaaaguuauaugcaaauaccacaccauuuuauguaagggacuugagcaucugugaauuuugguaucagcagagaaguuggggaaguccuggaaccaaucccccacagguagugagauauaacuauauguuugcuuuuggaguuguugcugguggcaucacauaugugaaagguggcaugugauccugacacauguuagacagcuucauaaaugcucacugaaaaguauguacuaaugaccuaauaacuguaaagaauugcuauagagaaggcucuaauaaaggucuaugagauccaucagaaaauaauaauaaugagauuauuacuagggagcuucugauuuuccauacaugaagauuuucuauacaugaagaagguaaaagauggaaaggcaaaucaauaauuuagugcuagcauuuagaaaugauuuuuaggguuaaaaguacuuccauaaucucccauagauauggcaaauaucuaauauugauguagcuagagggcuggauacaugauuuugaauacuucuauccauuauguaaacauuuaucaguagaaaaagguggcagcucacacuucuuuguauagcauuuuaaaaagcaaacaaaaauauuugaccauccaaauuguuuuuuuccaaaguccuuuuaaauucaaaagggaaaauaagauuauuaaagguuugauguuuuaaaucaguguuucauuacaauuuaacaaauaccauugacugccuacuuugugcuagguucagcaauagugacugaaauacugucuuugcccauuuacagaauuuaauacaugauuuaauauuuuaaugauaauuauaaugauuucagauaccucuguuugcuccauggauguguuauuuaucauucaugacuugcuucugaaauugagagcagcauuacuguugucauauaacagucauauaacaugcaaauaauauuuuuauuaaaauauaaguuauucccuuucaugauguuucuauaaagauacugcaguccuaaauuuuuuuuacuguagccuguaauauaacaugauuuuuacacacguauuuuuuuuuccacuuaggacauuuaauuucuuaaugagguggcauagcauaguaguuaguuugagaccuagaauuugucuggacaauauuacuaaccuugugacauuagcuuaaucaucagaauaguguguggaagaguaagaacuuaauaaauaucaccuauuauuauuucacuuuuuaauguguagcugauauuguuuuccuccaaaaaaaaaaaaauacagcuuucaacuauuuuucuucuuguaguaaacuucuauauacauuuccaggauggaaaguuggagugacagcucuucagcagguuaguauuuuucuguuaagucaaagaggaacaaaguuaauaggaaaauccuucaguuucaggaaucaaucauaauuuuagacguaaagacgaaacaauauauagcuuaguuuaccuuuaaaauuguuagccugaggaaauaguguuuuggaaauguaaguuaaaacaaguaauaaugccuuugccaauaacacuuauuggaguccuuugugcuuauaguuugacuuaaaucugugguugcuauggauccuuguuucuaaucauuuugcaaguauauguaguccauugucuuguguagacuggaaaugaguguucagcaaugcaagcgguauuguaagucauguagagaaauuugucaagauguugagauuuaugguuugaaguaauuggagccaaaauccuaauguuugauucgaugauggacuauuuaagaaauaacugcuuuuuuuuaaugaaucugcaaaauauguauaaauaaaugaaugcaugucuacagcgaaucuuguguuuauauuggccacauauguagccacuauacccuuaucuuuuucaguauccauugucuauacuugcccaauuuauauguauuccuuaucuucucuugcugucaucagccuagcuccacuuuugccuauccagaagacuccauaaguaucagaggauuaggacccuugaggacaagggauuauaucuguuuuaguaucuccaauuucuacacagggucucaugcauaguagacacuugaugacaaauuaauaaaacguguagccugauuccauucuauaaugauauuggacauugaucuuugcuaaaauagagaaauucauaauagagccuguauguaagacuuguauuauagaccauuauaaccauagaauauuagaacuggaacagacuaauuguaaaacuuuuuuugccuuuucacauguuuuguagguuuuuccuacuuucuuggauaagcaauucuucacuuccuuuguaauugguuacauguugccacacauagcgcaagccuuuauguuuucuaguugucuccuuuuucuguuuccauccaguccagugaucuguagugauuuuauacauagcuuucuuuuucuguugugguuguuuucuuuccaaaaucuuaccagcuagguuuugggaaugaggaugggauguugacuggcagaauugaagcugggaaguaauuuggaaaaaucauuacugaauacuucuaugcugaauaaaaaaguaugcuugaaugguaauacuugcugaguuuuucugccaucuuuuagaagauacuucauuauuucuuuugauaacaccuaauaaugaugcguaucaucaggauuauuaaagcuauuuugcuuaagaaaguaaaaguuugaauaauuuaauuuuuaggcaccagccguggauguuguugcuauuggucuuaugucaggucaaguuaucauucacaacauuaaauuuaaugaaacauuaaugaaguuucgucaagacuggggacccauuacuucaauuucauuucgcacagguaacuuuuaacauacuuauugauaggaguuaagaacacuuaaaauucauuacuuuaaaagucaauuuuuuuugucuucugguagcuuaaucuaauagaagugaaugaauacuggaguaaaaggcaaagaaauaugaauagauuauugguauauaguuuuuuucuaacuuuauggauuaaaagggaagagagaagaauucuuguuuauuuugggggaucuagaaguauuuuucuuaauguauuuuauuuuaauaacagauggucauccaguaauggcagcuggaagcccauguggccauauuggacucugggaucuagaagacaaaaaauuaaucaaccaaaugagaaaugcacacucuacagcaauugccggacugacauuucuccauagagagccacuucuugucacaaauggcgcugacaaugcucuuaggguauuaugauuauuguuaacaucuuccuggcucaucuaacuuacccuuuggguuauuacaagcuuguuuuaauguaucagcuuucaaccuagaagaugaaaggaauauggaaugagauauugguauagaugaaacaaaaagcacagcaggugacaugauugcagugaagcgggaaagaauuacaguuuauuucucccccaauacccacucccucccuuguagcuccagagucaguggcuuagcaagcacuacucaauaccaguugauuuauguagggggugauuugacugcuugcagaucagauggaacauuguagaagaacugacguuuuuauuucuuggcagauauggauauuugaugguccuacaggugaaggccgacuuuugagauucagaaugggucauagugcuccucuuaccaauaucagauauuauggacagaauggacagcagauucuaagugcaagugagcuucugcuucauacuauuaguuuauuucagcaaguauugagaugugggugcccaguaugagguuugauauuuacacauacuuagauucacauaucucuuugagugacuuagaagucuggguaaaacuaagaguccuuuuugucuacuugagaagcacuauagauguuauuaucuaugcuuaauguguccuucuauuuacuaauccucagagacagaaugguuagauucuaaaaauucuguuagucugcugaaaauuauuaguaccucauuuucauuuuauccuuuguucuuacuaaauggcauucuauaaaaaguugaauauuuuaaugaaguaguugcaaucugguuuucccuuuaaagugucccaaacuguaacuucaagauuuucaaauugaauuuuauaaaauuugugauucacauagucccuuguuuuaaugaagcuugauuagggauuuucuguguauaucaacaggucaagauggaacucuucagucauuuuccacgguacaugaaaaauucaauaagagcuugggacaugguagguccucuacaagacaaaauaagcuggucacgaaagaaacauuucaacauucuaugaaacaacuggaggaaguuucaucaaugcauuuuauuuuuucuuggaugaacuagauaaacauguauggaagagguaguaagauuccuagcaucaaaguugcuauagaagugauugagguucugcuauaagguuauugaaaaaaguuagacaucuugggugguaaaaacauacugcugccacccaaaagauguucauggccucacuugagcuaucuguagagugcacaguuuuuaaaauggaagguagcuuagagaaagcaucaaaguaaguggcauccaauauuuuugcuuuaaagcaaucauuuauucucuuucccuuuucaugguuuccagccuuugaaagauuuuguuuauuaaacaacaaaaucuuacuugguuuuaugauuacuaauuuuuaaguuacuaucuuauacuguucaugcauguauauaaauuuuaagauuauuuuuaacaauaucuaaaauaacuuuucuuagaauuaaaaaauaacagugguaauaacaucuuuguuuuguuucugacuuaaaugggaauaucuuguacuuuauaguuacaagacugauagcuuuucuuuuauauacacuuuuuauuaagaaggauucauagcuauguauguuccccuuucccccauccuuaggauuaauaaauaaaaagagaguuaaacguaaaggacuucagaauaccaugucagugagacuuccacccaucacaaaguuugcagcagguaaguaacuucaaacuguguuuugagaaguucuccuuugucauuuauuuccuacuguaugcuguuuuauuuucuguuuuaauaaaugcuuuuacaaauauuaauaagcauucagaagguaaccccaggugcaugcuggucuugugugaagacuaaaaaugaguuauuuuaaaugugaacuucuuaucuauuaacaucaggcuuugcucuucuguauaacagguauuaauaauauuugauuuuauagccuuuuuauucugucauaugccugguauaaugaaagucacuaauguaaaaagaacuggaacagcagaguaugagaacauagagcucugacuaauuaagaucuaagaauacugaggucuuaguauacuaugucauuugaccugugccacuuucaaagaagugauuuuaagaaaaauauagauaauggguuuguugcgugaaaucuaucaugggaaauuacuguagaggcaccauuucuauuugaaaguuguuauuaugaccaccuuucuguuuucucagagcuugagucauguuucuaaaaacauuugaaucacaucacacaucugcuuaaaauuuuuuaguggcuucuuaacaccuuuagaguggaaucucaucuccuuaacaugacuuucaagacccuuuguagugugguccugauugccuugcccuacuccuaucccucccaagaagauacuacacuuacuugcuguccuccguuuuguucauuuuuuucuugugcauguuaucccccccagguaauuucuacuuguucuacuacuccauccagagagccauuuacuuuccccaaaucuccugaguggucuuauaagacacugucauacuuuauuguaauuucuucugauuagaaucucuuguuagguauguuaauuagcuugauuuagccguuccacaauguauacauaucacaacguuauguucuaugccauaaacacauaaauacacacauuuuuuauuugucaauuaaaaaauaaucucuuguuagauuggaaacauauugcuaucagauauuaccuguuuguuuuaccauuguaucccuagugucugaaauauuggaugccuaauaaguaauaaaugaauaacagaaugaaaaguaauuugauuuaugauuuucauuacguuuuagaggaagcucgugaaagugacugggaugguaucauugcuugccaucaagguaagcuaucuugcucaaccuggaauuaucagaaaucuacaauaggcgcuuacuuucucaagccaaaagaguugaagaaagaugacauaacugcaacaguaagugagcuuguuuauaagaguaucuucucuuuaaaacuuuccuauggaaaucuuguuauacucaagguuucucaucauaauauugacugaaaaaacguaguuuaacauuuuaaagcauugcauaacccaaagccacaaaaauuugcuccugugacuucuaagaguuuucuaguuuuagcucuuauauuuagauuuauucucucugaauugacuuuuguguaugguaugauaaagggguccaaauucauuuuuuuacauguggauauccaguugucccagcacuauuuguucaaaagacuauucuuucuccauugaaagaucuuguuuccucugcugaaagucauuugaccauguauguaagaguuuauuucuggacucugaauucucuuccauugaucuguaugucuguucuuauaccaguaccacacugucuugauuuugauagcuuugugguaaguuuugaaaucaggaagugugacuucuccagguuuuuuguucuuuuuucaagauuguuuuggcucuucuggucccuugcauuuccguauggauuuuagaaugagcuuaucaauuucugcaaaaaaaagcagcuaugauuuugauagggauuucauuuugauuuuauagaucaguuugaguguugucucugaucuaugaacaugggguguuuuuccauuuguuuagaucuuccuuaauuuuucaacaauauucuguaguuguuuguauauaagucuuacacuucuuuggguacauuuuuccuaguauucuuucuaauguuacugaaguagaguuuuuuuguuuuguuuuguuuuuguuuuguuuuguuuuguuuuuuuauuuuggauuguucauugagaguguaucaaaaugcaguugauuuuugcauuauugaucucauaucuugcaaccuugcugaacuuauuaguucuaauaguuuuuaauagaugccucugcuuuugaaaaugcuuauuaaaaguguaacucaacauuugacccuauuuuauacaaauugcauuguaaguuuguauauucuauucucuguaguaugaaaauccagucuuaagcuuuuauauaauuuucuaaaccguaaagauucuaucuuacgcucccguagggacauuuaccuacauaguuuugaauaaugguuguaauaguagugguaauuauaaucacagguaacauuuucugugugauuacuuuguuccaggcuuucugucuggcauggauuauuucauauuuuccuuacaacaguccuacagcaugguacauugguuagcugcuuuuuauggacaguaaaacaggcuuuaugagcaacaugccuaagaucaaugaagcgaguaaggggcagagcugggauuugaaccuaagacaauucauucuagaaucuauauucuuauagcccauagggaucacuuauagaacauuuaguauguauguauacuaugauauuuagcuggaguugagucauuuuucugacagucucagcuaucuggagcaaagcuaguaaccaauaaguaauaagcaaaaauacguauagagagccugugcacuaaaguacaauuuguuacucaaagauaacauucacgguuuauuuauuuuugcuuuguuuggcuuagauaauacauuagaaugaauaaauuagaagaagagaaugccaggagcaggccgacuaaaaacaauaacuccccuaaaaaaauguaaagcaggacaauguagggccuguauuacuugcagguuauagcauacaagcuccuuuaguuucuugauuguauaacuauacaacauagcauaaacauuuaugaauuuuucaaaauaggucagcuuaauguuuguguuucauuuaggaagauaaaaugcuuuuuaaccauaguaauuucccaucuaaaauacuuuuuuuaaaagaaaucuuuaucuagaaaaauguauguauguaaaacauauuuaugugaugcaauguaaauaugucgugacaaagugguaugucaaacuuuauguugcuuugcuuaguuaaauaaaccuucauuaaauacuuucuacuuaguuuguauaagucaucuguuuagauguaaauugaauuaucucuugguggaugacaucugacugacacacauuggcaaucaguuauuucuccagcagugaccaaauauguagccagucucauguuuucaguauagaaaaaauauauugacauaauauugauauuuuaaguauuaaaaugagauuauauuauagaaccugcuuauaaaccaaauguuuucucuguagugucuuauauauuuccuuccuaauaugucauaauuaaaauauuuugggcuuuugcuuggccauucuaacuaaugguauguuuuugguuuuaugucagcuguggaagcaguuacaaaaggcaagacaaaaagaaauuaggcgauggaauguuuuaacuuuggcuuuguuaauaaauuaaaaauugaaggcuagucccauauauaguucucuugacuuuguacauuuaaauugaguuaaccuuaguuauguuuuguuuucuuagauaguaauucuucauacuuuuuaaagaauggagauagaaucuagcauauauucuuauacacccaaauauaauuacuuuauguuaaaaaaacuaaugaagcaauucauuuauuguucuuuuguuaaauaaaaaggaacaaguagauaaaaaaaugcuuuggaaagcauaaagugcaauaaaaauguuaguuauuuugucauuuguggguuuuuuuucuuaaaggcaguggauauaacuucuuguggaaacuuugcuguaauuggccucucaucaggaacuguagauguauauaacaugcagucuggcauacaucgaggaaguuuuggcaaggaucaagguagagaauuuuuuuccuuguuuuuuauuaauguagauagauacaaaacuaguagugaaagcugguauguauaaucuuuaagugcugggcauuuugcuaaaguugaagauggguuauaaucaacccuauauggcagauacugcaauuguaucauaaggaccauguugaaagagaaaagucauggguacuuaaagaguuacguggauauuauacagauuaauuuuuuuucuucucuccuuuaagcagaaaaucuuaacaaacuuuucaaaccuauguuguaucgaucugauuucuguuuuuuuacucgaacaguauuaauaauuaagaaucuucuuacaccccuaaaauccagauuaauuucaagauuuuaaaggauauuuaaguggcaccuuacauauuugaaugaaggaaucacuguguguauuguucagagagaaacacugccaauucugauuuuuuuuuucuuuugacaucuaccuuacagcucacaagggaucuguuagaggugucgcaguggauggauuaaaccaguugacaguuacaacugguagugaaggauuacucaaauucuggaacuuuaaaaacaaaauuuuaauccauucugugagccucaguucaucuccaaauaucauguugcuacauagggacagguaaacuuuuaaugauaauggauuuucucuuugauucuuuugguaaaagucauaaagucacaauuuaccaagugggaaaaaucagacucuuuaauaaagaacaacauuuggcuuaauuucccccaaaguguacuugauuuaacaaaauucaaguggaggugagauuuuaguucaaggguuuuuuguuuauuaaaacuggugcauuuaucuugcuaguggcauucugggacucgccuuggaugacuucuccauuaguguucuggacauagaaacuaggaagauugucagagaguuuucuggacaccaaggccaaauaaaugacaugguaaaacaaacucuaacuaauaaaacuugacucauuucuacuuuuguuuggguguguuauccuuuaauagccuuaaaaucauuauaugaggugguuaucaauuuuaauuugcaggcuauuuuucaaagauuuuaaaggaaaauuuugaauuaaaaguuuaauauuuuucagggaguugaugcgaucaaauuaaaguauaaguuuuagaacucaucuuuuuuuucauuaacucuaaacaaggccaaaguauacuuuagagaaugaaugauccauugguauauaugucauucuuaacuuaauauuaaaauaggcugggagaacucauuucugauuuacuauguauggaaugaauuaauaguagaagaccauuucccuggaauaucugguaucugguuuauuuuaguuuagugcuauuucuagaguuuacauaucuuaacucugaaaggguuuaauuaauaaaaaugugcuuaaguuuacuauuauguucuuauaaugggauauaugauauggaaagaaguaaacuaguuuaaauagcauauuucauuaaaaagaacuuuuaaaauaaauuugucacuugaggaccauauuaaguguauauuaucaucuuucaucaauugcagauaccuugauuugcuugaaaauagaaaaaguaaaauaaaaauaaaaucuuaauacuuagugacgaacccaacagcugcauuuacuaguucucacaccaaaaaucagaauuuacuccuuuccuucaaaauugaagaaaaaaaacauggucaggacauuguguucugcagauaggaggcuggcaaaauuauacaucagcagaauuuguuuugacagcaucuguagaaaugagggugggauuggguuaauugugcugaaauggcacuuuugaaaacaucugucagugucaaguugcucuuccuauuucuuuuucaaaccuuacuuucaacuuguauaucucgaguuucccugcucaguaauaaguuauuccgguuagucaaaucugugagcauuuauaacaugacuuuaccucucagaaucauucuuucccauccuuuacuaucuguaccacccuucuguaaauugaucuaucuauaacuugagauuugaguucccauuguauuacugcagccugaggaacaaaucaacauuuacguaucccaguaucaucuacuaauuuaaacugauggaugaacagucuacuacaacuguaaacuuuaaaguuuuuccuuuugggucaucuuucaccugugaucugguuugugccucacaacccuuagguacuacaggcagagagaucuauuauuuauccauuuucauagcuagaaaaaauaauggguggcauaaguaguuuauuuaaauuuauuuugaaaaucugauuauuauaguuuguuuagaaauaaagcauuauuaaaagagaaaagauuuuuaacuuaagcuucaagaaaaguaagcccuuaucacacacauaaacauugucuauaaauaaauagaagauugugauuugaaaauuaaugcaguacacuuuuuuaacuuuuaauaauucauuuaaaagucuaaucuuuauccagauuccaaaucagugguauuuaggaagugguauuuucuuuuauauaaaauaaggcagccugaauguuagucaaauuaauuuuuuuaugaagccugcauuaucuuuucauuuauuacauucuuuaagguguuaacuauauauacauacacacauacauacaaauauauucauauauauuuauauauaaauaauauauauauauauauauuuuuuuuuuuuaauuuaaaggcuuuuaguccugauggucguugguuaauaagugcugcgauggauugcucuauuaggacuugggaccuuccuucugggugguaaguuuauauuucuaauucccuaaccucuauaagauuucuaaguuauuuuuuucacaugugacuuuuaccgauaguuaauggguuauaugcuuuuucaaugugacuauauuuggagauuuuucugacaugacuauauuguauccuuggaguguuuuugauaacuaaacagcagguaguagugucaugaaacauaauagaaaaaugaaaucucucuuagguuuucucauccugcaaaauugagauacagaagcgagaugccuaaaccuuaagaaagcucauuugaccuuuuugauacuccaaaauaaagcucagacuuaaggauggcaaacuuuugaguuuuuuuaguucaugcugaauuuaguuaaaaggucaaacccccuaacuuuuccuuuuuguaugucucuucugcuucucugacauaauucuuaaaagaaggcauuuuagauagucuuagugcauuuucuguugcuuauaacagaauauugaaacuugguuauuucuaaagaaaaggaguuuauuucuuacacuuugggggauugagaagccccaggucaaagggccauaucuggugagagccuucuugcugguggagacucugaagagucccaaggugguauggagaaucacagaguaaggggacugagcgugauaauguaauagcuugagucugucuuucucuucuuauaaagccaccaguuucccuuucaugauaaucccuuaauccaugaauggguuaauccauuaaugaggacagaguccucaugauccaaucaccucuuaaaggcacucccucucaauaccaucacauuggggauuaaguuuaaacaugaguuuuggaggggacauucuaacuauaucuuaaaguggugaaaaugugugucuucggauuugguuaaaacguaacaaauguucagaaaucuguuucauggguugaaauuugcugcuaauccagggcuuuaaagagaaagugguaugaacagaggagacauacagaaugugucggcuuuguuguuaaaaauuaaguagguauagauaccauuuaaaaucaucucauuuaacauaggauugcuuagaugaguaugaagaaaggaagaauugugggaauagcaaaacaucuaauuuaacaguaacauaccauuagagaaagauaggugagaaaaaugagaaggaaggugguacuuuuuaaucuaaaauauucccaaauuaagcucuguucacuuccucuuccuacucaggaauggauaagcucauacaugaaaacaguuugaccuuuaggaaggaaaaacccugauguccucaguucccuucgaguucgaaacaggccugaggcauaccuacccaucuugcauauacacuggauuuguaguaagcacagcuaacgauugucacuaguggguccagcucuaauaaucagggaccuuuguccacagguuugucucuuucacuuaaaauagagugaagcaaaaucgaauuuauugacuguauccuccucaggcuucagaaaguucacuuaaaguugguauuucuucaauuaaaaaaacauuuuguuaaagacacuauuagaaauauuaguggucugucacuucuugggcuguugcuauuuucuaaaaguuaauguuauauaauuugaauugcuuuaaaauaagaaaguuguauaaauaguagaguuggcauagugccuuuuucauuuuccuguuuaauaguuuuaguuuauauuagugagagagauagauuauucaguaguaguaaauuggcaauguauuauaagugguaaauucgucuuuggaaugaaaaaauuaggaucugaaaguagcauucaaagccacuaaccuuugacucagcauuagccuuuugcugaauuucuuauaucaguaagaaguugaacagauucaaaucugauagauuuucagcucuaguaucuuuauuuuuaggugaacaggcaauuuuaagugaauagagaggcaugaagcuggguguagcacaagagcaagaagugaccacaucgaauuguuaaaagaaaauguaauaaaauguacauugauugaagaaaaguauauuuuuauuaaagaaaaaaguuuugguuaaaauuugaaguggaccaaaugagagagcuugaauaacuauccaacaacugcugcugcuuaauugcaacuaagcuaagauuuacaaugugcugcuaggcacuguuuaugcuuuuauuuuucauauccuaacaaguuguagguacuauuacuguuauuagucccauuucaaaaaugaggaaguggaggcuauuagagaaauuaagugauuugcccaaggugacuuaguuuauaaaugacagagcgcaaaaucagcacaggagaaagaaauagcuuucuuaacacuuauguuaucaucuuugcucagacugugucuuguuuuaaguaugaacugauuugcuuggaaaaaaaaaacauaauuaguaugacaaccuuuggaaauuccuaguucuucuuucaauuaaauaauuugaauaaugaaaacaaauuacauagccuggaaagugaagcuaucuaugaguaaacccuugaguguauuaacauacagguauauccaucuggaauugugccuaucugaaacaaauugcauggguauuaaaguuuccuguaaaguuuuuuuaaaguggugaaacauuuuuuauguuuguaaaauuuucagaggagcaaaguugaaauuuuuuaucuaaaauuaucauuccucugccacuaccaccaccuuuuaugucugguuguuuuugaucuaauagaaauucagauugaauucuuucuuauuuuuuuuuucugagaccaagucuugcucugucgcccaggcuagaguacagugguacgaucucggcucagugcaaccaccgucucccagguucaagcaauucuccugccucagcuucccgagcagcugggaccacaggcgugugccaccaugccuggcuaauuuuuuuuuuuuguauuuuuaauggagcugggguuucaccauguggccaggcugaucucaaacuccugaccucaagugauccacccaccucagccucccaaagugcugggauuacagccaugagccacggugcccagccagauugaguucuuugaggggugagaaauauauaaaauuaaauaaucuuaauagaauuuuucauuuguucugucucaccccaccccuacuuccugaggagaauuacaugagaauaauuggaauagaacauuguuuucaauuucucacugaggcagaaacauccccuucuuccuuaaagauuucuguggaaggugauuuuagcacuuuggaaauagaacauauggaagcagucuccauuugcucagaauaauaaucagaaacaaccuucugaauuguuaugcagggcucugaucuuguaaaucugaucucuuagaauaggaauuguuuuaauauuauuucagaaaaaauuguaagguaccuugggacuuacuuuuuuaagauuaccaugaaacuguaugguaguuuuaggucugggaugagccugugcauuuauguuucaugaacuaauguggcaguguagaauaugcuguguauguggaaaccaccuuccucaauuuggugguuuuauauaauggaagucccaucuacccacacaccacagcuguggaaaugaaguuacacaaugaaguugacaagauaauuauaguuugaaguaaaauaaguuugcucaagcaguaagcuuuuuaacagauaguaccuaaacauguuaggaaguuuuacccuucacguauguaaacuuuugaugaguaauauuaagacaaaggaaauaccuuaagauuugaaauugccguguuuuagguuuaaucuuuauauguguuaggauaauaucuucaucucuggauuguuuggauuaaaugacuuaacauaaauaauuuaauaguguauggcauagaauaaguauuuagcaaauguuuucuuuuccccaauucucuugauucccaauaaaagccauucuugugggcuuucaaaacagacuugaacagaaaucagacagguuauugcucccuuccccauaauggacaauuaaacagcaguccuuuuccugaacacacuuugauguguguguguuuguuuccagugcuucuaauuguugucuuuucuuuccaucuugcauucauuguuuaagguuuacauuuuuauuggcucuuuuagcaaauugagagaggcguuuuaccaugggcaagcaacuuaaugccucccacuggacagucuucauuuacauuugagcugcucacagugugugucccaugaaucacugauguaggcauacccucaguguguguaagcuguugcccuguuuuuguguuuuaguuucaguaguggcuuuacuagaauuuauauuggcuaacaauauaaauuggguagaacugcuuggguaaaaauccugacccaguugcuuucuaccuugagcgaguuuucaaaucuuacugggccucaguuuucuggacugauccgccuuaauaggguuugugaagauucgauuaguuagcacgcucaagugcugaggauacuuccucacacagaacacuaaaaaaguguuaaucuuguucuugaaauaauuuguauuaauguacauccggaacuugagucauuuguguguaccuuccuauggauaauauauuggcuucagaaaagcuguaauuaaaaaccaguauacucugcuuaaagcuauucucgcuuuuagccagccuaaggggucuuucagcaggauucagaugaguguaggccuuucucuuugcuucuuaaaucuaccucuuuucacuuccugcuaccaccauccuaguuaucuuuguugauuguuagaugauuacuaccauacugucaccauucucucuguucaaauauauucugcauucugauggcaaguuuuuauggaagugaagauuaugccacuaucuccucuuaagugguuaaugacuuuccaucgauuauaagauuaacacaaacucagguguuugauauguaagacauuguaugcagccuuaugcuuaugcuuaaugguccuacaaaacugcacuccucacucuacacaauuguauuuucccuugccuuauccaccacauuucucuuagccaggaaaugcuuucucuacuagacaccaauauccauugaaauccuguccauuuguaaagcuccucucaaacauaaguguucucugugaagcccauucugagucuucuaccugguuugugguuacucucccuuucaccccaacuuguaaaucccuucagcaguuuaaagcuaugggacuaguuuccauaaauugcuuuaugguucuucucuagagacugaauuuucaugguguuucauguauagcaugauuacuuauuugaaaaauagguacaguugcucaaaagcuuuuuuuaaauuacuauucuuauuuacauccauuuuguuauauuacuuucuccuuuugccuaagcuuuucauuaguuucacugaaguaacagaaauacagaauacugauaauuagauuuauuuuaaauguuauaucuuuagaauugucuccaagucagucuaccaaaauuuaguauucgagaaaaacagaaaauuuccuccuguuuccucccuguuguugaaacugcuucuccaguuagucagucuaguuaauguugucuuucucauuaagugagauuauuuucacauaguaacuuaguuaacaaagcuguuuauuaguggugacuuucugaucaaugcuggugauuaaaaaaaagaaaacauuuucugcaucucuuaucccuuaucuuuuuggcaaaaauauuuuugugaauuaucuccuuuuugguagaguucaaauacuuuuaacauguuaauuauuucuguagccuuauagacugcuuuuuguuggacucggcuccucucaauguuucuaugucuccuacuggagacuuucuggcaacuucccauguggaccaccuuggaauuuaucuaugguaaguucuuucauacaguucuguuuugggaugaagaagauuguauugucagagaguuagaguugcuaaaauugucauuuaggcuguuuuuaaguguauuaaauggaaaugucacaaguuaacacagauacuuaauucacuguaagucugagugauucaacaucugcuugauaauguagacagcuuugcugaaguauauucuaaaccacaugauugauuuuugucuguuacauuuggcuuuuauuugcagaaagaaugagugauuuuuaaaaguuuaggaaaagggaguccccagccaggccaugguuuuccugccaguaucccacaacuacuuuacgaccuuggccaaucccuucugaacuucagccuaguuuguauauaaaauaaggcacaaguauaagcagaauacuuucugagauuuauucuaguugcaugacuuuuauaaccguguaaagauacuucaaauucucuuuugaugaaccuguaagggacugucauugcucauaauaaauagaacaucaccuggguuuagaaaaaauuuuguuucuuuccuaacuuuauaucuguauuggguaaaagaaaaaauugauuuuuuauaaaagaauuaauuauaaaauguuauaauuacauuugaagauacaaagggaauuuuaauauauaauagaaacagacccuguucaccuuaauuuguaaaacagaguauguuuuagaauccaugaggcuucaacaguuuagaaaagaauagcuaugagcacucacagcaggaguauggcccuucucaaugaaguacugcuauuaauaacuugaaaccugagauucucaauuuuuauuuucuauuccagauucauaaggugugggaaaaagaaccuguccccuaaaagaccgguaucuacaucuugauuagucauccauggcuagggugcaggcugaguagcagaaauauggcuacuuagagggccauucuagagaaggggaaucuaugaccuuucagcagccacaagaauaugcucagcauauucgcacucugacuuacucucugaguucaucuuuccuuuuaauuuccuuaaauaaagguugauauaugucaaaacaauauaugaaauuuacuuuaccuuauaaaauuauuaucuacuacuggucugucuuuaauauguuuuuguacuacaucaggaaagagacucaauaauguauuuacacagcuuuguuaugauggcaucuaugacauaagucaaggcguuuuuaaauugauaacaaucuaucuuugagguauuuuuuaacuaauaaaagucuguagucaaauucaagauuguagaguguuucucugaaagaaacuuuuuauaauuuuuaaaauauugcuuauguuuugauuuuucagguccaauauuucccuguauucaguuguuucauuacggccacuuccugcagauuaugucccuucaauagucaugcuuccugguacuugucaaacccaagguaauuagaaaauugcaaaguaauuuuugagguguaauauuauaaaccuaauguaggagauauugcuaccaaaggcaaaguuuagugcauucaaucaaaguguuuuuuaacugauauaaaagacuuugaaugacuucaugaauuuaugcaaaaauauaauugaugugguauugauaagcuaucaaauaguauaccauugaagaagguguuuugggucuagugaugggaguuuuaguuaauaugagaaaauaaggaaaagacagggauaaguaaaugaaauaaaugaacagucuacaaggcugcauuaaaugaacauguuaugaaauacagauggauuuggaaugaauuaaguugcuuuuauaugauaaaaaucuuuuguuuuaccugaaaaauuuuuuuaagauguagaaguaucagaagaaacaguagaaccaagugaugaauugauagaauaugauucgccagaacaguugaaugagcaauuggugacucuuucacuucuuccugaaucacgauggaaaaaccuucuuaaccuugauguuauuaagguaauaauuaacauucuuuauagacccuaagcaugcauccagaagcauuuuuauuuuuuuaagcagagagaacuucuccuacauugagggcauuagaagagcaauuaauauguaagacagcacugacaaugcuauuuaaucaaauauuguuuaauaugguaugauuaucacaagauauucauauauauaucaacuuugagaacacucagcagacauuuggauguggcaaaaguugagccuguaacuacagagcuacuggaaacugaucuuuuaaaauccagccuaagaaaucacuuuuauauaaguuucuaaaacgagcgggaacacauauggcuauuauaacauauuucuacugcuagucauuugagaaccagagaaauuccacuagacuuucauuuuauuaaguuaacccuuuaucucacaccacacccugucaacuacugaaagauuuuuagaacuugcugugucagggcuagguacauaaguuaacaugagcuagguacuaaauaauguaccuggagaguaugguggugaagaaaaaacagccccuuuguccuugaggaauuuaugauucugcaugaaaaauggacaacuaugguauagauuaguauuuuuuagaguauguuuuaugaucccccacuagugaguagcaaaaacuacugaaaggaauacaauacagugaaaaauuucagguuaccuuuugaucaugaaugcaaguauuguuuggugaaacuugaguugguuagacauacacauacacuagaucugcuggauguacuuaagucacaguaugggcugugguaaaaaguuuaagaaacacugacuaaguaacuaauaauuauccuuguaacuaauaacacaagaaaagaagugugugucuuggguaaggaaagagaaguuuucacauuacauuuccucacagaaguuaaaauugcuucuuuuuacuugcuaacuuuuugagagauuagucaucagcauaaaggugugcugucuaggagcaugguguggaaucucuucaucaugcuguccacacaucagcuuuaaagggaguacuuuaugaaauaguucaaaugcaaggcauuaauaaguacaaauagauuagugugaggggagcaaucagaauaaugcuuaacuaauugagcagaguuuuggggcuacugugguccucacuaagauauaguuuauacugcauaaaaucuuauaucaaaacauaaguggauuaucuuuaugauaggaauaugcuaaaaccucuaauauuuuuauuuucugcugaauaaaagagaauguaccaagacuauaguuuacauuuguccuguggauaacuucuauuuuugcuuuucuuuauaagacuagauaauuuccagggcacuguggaguuccuccaaagccuuaugguuuuaacaaaucagugaccauccccuuucuaacucaagaauggugaguuagaaugguaacugugacucauaacagucuccaccauccuaaagggcucugcuuacacuacaguuugcggugcuuuguccuguguucaugugaucauuuuauuuuauaccauggcuucccuuuggaauagaaugucucccuagggcggcauagcuccuaaagaauggaagaauaaugugaggugaaauugugagacuucuuuauuaggcacuuuaccauagaaacgcucuuccaucaaauguuccugagagguggggcacgguggcgcacgccugucccacuuugggaggcugaaaugguugaucauuugaggucaggaguucgagaccagccuggucaacauggugaaaccccaucucuacuauaaauacaaaaaugagccaggcauguuguacgugccuguaaucccggcugcucaggaggcugaggcaggagaauugcuugaacccgggaggcggagguugcagugagcugagaucgcaccacuucacuccagccuaggcaauggagugaaauuccaucucaaaaaaaaaaauguuccugagauacugauauguagcaguguacuuaccaaaacaaaauucuuucaauggaaauuucaguagaguuuuugcuaauauaauuuuacuagcauuugaaauacuuauaaaccagcaaucauguuuucuugaauuuuaaaagcacaagguacuaaagaaaaaauuccagcaaaauagaaaaauuagagcuguacuuugaaaggaaauuaucaaauuacuuauaaugucagucugcuucuggcuccaaaguuccuuuggagaaaaguaauuuaagaaacucuuuuguauuaagcauuuauguaaauuuugcuuuccauccuguuuugugaaagaguuuguacucaauacaaaaggaaguuuaaaauuacuuaauuguuauaucuucauguaaauauauucauauuucaggaaaaugagcuguguuugucuuagaacuuccccugugcccugucacuuuuuuucugccuuaucggcaagggugcuagagaucugcauugggaagcccaaguuaaggauagcugugguauuggucagaagagaucauauuuuaacauucuuaugugaaagaguuucauuccucuuuuacuuuuugguauuuguuuuaaaauugauuugaaauuaaauaugagaaacuguuggcaagauaauuccuauuuuucuuucucauuuucucuuaaucagaaaaagaauaaaccaaaggaaccacccaaaguacccaaaucagcaccauuuuucauuccaacaauuccuggccuuguacccagauaugcugcaccugaacaaaauaaugauccccagcagguaaaaaacaaauuagaagauucuaaguauaucgguguauguuuguauguguuuucugcacuucuuuaccaagaccuaguuuuacagauauaggguaaauuaaugauagcuuuuaauuacaaacuauacauuuuugggugauacuugaauuauuugaauaauguguauuuguuuuuguuuaagucuaaagugguaaaucuuggaguuuuggcucaaaaaucagauuucugcuugaaacuugaagaaggacugguaaauaauaaguguaaguugaauuauaagauauuuuaacuaauauauuuagcuuauuuuacuguauaugaggagaaauugaaggaaauaucagcguucucaguaguuaagauaguaaaaaucaaaaagauugaaauuuugguuuuaauuugacguaauuuuagcauuuauauuaaauaagcccacuaaacucaaaugguauugauauuauaaaaaucuguugaagauuuuucauauaucuaacuuacuuuuugcuauuggagauggacacaguuauugacuauauuuauaauaaggagauccuucuuguugugaauuaaauguaaaaguuuuguuugucguuuuuguagcaaguaauuugcaagucuuuuguuuuuauuuauaauuuguaauucagcggacugcuuaggugauuucauauauuccuaaauuauuuuauuaaaaaggaaauguuuuaaucugucuguuguguucauauauuuaaauuucgaaggcuacagucuguagcuaauagugauuagccauaagaacuguaaucauuuaaaaaacuguagucacucuccuaauaauuuuaacuuguccucuuguuuugauucaaaugcuuuuguuuucauaccgagauuacuugaguccacauuagcaaaagucagagaaugauacugaugagcccuuguaaaugacuuguuauguuuauggggagacaaagaaauaaaaacacuauuguuuacuauauacugaaggaucuaaaagugauuagacuuuugucauuggugauacucuuuuucagaaagcuaaagcauagucauugcaguucucaaaugacucauaaaaauagcuguaaguguacugaguguguuuuccuagggugcauaugaaacaauucuucuagggaaaagaaguagguuugggcuggguaagaauaagggauggggucuucccccucugauuuuauauauucuguacuguuaguaauauaguuccuaaugauuauguacuuuuauaacuuuauaacaauagaaaagaaaaauuauuuuaccucaucagauucccaaugcuaaccacuauuaauacuuuuguauguaucguuauaggcuucuuaauuaggauuuacucugagagaagauauaugagcauuuuaaaauucuaacgugccuguugcaaggcauuagauuuucuuuauuaacaggaaaaagguuuaaauuacagaaaaaaaauguguuuugaguacuuucucuuauauuggugucaucguuuguacugauuuucaauuauuuuggguuucauucuacuacauaauaugaaaaaauuaacccacaggaagaauuuccuguaccauuuaaauauauccuauuugggguauaaaaggaaaacuguaauuuucuaaguuaaaugauuauaaucaagucauaacuggauuaaaauuuaaugcagaugacacugcucucaaccuucugaaagaaucaggcccaucaggaauugaaacagagcugcgaagcuugucuccugauugugguggguccauagaaguuaugcagagcuucuugaaaaugauugggaugaugcuggacagaaagcgugauuuugaguuagcccaggcauaccuugcauuguuucuaaagguaagucuaauguaagacaguacugcccagcuugucuucuucuggggcagugcuaucuaacagaacuuucugcaaagauggguaugcuguauauccauccuuuccaguaucauagccacuugccacauguagcuauugaguucuugaaauguaaauagugugaucaagaaacuggauuuuuaauuuuauagaauuuuaauuaauuuaaauuuaaauaaccgcauguggcuagugacuaccacauuggacagcuagacagugcagcuugggagucuuguuuuguuuuuuuacucaacugcacaauaauuuugacuuuacccccugacauuuuuaugcuaucugcuugauccaaugugcugaaccauuaacuuuucuuuuuuuagugguuaguuacauuuuggaaguuuuuugugauuaugaauagaaaguuggguuuguuuguuuuuuuuucuacuacugaaaucaaaauguucacuucuaucauuauuaaaggaguuuugaucauuugacaauaagacuguuacuuuuaugauuaauauaguggugaacucauguuuugagggucuacuuuagugguauaauguguugaaggagguagaugaugccgauuuuuggugauaauagauuugauucuuuaucccauuuauaccuaaaaugaguucacuugaucugauuauuuaaaaguaucaggacuguccuuagguggagaggagugaugaccacuuuaauucuaccaaggaagucacaguaucauaaaggaccuuauaauaaaaaaaguuugauagaggaggggaaaaugggagauaguaauaaaccagcgcuuaagaaaacaaauauucaccuagugucuuuugugguuccuugguagaaaaauugaauccagauuagguaaaauuuuaauuuucuuaaauguucaaucaucauauuuuucuuugcaguuacaccuuaaaaugcuuccuucagagccaguacuccuagaagaaauaacaaauuugucaucccagguggaagaaaacuggacccauuugcaaucacucuucaaucaaagcauguguauuuuaaauuaucucaaaagugcuuuguuguaaaaauaaauuugugacuaaacaaagacuuucauauuaaauggguucaauugaacucauuucuuauuuuccaagugucaaugugaaaagaaaauaaaugcuagcacuacugacuagucaguauaucuccacuuuaaaugcuaaauacuuucuugaaauaaaaucgcaccucccggccaggcaugauggauaaugccuguaauuccagcacuuucagaggccaaagcgggaggauugcuugaagccaggaauuugagcccagccugggcaacauagcaagcaagaucccaucucuacaaaaaguuaaaaaaauaaauuacaccugccuuuuguuuugaagacuuaaagaaucugcucaaaugauuuauuuucugagucucuucacauuaacuuuuauaugauuuuuaaaaaauuauuaccugcuuauauuuuuugaguaucuguuucauauaaagagaugcugcauguucacugugaaguauugcugaauuaaauugaaaaugucagauaaaacugauacaugauguaguuauaaaaaugcuguuaugaagaaaaaaggaaugcuuuuuuccucgguggccuuugauaaaaauaugaaugauugacucucagaguuggaggauaaacuaaucaucuucuagcacagcccuguuguguugcaggagaggaaucaggcuaaagucugcugguauuucagugacagauuaaaacuuucuaacaguggccuagugcuuucuccauuguaauguacugaaaggaaguuguucauggaucagaaaugugggaggcccuuccuugcccaaggcaagucgcuguagaugguuaaacugauaccaaggauagguaagggaaauuccaaauuccauuggaagauggccuuuuacugacacugcagacauguagauaacaauaguuuaauguccucugaaaagguaaaaauuccauaaauccuugcaaacaauuuuuagcaauauuguuuauugcuaccacagccaagaauggguauuucaaagccaggguuuuuuuuauuuuguuuuguuuuguuuuuuuuuuuuuuuuuuuggcuacacuuuuuugggggggaccuuuuaauuugggaagaaaaugcugaguauacuuuucuuucacaaccauugcaaacccagguagcccuggaguuuucuuuuuuucucaucaucauuguuuuguuuuuuuuaugguucaagacuuuugcaauacaugaauuaaaaauaagcaguucuuuaaagcauagcgcucuaaaaacuauucuuaguuuauacccucaaaaguugggucuuucaugaaacacagugguuugaauaugaacaccaguagcauucucguucguuguuaggguaagagaguuuuguagaaugaucuccaaaagaagcaguccucaaaaggcauuuaccagugauaucuuuuaauauucauguuuuuauuuaaugauguaagauagaauuaauaaacuacuaaggaaauaagccaaugugguuauuguacucaauuucguuuuucuuuuagaaauguguauugacuuauuaaagccacugacagaaauguuaaucaugacuuaaguucuaauuuaaaaaacuauuuuccucuuuccuaaauacuauauucuaaauuggaauauggcaaaaucccaauauauaauucuauaccuaguaaagauuguaaauaacuaaaacaaaaugauaagagcugugaacugaaauuguauugcuuacagaaaucaugaaccgaauuuucuucucuuuuuaaagugagcauaaagacuuaaguguauuguuaccagagauauauuuagauagaauacaucauuuuggcagguaaucuucuagaaccuuucauguacuguuuccaucaagggagggaaagaaauagaaaauauaauuuuaucuauauuuuccuuaaaauauaucaaucugugcacacucuuucaguuuuuuaauuacucauguaauauaugacuacauuuugcuugugugcuuuuugaaaaccaucuucagucccaauauccucuguagaaguaauaguuuuaacucuccuagaucuucuuuuagaguguuuuuaugaguguuuaauguaggaauguguauauauuaucuacagccacaggaaauguauaguuacgauuuuuacauacguguauguauauuauuguacaacuugcuauuucuacuugggaguuuuuuauuuugguacauucacauuuaccuaaucucuugugcacuguccaacaguacuuugccuauaauagacacuuaaggaaguuu

SEQ ID NO: 18503 - RNA, 1442 nt, Homo sapiens
cuuuuggugcgagcuugcugugguuuuugcucuggguccucugggauggcgccuggcuguggccgcguggucucucacgcaggggcgccgggcgggggaacgcggccacccugagucuggugagucgacugcggcggccuguguccgaaguguccggggccgugaacaagggcagcggccuggccucaggccugcguucccacguuuggaaacggggagcuucgucgauuuguguuuacaucaucgacuaugccagggaguucuccagauaagccugguuuuauuuucgucagugaaaaggccuuaccguauaacugacuuuaugcuugcccugcccccguauaaaauaacuuaaaagcagcgugccugguuacagcuguuuccacgugcggugcucgucgggagugaucaccuacccuacaggugaguuuucacguucgugcaagaccagucgccauuuaaaacgcaucgcauuucacuuuucauuauuaagucggauuuuaaaucgugagaaaauuucucugaaauguauuguccguuuuuaggcuguaaucggcauuacugucagccagucagcaaccuuaugccauaaagccuaccucacgcagugucagccuuuguguugcccauucacuuuggaaacuagugaauguggugucaaaaaaggcguaaauuaaacgcuuugcagccuuuuccugcccuuaaauuugauaccuuugguguaggagcugcauaaguaacaguugcugcuuuuacguuuccacgcgugaucuugacccugcuagccuuaaguguaugguuucucuuagccaguucuaauuuuuguucagguggaagauggaugccugaaguguagacugcugcuagcugaauaccaucugggagcauaaaggugaccugaagguagggugauaugucuuaaagcacuuuguaaugggaauuuuuaucaccuuuuaaauugggguuccuucucuagugaguuuuaaugucagugguacauucguaguguugcucugucuguagcuauuaaggugaguuaauaaaugggauagccuccacagcuuauuuuugggaagguuuugcugauacuuccugagaagcccagggaaauaaauacgcauaguacuggcauucugcaucucuuuaagauuuguuuuuauguguaguaauugaguuuuuuaaaagcuugugaaaucgcaggcauauuaccaaguucuugauuaaaauguaauacaaaaauauuugcugucgaauugaguacuuuauuuuuucucuuaggauguccuuggugaggauuuugaaaauuugaucuucacaagaguugccuggaucauuugaaauuucugggagucugaggaguacugacauaauuaccugcuggagucuguaaauacacauuuaagacagugaggaugugaauaaauauauuaaugcacuuuggc

SEQ ID NO: 18504 - RNA, 142829 nt, Homo sapiens
aauauauauguuauuaauaaaaauaaauacagaauuuaaaaaacauuaaaaggaaaaugcuaaaaugaguucugcucuaguucaaaagaaaagaacgacaguaguuuccaggcaggcccuuugagguccuacacagggauaguaauacgacugggacccuuaaguggggguaacugaaugaaaucucuaaugaaagccugcuaaugacacagaaucaaaucucugaguaagccugucuccaaauccaauuucucuagaugggaagggcaugggcuuuauggucagcacuaucccuuaaugugagaccuugggcaagggacuuaaucucucugaauuugcccauguauaaaagugaggauaauuaucuagcagggcuguggugaggauuucauaucuaacauaguucacagcacauauaauagggauugcauuaacuugaagccuuccuucucuccauacuacaacauauguaauauaaacccugcccacugucccacaaucacccacccuucuccaucccaucugcucucucuccaaccuuccuacuuauauucuagcugaggagacauauaaauaagaagugacuugcauuucauuuuaaaaaccaagugaaaccaauauaguacaccaccaacuacuuagaugcugacaaacuuccacacuuauuaaaucaacaaacacugagugacagagcacucaugccagguauggugcuaugcacuguguauucauugguaaacaaaacguauucccugucuuauggagucgacuguuuaguguggaggcagugaagaaacaaaacauagaucauuuaaaaacauauugaguaccauggaagaaaugauaaggugcaaugauugagaauaauaaggaagacaggggaaaauuuauuauucuuaggaaggacggucuuucugaggugauauuuaaacugaaacuugaaagauaagaaguuagacauuuaaagaacaagaagaagugucuucuagguagucaagggggcauauacaaaccagaaaggcagucgggagcuagaaguguuugaagaggaguagugggggcuaggggagacagcgucaacaacauacaagggccauuuugaauaaaauccaacuucuuaccaugaccuggaggcccuaccugauuuggccucugccuaccccgaccacaucuccuucccacuguccaugucaccuauucuuucugucccucuuucaugucagacuugcuaccaccucaggaucuguucuguuguucccucugucugaaagcuuuugccccagaucuuccaguggcuccugggcccccauggucagucaggcuucagauuaaaugucaacucuggagaaagaucacuaaucaccaccucucacuguccaucaucuuucugugugguuugcucucuuccuaucccuuaucaccaucaaacauucuuuuguugacugucuuuuauugucuauucuuucacacuagaauguaaguuccgugaguuuauuguauuuccuauugcuguaaaucuagagccugaaacaguaucuaguauauaucggaaacccaaaugauauuguucaauuaauguugaaugaaaugaaacugaagagguaauccaagguaaagaacuuaucaaacugugugagacaaacaaggauuucccggaagagguguuuuuaaauuaaaacuacagggugguagugagaggugguagggaagcagaggucgcagcuacaaaauaauaacuugcucaucuccguuucuccgcuaucuuaugagcccuuguggggcugggacagaauuuuauucaucuuucuaucaucagcgucuaguacggggaguagcaaauagugagcacucgauagauguuugcggaauaauggacuagugugugcagaaggaucuauuaacugggcugcagcacaauucagagaaggccaguaagugcugcaacugagacucggcugccuaggcagcaauggcucacgggacagaacagcgaagcagugcccggcaagcggagcgcagcacccauugcgccugcgcauaacaggcucuagucuccgggcugugggaagccagcaacaccucucacgcaugcgcauuguagucuucccaccucccacaagauggcggagggcaaguagcaagggggcgggguguggccgccggaagccuagccgcugcucgggggggaccugcgggcucaggcccgggagcugcggaccgagguuggcucgaugcuguucccagguacuguuguuggcuguuggugaggaaggugaagcacucaguugccuucucgggccucggcgcccccuauguacgccucccugggcucggguccggucgccccuuugcccgcuucuguaccacccucaguucucggguccuggagcaccggcggcagcaggagcugcguccggcaggagacgaagagcccgggcggcgcucguacuucuggccacugggcgagcgucuggcaggugagugaggcugcaggcauugacgucuccucccggcaaagcuuccucggcuuugccccgccgcugcucgggacccuacggugcucggcccgacucuguggcucucuucucuccaugucucacccucuccccuccccgcacuccccauucaggccuccaguuggccccuggcuuugcagguccuccauucucacgcaguggaugggggucgcgacgcccgccguccuccaccuuuccuggcugcugcuggagcuucgccccugcaaguggugccccauucgcguuaggugggugggucguccgcccuucccauuuuagucgcuuccccaucuuccucguuuggacccucuugcuuccucuaaaaguuuuaaacucucugccugggaaaauaccugauagcccggcauguggaguuacaaagaaagggcuguuauccaaaggccggugaauuuuguucacuuugaugggagaaucaaguccccaggagccuuggaugguuaggucagagucugacuccuugacccaccaaguagaggaauggugccucuguuggcaaaugauuguucaucuaaaucauucauuuuuuucggcuguaggaaaucuuuggucucugaacuguugaggugggggcgugagcuuucuagaucuagugaaagaauuggaaacuguuauauucguuuuaaaaaagaagaccuuaugcaguacauguaagacaucacuuaaugguacaagcaaggauaagugauuuauucuuuuauucaguguuagcuuaaauugccuacugacgucuuagaauuccauguuguacaagcccuuuguuucuauuuagaaaggacuaaaauggagaaaagcuuuuuaaguucaaaacuucuuaaauugcuuguauucucgauuguuguuacuguucaacccuccuuaggaguacuugauauuuucuauaugauuuagucuugugccagucucaguacucccuccuuuauuaguggagcaaggguagucagaauuacugguguaaaaaacuguccuaaauaacguaguaccuugccagagucuaagugcaaaaugugggaucaaagcgguaguggaggaaguugccauggcuaauuuuuccaucuuucccuggauggaaggguuggauaacgugucaagagccccaaaauuguagaagugagauuaaaaauauaaaugauagcuugcccuuugaaauugcaaauggguggaccuuuuuuauuaacauuaaauugagcaauaucguuuucuugaaguuaugcuagauguucuccaaaguuguuaagcacaaacuaugccugcuguauuagaauuguauguuaaaaauuuuuaacguguggguuauaaauagccuggcagauuuguuuacuuuucauucugucucauaacacauaaucuauuuuucccuuuacuguggacuuuugaccuuuuaaugcauuuuuaaaauuuagagauagaauuguucagcuuaaaagaaggaggaauauuuuuauguuugcuucuuguaugggcuaguucauucguugcuagccuucacuuuucuggaaccagagccuguguguuuuuagagcugguugucucugaauucucugcauacaguuugaaggggcaguagcaaagcagggguugcugagccccaaucaguggcucacugcuucuggcaaaaugauuuguagcucuguaucaaaaaacaucugaccacaaacucuuuaaaaccucucacuuuggcagggugugguggcucaugccuguaauuccagcacuuugggagaggccaaagcgcauggaucgcaugaguccaggaguucgagaccagccuaggcaacauggcaaagccucaucuguacaaaaaaaaauacaaaaauaagccaggcaugguggugcaugccugugauuccagcuacuugggaggcugaggcaggaggauuguuggagcccgggauguggagguugcagugagccaagauugugccauugcacuccagucugggugacaguaagacccugucuccuaacaaacaaacaaacccucucacucuuccacucuuauggaauuugguauuuuuuccuuucucucucucuuucucuuugugaaccuucuuugucucccuguucuuccaacccauuacccuaaugcugauuucauuugccucccuguguaaccaggaucccaugaucaucagcuuuuacuaagcuccuauugauggccuagaaugcuucacuuucuguagacuuaccuuucuaguccccaauccuaaauaagccucgcuagcuuuaccaguuugaccccugaaauucugagggacaucagagacagcuaugugaggauauuggucaguuuuuaugccaguuggugcucucugcugggucucuaguguuguguuccuuuucuucucauuuccucagguuuuuauagcaaauaacuuaaucucuuccuuugcugagaaaaaucucaaccaucugagguauauuuccacuucacuuuuuucaucucagugucaucucuuuauauauauauaucucagaggaagaaaugaccuucuuucuuuucaagagcaacccccucccuccagauguguccauguacccuuucccaucuuucuuucucuagaaacuguccauuuucacuuccuguccaccuucuucagccucucccucucuagccuacauagaugcuuguaucuucugccauauaagugugugugcuguucaacucuaggaggacguucuaaagcuugagucugcuaugccacuguauuucuauucuuuucuuuaaagacuuauucuuucaucccaggaagcuguuauaguaggaagaacauugacuuuugagcaagauagaacuuuugaucuggguuuuugaagucuuuuaaaaccacuuuaguagcuguguaacuguggguauguuacuauucagauuucauucuguaucuauaaaauauguuauacuuagcucacaggguggugguuaaagaaauuaauacauguuaaauguccauccaaguguuugguacauuguagaguucuuacuaaaugcuucugugcuuugcacucguacugccuuuaccauuucaccacugaaacuacuguuuuaaaaguuaucugugaccuccgaaucaccaaauccaaugacguuuccucugucauccuugguuuccuuagacccagggguccccaaaccccaggcugcagacagguaucaguccuuggcuuguuugguguuaggaacugggcagcauagcaggaggugagcagcaggggagcaagcauuaccaccugagcuccaccuccuggcagaucaguggcggcauuagauucucauaguagugccaaccuuguuuugaacugcacaugcaagggaucaggguugcauguucuuuaugagaaucuaacuaaugccugaugaucugagguggaacauuuucauccugaaaccaucccccacccaacuccugucccauggaaaaauugucuuccacaaaaccauucccuggugccaaaaagguuggggacugcugccuuagaucaguugugaaauauacugucuucuguagucauaaaacgaucuagauuucuuggcuuuucugcauuauacuuccugauucuguauuucucaggaaguuucuucacauuuuccuuuuaucaguuaggcugcaaaugggauuuaaaaaugaaagauaagcugggccauggugucucacaccuguaaucccagcaguuuuggaaggcccaagugggaggauugcuugaggggcggaguucaaggcugcagugagcuaugauugggccacugcacuucagucugggugacagaacgagaccccaucucaaaaaaacaaaaaaacccaaagagauguuuuggcucuugcaauuggcaaguacauagauagaaguggcuugaagagugcuuugucaugucaucagggcuaagcucccauuuaucugcuguucucucaacauuguccuuguguuugggcuuuagacuucccuucuaauaaaaaaaaaauugccaccaaugauguucauauuauagccccuucauuuauuuccaaagaaagagagaaggccacuucuccuagccuuuucccaagaauccuaagcucuaguuugauuaaacaaacauagaucaugcugccaaaccuguaacaauaucuuugucuagagggauggaauuauccuaaguggcuuagccaguggagugaaucuuaccugaaaauagagacugcaacacaauacggggaagggguggauccuggggaaguaaccaguguccucaagguuccauaugcuuuucacuguguucucuuggugaucauauccuuuaugauauaaaccaucauuucuguggggcuguuucuugguucuguaacucccuacuuccauuuccuccuguauaugucuaucuuauauauacuacccuaaguuuaacucauacuaaacugagucaguuugaucucuucaccaacccucaccuagugugugugugcacauauauguuuuguuguuugugagaccgacgggguuucacucugccacccagacuggcauguaguggcauaaucacaacucacuguaaccuagaccucucaggcucaagcaguccucccaucucagcccuuagccuccugaguaacuaggacuacaggugugcaucaccacacccagcccuuuuuuuuuuuuuuuuaagcgaccggggcuugcuguauuccccaggcuggugucaaacuccugggcucaagugauccaccugggauucucaaagugcugggacugcaggcaugagccacugcacccagcagcaugugcgcguuuguauuccucuucccccgauuucucuuuucuaacuaccucucucucaacaacccagucuugaaaucuuucagaaaucuugguucuucucccacugucaaucacgugucagaucuugaauauaucuuguuuaguuaggcccccaaguuguauaauacccaguuaacauugauuuaaacaguaucucgggcuaggcgcuguggcucacgccuguaaucccagcacuuggggaggcugaggcgggcggaucacuugagguuaggaguuugagaccagccuggcuaacauagugaaaccccaucucuacuaaaaauaaaaaaauuagccggguaugguggcaggcgccuguaauccccacuacucaggaggcugaggcaggagaaucacuugaacccaggaaguggagguugcagugagccaggauugcaucacugcacuccagccugggugacagagcgagacuccauagcaaaaaaaaaaaaaaaaccaguaucucacauaaaaaguccagaaauggaguauuccaugguuaguuuagcugugcuaugauuucaucaaggauucaggugcuuuccaucuuuaugcuuggcuauccuuagcaugcuuaacuuugggcucagacuuugccaucaugguugcagauggcucugcuccaggcaucacauucuccaaagacagguggaaguuuguccuuucaucucuuaauuaggcaacuaaaccguucacagaagcccucuuuccgauguccauccuggcgugccgcugcuuuaauuacgaggaggcugggaaaaugaauauguggcauuucagucuaggaagaggguaagcaaauggcugauuagaagaaaacagauggugucaaugacaguauuguauggagaaauuuaaauaaauaagaauuuucagauaauaguggcaaauuuaaaacacuguuuacaccaagaguuaauauaagcuguacauaggauuucaguguuuauuuucugagagagagucucguucagucacucaggcuggagugcaguggcuugaucucagcucagugcaaccucuaccucuuggguucagcgauucuccugccucagccucccaaguagcuggcgccugccaccacacccagcuaauuuuuguauuuuuaguagagacaggguuucgcaauguuggcuaggcuggucuugaacuccugaccucaagugauccgcccaccuuggcaucccaaagugcugggauuauaggcguuagccaccgugccgagccuauacguaagauuuugacugaacauuuaaauagucauaggugacugguuaaaaaugaauuauuauguaaaauuagaauauuucagugguauaucccaguuuguuuaagacuguguuaaguacauuuaagcauaucuguuggagcuacugcaagaaacagguauguuauauguaacaacuauugaaauagaguugugguuccccuuggggaugggagauguuuggaaauacuauauggggacauuuuugguugucacagugacugcgagguacuacucauaauuauuaaguagaggccagauacacuaauguccugugauguuuggaauggucccacaaaacagaauuguccuuucaaaaauaccaguagugccccugcacauguauacacugaaguuagcaaaugcuuugccuuuugaaagaauucagagauugaucuauauucuuacauugcaagugacagaaaacacaaaacuggcuuaaacaaaaaaagggacugaguacaucuucuaguaaacuuuagcuaagacuucauccaguggcucacaugaaaacaucaaggacuuaauuucucuuauucauucugcuccauuauuccccaugauuugguuuuauucuugggcuagcuuaucuuaauggugguaaauuacuguaguacuuucagacuucauauccucauuucacguauaguaaaaugaaaaauauuuuguauuugauuuuacaaguauuuauuuaguaucaccacuacugaaacuuucccuaaacaucuaucccuaaaaaguuuauuaucucuucuaucaugcuucagcuuuacaaucuauauaucacacucuauggguauuauuuuucugucccaugcauuacucuaccuugucuuaauuauuguauucuuaaugucuaaaugucuggaauacugucuggcauaguaguguaugauaacuguuuauggaauuagugaaugauuuugugcuuacuacagaaaggaagaagcaaguauauauaacaucuauugaaauagaguugagguaccccuuggggaugggagauguuuagaaauuuaagaacgccucauuccuucaucaguuauuuuugaauccugaauuauguacauuguacuccuaccacuaaagcauguauaugaugcucuugcaguuguuauaauagaguaugaauucguuugaaagcguuacugaauucuacuuguguuuuugucauuuucucaacaaaaccaaaaccaauuauuaauugaacaaauauuuuugaagccugcuguaggcagauaguguggcaacauugagugggaacaaaacagagccuguguugucugagcuuaaauuuuagugggggacauagucaauaaauauuauauauguacacauacacacacacaaauaacaucagguaguauauagaucuugaaauagaauaaaauagguucaggggacaggggauacuacuuuaguuugguaagagaagggcuuuuugagaagccguuugugcuaagagaccugaguguucaugagugagguggccuguaccauucuugucgagaugugaaauagaauaaaaugaggugcccaucauuuuugguuuuggaagaguuuguguauaguuggaaugaauucuuccuuaaauauuuguuauaacaugucagagaaaccaccugggcugggaguuuuccuguggaaauguuuuuuaaaauuugguauuuauuuguacauauuuaugggguacauguuauauuuugauacguguauaaaauguguaaugaucaagucgggguauuuagaguaccugucaucuugagcguuuaucauuucuuuguguugggaggaaagguuuuuaauuauuaauucaauguauuguuuuuaagccuauucaaguauucuaucuugugauuauuuuuuauaauuuuuccacuaagaauucuuuuaucuaaaauuuuaaauuuacuggcaugaaauuguuuauaauaaauauucugugguccuuuuaauggcugcaggaaaagauucccuuuucauaucugacguagguuauuuguaccuuuuccuuuuccuuauuaguuucaccagagaucaguagucuuuccagagaaccguauuuugaauuuugcuagucuguuguauguuuauuuucuguugcguuaauuucugcuucuuauuuccuucccugcugcuuuuugggguucuucggugaaguucuugaauuuucagcauuucuuguuuuuaaauauguucauaaaguuaaacauuccccucuaagcgccauuuuagcuaguucuauuacuaguuuugauacauaguauuuuuugguacauaguauuuuuauaauucacuuaagauguuuucagauuucuguuaugauuuauacuuugacuuuuggauuauuuggaaguauuauauuuuuauuucuaaacauauggagauuuuccaguuauuuuguuuuuaauuuguaaaauuacaauguaauccaagaacauacucuguuucaaaggccuguuauuucagacuuaaaauuugagaucuguauauggcccaguauauugucuuuuuuuuccucuccauuuauugagugcaggucucuguauuuuuuuuauuaggucauauuuguuaauccugcauuucaaaucuuaaguaucguaggugaucuuuuguuugcucaucaguuacuaaaaguguauguuaagaugcuccauuaugauuguggauuugaguauuucccuuguaguucucuaaucuuuuauaaauuugaggcuaugcuauuagaugcauagaaauguguaauagcuauaucuucucagugacucaacauuaucaaguuuccucuuuuauucugguaguacuugcacauuaaagucuaguuugagaugaauauaacaacgcuagcuuucucuuuauuauaguuugaucuucuuuuacuaguuauucuagaaauugcuaucuaucuuauaaaaucuaauguuaaucaauaccuuuauccuauucucagaugaugcacuuuaauucuacuuacuugcagcccuucucauauaguuauuuuuguuuguuuguuuguuguuguuguuguuuugagacagggucucgcuguguugcccaggcuggagugcaguagcgugaucuuggcucacugcaaccucugccuuccagguuaaagcaauucucgugccucagccuccugaguagcugggauuacaggcaugugccacuacgccugccuaauuuuuuuguacuuugaguagauacgggguuucaccauguuugcuaggcuggucuugaagucccggccucccagaaugcugggauuacagguaugagccaccgugcccagccccuacucauacaguuuuguugugcauuuuaauucauucuuauuuuuucucuuucuuccucauuauuguuguuguuacuguuucauacugccaauauuuuauuuaaguuaaugcaugucuuuaccaucuuuuuacuuuucguaugaucuugcacuuaagauugcuuucuuugauuuugaaggaucugaaacacacccuuuagaauguccuuuagucugcuugaaaaugucuuuauuuuaucucagucuuaaaggauauuuuugcuagguacagaauucuagguuagcagugguuacuuuauuucagcacauuucauuguuauugagaccucaacucuuugugucucaacuuuuaagauaaugugauuuuguuuggcugcuuuugagauuuuuaucuuuggcuuuggcuuucuguuuuacuaagcugugauuaggcaucggauucuuugggcugugugaauauauggauuggugucuuaucaguccuggaaguuucuuagccauuauuuuuucaaauauugucuuugcuucauauucugucuccugucauuuugggacuaguuuaguauguuaggccuucuuauccugucucuuaccucuuuucuuuuucuuuuucuuuuucuuuuuuuuuuuuuuuuuuuuuuuuuuuuugcuucuuuuugaccucaaggcauuguucuggauauugcuucagacuuaucuucaaaguucacauuuuuuuuuucaccuaugccuaaucuguuauuaacucauucaguaaauaccuaauuuagguuauuuuuuaguauagaauucuuauuugguucuuuucaaaacuguaucacuuuuuacaguuuucaauuuuaagcaaaaauauuuaaguguggccuuuauccccuugaauguaguaagcauaguuauuuuucaguuugugucugauaauuccaauguugggaagucucuaggaagcugauucaguuguguuguagaaauaaauugauguauauaauguaagaugaaguuaaucuuucucuaaagaagguuuucauuugcugucaccaagugccugggggugugagaacaucuuaaugaaauuucaaaucuuuaacuuuccugggccacccagaugaguugaaacugacuucaguccaugguuuccuucugguuccuucuuuauuucuagguugcagcccuuuagggucucagccggaagccaaugcuguuuucacugcaguccucacccuuggugggucucagacucuggcuuugguccccugugccugcaaugcaggcaacaaacaaccaagcucagccucuuaaaugcuucuuuguuggcaaacucacaaaaggcaaaagcuggggucaccuuucuggguuccugacuucuaguggauuugagcuucuuauucauuccucguuauuuugcugguuauuuggugcuguuaagaucauuuuacuaucuuaucuagcuuuuuaaauugucuuuguaaggauacuuggucugaauaaccuggucugcuguuucuacgaguguaaguccaaauauuucuuugacuaacuuguucagaaagacuggaaauuucuacauuagccauuccuuuguguuagggcuccuuugauggugcaaauuagauaccuggaaaagguagacuuuaagcuaugguugccuuuuaauuccuuuaaaguuagguuaguuccuaggacuuugcaaagcccuaagggaaggagacagaggauauuuuguaugaccggagaagcaaaaaauacuuguaugugaguagugccuuaggguaggaauuauguaagcaaauagaauguaaugugaacauuuuugaagugggacuguauggaggagggagaauguacuaaacugaggagggacugcagacaaauuugucuuuuaguauuuuuguuggaaguagguucauuuucauucuuuccuucuuuacuucuucuuucuuuucuuucuuuggacagagucuugcucuguugcccaggcuggaguacaguggcacaaucuuggcucacugcaaccucugcuuucuagguucaagcaauucuccugccucagcccuccgaguagcugggauuacaggugugcaccaccacgcccggcuaauuuuuuuuuuuaauuuuuaguagaggugggguuuuaccauguuggccaggcuugucuggaacuccugaccucaaaugauccacccaccuuggccucccagagugcugggauuacaggugugagccacugcacccagccucauuuucaauaauaauucuuuuuuuuuuuuuuuggagacagagucuuacugugucgcccaggcuggaguggcgugaucuccacucacugcaaccuccgccucccagguucaggcaauucuccugucucagccuagugaguagcuggaaugacaggugcgcaccaucacacccggcuaauuuuuguauuuuuaguagagauggaguuucaguauguuggccaggcuggucuugaacuccugaauuccugaccucaggugauccucccaccucagccucccaaaguucugggauuacaguugugcgccacugcgcccagccaauuuucaauaaaaauucuggcaaaucucucuaugccauguaggugucaugauuuuuauuuuuuauuuaauuuaaauuuuuuuuacaucucaaggacaaaauacgauuucaaaaaucuuacccacaucuauuuaaaauauagguacaauuugcguuugaauucugagauuaaaucuguugaauauggaagccaaacagauacauuagaaauucuucuaggcaaacuaagcuaugguagucuacauaaauugguguucuucugugauggaggaguguuaaaaauuuaguauaacauaccaauauauuuuuccuguauagauacuugauuugauauuagucacagccauuaauaugaaaugccauccauuucuuugugauuaaauugaugugucuauaaagaacaaaaccagcucuguuguaugaaaaccuagaauucuuauguguuuacuguuuacuuauuuuuuucucuuugcuagaagaaaauacuaagucaaagauuccuauuauaguuccuucucuuuccugcuauguuagauucaaauagcuuuuuguuuuagauuugcucacuugccuuuaaaaaacugaaggauaaaaugagguggacagagaauuuuagaacuggaagagacccuaaauaucauuaagucucucaugaacccucccguccuacccaucuccuauuuuaaacaugugaaaacagaggcccaaggaagaugggugacuugacuugccuaaaaauaugagggaauuucucuccaauagcuuuuauauucuccaugaaguaggucgucagcaaagaguggcauagguagaaaaauaggucuguuacagauuugaggagacaaaaaagacacuuagagugugggaaggcaaacuuuccaggagacauaguagcccugcuaggcaguauuggauauccuuugauguuuauaguugugaauuuaaagugaaaccagcuagcuuuguuagcugguuuucccccuuuccucuauaauaagcugcucugguacaggcacguaaaaguggaauggaauuguucagcuagaguugagauuuuaccagguaacagagggagagaagaguaagggguuugagaguuugaaagagacugguuauuguugcaucuaaagagaacaguguaaagaugaaaguaacggauggugaaaaaugaugagagcauuuuugauuggauuggagaacacaguaaguaaggugagggaauguugaauuuggagauaguauaaugaacuagaggggcaggagauacauuuuaaagacuggaaauuuggggcugggugcagugguucacaccuguaaucucagcacuuugggaagccgagguggguggaucacuugaggucaggaguucgagaccagccuggccaacauagugaaacuccaucucuaguaaaaauacaaaaauuagccaggcaugguggcgugugccuguaaucccagcuacucgagaggcugaggcaugagaaucacuugaacccggaagacggagauuguagugagcagagauugcgccacuacacucuagccuuggcaacagugagauuccaucucaaaaaauaaaaauaaaauaaaaaaauaaagacugaaaauuugauuuuugagauuuuugguuaagaauuuggagaugacgcaguuauugaugaugacaagguccugcguggaucauggaaguugguauuuggaggugaagaaguuaaggagcuaagaagccagaguguuagguggguaauccacguagacuuugaagucacugagagugaugguggggguaagaguggagaagagugcuagaggcaauagaggguacacaguuggguaucaugucagaagaucuuggguguuuaagaaaggaggagaaaugguuuggaagugauaauuggaugcaaggagcauaucuuuugccucccucuacaccaggcuuguccagucuuuuggcuuccuugggccucguuggcaaauuuuaugucuugggccacacauaaaauacacuaacacuaacaauagcugaugagcuugaaaaaaaauugcaggaaaaaaaaaucuccuaauguuuuaagaaaguuuacgaauuuguguugggcugcauucaaagccauccugggccaugcagcccuggggacaaauuugcucuagacccuucaguauccuauuccuaucuccuggccuaaaguacauaggaugugagaggaaaaaaagacccccccauugagaaagcggcacagaaaguggugucaucugauuucaacuaagauaaaucggugaagaugacauuuauugaagaguuugaaguuacaggggaguucguugauuaauuuauuguacauucaucuauuguauuuuaguacaguaguacuaaaguaauacacuguucgguuuugugaguuacauaaauuuccauacuauuauggcauuuuaaacacuguguguuucagaaaaacucuaaacccuuguuuuuccucugcucuugcaccaccacaacaaucguuaacauaguaaaagacaucugugucucaucuugggaaauuuaccaauuaaaugaauuaaaaaacagacaccugugaccaaagacguggggcuuuuuccccacacaccaauaguggaugcuaguuggguguccuccaauucauuucccacacugucuauccagaaauaccaucagaucccacagguugagggcucaggccccaagaccacccccuccuuccccccagucccaaguccuagccucuggaacuucugauuggcuucaaguuggguuucccacuacccccucuuuggagucgauuaauuugcuggagcaccucacagaacucagggaaacacuugcuuauauuuacugguuuacuauaaagcauauuacaagggaugcagaagaagagaugcacagagugagauauaggggcaggggcgcggagcuuccaugccuucucuggguguaccaaccucgaggaaccuccacguguucagcuauauggaagcugucugaacccuguccucuuggcuuuuuauggaggccucauugcauagguaugauugacaaccauguagaaauguguuuggacaaaaagugcgugaucuaagcccagcaaggccugucuguucugacucuucuuggccucucuguguagcauuucuucuuugauauggggacaggacccucucuggaaugaggguuuuugacccaaaaccagauuagagucaugccuuggguagguaaaaggaggacaggagaaggcuagagagagagauucuguuccugaggccugaagugccucaacauuauuaaaaaaaaagaggacuauaauaagcauuauaguagugaagagccaggaacuggcugggcgugguggcucacgccuguaaucccagcacuuggggaucgcuugagcucaggaguuugagaccagccugggcaacauggagaggcccugccucuacaaaaaauaaaaaaauuaguugggcaugguggugcagccuuguggugccagcuacucagaaagcugagaugggagaauugcuugagccugugaggcggagguugcagugagccaagauuaugccacugcacuccagccuggggugacagagucagaccccaucucaaaaaaaaaagaaaaagauccaggagcuguggaugaaaacauauauauauguauuucacacugugcuaaaccuguugugguauucagguuuucuuuugugggaggggaaaacaugaagagaauaguaguucaaaaauuuaaacaucugucauggucccauaggaauaauguguugaccggaaugaugaugucccagcccugcccacaaaaaaccauuuaauuuauaugcuguauuaacugccauuacuaccauguguaacauugaauaaugcuauuucuagaggaaaaugaauucaaaguuugaaauugggaugucaggaacauuucaucuccuuuuauugcucuaguauaagaguuuucuuccuuaccuuaccauuacugcccccacugcuacucuuugccaagcaauuaaaguggaaauucccugcuucuaaacuacugggagggcucuaauuuuggggggguccaggguuuaaugauuagaaaugagaacaaaauucagaugaaaaaaagagcagaguuucaggaagucagaggaugaggagcuaucuggggaauagucugaucuuuuaacggcucccuuucccuaauccuaaagcaagcacaaaauauuuuuagagcuuuaugaucucuuauuguuaguaaagaugaaaaaauaaaucagaagugagcaggcuauccuaugcuuguuauuuuuucacauguauuuuuaacaguauacauacucuucauccacucaacaaauaauuaauugcuacuagauaccugggacagugcuuguauaguuaugaagaagaaaaagcuuguuguucagaagcucauagucuaauggagagaaauagauauuaguugaguugguacuuugggagcauggagaaaaaagcaccuggcugcuuaggauagguauagacagcuucacagaauugggccuugaaguaugagagguaguucauucauauucugcagcuauuuggguaccuacuuuggaccaggcgcaauacuagaauacauuugagaauacaauuaugacauacaagagucuuguccucaaacagcuuuuagugagaaagagcaauauauacguaaucccaagugugugguaaaugagauaguugguaagcacagggaucuauggaagcauuggggugggggugggggcagaucuuacucuggaaggaggacuuagggaaggcuuuugggagaggucaucuaaauuggguccuguaaaauggguccacauuaucuaggugaaaaagcagauguaagaaccuuccaguaaaugaaaugguauagugauuugguggugagugcacagaauuccaaaugguuggaguguagcuagaguaggugaguggcgguggguaaggauggaggagugugaagagccaaggccauaaaggaccuuacauauagugcuaaugagcuuagacuuuuacuuugucacuguuugggugcuuugaaagguagaaaauacuaaucuugaagggucuuucuaacagcuggcaauuaacagauuuuuauuuuauuuuuuuuuauuuugagacagagcuugcucugucaccccaggcugaagugcaguggcacagucuuggcucaccgcaaccucugccuccuggauucaagccauucucguggccuagccuccccaguuacagacacgugccaccacacccagcuaauuuguauuuuuaguagagacagaguuucacuauguuggccaggcuguucucaaacuacugaccucaggugguccaccugccuugguccccaaaagugcuaggauuacaggcgugagccacugcacccaaccagauuauuuccuguaaguauaacuuacagcaauuuuuuuaaagguauuccaggcaguuguuaaagauuuaaacaguaagagagugccacucgguucuguuccccagaggaagucacuguuguuucuugaguguucaagcagcauauucuuaauaucagaauaguguuagaaacaaaacaguuucaaaaggagaaggaggggccgggcacaguggcucacgccuguaaucccagcacuuugggaggcugagguggauggaucccuugaguccaggaguuugagaccagccggggcaacauggugaaaccccaucucuacaaaaacauacaaaaaaaaaaaauagcugggcucaguagugcaggccuguagucccagguacuugggaggcugaguugggaggaucaccugagcccaggagguugagucugcagcaaggugugaucaugccacugcauuccagccugggcaacagugagacccuaucucaaaaaaacccaaagcaccacauaucaaaaaaauuccuuuacuauggaauucccaaguauuuuguugagaaaaucuaaguauuugaauuaaauagcagaccuucuucagaaaaagauuaggaaaaagcccuuaccguaguauaugagguacagacugguucaggaucaagauccuuauuaauagccugugucuauuugaaaugggagaguucccugaccccuguugcaggaugugcaacaggggaguggcucaucuguucaggccaccguccaugcucaaaccccuuaugggagggggagcacacagacgggcaggugcagaagccggggcaagugccccugggcuccggcccccuggcagcauccaggggugggagccugcagcuccugaagcccaagugggcauguguuacagugagccccuuuagccuugcagacgacuuaaguguuaaccagcuaaguacccuccugguacccagguccuugucuggcauccaggaagauucagguuguacacggacuugaaggaugaaugcauggguuuuaucgaguuguggagguggcucucagugagauggauggggagcuggaagggggauggagugggaagaugaucuuccccuggaguuuggcuauccaguaggcaauuuccucucugaccauccccagccaaacuccucucggcguucaaacauuccuuuucuuuucucugcugugcuguuuugcuguucuucugcuucuccauuugucuccuuguggagcaggggguuugggguuuuuaaugggcacaggauaaggggacauggcagaccagaaggcaucuuuugggugcaaaaaaaggaaugccucuuccuauuuagggcugcagguuuccaggcuuggagguggggccuuugcuggagagcuacccuccucuacccaguauuucccuguuuccuguccguaucauguugagaggguauuugaauguggaaugaaauuuauuccaauucuuaaaccuuucugcuuguauaaaagguguaugacacuuaagauaauucaccugaccuuggaguacuugggagggaaaguuuaaaaagacuuauaaaguaaauaugaaguuucaguuuuaaaacauugaucuauuuugaaaaagggaauuacauuuauuagauuguccugauuuucuuuucucucuucucucugagaacauaauauuaaauaggcauuaugaacgccuauauuaggugacucauucuccuaaugcuuaaaaugagucuauaauauauauuagauacuauuagguuggugcaaaaauaauugcgguuuuugccauugaaaguaaugguaaaaacgcaauuacuuuugcaccaaccuacucuuagggguagucaggugaucaagagguuuccaauuugauugacauaguccaguaaugcuagauagauuuuuuuuuuuucauuuuacuuaauaguaaguugggacccuugcaaacacuuaucuucggacauucagagugaaauaauuuuauagucuauacuuuuaaaaaauucagcauguagcaagaccaaggaaagacuuucaaaaaggaagaaaaugguauagcauuaggcaaugccaucugcaguuauuaaauaugauauuuuaaaagcuuauauuuucucuuucaagguaagaauuugguaauauugguauaagaacaaaagucuuuugacccaaggcuuugguuucaaguucuaaaugccauuacuaugcccuauauuuauucuuucauaaacacccaauuuuguuuuuaacaucaguauugagauuuuucuuaucaauuaugauauauuuucagggcugauuuguguguuauaaacugauuuaucagguaaucugggcauuuuaggacaucuuaaauauuaaauaaaugaucauuuugaucuuguuuucuugggaaaaagacuuuaaaaaaaucauccuaugugcuacucuuucuugaauccacaugcauaagcauuuggugcuguuuugguaaccuucagucacuaagcuucucagugguaaaaugauaucuuuaugaauacaguuuguauuguaaaauuguacuuuugggggcggucuuauagcuguuuuagguuuuaaguagaggucaaaguauuaaaaaaaauugaagaagacauacuuaaauauacaggcaagcauaaaaccuuguuuuaaacauuuaacuuaaaaaaaaaaaucagaauuuuaucccuccauaggaaaggauaguuuaaaaugagcauguccaacccacagcuuugaaugcggcccaacacaaauucauaaacugucuuaaaacauuaugagauuuuuuugcaauuuuuuuuuuuuaagcucaucagcugucgauaguguuacuguguuuuuuguuguuguuguuuugagacagagucucucucuguugcucaggcuggagugcaguguugugaucucagcucacugcagccuccaccuccuggguucaagcgauuccccugccucaaccuccugaguagcugggauuacaggcgcccaccaccaugccugccuauuguuuuuuuguauuuuuaguagagacgggguuucaccauguuggccaggcugcucuugaacuccugaccucaaaugauccgcccaccucagccucccaaagugcugggaauacaggcgugagccaccgugcccgaccaguguauuuuauauguggcucaagacaauucuuccaguguugcucagggaagccaaaauauuggacaucccuggaaaacacugcauaccuugaaauugaaguuuuaaccgauuaggacauguuaagaauuuagaaaaauaaaguucuuacgcacaguuuuuucuaaaucuuuuguuaauuggguaaaaugguugccagaggugauuguguuuuuuuuuuguuuugucaacaucauagaauuuauaaacuuuuuuauaaagaguaugacuuaguuuuuuuuuuccugcaaucauauuuuccaguugaaaaagcuuuuggccauuacauucagcuauaaauuaguaacagugugcauaugauuucugauuauuuuuccucuugagccagaacuagaaacugguccuguaauaucuguggaucuuguucuaauuauauaucccuuuuuauuugaaauacuuaguauuuucauugccuauauggugaauucugaguuuuuuaaccuaacacacaauauugaaaucucugcccugaaaaauuccuaaacauccuugaagucuaguucuguuacuacuuucucucugaaaucuuuuuugauuaccuagcuggaaacgaucuaaucucccauucuuuaacaguacauucccuuguauuaaaacuucuucuguaaaugucuuaguccucuucuagauuauaaauugucuuacucauuauuguaucaucuacauucauacauugaacaaaaagcaccaagcacuguuauagaugcgagggaaagagcagugcaggagaaucuugguucuugucuucaugggauuuauauuccacuuuggaaaacaaugaugagagagacagaaaauuaaauaaauacauagauagagcuuuucagaucucaaaugcuuagaaugugaaacuccaucaugugguagaaagugugaggauagcaccagugcguugauaaggugaucauggaaggugugaucuuugaaaauuugacauuuuugccaaaaccugaaugacaugaaggacuagucauuugaagauuuggaagcagaauuuuugaggcugaacgaaagguaguucuaaggcauaagaaagagguaggugaggaaggacaggagaagugauaagaaucagaucuagauuaugcagaguuguaaaccaagguaaagaauuuaaaauuuauucugauuacacugggaagccaaugaacaguuugaaguuuuuaagggcucaugucauuacauugggucuacccaggauaaucucaugauuuuaaggucagcuaacuaauaaacuuaauuuuaucugccaaguuccuuuuaccauauaauguaguauauucacuagaguaacaccagagggcaagucuucagggccuaaaugcugccacauuuugcaugcauaaguuuuauuuaaucuaauauauauuuaguaucuuacaagggcagugaaacagaacuaacuuaggguagcugaguuguugagucaucacaguuuuucugauuuauuuugccuuuacuaauaugcccacuccuuggcauuaccucuuauuugcuaaugcccauacgauaaccccaaacucuguuucucuuuaguuauuuaacuaaauuaacauaaagaugucuccugcauuuaaagaaauuuuguuccagauauuuuccagagagaucuguauuuucucauggauaaaaauuuauggguggauucauuguagauucuaaaaggacauuuucaaaucuguuugaguuuucuuauuuuuaccuauucugauuauaauaaauccauucauucaauaaauauuuaucaaguaccuacugcugcagagccagcuacuauauaguaagcaucagaaugauaacaguugaacaaguaacuuuuuaugagggaugaggcuugaaaaaguacaagcugcucugaaagguaccuuagugaaggaaauugcugcugagacauggaggaugaggcaauauagucagcauuggcuuugaaggcggacugccauuucacuguugggugaauuuggauacuuuuuaaaauuucuuugagccucaauuuuccaugcaugugaauagugauaccuuuaucucuauagaaguuuuguuagauugaauauaugaaaaugccuaacguaauguuugccacugguuuagaagcauauuuaucaugaaacugaugaaguuuagugaaccuaauugcauggcccuuucuaaggcccuugcaggagcagcccuagcaaucuugaauuaauuuguguuuuucuuaaggacccucccacccagcugccccuuuauuauaggcugcuggucaccacaaaaucugaaucugccuuuggccacagguuaagugagaaauguuaauuucucucuccucuaauguugugacuucaguuagugucgaaccuagaaguacuuaacuuaaaaaaaauggaaagaaauuauauauauuagguuguaggaauuuuauaaaauucagaaaaaccgaaauucuuguaauuccuagggaggaaacaugauguuuuaucucucucugcuuuucucuguguacauacgcaauuuauuuuuuaaaagcuaguuuauaucauauuaaacagacaauauucugcauuuucacauaauauauggauuauauaauuauauaucauauaauuauauuuuacaacguaauuuuaaucaucuuauaaaugugccaaaaguauaauuaaccaagcuguuguuaguaauuguugagguuuuuucuaacauuucaguaguacaaguaaugccaaauuacaaaucuuuguagggguaucuguacauaggauaauuucuuuuaauugggcuugcuugaguauaagaauugccuuuguccauuuucugcuacuauaacaaaauaccugagacuggguaauuuauaaugaacagaaauuuauugguucauaguuauaggagcugagacguccaagagcauggcaccagcaucuggugagggccuucuuauugugucaucccaagguggaaggaggaaggacaggagacggccagagcaagcaagggaucaaauuuguagccucaggcuuuuuaauaaaacacauuaauccauuacugaggguggaacgugaauaccucccauuaggcugcagcucccaacacuguugcauuggggauuaaauuuccgacacaggcuuuugggggacauacucaaaucgugguaaacauuuuaaagacuuauauguccucacugacccuacaauauuauuuuaaaauaucauugccuauuuuuauaguacucuuguguuuauuucuauuucuuugaucauuugauauacuaaaacauucuucuggguuuuuuugguuuuguuuuguuuuguuuuagacagagucuugcucuguugcccaggcugcagugcaguggcgugaucucuguucacugcagccucugccucccgggcucaagugauucuugugccucagcaucccgaguaucugggacuacaggcaugugccaccucgccuggcuaaguuuuguauuuuuaguagagacaggguuucgccauguuggccaggcuggucucaaacuccuggccucaagugaucugcccaccuuggccucccaaagugcugggguuacaggcaugagccauugcacaugaccagaacauuuuucuauguauuuauuaguccuucauauuuuuucucauguuaauugccaguacuuaugcaagauaccgggaaagcuuuuugacaggaagaaguaaguuucuuucuccuguaagcaaguccugaggcuguauaacacuccaaauuaaaaggcuauuucaaaaugguuucccuacuguagugcagugggaacuucgagagcagaaucuaaaggagugcuugguguuucucaucccuggcagcacauaccaaagcuugggcacuacccacagauucuuucuugguguuuuaaaagcuccucggaguacuaaagggauucugcaguguaacaacuaagcucagaaacuuagucccguggcugcaucacaacauuuguuuuuccauauacaggggccagaguuuuaacuuagaauauuccguuuccucaguagaagguuauauuuuacaauaauauuauuuaacaauugcucuacuauuauuccgugagggcaucuuaauugaaugcccuuugcggguuaauuuaaaaucacuuuuuaaaauaauguuuaaugaacaccuauguagaaaacauugugauauacaccaugagauaugagacaaaaucaggugagggcucuucccuugggauuuuaauagucaggaaugggauaagagguguauacacacagguacaaaauguguuugugccauaaaagauguaggaacaaugaagggaaaaggagaugaauugauucuagguggguugcuggauuacuucaugggaauuuauguuuaagccaaaccaugauuugggccaguagagcaauuaaucauccuuuacuuuaaaaaauuguuucaguuuauaaagcuuguucauaauacauaaugauccuuauuacagcucugcaagauaagucaguuauucccauuuuauagaugaaggaguagucaagccuuagaaaaguuaaaugacuuuuccagcguuaucaagcuacaaagugaaagauucagaacuugaaccuaagucuucaaucuccauaugcuggagccuucuaaaguaucucaguagaguagcgaagagcuauaugaguaagaaacuauaaguuuuagaaagggcugauaguuaauuuuauuauuaggauggaaguucugaaauaguuggagauaaagcuauaguauggucagcagaauaauggcucccuacaaaugucugcuuccuaguccccagaaucuaugaauauguuagguuaugugacaaaagggaauuaaaauggcuaaugagguaacuuuaaaauaggaagaucauccuggauuauugacgugggccaaauguaagggucuuuaaagagguuacuuaagaguggaagagggaggcagaaaaaugagagucagagaaggagauuugagaaggggcaaggucaguccugcagaaugagaaagacucaguccaccauugcuugcucugaagauggaagugaagugcuaugaaccauaaaauacaguggaucuguagaagccagaaaggauaaggaaacagauucccccuuagagccucuagaaagaagugcagcccugcagacaccuugguuuuagccuagugagacccauuuuagacuucugaccuacaaaacuguaaguuaucaaauguguguuuuaagacacuaaauuugugguaauuuguuuuggcagccauaggacauuuaauacgccuaggaacuauuuuauuguaggaagacuaauuaacaugaccucagggcacuccaugacuaaacuccaaacugucucuguuccacugucagcaguagaaagacauggaauguucuugagcaaaagugugaagaacuauuuugguguuugcugauuagagaggauauuggugagaggaaaauuaauuaagauucuauuagaugcuaggaacacuucuuuugagacucacuccuugagguaacauagaacauacugguaagucuugcccguagaagacuaugaauauaucucccaguccuguguggcugcucacgucuguaaucacagcaccuugcgaggccaaggcaggaggaucaccugagguuaggaguucgagguuacagggagcugugcuuaugccacugcacuccagccugggugacagagcaagaccucgucccugaaaaaaugggagaugguuagguggauggauagacagacagacauauagauaaagauagacacgugggucaagaucucccacuuaguuuauacaucacugaaaaucucauugccauuguaacauuucaccucguucucguaucccaugaaaaauacagaaccaguuaggcacacaucuaacuuaucucuucuuaggcuuuuccaucguaccauaacuaacuauaagauccgaacacugaaagguuucuaaaucugagcuuuauuugaugccuuaguaccuguagaaguuaaauuuauacuaguaacuguuuuuucaaugcauaauuauuauuuugaaagaaaaaaaaagcuuguugauaucuguaggcauaacucuauucuaugucuaaggucuucgguaaagagagacgauuaaguuuaucaguaaagcaccagagucaauuaaggcgacugaaaggagcacuaauuuuaauucauuuuacacuaguuaauauugucaauauucuucuugucaguuuuuuaaaccaaaagucuuaaauuaggccaaaagugccuagguaaaaauggaauggaaaggguuuucuuguguguguguguguguuuuuuuuuuuuuuugagauagagucuugcuuugucacugaggcuggaguacaguggugugaucucggcucacugcagcccccaccucccagguccaagagauucucaugccucagccucccaaguagcuggggaauguaauauuuaagacauuaagaauccuauuaauccuauuuagucauuuuuuuuuguagcugcagaagguucagaaggguuuuuuaaguugaauuauauguucauauuuacaacauuuacauaugaaaccauuuacuaaaagcaaugaagcugguuauaacaaacacugauacugaaaauaagagauauguuugucagugcggucuuuaaacaguguuacacaauuuauuucuguuucauuuugaucagaaaaaauauauauaucuuuugagacauggucucuguugcacaggcuggaguacaauggcgagaucucggcucacugcaaccucugccuccuggguucaagugauccucccaccucagccucuagaguagcuaggaccacaggcgcgugucaccacagcuggcuaauuuuuuuguauucuugguagaaaugagguuucgccauguugcccaugcuggucuccaacuccugagcucaagugaacuggccaccucggccucccaaauuccugggauuauaggcaugagccacugcacccugcccagaaaauauuuuuaaugcauacauauauauauauauauauguauauguaguguaaauaacaucuucaaucaaauagagauggcaggagcuuuauucugagcuaugugcaaacuugauaagacaagguaaugcuucaguaauuuuccaugcugaaauuuggcccaguauacuuugauuauauaucuauauuuaauuauaguuuuaaaauagcuaagcaguuuuaaaaauucaaauuaaacuuuuguggaaucucuaaaaauaagaaaaauauuacugaguaauuggcaacauaaaauacaaaauguuuaacuuggcuuucuuuuagauuugaagcauagugacuaaugaacauauaauggucguagcuuucuuuacaacuaugucauuuaagucacugaugaauaucuaugauacaugcaguaaaaauuuagacaaacauuuuggcuacaaacugguuuacuaaauaauagcuuguaucauagucugagucaagaguaauaggcuuacaauugugucuuaggguacuaagaaguucuuuugaggaccuuuuaaaagguauucuuuguuuugaaagacuguuuuccuucuggaaguucuaggccuuaugagaaauuaccuauucugaauuugucacaaaaaaugacuuguaaauaaguccugugcagugaaucaugugcuuucaguaagaggauuuugaaagccuuuuguaaaaugaagucauucucaaaagagaguuauuuagaauauaaucaaauugauuuacaugcuuuuauuuauuucaaauaugaagggaaauuguuucuaaauauauuuaaacuuuuaauagaacaguaguaugccaucaguguggaaauaacucacuuguuaaauaaauauuugggguguauuugcuguauaucaggcauuguaacacagggacuaaugaaagagaaaaaaaacaaagcacgaaaggacagcagaaauagcuccauaaucucacuuuccaggaauaaccucuauggacauuuuguugugugucuauugcuuuucuaauauauacauuuuuuaaucaaauggaauugccucaaauaugcuauuuaauagcuugcuucuuuucauacuauuugaaaauuaagaaacgauuauaauaugcuucauuuaaaaacuuuaaguuuaggccgggcacaguggcucacgcauguaaucccaguacuuggagggaccgaggugggcggaucacaaggucaggagauugagaccauccuggccagcauggugaaaccccgucucuacuaaaaauacaaaacuuagcugggcaugauggcacgugccuguagucccagcuacuugggaggcugaggcaggagaaucgcuugaacccgggagguggagguugcagugagcggagauugcaccacugcacucgccuggugacagagcaagacucuaucucaaaaaacaaacaaagaaaacuugaaguauaguauccuuuuaaauuuuaaauagauaauagaaacugguuuccccccauuuaaaccagaauuuaaguuuaacuuuauauauucuugacaguuuggauuuuguccuucaaccucauaaaauugggaauuuaagcaucaccugguucgauuuaaaugcaauguagaauuugcauuaaaauacuacauuaaagccucagauuuguaguagcuaacagcacuucuauguaugugucagggacugcucuaaauacuucauauauauuaacuccucuauucuguacuucuguucccguuuuauacagcaggaaauugaaacacugagagguuaaguaacuaaaguuacagagcuagagugacaggaguaaagcuucaacucaggcaacccagacuuccagaguucugaucuccacuacuaagcugcuagcauagcuuuucugguaacuauuuuuaauucaaauauaauucgagugaucuaucuaacaagucaucacucugacaacucagugacuuguaauguaaaauuauucauuguaauucauuuaauauuauuguuucucugugcugcaaaaaucauagcaaucgagauguaauuuauuacucucccucccaccuccggcaucuugugcuaauccuucugcccugcggaccucccccgacucuuuacuaugcgugucaacugccaucaacuuccuugcuugcuggggacuggggccgcgagggcauacccccgagggguacggggcuagggcuaggcaggcugugcgguugggcggggcccugugccccacugcggagugcgggucgggaagcggagagagaagcagcuguguaauccgcuggaugcggaccagggcgcuccccauucccgucgggagcccgccgauuggcugggugugggcgcacgugaccgacauguggcuguauuggugcagcccgccagggugucacuggagacagaauggaggugcugccggacucggaaaugggguaggugcuggagccaccauggccaggcuugcugcggggggaggggggaaggugguuuucccucgcacugucuuaaaccgauggccuuuccuuggcacaggguccacugcagcaugccaaacgaggaggcaggggcgucguccccccgccccccacugcagcacuggagauggauuuccuguacuucggauccaggguuuuugacagaagaggaagaagggggagggguagaaguguuaaggggagucugcugagaaaagcuguuuuugaagccagaagggguuuuuguuuuuauaaugccauuugacagaguggaauaacaguaucuaaggaaacggguagaggacaacaaagaauggagcauauucauggcgaggagcaaaagcucuaccccauugaaaggcuucuuuuccucccuggcgacaaggacacaugcauugguggccaaaagagagaggagacaaaaccgcugcagauggcugaugugaaucuaguggaaagagcuacuggggaugagagaaagaggaggaggcagguacugcagagcgugaguggugguguugguuggugaaauacuggucaccaguagugugccugcuuuuguaaaacaucuaaguaaacucccugugaacaggguggcaaacagauaccagugucuuuguuaguuacaaaaugcagugguaguggcuuuuugcggacgacugcagcagugcuuuuucucccucuguuaggccgaaaagacaacugcagaggaauaagaaaccuugcagcaaaugcugggguagaagcccauuuacaagaagccauaguuuauaaaugcagccugaacagcagaaaaaaaauuacuguuuuuuaaaguaggaauaaugucaggcuaugaauguuuugucauuggaauguauuggacacuuugauucuacaucacgaaagugaugcucaaauucuuugauuuaacauaaauccuauacgaaaucuuaauaaauuauguaugaaacaguggaucuuuucuuuuguuagugaagcuuuuaugccauuaauuaggucauucaagagcaaaccacuuuacaacguaaauuacuuugucaaaaauuauggugaacaaauuuuuguaggccuaauauuuaagaccuauaguuaaguaauuuuauauuucucuuugguugcuuuuagauaacacugaauaaauauuuaagauauuaauucagugugcaaauauuuuaaauuaaagcaacauggcuuuucuucuagauguauuucuguuuagugaguacucaugagauauacucuugauauaaaguguuuuucauugagcuuuuuuuuccuuuaccuaaauguaaaagccuaucuuuaugcauacuuauaguagccagccugccacaccuccccacucccugaacaaggauggcaguggcuuuguaaagcccuccagggucagugacagugucucuuaaauaauguuuauguaauagaaagucuuaagaugaccuauuauauuguuucaguaauauuuucaagauaaugcggaauugggcuggcuuagauaaauaagacuacauaaguuuuucacugauaaauuuaaauaguucuuuaaaaaauuauuucugcuuuaagaauuacuugaucauggauaucaggguuaauaguacuuaggagccgggcgugguggcccaugccuguaauacaagcuaaacaggaggcugagggaagcugaggcaggaggaucacuugagccuuggcguucaagaccagccugggcaaccaagcaagacccuaucucaaaaaaaaguacuuagagucucuuuuuuaaaaucugauggaaacuauggcuagaacuaaagaugucacauuaaaauuccaaaugacauuuaacagcuaauauuacucaguucuuugaauuccauuagcauaguguuugagagucuauaaaacuauuauuuuuacauaaauuaccuuuuaccauuuuaacagcucauuguagcauuauuuuuauuuuaaauguuagagacuccuauucaaguauguugugacuuuauccaaggucaaauauuguauaacaauguaaagaacuuaagucuucuauuuuauucuaauucuauaaaacuauaaugccuuuuauuacauacauacaaaauaauauauaacagagguaauuugaaaaacaguguaagucacugacaaauuauucaaaaaaugaaaaggcaauccuacuugguuguggauuuuuaucuacaauauaagaaugcuuuaaaaaauaccuggugacuaagcaaauggagaagcagcaguuuucauaaugacauucauaaacgacuuuuuaaagaucgucuuauuaaucauaugaacacauuuaaguagaacaguguuagauugagauguuuuucugaauuaaauaagaaauaaagaacuaaaguuuauuucauuccucuuguaguauaucuaaucuaugacugaccuauuggcuuuaguggucuuugaaauuauucacugcucugauauggccugaauugugcuguuuaaggaauuuaaaauuaaauauucauaaauguuuuaugaacugaauuuaagcuauugaaguuuuuguuuuuuguguuuuuuuuucuuuuuuuuuuuuuuuuuuugagacagggucucacuuugucaacccaggcuggcgugcaguagcaaacauggcucacuugcagcuucaaccucgcaggcucaagugaugcucccacuucagcccuccagguagcagggacuacaggcacauaccaccgugcacagcuaauuuuuauauuuuuuguagagaugggguuucaccauguugcccaggguggucucgaacucgugagcucaaaugauccucccaccucagccucccaaagugcugggauuuacaggugugagccaccaugaaguuuuuccauuugcauuaauugcucuguagauuuuaccauuuuugucuguuuuauaaacuguuacucauuuuaugaaauuuaaccaaucuuuuauacuuguauauguuuaaaugaucuuuuauacuuguauauguuuaaauguucucuucaauuuugaucucccuucucccccuuuucuuguauuagaaucugaaaccuaccuaugcagcacauaaaaugggauagaguauuaugguucagaaaagauggguaauaguuuaggaaauauauucacuacauauuuauuaggauaccuucuaaauaucaucuuugaaaaaugcuggagucaaauaagacacguaaacuaaucucuaagaaaacucaugguagaauuaugugaaauuucauuacaaguuaaacacugcuuuggcuacuccuaggauauuuaaagauuuauauaaucuaagauauccucuaauuuagaagaauaugguggauugcuguuugaaacacugcuuuuucauaaaaucugcuuagagucacagagaauuuuugaaaacuaaauuacuuuugaaguacuaaguaucuugaauguacaaugagaacauuaggugaauagguauguucucaaaaguugacuuuguaaaucaaaucauacaucaucaguugauacaagguaagccuucuccccuuuauucucacacccugcacccacucuucuuguguguuuaauaugcauaaauucuugagaaauagcaucauuuugugagucuguuuuuuacaguuaaugagauuuuuaaaaaaauuuuauugugauaaauauacauaaaauuuaccaucuuaagcacuuuuaauuguacaguucuguggcauuaaguucauucacauuguugugcaaccaucaccaccacccaucucuagaaauuuuuaaucuucccuaauuaaaacucugugcacauuaaacacuaacaugccauuuuccccuccccccaacccuuggcaaccaccacuccacuuuuugucucaaagaauuugacuauucugggaaccucuaauaagaaaaaccauuuaauauuuauucuuuugcaccuggcuuauuucacuuagcauaaugucucgaagguucauccauacuguagccaugugucagaauuucuuuccuuuuuaggucuaaaugauguuccauugcauguauaugccacauuuuguucauucaucugucaguggacacuucagguuguuuccaccuuuugucuaucaugaauaaugcuacuaugaacgugggugugcaagugucugcuuggguuuuacuuuuuuuguguguacucaaaccuguguuuuuaauuuacauaauuuuugaacauuauuaacucaauacuguuuuuaagaucuauccauuuuacuuuauguccaucuaguuugugaugcuaacucugcucuauaguauucuauaguaccuaucacuguuccuccagugaaggccguaaguuuucuccaaaucccguuaaccacaaacaccuuuaugauauacauucuuauacauaucuccuuggacuauguuauuuauguauuucuguauaacaaauuguaccaaaacuuaguggcuuaaacaguuucuguggggcaagaauucaggaaugucuuaguuggauggucugacugaggcaggaucucuuaugaaguagcagucacgaugucagucacagauacagucaucugaagggcuugacuagacugacggaucuucuuccaagauggcuaacucacauagucucaguuuuucauuggcuauuggcaagagaccucaguuccuugucacgugggccucuccauggggcugcuugaaugucuucaugacauagcagcuggcuucccucaaugauucuaacagaaaggccauuuaugaccuagacucagaagccacacaccauugcuucugcuguauucucuuuauuagauaugagucacuaaguccagcccaccaaagagaggaauuaggauccaccucuuaaaggaguagggucaaagaauuuaugauauauuuuaagaucauuacaucgaccagugaaacaguuucacuggauuuaucccuaggagagggaucacuggauaauaagggcauuguuuccuauugcuguuguaacaaauuaacacaaacuuagugguuuaagagaacacaaauguauuaucuugcaguccuggagaucagacacgguuuucacuggaccaaaaucaagauaucaguggcucugcgucuccucuagagauucuauugaagaauccauuuucuugcuuuucuucagcuucuugcauuccuugucucauggccucuuucuccaucuucagugccagcagcauucuaaaucucucucugaaucugacccucugcugcucuugucacauauucuucucugacccuucugccuccuucuuaaaagaaccuuugugauuacauuggguccacccagauaauccaggaaaaucagcuucaagaucuuuaacuuaaucacaucugcaaaguuccuuuagccacauaagguaacacauucauaaguuuuggggacuaggauuuggccaucuuuguggggccauacacaggcauacucaucugguucuccauuuuuuuuaagcugaaggauuuuuuuaguuauuuuuacuuuugcgaauguguguuacuuucuuuugguaauuucagauuuucauuuaccaaguuuauuuaaagcauaguauaauauauaaugaucaccaagaugguaagcagauauucauuguucaauuagauucuugauuuuaucaucacuuaauuuauaucaguguaucagcuacuucugacauagucuguaauagaaacugagaaacguuaaagcaacacagccuuauuaaauuucucuuuguaucuuuuagacucguuauaacaccaguucugugggcgcuuuguugaaacuugaucugucauugucuuaccagucauugaacuuagggccacucuaauccaguaugaccucaucucaaacuugauccauuuaugaagacucuguccucaaauaaggucacauuugacaugacauuuuuugguguuuuuuuguuuguugguuuuuuucccucuguugcgcaggcuagaguagcuucugggcucaagcaguccucccaacugagccucccaaguagcuaggauuacaaacaugugccaccacagcugacuaauuuuuaauuuuuuuuucauaaggagagagucucacuauauugcacaggcuggucucgaacuccugucuacaagugauccucccaccucagccucccagagugcugggauuacaggugugagccacugugcucacaccuguaacauaucuuuuuaugaaacacaguucaacccauaacacucccuuaauacuugguaccuugugaauaauaagauaccuaaauaugguaccuuguggauaacaaggcauauugucuuacuuuuuuuauggaaaagucaucuuggacauucucugaacuugugcccucucuuucuguugucugcccucuguggcugauaaugcacccuuucuguucauucuuacguguauauuugucuuuuauauggcugucgcugaguaaagcauuuugggaauuacaaaagcuaaguauuagauauagaccuugucuucaagauauuuaugcuccagcugggaagacaaaacaccccaagguaaaauggaauaauuugagaaguuaggccaaauuguauaguauuuacuguucagccagcaggaagauucauuauuggcuagagacaucaggaagguuuuguguaagaaacugagcugggccuuaaaggaugaggauauauuauaacagcagaggaaaaaaggaugugguauucagaaaggggaggagguauaaacaaaaauauaaagguaagaaauaguuuguagaggaaagugaggagagacuuacuugaggaagguuaucuuggaacuuaauaggaaauaaguuuugaagguagacuauuaucagauauaauagauugugaacaccagacagaaguuauacagucuuugagagcaugagcauuaaaaacaaguacagauuugaauucuggcauaggcucuugauauguguucuuagggaaguuaucuacuguuuuggaguuccauuuuucuuaacucaaaaaugaguaacaccuaccucauaggugguugugaggauuaaaugaguuaauauauagaaagcauuuacauuacgugagauauuguaaguacuaaauagauaucaggcuuucugaauuucacauaucaaauacauaaaaaauaagggcauauauaggauuuaaauaauaugcuggucaguuauagaacuuuauauacuuuuccuuuuaaaacauuuuuaguaaaauuuuuaugaaaauuagucaaggcaaaccuuuaaaaauuuucagaugguaacaauuuuauaagcaauagucuuccauuaaucuaauaagcaauguaucaaugacaauaaaaagaugacucaaaaagccuuauauaccuaacaauugagacagaucuuugaaguauccccuagaucaaagaggaaaucaagauggaagucaugaguuaucuggaaauaaagaggggaacacuucauacuaaaacuuguggaauguagauaaggcuguacuaagagaaaaauugauguccuuaaaauuuauauuauuaaggaugaaacgaauaagugaauguuuaaguaaaguaaggaaauaaaugaauuaauauucacuuuauuauuauuauuauuauuauuauuauuuuuugagacggagucucacucugucgccgaggcuggagugcaguguugcaaucucggcucacagcaaccuccaccucaagcgauucuccugucuuagcgacccccccaccccacaccauagcugggacuacaggcgggugccaccacgcccagcuaauuuuuguauuguuaguagagacaggauuucaccauguuggccaggcuggucucaaacuccugaccuugaccugccucgcaaaguauggggauuacacgcgugagccaccacgccagccuuucacuuuaaauaacuauuaaaaauaacaaaguaaaccaaaggaaaauaagaggauauaauuaguaaagauaaagaaauugauaaaauagaaaauaaaguaguggaaaguauguguugauguuuuuguuuguuuugguaaacaccaauaaaauaaaugaaacccuaaaaaguuuaaaggaauaaaaggcaaacagaacaucagugagaaaagauaccuucagauaaagaauuuuuaaaugacagaauauauacaacucugacaauacauuugaaaaacuagaggaaagaaauaguuuacuagugaacuauuaaugaauaaaauuaauacaagauggagaaagcauuaaaagaguaaaucacagaagaaacuuuaaaauacuuuaaaaaaaucuuagcucuaaaauggcaccucuuuugaguauccgucacuuugauaagaaaaaagaaaaaaggcaccuucugauuugaauucuagcugacuuucaaagaauagacacuauucaaacuauuccagaccauauaaaaagaugagauagcauaagcuuaauugaaaaccuuauuucaaaauacuauaaaaauuuaaaacuauacauuuucucuuuaaaaauucuaagugaaauauggaaaaaucaacaggcucguaaaagcauaaaacaugaacaacugggguuuauuucaggaauggaggauaggucaacauucaaaaaucuuauaacugacugcaucaagaaauuaaaagagaaacgauaugauuauacaaaaaagugcuauuuacguucagcaaccacuacuaacaaaaacuuuaaacucaaaggaaaaugccuaaacauguuuaaaaaauuuacugaaaucugaguaagaauauuaaauagugaaauaauaugccauucuuauuaaaaucgagaauaagauaguuuauucgacauuuuaaaguuucaagcuaacaauaaaacgugaaaaagaagugagguacaaaugcaggaaagaagagucacaaguaucaucacuuacagauuauaugauugcauacccagaaaauccacuggaaacccuauuggaauucauagaaucauuugauaagguggccacacaaggguuaugaguuaaauagaauuaguagcuuuuauauauacuagcaauauuuguuuuucuuucuuucuuuuauuaagagaaggggucacacugcauuacccaagcuggucucacucaagugauccuccagccccagccuuccaaagugcuuggauuacaggcaugagccaccacaccuggccauuagcaguauucgaugugggguggugguggucauucacagcaacucaaauagccaaaagccuagggauaaauuugaugugaaagauacagaggcauaggaccuuuuucuugaggggggaaaacccuggaaaauuugauugcagaggcuaaauuauucaugagauauaguaagacuuaguauggaaaugugagccucucucaaauuaauauaaauauaguuacaguucuaaguaugagaauugagcuauaagaaauacguuuccauucaguggaaaagaaaugguuuguuuaauagugcugauguaauugcacuguuuauuacuacuuucaguuauccauaugaaacacaauaaaguuagaccacuacacucaugccauacacagcaauaaaaaugccuuaugaauuaaagaucuaaauguaaaguaaaauuucuuauucaagcuagugaauuaaucucccaaauuuaucaccucuuucgccuaagaccccauuaaagugauaguaaaaacaaaauaaagaugggagcuuacaaugccauaaagaguaagagacauucaaauugacauuguaacaaguuucuggaagaugaagaaaucgugggaauuaaaauggaucacugaaaagaaaucaaggauucuaagacuuccuaguucucuguucuuuccaacauggcagguuggaaauuuaguauuuaaaaguaaaauacuaauuuuaguauuaggaauuucucaauggccuuugaaauuauuuggguuaccuugggguguuugaaaacccaaauuaggaaauuaugcuuuagaccaccuguuuuuguaaauuaaguuuuauuagagcaugggcaugcccaucuauuuauguguuuggggcugcuuuugugcuacagcuacaaagucaaguaguugcaacagaaaucauacgacccacaaagccuuauaauauuuauuaucuggcccuuacagaaaaugcuugccaacccccgcuccuggucguugggaugggcaucuugagaccugcccacacgugguaugggcuuggauaggucuagccaguguuauguagcuauuuacagaauguaagcaaaggaaaguguggggaaagaauauggcaaacagaaaacugaauaucaccaccuaauggggccuuaguagggaagagaaagagaaauagaaaaggguuguuaaagagaaaauuaaaauggaugaggugaauucugcuuggaauuuaaaacuuuuugguauauuauugauuuuguaucuggcaagccuaaaauuuuuauauuucuaagauguuucuauuuuguuucuuuccaaugauaacacuuucucuuuuuuaaauuuuacugugugaauuaggacuuccaggauuauguugacuggaaguguggauaguagacaucuuauuccugauuuuaaagagaaugucuguaacauuucacuaugaagaaugaaguuuauagcuggguguggagcgccuguaaucccagcaguuugggagguggaggcgggcggaucacuugaggucaggaguuugagaccagccuggccaacagguaaaaccccaucucuguaaucccagcuacucgggaggcugagggaugagaauugcuugaaccugggagguuacagugagcccagaucaugccacugcacuccagccugggcaacagagcaagacuccaucuauuuaaaaaacaaaaaaaagaaugagguuuacaaaauuagcugggcauguuggcuugugucuguagucccaguuacucuagaggcugaagcaggaggguuacuugagacuugagccagggaggucaaggcugcgguaagccuaggugacagaguaaaacccugucucagaaaaaaagaaugaaguuugcuuuagcucugacaguuucccuccuauuuccagguuuuuauggaaaguuuuuucuuugucuaagaugguuuuucuuuaguauuuuaauguagcgagugacacauauaaaugaucuuauauugcacucuacucgcauuccuggaauaaacucagcuuuguucugcuguaguuucuuuacuguauguuauuguauucugcuuccugauaaucucguuuagauuuuucaaaucaacauuuguaaauauuagcuuaugauuauucuuuuucacacaaucuuugaccuguaugucaugguuagauuggcuucauggaaugcauuggaaaauauuugcuauuuuuccauccuuagaagcauuuguauaagauuggaaugauuuguuccuuaaaaguuugguagaagguguuuguaaaaccauucagauacgguauuuugaaggauuuggaggaggaggggaaagauauuaauacuuacugcuccaauuuuuuuuuuuuuuuuuuuuuuugauauggagucuugcucugucacccaggcuggagugcaguggcaugaucuuggcuuacugcaacaaccuccaccucccguguucaagcgauucaccugccucagccuccggaggcgcugggacuacaggcacaugccaccaugcccggcuaauuuuuguauuuuuaguagaggcgggguuucaccauguuggccagauggucucgaucuccugaccucgugauccacccgccuuggccucccaaagugcugggauuacaggcaugagccaccacgccugguccaauuuuuuaauaguuguagaacuauuaagguuuuucuguugcuucuugaaucaauucccccucccuagaaucuuuaauauguuuggagguuguuuucuuuuuccugucucuaaucauacuuaguuguuuuuuuuuuuuuaaauccaacuuuuggaugguuuucuuuuucucuuuuuuuuuuuguuuuuuuuuuuugagauggagucuugcucugucucccuggcuggagugcaguggcgcgaucucggcucacugcauccuccaccucccagguucaagcuagucucucaccucagccucccaaguagcugagauuacaggcauaugccaccacgccuggcuaauuuuuguauuuuuaguagagaucggguuucaccauguuggccagacuggucuugaacuccugaccucaagugauccgcccgcuucagccucccaaagugcugggauuacaagcaugagccaccgccaccuggccaaugcuuugcuuuucaaacucuucaaaggguauguaauaaaaaggaaggcuuaccaccagacaccauaccuugauucuauaagcagugacuguauuuuuguauguucuuuaagugauauuuuuuauccuuaugcacuccuuuauuuuuacuggaagaggagggaccacaugaggcauuagugaugagcauucuuuuuuuuuuucuuggcuuuugccuguuuuuuauguuuguuuguuuuguuuuucaucaaccucauuuuuacaucagccucauucuucuuaauaccaauguaguauuucacuguacagaugugcauuauuuauuuuaacguaguugugcuuuuauagcaaauagaaacuuucccauuuguuugaaguacccuaagaaucuccuuuauuacuccuagucuaguaacggacaucauuacuuuagagaacucuacuuggcccucugugugucuuacacccauuaaacaaauuaaaauuaaaauguuccauaccauccuuugaagaggguguacaccauuuaaauaucuuuacuuaaaaaaauaaaagucugcucucauaagcaaugaaauguuuuucaaacauuuaaaucucuguuccuuuuugcaaguuauccuaguguguuguaugaggaauagaugcaguuuuuucuuuuuccucauggcuguccuauuucccagcaccacuuuaaauuccaucuuuuuacaaguauugagaugcuacuuuaaucauauacugaauuuauauauauuuacuucuggauuuuaaacauuguguucucgugguugaucuauucauguacugguauuguagcuuuuuaaaaaacuuuuaauuuuaaauaacuuuggacuuacagaagaguuggaaaaauaguacagagaguuucuauauaccuuuuacagauuccccagaugauuaacaucuuauauaucuguacuacaauuaucaaaacaaaaaaacuaaucuauugguacaauauaguuaacuacauuuauaugguuuuaauuauaaaggcuuuguacaauauuuuaauauguuguugguuuacucccugcucuucuuucauauuuucaauuuuuuaaaugucuagcugcagaaaauaaacaaaagcuuuauauaguauuuuuacugggacuguaaaauuuauaaguuagcuuagggagaaauggcauuuuuauguugcugaaucuugguauaccagaauaagaaacgucuuuccauuuguugaagucuacuuuucuaucuuucucauauauguuuuggacucuuuuuguaguuuaugcccagauauuugcauuuuuuauuguaaaugggaucuuuucuuucauuuaucuucugucugguuucucuccccuauaaaugaaugauuucuguauauuuuguacuauacuguauugccaaauuauauuauuauaauaauauuucaucgaugcuuuuguauauuccagguauauaauuguguuaucugugaauaauguucccuuucuaauuuuuuucuaauuuuauucauuaauuuguguugacuaauauuaugacuaauagaaugguacccugacuguaggacuauauccaguguuuccacauuaaguaugcuguuggccuugggguugauagaucauguuaaagaaauguucuuuuuuauucaguauuuucaacaagaauggguauuaaauuuguaaagugucuuuuccucaucuuuggcaugaacauaugauuuuuucccauaucuauuauguuaaaugauauaauuaauuuucuaauagugacuuuuucauuguaaauuauauuuuucaucucuuuugggaucaguucugauagauuauaucuucuaguaaauuauuuuggguuuucaaauuuguuugcauagaguugagcagagucaucuuuuaugauucuuuugcuuuccugccuucuuauucauauuuuccucauuucaucuaaaaaugcuggaaaauauaucuuuguuuuuccaugaaaacaaaacaauaaaagcagcuccauuaauguaaaaaagaagugaucucaaacuucugaaaauaauaauccuccacauuuaauucugauuaucuuuugccagccugaaauuuuuugcuuccuugcuuuaauuucuuacauuacuuguaaauuuauuuucuaaugaacauuugaauaaaagucuagauaauaguccuugugcuuucuucuccccuaccccacacuuacaaggugcagcagugucuuuaguggucaucuuaacugcagaaaaacaaauugagagguuugcaugcucucaguaaagugaaagauugggagguuuuccccauuucaugguguguggcagcuguaaugugaucacacaaguuucaaauuugaaaaauguuuuaaagauauauuugguaugcaauucguguaauugcaaaaaaggcauuccaaaguaaauuuaugacuucacaaauuuuguaugacuucacaaguuuuggauuagggagguauggcugcagcauccuaaaacaauauaagguuggguauucuuccaugaaacuuguuauuuuuuccauaaaguuagauucuuucuagagcagaaagaacuuuaaugauugggaaucuggaguuaagggaaaaaaagaugauuaaaaguuuaauuguucaucugaagaguugauuuuuuuauuccuguaauaaaggguacuuuuagcagucucugcucaucuugcccauccggcucuuuuugugguuguguaagguuauaacuucugugucucaguaaacuugugcaugcccauuuuuuucucuguuacuaccuuuucucuuauuuuguuuuauuauuuugauguaaaauuaccuguuaauuuuauuugaaaugagaaauuuuaagguucacauuauucaaauucugucagaucccuaccucugucauaugguuuauaaugugcuggguauuuucagaccugcuuauuaaaaagauguaaaacaaaauaaugaucacuccuguggauuuuuccuuuauuuuugagaugucuccuuuggcugcauuacuucuucaccccuugcccauugaucagaggaggggucuuaacuaugggugaacccuauaucuuacugaagagguuauguuacauguauauuuucauaauauaacuuacauuuacauaguacuuuuauuuuuagcauaccuuuuuuuauuaauccuaauaauaucacuguaaguuauguugaagcagauuguaaguguucauuuacaaauugugaaaugaauuaaaaugaaagggcaaagauuaaaucaugaccaggccugaaauuaacacacaagacucaauuuuuuucaaccaaagacuuuuguaggugaucccugccugcaggacuccccuuccuccucagaugucauuggauuguaccagguuuacuguagauucuagccguuguagaacuaacuagaucuaagaugaguccccugauuuccuuugguagagucuuccaauugcugaacuccaauauugucgugacuagccaguguuacaaccugucugccuuauuuuguguaauggauuucauauuacagaggcauuuuuuuaaugucaagauguuuaaguauugcuuaagugcaaacuacuuaauacuuuuuagcuauuaaguaauuaagauaggcaggauuuuauuuguuccaaaaugauuugaccuaaacuaaaaagagaauguggaucuccugaaucuuacuugguuaaucuuaauauaacuccuagcauucuauaauucuuccuaaaguccucuuaccuggcuaucuuuuguaucuucuuugucucuccucuucuuucccagucauaauaacugccagacucugcuucauuucucuuugacagucucuacuccuaaggucauccauucucuuuagguaucuuuuggccucaguuugagcacagcagaucccaagaccacauaugccauagcauaggcuauuauagucaaccuuuugaauaaaugugauugaacuuuauguuaguaauucuuauuuaccaucuuccuaucaaaaaggcuuaaagucuucauuuaaugcucuccuucauguccauuuuguuaaaugauugccuuuuaaugacaucuuagaacuucagaacuauuucaccauggaggauguguaagauuagccuuuuaucaaauaaaaagugugaaauggaauauguaaucucauuaauccauucuggcucuaaaauucugugacuaucagauaaaauucagaaauaaaauaguauuacuaauauaaauaaauuuuuaucauaauuauauuuccuaaguuuugccuguaagaauggguaaaauaucuuuaaaaccuugaagaaauuauuacuugauagaaaguuuaauccaucugugagaaggcaaauguauucagacacaacuaaaguucucucuucuauuuuaauuucauuuaucuugaacuaagacuccacuguuucauccucuuagaugcugcuacuugaacaauauuguuuugagaccaaaaacuagcauauuaacacaauucuucuuaaacgucuuaagaguuuuguuuccuuuaccccuuucuuuaaaaacaagcagccacuaaauuuuuuaguagugaauuucaaaauccuuuuuaaccuuauagguccaaggguagccaaggauggcugcagcuucauaugaucaguuguuaaagcaaguugaggcacugaagauggagaacucaaaucuucgacaagagcuagaagauaauuccaaucaucuuacaaaacuggaaacugaggcaucuaauaugaagguaucaagacugugacuuuuaauuguaguuuauccauuuuuauucaguauucccucuuguaaacuugagguaagacacuuuacuuaaaaguguauuuuaaauuaagcaauaauauguaaacucuuucuugcaaaaguuagcauuuauauuuuuaaauaagauauauugaauucauucagugaaucauauaaagaaaauaaguguaaaacuccaauggcuaguuaguucuuaguucuuuuuaagauuaaagagaagagaccaaauauagcaucacuguacugaggcaagguuuucuguguaguucauagaaacuagccucaugauuuuagaauaugccuugaauauuaaguguagccuuccuccccaacucccucagaucuugccaccccuuaagugcugcagugauaggugaucaagaaaaucaggauacccuacugggaagagccaugaacugaaagucaguaccugguucuaucccuggcuuucccacaaacugagcuauaugaccucuguauauucuucagaacuuaaguugucuuauuuggcaaguacaggcaucacacuagucuagaugauuuccauggcaccuucaagcccuaaaauuggcuugccaaauaguacugaaaaguucugaucaccuccaagacagguuagaaaaucgucuauaguggggaaaauguucugguuucaaaauaauugagguuaaaacuuuagccauuuuaauucccacuuaggcagauucucuucugacugaauuuaauaacuucauagaauuggacauuaucaacaaaaauauuacuuccaccgggugugauggcucaggccuguaaucccagcucuuagugaggcagaggcaggaggauagcuugagccaaggagcucgagaccugccugggcaauauagcaagaccccauucucaaaaaaaaaaaaaaauuacuuccuuuauaaaaaaaaaaaucuuccugcuuuguguuguuucucccucuuggcuauuuuaacauuugaguuccugguccaguucuuccugucuguucacuacucuuauuccuuacuaauuuccuauucuauccuaguuuuuuuccuaugcauuucaagguuucccuuauucuccagacuuuugugugucacugagguaacuguuucugcuucucuuuuacccuuuauauucaguaucaucacagcucaaccuuugcucauguguccuauucucuuuuuccaucccucuaucaaucuuuucuacucuaauuagccucuucugugguaaaacuguccccagcaaugacagacauccaauauaccuacuucaaaucccuugggaaauaagguagacuauaaacaaacauuuuauucuuuccacaaacuaugggugaccuaaaaagacuugcauuaguugccuaacagguuaaaaaagaguaguuugguauuuuaacauugaucaacacauuacauuucaaaucauuauacuuggcauguguuuuuaaaaguuuuaaaauacagaauuaaaauauucuuucaucuacuuuaguaugguauauuucgcagagaacuccuccuggcaggccuguuuagauaguacaugucuguuuuguaguguagaacucugagaucucuuuuuuaaaguuuguuuaauuccuuaagcaauucaaaacucauauuugagagacaauguaacuuacccuuagauccaucuccacacugaaguggaaugucucucagagugacaauagaagucacacccucaaauuucuacaguggaauaucuaguugaucauuuauaugugugguauaauacaaguugaguaucccuuacccaaaauugcuucaggccagaaguguuuuggauuuuauauuuuuucagauuuuuaaauacuuguauuauacuucuugagcauuccuaauucgaaaauccaaaaucugaaaugcuccauugagcauuucguuugagugucauguuggugcucagaaagcucaagacuuuggagcauuucagacuucaaauuuucggauuuagaaugcucaaccuauauacaucaggaauaguggcacuucagauauaccugaaaccaaccauaaauuuuauuuuacucagcaugugcuucaacagacaucuugugaauccauuaacauauuuccuuagaauuggacaugugguaccauaacaauuacagcccuguaaugaaauuauaucucuuuuuaagguuuuaugcugugaaagagcauaaaccaugagcuauuuauuuugucuuagaauauuguuuuguguagacacuuuugaaaccauuggcacuuccuacuguggauuaaaauuaauccacacaaugguuauuucucccaaaaucacuugcuagacuuuguaauaccuuauauaaacucgaaucacguuuccuguucauuaaucucuuuacccccaaaaaaggcaaaaggaggcugggcaccguggcucauaccuauaauccuagcacuuucggaggccaagcagaaagauuguuugagcucaggaauuugagaccagccugggcaacauggcaagacucuguuucugcaaaaaaauacaaaaauuagccagguguggcguauaucuguggucccagcuacuuggaaggcugaggugggaagauuguacuccagccugggcaaaagagccagaccuggucugucugaaaaacaaaaacaaaaacaaaacaaaaaacagcaaaaaguaggucuccuccaaccggauuacuuaaagucuaaaauuuauguaguaguaccaucuaguggcaaaagaggacacugcuuugcuauuugauuauaugugucuuuguagcagccagggaaauaaguguuuauggguuagggaaaugugaacacuguauauuaaggaaauauuuauuuuuaaguauaaugauauuauuguguuuguguuuagaaagaauccuuguuuaaauauacauauugaaauauuuacaaagaaguuguaugaugccugagcuuuauuuuaaaaauaagucugaggcagagggguggaaauagaggaaguggauauggguguagaugagauaaaacugaccaugaauugauaauuauugaugugggauaugaagguacauggggcuuuguuauaauuuucugcauacuuagguauauguuugaaauuuuuuguaaugaaaauaaaauagagauuacauggaauuuagaugauaugaaaucagauaaaugcagaauuauagcuaaucuuaaaaaaaguuguguaguguauuuuuuacuccauggcuagagcccuccccccaacuuguuuuuuuuguuuguuuguuuuuuguuuuuuguuuuuuguuuugagacgaagucucacacugucgccugggcucuggugugcaguggggcaaucucggcuugcugcagccuccgccucccggguucaagcgguucuccugccucagcuucccaaguagcugggacuacgggugugcaccaccacgcccggcuaauuuuuauauuuuuaguacagacgggguuucacuauguuggcuaggcuggucucgaacuccugaccucgugauccaccgccucggccucccaaagugcugggauuacaggcaugagccaccacgccuggcccccuccccacaacuuuuuuuuagauggaguuucguucuugucgcccaggcuggagugcaguggcacaauuuuggcucacugcagccuccaccuccugggcucccagaguagcugggauuacaggucccuaccgccacgcccggcuaauuuuuguauuuuaguagagacggaguuuugccauguuugccaggcuggucucaaacuccugaccucaggugauccacccgccucggccucucaaaguacuggaauuacaggcaugagucaccgcacccagccuaccuagagcucuuuaauugacuuuaaaauacugaguauagcaacaagguaaauauggcauuuuagagauaaaaagcugaaagauggcaugguguaggaagaauuaucuauaggcaaguuauugaagcauuuacaucuuuguuguaguuugacaaaauuuaauauuuauaaauuggucuauaaacuguaaaacaauauacauguaaaguauaucuuuucagaaaguaaggaaaaaccgagaucaacauuucagaauguauuuugaagauguaauuaucaaguguacuuauaucugguaaugaaaagcaucuuuaauuaugauauacugaaauaaauaaaagugggucaaguagcagccucccugaaaugacaaaguugcucauagauaaauaucacugguauaaccacagcagauuucauuucuaaugaauaauuuucuuucuuucuuucuuucuuuuuuuuuuuuuuuuuuuugagaccgagucuugcucugucaccaggcuggagugcagugacaugaucuuggcugucugcaaccuccgccucccggguucaagcuaaucuccugccucagccucccgaguagcugggacuacaggcgugcaccaccacgcccagcuaauuuuuguauuuuuaguagagaugggguuucgccauguuagccaggauguucucaauuucuugaccuugugauccuccugccucggccuccaaagugcugggauuacaggcgugagccaccgugcccagccuaaugaauaauuuucuaauguuucuaaaauguuaaaauacuucuaagacaaugugugauuauauaguguaauuaaucuuuuaaaacugagcuuccagaauuuuaaaauacaaaugaauauucucuccuucaaaauuacauauguauuuaaaagcugccacuucucaaagaacuuuuugaaacauuuuuuuuuggaacugcuuugcaauuguauuccauuuucuuuuaaaaacucuucaaaaucaagggccucuucuagguuguaugcaguaugcagcccccaagaaaucugucccacucaaaaacuagaaaacacuggauaaaauacaaaaaucauacuuuuaaggacacuggaggacuguggaaucaucaagcucuuuauuaacuauaauucuuaggaagaaagaacccuuucuagauaagcugagauuacugguaauuuucuuccugggguauauugauucuggguacagauugagauucaucauuggcacaagcaggaggacuucacugggagaaagaaacucuugaggacuuucugcaggacuagguaugaaagaaaaugaaaucguuggcagccuugacaaacaugagggcagauguagagauacuagcauuuagaggagcucuaaaugcauggcucauuuuuaccaugagauauuggccgagucuuguagugcaggagacuugggauagacuagaaacgcagaauguuagcaggcgaaguccugcuagagggagagacauguuacuuucauaccacaggucuccucaagucauuugccagauuuuaaauuuuguagagcaggagauuaaagaccugaguuuacaaccuccaagagaaacaacauuuaaggcuagagaguuaagugcuaccagagaauaaggcugaacuggaaaggcaaagugaaauaucccauauuccugcaauguuuaggaaagaccuauuagagggagaccuaccuaguauaucaaacaugacugguuuuccauucaagauaaaugucagauuuugauacuguauaggguaagaaguuaacugcugaggagauggagaacuuucauauuuucuaucugaauauagagagacacacucaaggaacugggaaaaccaaaccaguuaguugugaacuuaaaauugcaacuaggucucaauccauuuuuuuuuuuuuucaagacagagucucgcucugucgcccagucuggagugcaguggcacagucuuggcucacuacaagcuccaccucccagguucacaccauucuucugccucagccucccaaguagcugggacuacaggcaccugccaccaugccuggcuaauuuuuuguauuuuuaguagagacgggguuucacuguguuagccaggauggucuugaucuccugaccucgugauccaccugacucggccucccaaagugcugagauuacaggugugagccaccacccccagcgggucccaauccauuuuuaguugcuaauuggauugaggagaucagaccccaacaauggaaaaggcagacucucuagaggaaaauacuaucaaucaucuuaagucucuuuuguucuuguauacacaguuggcauacagucaaacguuauaugaaaugcagagaaacuggaagauuacugauaaucaagggaacaaauagguaauaggagcaaacucagaugauccacauguugcaguuaguagucaaggauuuuaacauaaguauuauaaaugucuugaaaaaaagaaaaaugaacagauagaaaauuuugacagagaauuggagucuauaauuaaaaggaaucaaauagauauucuagaacugaaaaauauauuugaaauuaacauuggaugggcuuaacagcaggcugaacacugaauuagugaacuagugagaagacagaauuagugaacuugaaaaaagaucaguagaaaauauucaaacugaagcacagagaaaaaaauggaaaaaacaaaaaagacaaaacaauggcuucuagaagaaaacauagguaauagcuucuuguccugggaguaggcaaagaugucuuaaacagaaugccaaagcaccauauauagaaagaaauuugauagaccucauuaaaacuaagaacucuuguucaucaaaagacucgagugugcuucuagaagaaaacauaggauaaucuuaucuauguggccuugggugggcaaaauuucuuaggacacacaaaagacuaaacauaaaaauguauaagauaaacuucaucaaaauuaaaaaccugugcuuuucagaagacuucauuaagaaaaugaaaaaguaagccauagaggagaaaauauuugcaauacauauaucugaccaaaggcucaguucagaauauauuaaguaauuccuucagaauauauaaaucccacaaaccaguaacaaaaagacaauccaguuuuuaaaaugugacccagggacuugaaaagacaauucaaaaagaaagauaaauggcagauaaguccaugaaaagggauucagcaucauuuggcaucagggaaaugcaaagacuauuucacuccuacucaaaugacugauguuuaaaagacugaucacaccaaauguggagcauuggaaugcucaggcauugcugagagaaguauuaaaaaccauuuuggcaguuuccuuuaaaauuaaacccuaugacucaguguuugcacuccuagaaauguacucaagagaagugagggcaaguguccacuaaacgguacaagaauguucauagugacauucuaaauaauagccugcagacugguaacagcccagaugccccuuuaagaggagaaaggauagauaaauugggcuguauuuauacaguggacugcuacauacuauacaacauuuaaaaacaaugaacugauaaggcaacagcauggacagauuucacagauacuauguugaacaaaaaaagugagacacaaaauacuuauguacugugugauuccauuuauaugaaggucaagagcaugccaaacucuucugauaaagaagccagaauagugguuaccucuaggaaaugaagauugguaaaaggagcuugagggaacccucuggggugcuagaaauguauuuucaccuagauagugauuacaugggugugaaaauucacuggauauuuaggauuaguguauuuuacauauguguguugugccucaauaaaacaggaaaaaaauuacuugaggucaguuuuuauuguggaauagccauaaacuguucacagcaaacuaguaaauaauguaggucauauuggaugguaucaucuuaaggcaaaguaacuggaugugacuguaaauuuacacagauuuuguugaugagguucauaacucaaagcacuuacaaaaguaauuuaacacaucauuggaguaaguuaguagcuuuccaaggugacuacuuugggaaucuuuuuaaaaauuguuugaccuuaaaucuuauuuaccuuuaugcuuauagcuaucaauagauuucuaacaauguguacagaaauuuuuaaaaauagaacuuuauuacaaguugaguauauucacuauuuuauuaaauuaggaaguguggacaaaaaaaaucaaaaucaacuauuuuuuuuuaaauuuaaaucccaucaccagagguaaaaguaaccuuugauaguauauauauauauucuuuucucuauacauuuaugcaaacuugcauuugaugacaucauauuuugcagguuuuuuuuuucuguguaauuuauugucaucuuacgucagauuauguauuuuacaguugcauaguauuccauuguagguacagcuaaaaaaugcuaugguuuauuuaauacuuauuguuggacaucugaauuuauauggcuuuuuaauuucuuuuuuuaguauuuuaaguuuuuauuauuucuuuuuaaaaagaccauuaauguaccauuaguuuugaaaaaauuagauguauguccaaugauguacgaaggauuuuuuauuuuuaaacuuuuaaaucuuuguaacuuuucuaaaaacaaguaggauuuuuucuaauacauauuguuuaaaaaguaugacacaacaaguaaaaaagaaauugcuuguaauuucagucuccauagaauaacacuguuaacauuuuaaugauucugcuuucagcaucagcuucaccugagaacuuguucaaaaugcagauuuucagccucuaccccaggcuuacugaaucgacagucuauguuuuaacaaggucuucaggugauucugauccaugcugacgcuugagaacacuacuguaggcuuuggagaagaaucuuacaaagagagaccugaucggccgggcgcgguggcucacgccuguaaucccagcacuuugggaggcugacgcgggcggauggugaugucaggagaucgagaccauccuggcuaacacggugaaaccccgucucuacuauacuaaaaaaaaaaaaaaaaaauuagccgggcgugguggcgggagccuguagucccagcuacuggggaggcugaggcaggagaauggcgugaacuugggaggcggagcuuucagugagccgagauugcgccacugcucuccagccugggcgacagagcgagacuccgucucaaaaaaaaaaaaaaaaaagagaccugaucacagcugugccuuaaaaaggcugcucugacagcucugugcaagguugagccacuugggaaauuauuuucauaguuuagguaggguuaauaacaagauaguggcaguaagaauaugaaagagauagcuguaagagagcuaauagagguagaaucaccagaaauccauaacugggaaugugaaggaagaggugcuaaggauuugagcuggaggagaaagagaaggcuaaugccauuuaacugagagaauacaaggcaaagaauaggcuuuauugguacaaaauguuaguucaguucuggacauuuagauguaugguaccugucauacagauguaaagcauccaucaguugguuggaaaagugagucugaaguuugcaagugaaguuaggauucgagacaugucauuggaaauuaacugcucaaggguaguuguugaauugugagaccggaagccugagaaauaaggauaagauuaaaaaaggauuauugaaggacuaaaacaguagcaauggauggaaagagaauuggaauccuggaaaaaucacagguagucuccaaugagaguucuuaaauggaagagauggugcccugaaguuuauaguagacauuuugaugggcauauucaaauucaguaaaggaaguuaucacugagcaaauuuguuuucuauuccacaaauguaaaacacucuggaauauuuugaaaauaauacagucaccuucaugcccccacaucuacuuaccaaagccuuucaaacuccaacauagucuauuauuuugaaggucagauacuaaggcuauuuauuaaaaggaauucugggguuugggggcgauuucuuuguuucuguuuuuuuagcugaggucucacucugucccccaggcuggagugcaguggugagacuguggcucacugcagccucaaacuucugggcucaagugauucuccugccucagccucccaaguagcugggacuacaggcacaugccaccacucaugguuuuuguuuguuuguuuuuuuaauuuuguagggacagagucucgcuauguuguucaggcuggucucaaacuccuggacucaagugaccuuccugccuuagccucccaaagcguugagguuacaggcaugagccaccaugaaugcuuacaaugucacugucaagauaaaucagugaaaccgucuuugcuccagucacucacuuuuugacagguuuuccuuuuaauguauuuacagauuacuuuucuuauaggggaacguuccauuuaguuacaaaguugcaaauguucaaauauuuugucuugcauucaggaaaccugauuggccaaagaacuaugcuaggagcuagaauggaaugccucaguaaauggaaaauaauauaaauuauuauuaaguagcaugcaauaagagccaaaguucacaaauguaauggcagaaaaacugguagaaaaugaaaauuuccaacauucuuugagaaaaaaugaucaagaaagggauuacaugggaaagaagaaaagcaucaaaagucaagaaguagugaacauacagucauuugaauguaugcuaauuguaaauuaguauacuagcagaauauacuuaaaugugguauauaaaagcuugaauguugaaguuguuaaauagauuauguguuaauuugguguuuuuuauggucauguuggugcacgcuuaagagacauggauucuaaacacauaaguagcuuuuguaacuugagcaagucucugggucucacuuguuuuaucugaaaaaugagaauaauuugcauuguugguuuuuagguuugaaauaaugaauguaucuuaaauguguuucuaauaccuugcacagagacuccccauaaucaccauuaucucaaaauaucacuauuauuauuuggccaugauuuauuuauuaauaaugaauaauagguaauauauauaaggugcgugcuuugagagugaucugaauuuuuuucucagcauacuuaaaugucaagaaauacagaaucaugucuugaaguuauuuagaauuucauguuaauauauuguguucuuuuuaacaggaaguacuuaaacaacuacaaggaaguauugaagaugaagcuauggcuucuucuggacagauugauuuauuagagcgucuuaaagguagauuuuaaaaagguguuuuaaaauaauuuuuuaagcucaaauugucaucuuuagguguguagauccaaguacagcuucucucgauuuggguguugguaucaguuuucuugguauguuagccuuacccucaggauguaauuguuaaaguacaaauaaauaaaaaauguauuugugugucauuucuucaguuaaacauuuaacuggcuuugaaugaacuauuuuaaaucccucccuuaaauaauuuucggcucuuuguaaagcuuguugcuauucugccagucacuaaauagggcuuuaguauucuauaugccauagacuugagccuacuguuucauuggaagaaguauugucuucuucauucaggauagaaauacuuuaaccuuuucacauauauaaguugauuauaauucauuuuuagcaguuuuaaaaggauaucuuucucauucuguugcuugaaaauuccagugucagaacagagaaagugcuugauaauaauugaagccagacagagaaauuacuuuuggauucuaaaauauuauuuagaggaagucuaaggaaguacauuuuaucuaauuuuccuuuaacacacuccuuauuuuuacccugacccaaguggacuuuucagggaaaguccuaaauaauuuuuguuuucagucauguauauuugugguuaaaauguaaaccuaauauuucacuuuaaaauaauauaacauuaagaauauuuuagacugcuuaaagcaauuguuguauaaaaacuuguuucuauuuuauuuagagcuuaacuuagauagcaguaauuucccuggaguaaaacugcggucaaaaaugucccuccguucuuauggaagccgggaaggaucuguaucaagccguucuggagagugcaguccuguuccuauggguucauuuccaagaagaggguuuguaaauggaagcagagaaaguacuggauauuuagaagaacuugagaaagagagguaacuuuucuucauauaguaaacauugccuuguguacuccaguuuauuguuauuuuguaauauaauauuuaaauugugaauuuauaguaggugauagcuaacacuuagagcauuuugcauuuuuaaacucaaagauagcauguuauugauugcacuuacauuaaaucuaaaaauauaaacaaggccguuuccugggauucugaagaccuauuuugucacuuauuuuguuuuuuuguuuguuuuuugggguuuauuuugagacagggugucacugugucucccaggcuggaguguaguggcaugaucucggcucacugcaaccuccaccuccuggguucaagcgguucuugugccucagccacccaaguagcugaaacuauagacgccuaccaccacgccuggcuaauuuuuguauuuuugguagagacgggguuucuucauguuggccaagcugguuaucacuuaaauacuuugacuacucuguacauugaguaauacacauaauuauuauauuuauacguaguuaaaauguguaacuugccagauacuuuggcccacaccuguaaucccagcuacucuggaggcugaggcgguaggauugcuugaggccaggaguucaggacuagccugggugacauaguaagacucuuucuuuuuuuuuuuuuuuuugagaugcaguuucacuuuuguugcccaggcuggauugcaauggcacaaucucggcucacugcaaccucugccucccagguucaagcgauucuucugcuucagucucccaaguagcugggauuacaggcaugugccaccacgccuggcuaauuuuauauuuugaguagagacaguguuucaccauguuggucaggcuagucucaaacucaugaccuuaggugauuccccccugccucggccuucuaaagugcugggauuacaggcaugaggcacuacacuuggccaagacucugucucuuuaccaaaaaaaaaaaaagaaaaaaaguaguaacuggauuuuuauugaauuucugauuaucuauugaaguauauucaguaacuacuagauucaguaaaagaugacucuuuucauuauggaaggcccacuacaaguggccacaaaugaaauacuucuuuuuuuuuuuuuuuuuacuuuauaaauaauaauuguacauuucaugggguacauagugauguuucuacacauauaauuuauugcaaucagguuagcauaucugucaucucagacauuuauuauuucuucguguuaggaacauucacugucuaccaucuagcuauuugaaacuauguaauauuguuaacugugcucauccuaugguagcguagaacacagcccuguacaguagcguagaacacaguccuguacaguagcguagaacacaguccuguacaguagcguagaacacaguccuguacaguagcguagaacacaguccuguacaguagcguagaacacagucuuauacaguaguguagaacacaguccuauacaguaguguagaacacuagaacuuauuccuccuaucuagcuguaauuuuauauucuuuaacaaaucucucuuuaucucuucuuucccucuguguuuccuagccucuaguauuuacuuuuuacuucuguuaguaaaaaguaaauuuuucuuuuuuuucuucuuuuuuuuuuuuuuuuuuuugagauaagagucuuccugucgcccaggcuagagugcaguggcgcaaucuuggcuccugcaaccuccaccuccuagguucaagcaauucucaugucucagccucccggguagcugggauuacaggcacgccccaccgcguccggcuaauuuuuguauuuuuaguagagaugggauuucaccauguuggccaggcuggucucgaucuccugaccucaggugaucugccugccuuggccucccaaaguuuugggauuacaggcaugagccacugcgccuggccaacaaaacauuucuuaauguauaaguuuuaauaccugaaaaaaaauugcuugauguauggaaugaguucugauuuuucacagcuaguguauuaauucuucucuuccuaaaguuaacauuaucucacugcagauaccaaaauauagaucauuaucaggaacuucgucaaauguuuuauguccccuaaaagauuccuuaaugcacauauuaaggaauaucuuuauuaucuuuauauuucuaaaaguucuauuagacauucagaaaaugguaaaauauauaaaagcuucauauuaucucugugaccuugguuaagucauuaaauuuuuguaccauuuucuucuguaagauaaagauaugguucuacuuuguggcauuguugugaaaauugaauauuaguauauaggaaaugcccagcauaucucccugagaggcagaagaccuuuuauaacuuucucuccaguuucauauaugcccauuuauaaaaauagggauaauuaucuggacgagaaaugauguuucacugucuuuuauuucuuaaguuuacauaagucucuguuucauacauugauccuagacuauugaaacaccaucuugaaaaauaaggagugaacuuggguccauaaucuuccaucucuuuuuccccuuugagcucuauuaagaggcagagggcaugcauacuaaccuuuccuuacuugcuuucuuuuccuuacuuugcuuuauguaggcaaaguccugauuuuauuagcagagagagggaauuucagagaaaaauauuaauuuuugaaauaaguuuuacugcaaauacuaguaaaccuaacaaauacagcuguaagugguaaggaauacuuguaauaaaaauguucuuaguuucugucuugacauuauuucuugcuagucuuccagaguucuuugcaucuaaaucuaggaaaagcuuauuucucuguucaaagacuuaaaugcaaugauccccauguuuuauuuauuauauaauaccacuguaaguaacuuuaagcuaguauucugacuuuuaacuccaaguggaaaauacauuucuuuuuaaaaauauuuaaaggugcuuuagccuuuucuguuguuacuguagaaaagacgucuuguuuuuguuuucguuuuucucccaaaauauggcccaacuucuaauucaggcuuuauuacacucuauaaaaaguugcuuuaucuggagagaaagagguaucaacaugguguuguuagaagguucucaacucucacugaucauuaguaucacuaguuuagcuuuauaaagcaucauaaaugaaaaguaucaguauuccuuugcuauguucagucucauuucccaugagauaguuacuucuauaacucuaaauaauauguuuauauugcuaguauuggacaugacuuacugacucaccacucugaaagaugaagauuuguuaaauucacucaauuauccauccaguuuuuaauucuguaccaauucuuuggucgaauuuguauacauauacacauaagcaaauacacauacauauauauaaguucuauuucuuguucuuuccugugagugacugugucuacugaagccccgcuguauaagauuuggcaacuguguguuuaccuuuauuuuguuaagacuguuaacaguuacaucauacuauauauauuuaagucuucauguuuuuuuauucuguaaauuaagcauaauguugaugugaaauaaguggguuuuuuuaggacucuguagucguuggacacugugagucaguaguaugccagaauuaauuuuugcucccuauugauagaauaucauacucuuugugcuguuuaaaggaagaugaugcuauuuggacugugucuuucuuauauagcucuuuguuuuugucucaaguuucuaauugccuuucuuuuauguuuucgggagcagaaacuugugccuuuaugauaauaugaggaucuaguuucauuuuauucauaaauaaauuuuuauuggagccaaugaauuuuucugaucuaauuuguaccauuugcuuccugagccugcuacaagacugucauaccacuguugucauuaugcuucccauuuaggucuaauauguuuggguguucuugacucuugcuguguuggagagagauaaauugauuucuugcuugugugauaguauacuuauuuugcucucacacuugauugauaguucagguagguuuagguucaaacucauuuuucuucauuaucaagguaccaaugagaaauuugauaccagucugaaucuuauuccuuuguagauggccauuuuuccucuuuggaagcuuuugaauguuuugguaugcauauuuuccucauucaucaugcugaauauuuacuguacccuuuugaucuggaaauuuauuuauucagcuuuuuucuguuauauuacuucuuugaugauuuuccccuuuaguuuuuucuguucuuucuuucuagaccuucuuaaagucauaguuuauaucuucuuccuuuaucuguacuccucaagauaaaugcuagaaguugguuaagccaggacuuaaacccagcuuguagcuuuauaagcuggguuuugaaccucaguuuucuaguuaguaaagugaucaugagaauaacgaccucaaaggauaucaugaggauuaaauuagauuuuuuuaaaguccuuagcacuaugcccaguacauacagcauucaauaauguuaggaauuguugcugucauguucacuauuaauuuauuuaacaaauauuuauugaaugcuaauacaaaugugccaugcucuucuaggugacccccaguaagguagaggacuaagaagacaugagauuuaugugaaaaagcauuuuuaaagaagaccauuggcaaucacaaaauaggccuuuaguacacuaaacccuaaugacucugccuguucugagucuagccuuaguuucaguucugagccuuaugaacugcuguugugugagucacaaggucaacuaccauaauuuaaucacuugcuaucauuuuagcugaagacacuauaaccuuggcuuccccagaguauuuuacuacagguuaaucuuaaacuugauaguagcaaauugucccuagugucccuaaccucccccuuacuucaacacugccacugacauuggccugucaauuuaagcacuuuuaaugcccagcucuuuuuuuuuuuuuuuuuuaagacgaaaucucacucugucaccuaggcuggagugcaguggcacgaucuuggcucacugcaaccuccgccucccugauucaagagauucucaugccucagccucccaagcagcuaggacuaugaguaucugccacagcgcccagcuaauuucuguauuuuuaguagagacgggguuucaccauguuggccaggcuggucucgaacuccugacuucaagugauccaccugccucagccucccaaaguacugggauuacaggcgugacccgccgugccuggccccaacucuuauuucauaaguucauuuauuaggaaguaauggaggaaauaguagcaucaccaucuauuuuauucuuuuucccaccuuggaccugguagguccugcagguccucacuagggaaaacugaaaaauagaauuaaaucucaucuuuaugggaguugugguacccagcugugaauggaguucaggcuuucugcagugcuuucuccuguuccuguugucagaaaucggagggagagagcagcuugucuuuagugugccuuuucugagggaugcuacaucauaagcaggggcuuccuuucuucccaaucaguccaucacuauuaagguugccacauaagaacaaaagcuuauuucuuauuuuuuaaguugcuucucaguaaaggaaaauacauuuuagcaagaacagaaccuuccacauacucacuacuaagauucauucccauauuuccuaagaaacaauaaucaagcagaacuuuuaaaguaauaguaucagaguggggaacgucucucuguaugaccaaacuccagaaucuguaauagaaaauaucuacaaaucggacugcauggaaaucaaaauuuucuacauggcaaaacguuacaguugacccuugaacaauucagggauuggcguacccacccacuacgugcagucaaaaauauauauauaacuuuugacugcccgaaaacuuuacugauugccugucuauugaccugaagccuuacugauaacauaaacagucaaguaacaaauauuuuguauguuauauguauuauauacuauguuaaguuagagaaaacauguuauuaagaaaaucauaaugaaguggaagggaauucuuguauaaguggacccaugcaguucacacccauauucaagggucaacugaguaaaaaauguuaaaaagacaagugucaaguucagaaaauuauaugcagcccaacaacugacaaagcacuaucauuuuuaauauagaaaagguccuacaaauaagaaaaaucacagaaaaggaaauacaaaugguuuauaaacuugaacaaaauguuuaaucucacucauaguaagagaaaucaaauuaaaaccagugauacaccauuuaaaaaaacuagacaugaaaaagcaaaaaguugaauuaaacacuuaaauuggugaugaugguagcauacauugguauaacaucucacaagggcaguaaguuaaaaauuuauauauucuaggaauuucuuuuauauaaaugaguguauauguauuaaaugagguauagguauaaggcuauucaaugcagcauuguuuauaauaacaaaagauuagaaaagccuuaaguacccuccaacuaagaguugguuguaguguaucccuacauagauuuaugaauacuagggaauucuuggaauauuauguagcuaacaaaaaaaauaccuaguauagauugagcaucccaaaucuggaaauagaaaauucuccaaaauccuaaaguuuuugaguaacaugaugcucaaaggaaaugcuaauuagagcauuuuuggauuugagaugcccaacugguaaguauaauagaaauauuccaaaauccaaaaacacuucuagucacaaucauuuugaauaagggauacucaaccugugccuauuuguguucugcaagaucgauuuuuuuuuuuuuuuuuuuuggaaaggaguccauugcccaggcuggaaugcagugguaugaucucagcucacugcagccuuggccuccugggcucaagugauucucccagcucaaccucccaaguagcugggacuacagguaugcaccaccacaccuggcuaguuuuuguauuuuuuuguagagaugggauuuugggguuuggguuuucaucauguugcccaggcugguauugaacuccugagcucaagugauccaccugccucggcuucccuaaguauuggcauuacaggcaugugccaccacaccuggcccccaggaucaauuuuuaagugaaaaaaaguugcaggacaacauacacuauaauaauaugcuacaauuuauauuuaaaauguacauauaaguaugcacauauguccuuguauuuuuauagaauagcucuagaaguauaccuaagaaaauuauaacagugguagcucuggcaaagagccacgugaaaagagauaaauuauauacuuuuuguaccucuugaguuuuaucccuguaacacucuuacugugcauuuauguuuauaaugcucagguauacaguuucuuaguacagauugcuauggagaacaccaucauuugguguucagauuccaaacuaagaaguuuuucuccgucauaacuuccucuuauuucaaaaugacaguauauuucuuauuauuuuggcugcugugaagcugaaagccacaucaguguccaaaguaauagcuucuuauauucuggguuuguuuucugggcaucauugcugcuuuucuuauuuccuuuacuauacuuuuuauucuuauauuaauuuugaguuuuguuauauguguaucuuuuaccuaucauuauauucuuagacuauaaauaugaagaaagccuuuggugaaguguaaguauucuuuuaaggaugauuaccaguuuauuuagaaaaaaaguucuuuuuaauacucuaauuuuaaugacuguaauauucuaaguccuaccuuuaaaaauugaaaucaauguaaauuuuuugaguaauucauuauuagcacuuuagguagagaaguuugcaauaacaacugauguaaguauugcucuucugcagucuuuauuagcauuguuuaaacguaccuuuuuuuaaaaaaaaaaaaauaggucauugcuucuugcugaucuugacaaagaagaaaaggaaaaagacugguauuacgcucaacuucagaaucucacuaaaagaauagauagucuuccuuuaacugaaaauguaaguaacuuggcaguacaacuuauuugaaacuuuaauaacuugauauuuuaaaguaccuagguaauccauuaaaauucaggauaacugaauuuauaguuauuuguaaauugcaauauguuuuacccaacuuuaggccugaauauauaauaguuaaugaauuuuuguugguaaagaugauaaaacuuuauugugcucaaauguuuuauuuaaagcucuuauuuagaaaaucuauaaaguuugaauucuagaggaccucaggguucaacuaggcaacuaguuuuuuaacuccguguauugaauugccaaacauacucuauagaaauauuuaucaccaucugccuauuuuuuguacuguguugcaggaaucaugccaaauaguuuuugcaauaaaaauaucucugaaaauauucuagauauaaaugccaauagcuauagcacggauauuagcauuuuugcaagcacuaaagcugguuuguuuuguccaccaguauucacaauaaauuaacaguaugcaguugaauaacauucugauuuacuacaaaggguuauuuuucuuggccucugcugaaccaguaaaacauauacugaaaagaucgaaccugcauauaaugaauguguuggaguaaagaaaaaacaugcaagucaauaguuuagauuacagaaguuuguucaccgauuuaugacagcagguccuaaacugccaacaucucuaaccaucugauuagguuuccaugagccaagucuuagauauuccaugaaucauaaccuuuuagucaguguaacacagggauuucaacuuuuuguuaagaaaugacucaacaugguggaggcuuaugccuguaaccccagcacuuugggaggcugagaaagguggaucacuuaaggccaggaguucgagaccagccuggucaacauggugaaacucugucucuacuaaaguaaauacaaaaauuagccagacaugguggugcaugccuguaaucucagcuacuugggaggcugaggcaggaaaagcacuugaaccugggaggcagagguugcaaugauccaaguucaugccacugcacuccauccagccugggugacagagcaagacuccaucucaaaacaaaaagaaaaaauaaaaaaaaaaauaaaugacucacuagaggaaucuuuaaguguccauuuaacugucuuguuuagcuaauuaaaauacacuaggauuugucugguuuccucaucuggauguugcuagcaaugguaacauuuuucauuuuagaaauuuugcaaaccauugcauuuauagauaugaauucugauauggcugcuuuaaaauuauccaauuuaaauuguccaauuaaaaucauucauuuaacuugaaauguaugacuuaaggaaauuuuucaauuuaacuugaagugauuuauuuuucuuagauuguucagaaugauggcauuucagaaacauuggauuaccugugauuuuuguuuugguaaauguuuaaaaacaauaaaaaaggaaaacauuuacgugugcauuuucuuuauacacacacacacacgaaaaaaaaacaaguaagaaacccagaaugguccuuaggcauaugagaacagaaguucugauugaguaauggcuauggaaauuuccccuaauauauuuagaaaagcuguucucucaugcaguggauauaauauaccaugguaucuaauuuuucuuucugaugaaggaagcaacuacagaaagcuuuuauuuauuuguucaaagugaccagugcaauuaaugcaaaagaaaauccacagcaacucucccaauacuacuuucaaaacaaacauaccaaacuugauuuucauuaaaauguaguuauuucuucacacuaguaaaucaaaaaccaagacccauauaaaacagggcgaacaauuacugugcuucaucuucuggacaagaaugccaaguuaguuucucuuuuauaagcaauuacauuuugaggacccuucauauuugccucuuuugccagcagcaacucugccuaaucugaauccuuccauuucaugagaaacagcaguucuccacugcugucuguggcaccaauuacuccuucaggaucaagacaucuggcaaagccuuuuaguuugucagcagcaucccuucucuucuuugauuuacugucaucagauucacugucagauaaagauuuucuguuugugccaucuuuuucuugacuaguuuuuugagaauuaagaaaugcuucaauuaacccugaaccaucuaaauuuucuuuagguucccaaguguugucaacaucuguaaaucccuuccgcuuaaggaaauaucccacuuuccuauucacuacacgucagucuaguacauuuuccaucacagauucuuccggcucugccucuucaucuuuuuuacucuuuccauucuguuuguuuccuauuuuuugcaauguaguuuuauuggaggccauuuuuuauugcagacuugaggagcugauauucaccaccuccaagcugcucuggguuauaggucugcaguguucuguaaaaaaaaaauucuaauccugucagccucucccucuccaugucaaugauuuuauucaugggauggcacauauaagaauauuucucaaauacauuuauaguggcugcgucagcagcacauauccuaaaacuggaaugaggcagaggaguuuagcauggcccuugcucaaggaugacauggaaauugaugaaguauucuauauuuaaaaaaaaaaaaaaagaaaauuauauaaucucaaacaagacuacauauuuuagcuauuauccauaaauauuucacguaacuuauuuuuuuuuuuuuugagauggagucucgcucugucgcccaggcuggaaugcaguggcgcaaucucagcucacugcaaccucugacucccagguucaagcgauucuccugccucagccucccaaguagcugggacuacagcaugccaccauguccagcuaauuuuuuguacuuuuaguagagacaagguuuugauguguuagccaggauguucuugauauccugaccucgugauccacccaccuuggucucccaaaguguugggauuacaggugugagccacugcgcccagccacauguaauuuuuuaaaagaaaauagacuaauuaaaauauaacguacucucuuagcuuagauuuuucauuuucuacuacuacuuugagagaccaaaauagacaaaaagguaaaaacugaaagagagaaaaccguuuugaaaacauguagcuagccagguuuccugaguggacguuggcugacaggagguggaacuggaagcuuaagugcucauucuccuagaauaaucauucaggguuuugagagagaaaggaucccuuuuucugagagggcccuuaacauguuaacacuuaacagugcuccugggaauuaaggagcacagauaaugagagaacaguuauuguuagccugugaggauuaggaauuuugggggauuuguugggacuauaacuuaugaagaaaaauaccaaaguguaguuuugcuuaccguuaauuuuggucauuagagaauauacaaaaauccagaaucccacugucuacaugaagucagguucaggaaagagcuuaaauguacaugacaacucaagaguauuugguuacuaucugaaacaaagaucaguugucaaguuaauuauucucuacuaauuuauuaaguagaucacauuuauuuaauaugauauauaagacauuaucaggcaccauuggcaacaucagcaaauuuaaacucugcuuguauuuuauaaguauuuuuuauuuucacaaauuuugcauuuauguugggaagccaagcuaaugaacacuuuauguggaaauaccuacuuaucaaaacauuacugaaaacaucagaucuaaaccacauuauugcaacauacugugucauguucaauuuuuuuuuuuugcagagaggguuugggaaguggaggacuaauaaguggaguuacaacuggcucaguaggaauaagaaauaacaugcagacuauuucaucucuauugcaacccauaauuuggguaugccuaagggaaugcauucugcauaugaaugucaucuguauguugcaaagggaaaagggugagaacuaaucuaacuacaacugacaacacaauuuggaguucuuggaccagaaugccauucugagucagauauaugucauauacaguuuucuaagggcacacagaaaaucuauaacauugccugauucccuucauggcccauuauaagucuguuaccuaucauuuuauuuaaucagcuuuuauugccuuuugggcauggguuuauauguuucauuaccuuguccuuuuaaaauccuguugcaugcuuggcaguuaucacaguccuuggaauuuuaauuaaaggguuaauaaauuuuugaaugaguuauuacccauucugaagaaguaccucuuuuuguuucaacuuugcuuuacuuuugaauuuuuaccaaagucuguguugacuuuaucuacucuauuuaugauuaucuuucuuacauguaggcuuuuucuugucccauauuccucauuugauuaaugaaaaaguucucucaacuuaaucuguauguauaugguaauccuuaccuuaaguugaaguaugagcuuaagaaugauggacuuguuucuugauauuucuauguuguccacguuaauaugcuaguauuuaauaauuaaaaguagugccucuucaguagagaagagucauaaggcaacugaauuuaaccucacucuaacuggaccaauuauauauuuuaagugaaauaggccaaucuaauuaaagccacuugugacuuuggcaaauaaguguuugaauuccacgucacaucagggauccagauugagucugacaccuauaaucaaauuuaaacacuccuuggaguaaaaaauaauuuucucaugcaccaugacugacguauuugcuuauucauuuucuuuauugguucuuauaugcuuuuuugcuuuuacugauuaacguaaauacaagauauugauacuuuuuuauuauuugugguuuuaguuuuccuuacaaacagauaugaccagaaggcaauuggaauaugaagcaaggcaaaucagaguugcgauggaagaacaacuagguaccugccaggauauggaaaaacgagcacagguaaguuacuuguuucuaagugauaaaacagcgaagagcuauuaggaauaaaaugaauuacagcucuguuaauauugauuaaauuuuauuaaagacauaaggcuguguuuauuuuggcucuauuucaaaauaagauuuaucauggcugcugagcaacauaaucaauauucacauaguugugucuuuaccauauucauuuccccugguacuguucuguucugccuuggaauuauaagggagagacagaguuagaugguggucuuccgguagcuaaugacuagcuucaguucuccuuugaaauuuuuacuucuuguaaucuuagacuguauaaaggcauucagaacaugucacugcucuucaaauugugcacuuaaaaaacccucauucaaggauaauaggaaggaaacaaagagaauuuuaggagagaugaaguaaguuguauggagaacauucccauauuucuacccucaaugucaagaaagaguauuagcuagcuuugcuauuaaguauuuuuauauauuauugaauauagccuuuuuauauucaaacaaguuuaugacugacuaauguuuuaaagcccugaagaggccuugccaauugccuuaucuguuucaaaacuagcguggguuguuguuuucuuuuuuaacuuuugggacaaauugggaggaaaacauuuaaagauuuucuuuaaguaaauauagcaaauaaaagcagagaccaacauuuacaugguagugauacacauacauuuuguauucuauaaaacauauuaaauaguuuuaaaauggcuacuguaggauauuuuacauuccuugaaguauagucuuuauuuuuuuugugacacuuccuaaacauaaugauuuuuuuuuuuuuuucuugagucucacccuguugcccaggcugaagugcaauggcaugaucucaccugcaacuuccgccuccugggcucaagcaaugcuccugccucagccaccugaguagcugggauuacaggcgugcgccaccaugcccagcuaguuuuuguuucgccauguuugccaggcuggucuugaacugcugaccucaagugauccaccggccucagccucccaaagugcuaggauuuagagucaucaugcccaguguauuaguuuguuuucaggcuucugauaaauacauacccgagacugggcaguuuacaaaagaaagagguuuaagggacuuaacaguucuacguggcuggggaauccucacaaucaugguggaaggcaaggaggaacaagucaugucuuacauggguggcagcaggcaaagagagagagacugacagggaaacucccauuuuuaaaaccaucagaucucgugagaauuauuuacuaucacaagaacagcacaggagagacccacccccauaauuuaauuaucucccacugggucccucccacaacacaugggagcugcaagaugagauuuggguggggacacagccaaaccauaucacccagccuaaacauaauguauauucuaucuguuuuggaguaugguggaaggcuaaggugcuacuaaaacaccaguaccauacuacauuucauaguccauacauguuaguuucauagugaagguuaagaucauaaugagguugggggcuuaacuaguguuugugugcaugugcauguauguguacauguuaguuauaauacguguauauaucauuuuuucuuaccuucccucuugccccuaucccagucagaaagauucgugacuuaaaugucaaaaguaaaacuuuaaaccuuucaguagaaaauauacauaaguauguuucugauauuagaguaggaaaguauuucuuaagaaagacuuaaaacgcuaaugauaaaagaccaauaaguuuacuguauuaaaauuaagaauuuaucuucaacagguaccugaaagaaagugaaaagauaacuuacaaauugggagaagauauuuauuaccauauaacuggcaaagaacuaaaaucaagaauauauaaauaacuucuaaaaauacauugcauuuuacauuuagauuuaaauuuuagauuuucauggaauuauuuuaaaauguuagguuuauuuguuucaaaaaaacaaguauuacuuugguuuauaugaauuugcauuuuuagaacaugaauauaugggauacuguagacauaaguuaguuuuucugugucuguuaaugugagcuuuuuuuuagagagagagauccuaaaagaacaagaugugaugguaguuguaaaaauucuugugcuauauaaauauaaguagguguauuccagacauuuuauaucccugaggagagguuaacuugaguucuuucuuggccauuuuguucacauaagcgcugauacugucauucuuacuuuauucuggaaugccguauccuucauuuugguaguuaauauucuaaggaaauuuuauucuguauuuugagaaacauacguguucauuuauucuggaaauaguuauaugaagguuaagguuaaagaaauuguaaacaagauaaaaaggcaaauaauggaaauguugguagaauauauaagagauuuaauaucccuacucuacaaggaucaccuacaaaucaauugaaaauggucaaccaugccaggcauggugauucacaccuguaauucuagcacuuugagaggcugaggcagaaggaucacuugagcccaggaguucgagaccagccugagcaagauagcaagacccugccucuaccaaaaaaaaaaaaaaaaaagcugaguaugauggugcacaucuguagaccuaguuacuugggaggcugaggcugaggaggaucccuugagcccaggaguucaaggcugcagugagcuacaaucucaccacugcacucaaaaaaaaaaaaaaaaaaagagaaagaaaggaaagaaaagaaaagaaagaaaacagauaaccaaauagcaaaauagucagaagaugugaauaguuccaucagaaaauuaaguucaagugucuaauaaacaauugugaaaagaugcuuaaacaucacuacacaucagggaaauguaauauaaaguaagguacuauuuuuuuuuugccuaucagcugcccgaaacuuuauaauuuuugaugacaugcaguauuagcaagggugugaaaguaaaaacaucaucuaccuuuaaaucuuuuuuguuugcuuuguuuuuucuuuuugagacacagucuugcucugucacacaggcuggagugcagugguuugauuucgccuuacugcaacccccaccuccuggcuucaagcgauucucaugccugagccuccugaguagcugggacuauaguugugugccaccacgcccagcuaauuuuuguauuuuuaguagaaacaggguuucaccauauuggucaggcuggucuugaacucuuggccucaagugaucugccugccuugaccucccaaagugcugggauuacaggcaugagccacugcacccagccaacauugucugcccuguucuuuuaagaauaaauugauacauuuuuggaggacaauuuggcauuauuugccaaaauuaaaaugccugugcucuaugaccguguguuucuauaggacuucuaggaauauguugcguacagaaauacuuacuuuagggcagaauguagauacauauuuuaaauuauuaaaugaauaguaugcaagcuauuauaaaauaccauacugagaauagugggaauaugguagccaaagcacuccuuucccuccuaacucccugcuugggugauucagcaagugaaacaagaacggcccuggaagaggagaucucaggagggucugaggcuaugagaaaaaauaugggaucucauuugcaaggggaaggaguaaauaagaauuccaaauaaaauaagaauagaaugaaaguuuuuaaacauaaguauuaccacaaaccagaagcaaaccuuauauuaagaaaauagugacugagugaaauagcucaggccuguaaucccagcacuuugggaggcugacgcaagaggaucacaaguuagcaguaguguuggcacacaacuguaaucccagcugccuuaaggaaugcugaggugguaggauugcuugagcuuaggaauuagagguugcagugagcuaugaucaugccacugcacuccaaccugggugaccgagcaagacccugucuugaaaaagaaaacagaaauaaugagguaaucauuguugcuaucauuaauauguuugaguagcuugccgucaucacuauuauuuaacuuuguuugacaggcuugacuaaugcaaguagaaaaaacaaaauaaguguuaugaauccuacacuauuuuugaacuagaaaggaagagauuaaauaauuauuuguaaaugauguggugguuugccuagaaaagcuauacaaaaugaacuaaaaaguauuuaaacuaguaagagaauuuaguaagguaacucaaguuaagauacauacaaaaaucagcaauaacuaccaguuaaagguggaaauggggguaggaggaccuguucacaguaacaggaaacuuuaaaguaacuagaaaaagccugcauaaagaaaaacauaaaauuguugaaggacacuaaauuuuuuggaaccuagaaaaaugauuauaaaguuuauaaugcaagaauuuccaaaaacauuuaugaaagaacgcauaauugaagauuuaccuuaccauuuguuaaaaucuauugugaagauguuguaauaaucacaguaugauaauagcacaggaauaaauuuaggcaaaugauagagacuagaaagagguacaggaauauuuacaaccuuuauaugacagaaguuacauuauaaauuuuggagaaauugauaaauuacucaauaaauuauauagguacaaccaaugaccuguucagaagaugagaaauuaaacccuuaccucacaucuuaagaaaaguuauagguugauuagcuauucaaaugugaaaaauaaaucuaaaauuaauagaauaaaauacaggcaagagaucuucuuaaauaugaauggaaacucaaaagcaauaaagaggaaggaaaguugggauuuaucucauaacauuuuaaaucauucauugcacaaaagauaaauuagaaaaauacuuauaacacauaaaggggaaaaugguaauaucucuaaaauauaagaauuccuacaaaugaauaagaaaaagacaacccuguguuuuuguuuuguucagagaggggguuuugcugguugcccaggcuguagugcaguggccauucacaggagcaaucauaauacacuacagccucaaacggcucuagcaacccuccuuccucagccucccacauaguugggacuuuaggcguguacaucgcaccugccuaacccauguuuuuuaauggacagaggauguaauaaggcaguucauuaaaaagauggcaaaugaccaguaaaacacagaugacuaguaaauaauuuaggaaaacucaaaauccacuugugccuaccuaugugagauuguuagucuccagguaccucuuaacugcaugguuauuuauuuacucuuacuuguucaguguguauuuggucaccuaguauggugguacuuacccuuccauaggcauguaagcaaagguuggaaaagugcacaucaguuuguuaauagagcuuacuacugggaugugggaauugguggggugaagguguaaguacaccucuauauugccauaauugaugauacuguuuaauguaguuuaucuccucccuaguugauggacacuuaaguugauucuaauuuuucaguuaaaaacagcacauguacccuaaaacuuaaaguauuaaaaaagaaaacagcucugauaaacauacuuauucaugucuuguaaacaaacaugcaagaguuucucuaggugaggagucagcaaucuuuuucuuagaaggccacauaguaaauauuuagguuuuguggaccauauggucucuuuugcaacuacucaacccugccuuuuucuuuuucuuuuuuuuuuuuuuuuuuugagucagagucuuacucugucaccuaggcuggaguacagucaugcaauuuugucucacugcaaccuccgccucuaagguucaaacgauucuugugccucaggcucccaaguagcuggaauuacaggcaugugccaccacgccuggcuaauuuuuguauuuuuaguagagacgggguuucacuauguugcccagucuggccucgaacuccugaccucaggugauccaccugccucagccucccaaaauguugagauuacaggcgugagccaccacucucggccucaaccgugccuuuuaacaagaaagcaaccauagauaauuuaugaacacaaaugggcauggcuguguuucaguaaaacuuaauuuauaaaaacagauggcuuaguaggcccuaguuugcugacuguugcccuagcauauauaucuaaaagcauaauuacuggucauaagguaugaguguuuugaaugaguguuugccaaauugcucuuaaaguaaucuuuuuaguuuacauuccuaauaguaguaugugacaauucuuguuucuguaugucuucuccaucacuugugagucagaauuuaucauuaacaaucaguggguagugaaacauuuugucaucuuaaacuuuguauuuuccugagcuacugaaguugaaucucgaaaauauuuauuagauuuugggguuuucuuucuaaguuacuuccucauaucccuugcucauucccuacuguuaaaugucuuguuuucauuuguuugagagauguuuuaauauccucuugauaccaauccuuuguagauaauauacaucucaauuccuccccaccaaaucuguuaucuguauuagccucauaacaaaaauaaacuuuuaugauagagcuaaauuaguuauauugccagauuuauacaucuuuuccuguacugaagucguaaagguaaucuucuauuagcuccuuaauucaucuugaguuugcuauuauguauguuguggaggcaggaaucuaacuuauauguauauuacuuauauauguguguauguguauuauacaugcacaugauuuauacauguguguauauauaguuauguauagucauacauacauauauuuauguuguuaacugaauuucucauuaucauguauuggauaccgcacuaguuccucaucgaugaguaaugucaucucuuaucacauaacaaguuuauauaugcuggauauuucuggacuuucuucuguuaguccacuuuagcuucuccaugccugcacugauaccacauuuuuuauuugcugcaguuuuauaaaucuugauauccaguugggugaaucguucuuuguuuuuaaaaauguaguauucugccuuauuacucuugucauguaaacuuuaaugucagcuucuaauucagauaaaagcuucaugggcuuuugauuagaauuacauuaaauuuauagauuaaggagaagucagaccuucauaauauuuagucuugguugaaaggauggacucuggaaccagaccuucuauauucaaaucccagaccugccacuuagcaacaccaugauccuagguaaauucucugccucaguuuucuugucaguacaauacagauagugauaaacuguaaaaugugaggauuaaaugaguugauauauguaaaagcacucagaaccuggcacauaguaagcaaauuauuagguauucuuacuaauuuuauaucucucuauucauuuaggcuuuauuuuauauccuucaauaagguuuugucaaauucuucacaggggucuuacauaucauuuaaaaaaguuauuccuagauauguuacaguuuuuguugcuauuauaagugagaauuucuuuaauuauauuacuaaauuacauuuaagugaaaaguauccagcagucuuccugaaauauuuuauuauaucaucgccgguuuaagauucuauacacugucauauuguucgcaaauaaugacaguuuguuuauccuuuccaguccuuacagcguuuuuucuuuuguuguauuguguaagaacucuaauacaucuuugaauggaaacaaugauaguggucuucuuuuucuugucuugacuuuaaagggaauucuucuaaaauuucacaguuaaguguguuguuuacacaguuaaguguacccuuuaucaaguuaagggauuuaccuucuauucuaauuuguggagaguuauccugaaucuguauuacuacugcaguuuuuaaaaaucacuuuuuucuaaagucauaucaaguccauacuccugaacaguuuguuauuaaauauaacuucacaaauauucuugucauauagaaaaaggaaagaaauacuuagugguuaagcauccuaauccaaaaauccaaauugugaagugcugcagugagcauuuccuuugagcaccaugugggugcuccaaaaguuuccuguuuuggagcauuuuggguuuuggauuuuuguauuagguauagggauuaggaauacucaagguguaguggcuucuucuauuuucauauuagaaacagaagcacaaggaaugucaugucagaaaccauccaccucacuggacaucaagacauagacaugaccucaguauuuagugagauacuggcaauauggaaauguaguguaaaacggagaggagugggagauauaauuuccuauuuucauccucuaaauauuaaaaauuuuuauuuaggccuauauugauggaagggagcuaauuauauagaaacugauuauauagaaaaggaggaaacaaucaaauuuagaaauccaguaauuuuauguagcuuggcuauuucucuaaagcuaggaaguacuugccaccugguuauggaaaugaucacucaucuuugcaauaucuuuagaaaacuagcaaaaguacagguacuucuucagaugguuuucauacugugaauuggacaugguaagauuuguuacuuaaagaauauuuuuuuuuuuuucuauuuuuuugagacagucuggcucugucucccaggcuggagggcaguggcacgauaucgcucacugcaaccuccgccucccaggcucaagccauccucccuccucagcuucccaagucacugggacuacaggcguaugcccucaugccuggcuaauuuuuguauuuuuuguagagacgggguuucaccauguucccuaggcuggucucaaacuccugagcuuaagcagucugcccaccuuggccucccagugugccgggauuacaggccugagccacggugccuggccugagaauauuuuuuuaccuuaaguuuacuacuuucagaaucaugauagagacucagcuuaguuauauuguuaaaaagaaagaaaagagggagaaaauuaagauagauuaauuugggacugugagcacagcuucuuguuuuauuuggguuuuuuuugggggguggggguuguuuuuguuuuuguuuugagacggagucucacucucgcccaggcuggagugcuguagcaugaucucagcucacugcaaccucugccuccuggguucgagcgauucuccugccuuagccucccgaguagcugggauuacaggcacgcgucacccaugccuggcuaauuucuuuuuguauuuuuaguagagacgggguuucacuguguuggccagaguggucucaaucuucugaccuagugauccaucugccucggccuccugaagugcugggauugcaggcgugagccaccgugcccggcagcgaacacaacuugaguuuucuguucuuuguuuaucauaagacuggaugauagcaguaaacauuuuuacuaugguaguaagaaaagcaugaaggcauuguauuuaaguaaaacuagaugugaucaaagaguaaguuuuauaacugcauguauuuaaagcuaauugccauaguacuuuuauuauuuaucuguugggggugauauuuguuccgaaauauuuuauugauggagaacauaacugaaaaauguuuggaaauacuccaucuagcuucuaacacacacacaccccuuauugaaacaguuuacuuuuauaauauaauuuuugauuucucaauauuaggaugucaauaacuauagaauuauuacagaaaaugguacaacauugucaguacuuguuuuuaaaacauauguguuugauuugucauaaacuagcuuuaugagacauuugcaaagucuuuauucauaagugaguuguuuuuuccacuuccacuaguauucauaaaaguuaaaaugaagucuagcuuaaaaaacacacacacacacacacaauauauuccccacauuguuuccauuccaugugguucaaucuguaguuacugcuuugugaccaguugauggucuccauauaguggaaaagcaaaagcucuauccucuuuaugauccuaguguuggagaaaaaauaauguuuagccacaguuagguacuuggaaaggcugaaaaauacuacuaacuuaugacagaaguaacuuuggggaagaguugggccuacuguuuaaaccagggguccccagcccccaggccacgagcaagcauuaccaccugagcccugccuccugccaccaucaguggcugcauuaggagcaugaacccgcuugugaacugcacaugugagggaucuagguugcgggcuccuuaugagaaucuuaucuaaugccugaggaccugagguggagcaguuuuauccugagacuuccccugccccagucaguagacaaauuucuuccacgaaaccagucccuggugccaaaaagguuggggacccugauauuuauuaaaacaaaucagauguucuuucccuuuacugguauacuauguuuauauaaauuuauuauauuguauuaaugucucgauuaauauaaaagauuaaaugcagguguaauuuucucuuuguugaaauauuuuuugagaauaaauuuucacaauguguauugugucaauuuucauaauucaugcaacauacaauuugauauaugacuuguauuuccaguuuuacuaagcagaucuagacaucuguugaauaaaguccaguguauuacaaaaaauugaacugacccagggccgggcacaguggcucacgccuguaagcccacagcacuuugggaagccgaggcaggcggaucacaaggucaggacuucgagaccagccuggccaguauggugaaaccccaucgcuacuaaaaauacaaaaauuagcugggcgugguggugcgcgccuguagucccagcuacucgggagccugaggcaaaagaaucacuugaacccggaaggcggagguugcggugagcugagauuaugccacugcacuccagccagggcaacagagcgagacucugucucgaaaaaaaaagaaaaaaagaaaagaaaaauugaacugaccccaauuuguuauuaaagggugaauauauuuauaugucuagcuuuuuaaaugagaaugauuugacauaacccugagcuuuuaagugguagccauaguaugauuauuucuauuaauauuauuaauaaaaacauaacuaauuagguuucuuguuuuauuuuagcgaagaauagccagaauucagcaaaucgaaaaggacauacuucguauacgacagcuuuuacagucccaagcaacagaagcagagguuaguaaauugccuuucuuguuuguggguauaaaaauagguaguuauucugagaaaagaaaacauguauaauuuaaugugacaccauugaaauauagauguucuuucagagaauuuaaauaccguaauuuuuuucgugaaauuaaauuaucaaagauuuggacuauuuugauuuuaucuaacuuuuaggcaguuaaaauuuauaaaacuguaaauauagauaccuuacuuuagcugucaguuuacauauaaucaaauaguuaacuuaauuuggcuacuauccaguaaguaaacuuuuuuauagauaauccauaguaagaauugauaauacacauuuaccuguguuuacuccagaaaccccauuaaagugauaguaaaaggauacaaugaaagaggcauuaagaccagggaaggugaccacaguaaaauccguggagcuggaaagcagguaaacaagugauaacauucuagcauaucagagaggguugacccauaaggcagcaauaggaaugaaaagucaugaagcaacuagauaccucugggugugagaguaaaaaaggguuaaaagcaggaagauauuugaaaaucuguuaagaagcagauggacuuuccagaaccucccuacaacccuguacagcuaggugacugcuccuuuccaaucccagcaaaagaugagagcuuucuccucugaagagguggagaggguaaacaaagggucuuugguuaggggucaaccuuguuuaauugaacgugaggguaucauacgaaacacugaauuacaugaaaauuuaccuacugaaugcugaaacccccacuggcauccaggcuuauaaucuccaggcaaguuucuggaaggaacuucuauaaggaaugugacuaacccugauucugcugagagaacauuaaaaagggagaaaaaaaaucagaagaaugugacuaacccaagaaaaaaaacuuaaagagacuuacauggaaaaauucacccaacaaaacaacccaccuagaucacccuauaggguaauauaguugacaaaauccauucuucaggcauagagcuucauuuaacuuuuucauagauagcccgcucuuaaauaugaguggacacuaacuaccagacaguauagaucauucuaggaagguucaauauccaaauaaaaggaguuccaaaaagaaaauggagaaacuggagacaggaaauuagagaaauaaaucaaaauuucucagaaauuuuaacaaggggcuuaguuuuccaaaaaauuggucucuccaguaucuaacaucauguauaagaauaauccuacacuaagacacaucaugaggaaauuucaaaucacuggggauaaaaagaauauucuaacaaccuucuggagaaggaagagaaaacaaauuucacauaaaggaacaggaaugcaaaugccuuuacauuuguaaauaacagcacuggaaacugggaaguaggguaggcauuucuuaaaacuuuucuuuuuuuaagagacguggaacuaagucucuuaaaaaaaaaaaaaagguaggaugaucuagcuggguuguuuuguuggugaauccugccauguaaguaagucucuuuaaaaaguuucugucacccaggcuggagugcaguggcgcaaucucggcucacugcaaccucugcuuccuggguucaagugaucuucccaccucagcccccgaguagcucaugugccaccaugccugacuaauuuuuguauuuuuuguagagacgagguuuugccauguugcccaggcuggucucgaacuccugagcucaagcaaucugccugucuuggccuuccaaagugugggauuacaggcgugagccacugcgccugaccccuguuaaaccuuuuaaaagaaaauaugugcagcuauguuuugaccccaguucuuugacaccacuguauauccuccaguuggguucaauuuugauccuaacuacccagaguuagagucagcuccacaaguaaaagacaaagucagucacaagacuguccacuucaaacgccagccacaaguuuugggugucccuaagccaccaggacugcugccaagcugucuauaaauuccaccccgugugcgugugcugugguaccauuccauucucacacuaacuacccagaguuagcacagccccaacagguuaagagccgacuccuucacaagacugcucccaccucagaugccagccacaaauguugaguaucuccaagccacucacauuucugcccaguguguuacaaauuccaggcuuccacauccccuucacguucaguaauucauuagaauggcucacaacucacugaaagugcuauacuuaggauuaacaguuuuauuauaaggauacagaucaagaauggccaaaugaagagacauauggggcaaggccuaaggaagggguguaggaauggggaugggggugcagagauuucaugcuuucuccuaguggaaucuaggcaugucacucuucuagcacuucauuguuuuguuuuuguuuuuguuugagacagagucucgcucuguagcccaggcuggagugcaguggcgugaucuuggcacacugcaaccuccgccuccuggguucaagcgauucuccugccucagccucccuaguagcugggauuguaggugucugccaccaugccuggcuaauauuuuguauuuuuaguagagaugggguuucaccauauuggccaggcugggcuugaacuccugaccucaugaucugcccgccucggccucccaaaguguuaggauuacaggcauaagccaccguucccagccuuuuccagcacuucaguguauucaccaaucagaaagcugcacugaguuuugguauccauaauuuuuauugaaauuuuauucuguaggcaugauuaauuaaauaauuggccacaugaggauuaaacucgauuuccagccuccuucucuuccuggagguccgucuggcccaaaguucuaacucucuuaucacauggugacagccacccaucuuuuugcuaucugguggccuacccugaguugccucauuagcauaacacacaccccuaucacucgagaaauuccaaggguauuugaagcucucucagguacaaaugaacaaagaccagcuauauuuuuuauuauaccauucuagccuuuaaucaaaguguuaaauuugagaguggaauaaagacacuuuuagauaggcaaagugucaaauacguuuuucucaugcacccuuuucuggaaccuauuaaaggauauacucaagugaaaucgaaauguaaagcaagaaaaaugaauuuuuucaacucaagacccaggggauauaauacaagagaaagagaugagugaaacuacagaguaaagaugaagggacauccugagauaaaugguaaagaaagcaaccaguccauauugaaacuauugagaggauuccaggagagauuaaguccaagaagaugaaaucagcagaauaccugcgguuucugaauguauugaagggaaaggaaauuuacacaguaggagagaagcugagcaucagucauauguacccagaaacccaaaugaacaaaaaauaaagauaaccuuuaacuccauggacaacaggaaguuguaaaggaaggugauuauaguauaccaucugccagcuaugauuagaauuucauagucaaaguaauguaaauaguggaaaauuuguguaacaauaaaguggaacugaaaugaagcauucaacugaaaaaugcagaacuagccauugaagcagguuauuuggagaucggagggggugaguauccccccuuccccaaaaacucagcugaaagagauuagaaagaaagaguucuuucaaaaaacauuuucauccaugucuggcuuuuuuaauaucugaggaacuuuggauuuaguacaucugaaucugaaauauguagaaacuuauuugcuaaguagacaguuuaaguacaaugugauagucauaauccuaaaagcaguuuaacaugacugucuuaagcaaauauaagucaaauauuugcaauuuaaagaauguguucauuuuugcaauggacucuuuuuuuaccuggcccuuggaaagggccaggaaaaaaagcaguauuuuuuugcuccuuuucaguucuguugguauugauguauguagcauucuacuuauuaugaccuuuuuggcuuucuacugaaguuuuuaugugucuuucauccuuaagcaaauuuguuuuggucuauuuuuuaaauuauuuuuaaauaggcaguguuuuguuuuuaauugaauagcuuuaguuacaguuaguucuuucccccccaucuuucuuguauucugauuauuacuguuuugcugcaucuaacagguuuugauauuucuaaaucaauagucacauuuuuuucuaguugauugaaucuuuuauuuauguaauauaaaauagcccucuauuuuauuuaaugcuguucaccuucaauuucauuguaguaccauuuauuaauaguaauccucauuuuccaguacuguuacaaguuucagguuggaaacuuguuuguguuucuuguaucuguucaaaacuuuuuauucauauuauuggauuuagggcagacugucugcuacuaugauccaaccucuuauugcuuccuuuuguuaugauaauaguuacaucaguugcauuauucugauaguuuguaaauguaagccaaaggaaggugccauuucacauuuaagaaagaacaaaaccacuuuuuacaauuuugccguuugugguuuguuuauugcauuauuuuauucuucuaauguaaguuagagggagaagcuagaagauggagaaaauuggggauuggacacuugcaaauuaguucauagagcaguagauaugagaaagggaaaagcuucugccaaauaauuucucuaucaugaagcauauuucuuauagcauuuucuuuggcuaccuguauuauaacucugguuuaaggucuagaugcuggacgugauuuaagucuacuaauuauuacacaugauucaaaacucagaaguuacauaaagguaugugaggcaaccagugcugugacuuucuuguguguucuuccagacauaguuuauuuauuaacaagcaaguacauuggguggaaugggagcugugaggacaaugcagugugucuuaaaagauaauagcaaaugaagaauacuuacuaaagucacaguauucuugcaacucauuaauaaagauaaauacaacucaccuuuuaagugggcaaaagauuuaaauaggcauuucaccacagaagguauauauaggaauggcaaauaaguacaugaaaauaugcucaaucauuaaggaaaugcaaaucaaagcccaagugagauacugcuucacacccauuaugauggcuuuaaucauaaaggcaauaauaagcauugacgaagauguggagaagcaggaucccucauugcuggugggaauuuaaauaguacagccaccauuuuaaaacaguugagugauuccucaaaauauuaaacauauaguuaugugacucagcaaucuuacuccuagguaucuggccaagagaaaugaaaauauauguguacacaaagacuuagacuuguauguucauucacuagcagcauuuuuucauaauagccucaaaggagaagcagugcaaauguguaucaacuagugaauaaauaaacaaaauuuguuauaucccuucaguggaauauuauucagcaauuaaaaguaaguuacugaugcagaauuuauaacauggaugaaccuccagaacaugcuaaguaaaauaagccagagauauaaguccauuuauaucaaauguccagaaaaggcaaaauuucuaaagacaaaaaguacauuagugguugucugacuguaaguggaaaugaggauuaacuguaaauggacagcaggaauuuuauuggaaugaugaaaauguucuaaaacuggauuacagcugugcuugauaaaucuaaaagucauuuaauugaacacuuaaaauggauggauuuugugauauuuaaauaccucaccaaaauuuuuuuucaaguucuaucaccuagaguagaaaaccuuggagaaguuguaaagcaacuauggaaaugaggaaacuaguuagaauuaaucuuucauaauagugaacaaccacuucuuuugucuucaguguaucgaagcgugcaggcaggccuguagccuaggaucagugaaagaauaaaaaaaaguaauuaggaaagaggagggaggaaagaaaaugaagauaguaaauguuaaaugguaguuuggguuggaauugccuggguuggaauuccagcucugacucugccauuuacuagauaugugacugaaaacaaguuacuuauauucucugugccuccaucucuuuaucuauaaaauggggauaauggccgggcacuguggcucaugccuguaaucccagcacuuugggaaacugaggugggcagaucaccugaggucaggaguucaagaccaaccuaaccaacauggugaaacccugucucuacuaaaaauacaaaacauaaccagcaugguggugggcgccuguaaucccagcuacuugggaggcugaggcaugagaaucguuugagccgagauugcgccauugcacuccagccugggugacagggcgagacucugucucaaaaaaaaaaaaaaaaaaaaaggcacuuuaauauuacucaacauauucaaaacauaauuaaugaucuguuccuccuaagcccucuuuacuaccccaccuugcagcaaaaaaccuucauccucccucaguauuaccuaucucugugaggaguagcaccaucauuauugaauugugugagcuaaggaauguaggaguaauacuccacaccagaccucuuccuccacuccccauauccugucagcgaacccgaucagauuuaccucuaugucuccacuucuuuuaucucugucacugcuucccuagugcauagugccacugucucacacuuauauuaauacauuagccuccuaacuggucuuuccuauguuuccucccuacuuagaccauuuaaaauuugacuuaaaaaauaaaauuuacuugcaacuuuauccauuaauauauuaguauuaauuaugugggggcaaucaugcaguggccucacuguaacuugcaaguagaaaaggcaagaaugccaucuaagaaucgcagaaaaaggcauuaaaauuuaaauuuuuuuaucauauucuuuuuguucuacuuuccuccuuauuuuuggugcuucauccacaccaugauucguugacacgcuaaaacaagccacacucccuccuacccuggguccucugcaugugaucuguuuuacccagaacacucauccucuacuccuccccuuugccuaguuaacuccuauuuacucuucaagucuuuacucaaacagcacuucccaagagagcucuuccaaaccuccagaguauaucauaucucucuguuauauauauuuacagcaccuuguacccuucuuucauggcauuugucaauuuuaccuuuauuauuucugucauuauuugacagugucccugacuaaacuguaagguccaagagagcauagaacaaugucuaguuuugcuagcacuguauuccccagcaucuauugcaaguaacuaacauaguagauggucaguaauuuucuuuaaauauguugacaucuucacuuacguuagugucaaaucuuuguggucuuagauucauuuugucucuagguugacuuuauguauguauaucuauucuuguggauuccauuaaauucuauagcaugauuuucagaugguacuaauuauucuuauauuucuggauuacugagugcuaccucacuuuugccagcauauaacugauacuaguuuauugauggaaauguugcauauaaauuaaauuuuuaagucacauuuuuuaaaugaucuaggaaagcuugauguuuaaagaaauuacguuaggaaucauuuuguaauuuaauuauccacuguuaggucagauuuuuaauguauaauuuuuauuuuagauauuuuuuuccuagaacaagcauauagguguuucuauaaaugaccgugagaaauucuuuuauuucuuuaauuuuguggugguauuuuuauaaagugacugcuuugugcuagggauaaucuaucuugaaaugacugcuuuuacuggauguaaucugucauuuuaauuuccuguuaacagauggugguugcauuagaaaaggcuuuggguuuuauucauaucagaagcuaagagccuaucauuuuauuucaccuaacuuuuauuagaagauauacauauauauauauauauucuaugugaaaauauaccuaaguagaagauauuuguaagcuuagguaauaguuuaacuguuguauuugcagcuccauuaaaugucagaaucauguguccuugcagaaaagauaguuauuuguucuacuuggguuauguuccugauaguaaugugagcgcagcugguagaggauggcauuccugugagucucagaaaauccuuugucucgugcagcucuaaugcucaagggacacacuucacuuuccccuuaccgagauagucgaccgccaaucguacuggagguuaugaaguguaauacacaguuccaugccuuuaucagucuguauaauugaugcauucagagcuuuaaagcaaaaaaagaaaaaaagccuugggcuaagaaagccuacaccauuuuugcauguacugauguuaacuccaucuuaacagaggucaucucagaacaagcaugaaaccggcucacaugaugcugagcggcagaaugaaggucaaggagugggagaaaucaacauggcaacuucugguaauggucagguaaauaaauuauuuuaucauauuuuuuaaaauuauuuaaauaucagaaaaguaugaagcaagaugguucuaagaaugaucuauaaaucuuaccuauuuucuuaguccugaaugcauauuuccagaagcauucaguaccaaugugcugucauuucucuuuauuauaucagcaauaaugcuguaaggauuuucuagaucuauuucuauagcuauagauuguguguuuauguuuuagucuaaaaugauugugaguaguuuuuuuuaauaacucuaagcugcauuuugauuauguauaugauuugaccuaguuauuuuugcuugccuugaauagguuugcucuuucacuaagaccuucaauguaaagacauuuuuaugguuuuuuuuaaaguuauaaaggcuuuauuuccuguuguacuuaaagauuauauaaaucuagaaauccaagucuuacugaaaaagauaauuguaaugcacacaaaaaaguaaggcaacauggccuaauuaugcuuaauauuaccacaucauuuucagcaaaauuaugaaaguaaacuuuuuuuuuuuacauacagaacuguuauuuguuaugcuaccauccguuaucuuauuagauuuuuauugaaauacagugcaauaggacagaauuuuucuuuaggguguucuguauucuccaaauuuucuucaaugaauauuuuuagaguguaaaugaaugacuuuuuaaaaacagaauuucacuaaauuguucuuaaagguaauuuuucuacuguugauacagaaaauuuucuuagucucucuagguuacuuuugauaguauuguuuuuaagaauaugcuucuauuaguucauuaaaauguaaagcuuaaaaugucuuauuaaguauuuaaauuuauuuuacugaguuaaaacaaacauacuucauucaguauuacuaguuagcauuauauuggaaaacaagugguaaauuaggacaaaggcaaucauguuuaaacagcacauuugaguuauguaucugucuuuuguuuagggaauuaguugcaacauuuauauauuccuacacauauguagaaggaagaaaaauuuaauccuauaugacagaaaaaaauauuuacauaggaauagaucuacucguagugcuuugggucaucuuccaauuauuauguacuuuggaaaccuuaccuauccaguaagcuggcuaugauaaauuggauccauauuacacuuacuacaucaaaauaaauucuaaguagauuagauuuaaugucaaaaugaaaaucauuaaaaauauaaaaagauuagaagaaaauguggguagcguuuuuauaaucaugauguaggugggagacccauaaagaaaggauugauagauuucacguuacagcaugagacuucaguaugccaggaaaucauagcgagauuccaaaacaaacaaccaagaucacauuauuugcaaacauuuaugacguguaaaaaguuaaaauucaagaugcaaaaaacaguauuuauauaccagcuauuuaaagaguaucuuaaaaugguuccaagccaucguagaaguaaaaaaauaaauaauaauuuuaaaaauaaaauuaaaaugggcaaaggauaugaacaggaaauaaaagaagaaauuaaaaugacuuguaaacauggaaagauggucaacuuuacuaaucaugauauauaaauacaaauuaaaacuaaagucagauuucgugggggggccauuuaguuggcaaaaaucaauaacacucaguaauggugagcaaacaggcauucucauauguugcuuuuaauuguaugacaugaaacaggcuuucuggagagcaauuuugucaaaugcaucuagcauuauuuauaaugugccuguugugaagcucaucacuacaacaucuaagauuuuuugcuaaugagauaaucagucaagagugaucagacauguuugaagagauucaucauaauacuaacaauagcaaaaaguuagaaauaaccuaaauggacauugaucguaaaaugguuaaauuauuagucagcuguagauuaguuaaguggcucuggagucaacaaaccugggaaaucacacucccucacuaacuagcuuaguaacaaaaagucucugagcuuuaguguuuccucuuuaguaaaauaagaugaugauaaaaccucuaccucauagaacaguugggagaguuaaaugcaagauacccuuaacacagucccuggcauauugucagagcuuaguaaaagguaaccgauucuguuguuaacaaguguuaauaauuaucuuuaaauuaacaaauaugccagauacuguguuggacucuagaauugauaauugaaaaggacagacaguccuuggccucauggaaccuauauggugcauccaugcaaauauuaaaaaugauaaauuacaucucuauuuauguaaagaucuaauuuuuagccuucaauuguugccuuuucuaguauauccuucauauuauaaucaguuauucuucuaaaacaugaaucugauuauaucacuuauuuguuuaaaccuuucaguggcuacucaccucccauauauuagaauccagauucuucauguugcuuacucuuccaagaguaucucacaauauuugcccacauuucucaccacucccucaacuucaacuucuucaguuccuugaguauguccaggccuuccacaggacauuccuuuggucuaaaacugucuucugcuucaguucauauuauauguuuuacucauccuuccccaccguuuaaaugucacuucuuccuggacauuuuccuugucuccaccuaccuggaauaaauaaaguacucuuugauacgcuguauuccugcucucauagugcuuagcacaauuuaucauugguuuaauugucuuccuuccuucuuaaaguccuuuaagccacaccugcuccucacuguaugccagccaacuaauauguaccuggcagagagcauuuauguugaauauuaauaaauauuauugacuuagguaauuauaacuuuuuuuuuggagacagagucucgcucugucagcaggcuggagugcaauggugggaucucagcucacuauaaccuccaccuccuagguucaagcaauucugccucagccucccgaguagcugggacuacaggugugugccaccacaccaagcuaauuuuuguauuuuuaguagauacagggucucauuguguuggccaggauagucucaaucucuugaccucgugauccucccgccucggccucccaaauugcugggauaacaggcgugagccacugcgcccggccaauuacaacuuuuuuaauuuaaaaauagcaaguaugcugggcaugguggcucacaccuauaaucccaacacuuagggaggccaagcgggaaggauugcuucaggguagaaguucgaguucaaccugggcaacauagggagacuuugccucugcaaaaaaaaauaaaaauuagccgugugugguagucccagcuacuugggaggccgugugggaggaucacuugagccugggaggucaaggcugcagugggcuaugaucaugccacugcauuccagccuggguaacaaggcaaaaaauauuuuuuuuaauuuuuauuuuuugucuaaaaaauaaaaaaaaaaacuuaaaagcaaguaaguaugaucucauuauacauauguauaauguguguauaugcauagagaaaugugugggagaauguucuuuaaacuguuaucaauaguuaucucugaguguugggauuuuuguggguuuuacuuauucuuuugugugucguuuuauuuuuuguaaugaacauguauuacuauaauuuauaacacccaaaacccauuuucauuuugggaaaauagaagaaagcacugucuugauuuccguuguaugguaguuuagguugccauacuucagaguccuaccaugacauacaucaugucauuuaugucaguauagggauggcagaggaaaagaucuauugaaaauaguaaaucagggcccgguauucauuccuccuuuaagugaugaacucugauagugcugugaauucagagguaaacauaaguauguuuguuuagcaguagcaaucauagacuugcccaccauauugguguuuguaugacacuaaugcugcuaauacuaucugguuacuuucagucacuguuuuaaaacaauauugcagcuauucccagauccugauguagaugugugaccuguaucugugggacugugauuuguuauuccaaaaguccuuucaucuaaauaggaucuauacacaugaucgccucuugggguuuauuaguuuguuuuguuuuauuauuugcucaaaagacaaaagccaccaacacuaguugaaaaugaaaaucagucucugacuuucucaggaucacaguagcaugcucugccaaaguucuguccuagaguaauucucuucaccaccacgugggaauguauucuaccgcuucucucaccugguuuccugcccacaaucauucucuuugaaaaauccuucauuggcuucccuugauucuuagaaaaaugauaaccauuuauugugacccagguaaccuggccccuaccuaucuugucagcuuuaugucacaucuugcucucacaccuccacacuggccuucucucaguaccucauauuuacugggccuucuccuaccacagccugugcacaucuauaccuguuccauguaguguuuguuucaucccauuuugcucaguuaacaccaguucaugugugucugagcuuaagcaccaguuucucagagaggcucgaacagaucaaaucucacuaccauaggcugucacagcauguuccucucguuugaagacuacuacauuugcaguuuuacauuaauuugugugaugacuugauuaauauuuguguuucccccacuagacuguaagcuccagaaaggcagggauucuaucuaguuuuguuauuuucauacccacacagucccugauaaauaguagauaacaauaaauaugugguguguguaauaucccugcuaaagaaaggguuucuugaucuguuuuuaaucucucauggaaguuaaauggaaggaaaagcuuaggaguaaauuauacaggccagaucccugcuugcuuagcauauaacuauguguauaauuuauuuauuaguugguucucaacuuuauuuauuuauuuauuuauuuauuuauuuauuuauuuauugagauagggucucacucugucacuguacaccacugcacaguggugcaaucucggcucauugcaaccucugccucccaggcucaagccauucuuccacugucauucuuggauaguugggaccacaggugcacaccacugugccuggcuaauuuuuuaauuuuuuuauagagauaggaucucacuauauuguccaggcugguuuugaauucccaagcucaagcaauccuccagcauuggccucccaaagugcuacgauuggcugggcauggugcucacacauguaaucccagcacuuugggaggcugagaugaguggaucacuugaggucaggaguucgagaccagccuggccaacauggugaaaccccaucucuacuaaaaauacaaaaauuagccaggcaugguggcgugcaucuguaaucccagcuacuugggaggcugaggcaggaaaaucucuugaaccuaggaggcugagguugcagugaguugagauuguaccacugcacucuagccugggugacagagcaagacucuaucucaaggaaaaaaaaaaaaaaaacguaaaaccaaagugcuggaacuacaggcgugcaccaccaugcccagccuguggaaaguguugaccaaauaucuucuguauaucagaguguuucuauggcaauuacaguuugacaguuuacugugguaauuguauuuuagggaguucuggguuuuuguaauuuguuauuuggggaauuuaagaaauuaguuuuuccaguacccuuuauucuuuuuauacguuacauuguuacuugugaaucagccauauauaauuuuuauauaaacaauauuuuuauacuauacaacuuacucuugucauuuaauaauacuuugagauaucuuuuccuaucuauaugugguuuauagauauggaaguuuuuaauccauuuuucuuucacuauuuuuucuuuuuuucaagcaaccuaagcuuuucuauuugaaauuuagaaccaggucucugguaauagccaguauauaauaauaaagcucaauuaaaagugggaaaaagauggaaugauagaaaaacccacucuacugccacugguuuuuaaaacuuuuucuuauggaaaauuuuaaacauuuacaaagacaauaauguagugauucauaucgacauguaaccuauucaccuuaaccucccauuuuauuuuuuaagaagauuccaggcaucaucaucacuucuucccuguuucacuguguauuuacaaaagauaaaaguacuuauuaaaaauacauaacuggccaggugugguggcucacaccuguaaucucagcauuuccagaggccggggugagcggaucacuugaggucaggaguucaagaccagccuggccaacauggugaaacccugucucuacugaaaauacaaaaauuagccagaugugguggcgcacacguguagucccagcuacucgggaagcugaggcaggagaaucacuugaauccaggaggcagagguugcagggagccgagaucgcaccacugcacuccacccugggcaagagagcgagacucugccucaaaaaaauaaaaaaauuaaaaaauaaauaacugcaguggcauuauuacaucuccaaagacucuaacaguaauuguuuaauagcaucauuuauccagucaguauucaaacuugcaguuguuucauaaaugucuuuuucacaguuuauuugccucaggguccagauaagguccaugaauaggaauuaguauaucucugauaucuguucuaaucuguauguuccuucuuuuuguuuuacggccauuuaguuauugaagaacuaaaguuguuuuucuuuuuucuuuaugguuuucugggguuuuguuuuuguuuuuguuuuuuuagucaggaucucacucucgccuggacuagagugcaguggcaaagcucacugcagccuugaacuccugggcuuaagcgauccucucgaguagcuggugcuauaggcacucaccaccaugcccuaggccucccucuguuccccaggcuggucuugaacucaaacugaucucaagcaguccuccugccucagccuccugaguugcugggauuacagguuugagccaucaugccuggcuuccaaauguuuuuuuuauagagugucccauacucuagauuuugcugaugacuccccaugauauacuucaacauguuucuuuaucaucuguauguccuauaaauugguagauuucaguaucugagaauauucaagaaguagaaucagucaagcuuagggauuggauaugaguguuuagggggaaggagaagucgagaauuacucgcagguuucuguuaggcagcuagaaggguagugaugcaauuuaguaauaaugcuagaugagaaggagguuugugagagaaaauaaugagucuaguuuuggaaaaauguuaaguuuaacuuuaaagauguuaggucugagacaucaaagcagaaaugcaccugggugcaguagcucaugccuguaaucccagcacuuugggaagcaaaggcagguggaucacuugaacccaagaguuugagaccagucucagcaacauaaggagacccugucucuacaaaaaauacaaaaaaaaaaaaaaauuaggcgugguggcaugugccugaggucccagcuacuugggagguugagguggcugacccuggaaggucaagacugcaguaagcugaaaucauggcacuguacuccagccuaggcaacagagugagacccugucucaaaaaaauaaaauaaacacacaaaguagaaaugugagguaggcuauuagauuuggaauugagaggaaagguaaagaauugguaauuaaagguauuaaagauuuuuacauccccaaugaguauacagugagaagaugaauaccuagccuaaaauuccaaagcaguagaauaauauuguuacaacaaagagggaacaguuaacaguuuccaccauugccaugaggacuaaaaaaucaccuuggguuucaccaaaaaaaaaaaaaaaaaaguucauugcugaucuugucaaaugcaauuccuugggccuucuuuccuacuauauuauauuggagugaguugaaguuaaauggaagguuaaaaaguagaagagagcagucaggcgugauggcucacgccuguaauccagcacuuugggaggccgagaugggcggaucacgaggucaggagcuuaagaccauccuggccuuggugaaacccugucucuacuaaaaauacaaaaauuagcugggcguggcagcgcgugccuguaaucccagcuacucgggaggcugaggcaggagaaucgcuugaacccaggagggagagguugcagugagcugagauccuuccacugcacuccagccuggugacagagcaagacuccgucucaaaaaaaaaaguagaagagagcaauuuuagcuaacuguaaagaugucuagaugugaacugcccaagagagaaaagaucguuaacugauacagacuauaaguuugagagaaaauuuauuucuguuuuuaagauagaaaagaugaggauguuugaaugcugaugggaaggagccaguagagaagagaguugaagaucccuaagaucaaagagaaauggagagagaaaggauccagagcacaucuaaagggauggaccuuagauaggaggaggggaacucugaugucacagcaaaagguggcgauggauauauacgcagguaauuuuaagguucugguuagcaagaaguugaggaaauuuugucuguuggcuauuuuuucuauaaaguagaagguaaaguuauaugcaguaagagaagaagagccacaguuuuauaugauacaaaaugaggcauaucaaaaauagccaaagaaaggagagcugacaagggaaacaaaaagauggcaguuauagcacggagagucuagguguauuggugaccauaaauguauaucgacagcauccuaaagaguuacguaaguuucucacaugcucaaauuucucuaaugcugccuggcacuucaugucaggguguagagaaaacagacaguuggauucaucugugauugcaauguuuccagacaaaugggguggaauaagugcagggcaaagcuguuaaaagcuagcaagagaauuaugaaagugauaaccacaagaaauccaaccugaaauacaugcuggauuugcuagucauuucaaggaagcaguaucuuacuugcggucaggaguuugagaccagccuggccaacauggugaaacccugucucuacuaaaaauacaaaacuuagccaggagugguggcacaugccuguaaucccagcuacucuggaggcugaagcaggagaaucacuugaaccugggagccagaguugguagugagcugagaucacgccacugcacuccagccugggcaacacagcaaaacuccaucucacacacacacacacaaaaaaagaaccaacaucuuagagaaaguugaagaccaggaaauaaaaggagcaugaaguaaaauguugaggauguauggauauuuauaaagcauugaauguggaugguacaggaaaguuggauaggaaaaaggacagugggaaauagugucucacacauuuggacacugagugucaggaaugauacagcgagugcuucuaucuuuggacaaugagcaaagcugauucaagggaugugcaaucaugacugacuuagcaggucuugagguugugagaaaguucaucacacucaaguuuauucagaauuuaguuuugaguugggugggaaacaauucuuaggaaguuauuaaucauuucuuguggauagggagacucuagucccuccgaaagaaguuggcucaggucuagccuuaauaaaacgcccaagaaagacucucauggaccaaguucuaggcucauagagaauacgaguauguguaccucuugguaucuccuaauaauaaauacaucuaaauuucuacugagacagauuggugaaugaagagugucucaaaauccaggagcuauauaggaagauaacuaagacugaagcuuagaaaagauuuguugucuacacugaaaugaaugucagaaacauguuuuauuguggaaacagguuuucccuuguuucauaauuaaaccuccuguuuucuuuuguuucaaguaguacauuaguuagcuauugcugcauaacaaauugcccccaaaacuuaacagcauuaguagacauuuauauuugcuucuauggaucagaaauccuggugcagcugagcugccugucucugguucagggucucccacaagacuuaaggguauuggcugggguugcagucaucuccacacauaaccaggggaggaucugcuucuaaguucacuuacggcuauugaaggccucagauccucauuggaugucagccagagagacaucaguuccuuguuacaugggccucaccaagggcaguucacagcauaguaacgcuucccucagagggaacaagagaggugcccaagauggaagacacgucuuuguaaccuuaucuugagagugcuucucaucaccucuauagcauuuuauucacuagaagcaagucacuaaaucuagccaagacuaaaggggaagggauuacaaaaacgcgugaauaccaggaggcaaagaucuaucuuagaggcuaccuacaaacaguaaaaauauuuagacaucuuccaagauuguguguuugcuucaggguaaagacucauuucccuucuauagaccaagaaaaagguuccuugucugaauuuacuaaaaaagccccaacuauccuccuuagccugagucucagucccucagaucuauccuuuauuaguuagaaccagaguaagcuccuuauguucagauuuauuuguaguucugccuccccuuccucuccacacacacacaaacacaacuauaccauauucuucugacccuugcuuaugccucugccuuugccugggcugcccuguggcuaaucccccucauucuuuuuauuaacuaaauuacuccucaugguucaaguccaaauucagaugccacuuuuucaggaaccaagacugaauuguguaucuuccuguguguucauauaguuucugucaaagcacuuacccacacguauuuucauguucagcuccucaucuagauuguguguguagugugggugagaaugucuuauucauuuauauuccuggugacuaauauacuaccuggaaaguagcaggggcucaggcaauauuuguugcuugguugcauguggauuuaaagaccauuccagaagcagucaauagcugguggcaguggaaagagauguaagaugagucuuuccuugaugccucuuuucccuucccuaaggaggauuacuaauuaguuuuguccuagaagugucccuagucagcauaaagaguccagacccacaaaggaaguagagacuggaaaggggagccacucuggacucugaacuaguauucucaguccaaccccagacuucccuaugcgaguaugaauaaguggauuaucuugccuuuauauggggacacauuuuuuaaaaccucucaaguuaggauuuuuuaaagaucacuuuuauugaagaaagauuaguaugugauaaaauguacccauuuuaaguguacaguugaaugaguuuugacaaauguaguuuucucuuuaaaaugcugaucuaaaauagcuaauuauugugaacgaugaucuaaaauaguuuugugcacuagucaggaaaaccucaccuuggcuuauaacaugacuuauacagaaguucuaagcagcccucauaaaaauuaacuuuggaguauuaccuauuuaaggacuuuaugaaacaaauuuauaacaaauuugaacaaggaauuuauuacgaauucagaaaucucuguaugagcccuuaauuauugcuugauuaaaauccugacgaaucacuuaggaauacauuguuaacaguuuucuauguugucuaccaaaguggaaguuaucuggcaaacaguuuacguugcuagcuaacagggaagaaaaguuucuaauacgucaccauagcugggcucauuggcucgugccuguagucccggcuacucuggaggcugaggugagaggaucacuugagccaaagaauucagagccagccugggcaacauagugaaaccuugucucuaaaaaaaaaaaaagaaaaaagaaaaaaaaaucaccaaaagugaaauuuaugcacaaaaggaaguuauaagguguguugguuccagaauucuccccuuguacccucuagaguaggaggugccaucucacaguccucaaaaccuauuacucccauugugguuuucucuuuaccuucuucaauuagccagagccuguauaucugaaagacaauucgaaugauguccugcaucuugacauucuuacggauuuuacuaauagcuccucauuuauuuauaauucaacaaauauucuguggauaccuacuaagcuuaagaccacccuugguacuaagaaugcagcagcgaacagaauaaaguuucuguccucaaauaacuuacauuuuagcuuuccauucugcaagguugagaacugcaaaagaaugccugcaaauauugcugacacuauucuuacagucauuuccuuaauuauuaaugaauggauuuagcuguggccuauauuuugauaggucccaguuauuuaucugcaaccccaccuccuguccagaguugcauccuuuguuuucaggugcccauuggggauucuuacuggaugucagauucaaagugagcucaguucccccaaugaaagccaucauuuauuucuggguuuccgauauccauuacgagcaucauuacuuacccauuuauccaagcuugacaccuccaaguuguccucgacucccagccccucuuuacucacauccagucaaguuacucaagccaguuaauuugaccuucaguucaagccaauuaauuugaauauccuucaagagcauccccacuucucuauucucacugccuuaguuugugcccucagaaccacucaacugcugaaaauacccucucccucauuuccuaccugugaucucuccgugcuguuuuuaagacguaauucugauuguaccauucuccugccugaaguccagugacuccacagcuugacagcaacaucuuugaaaugacaugagauacuuaaugauuuaacccaaccuuuaucucuaaccauacaccuuguguucuguccacauuacauuggaacacuccacgcucuccguauuuguaccuuugcacagucuccuccgucagucuccugucacaaaaugccuaccuuaaauguuacugauuuuauacagccucuaauagucccuaugcaguaauuucuuucuuccuguuuucccucaguguuuuguucauucuucuacugcgguguuuauauuauacugcacugcagucauuuauuuuuucaugucuuuguccaguaaaaguuuuaaacagcccuuucuaaacugugagaucuuagagaacuuggacuguagcaaauucauacuuaguuuucuggcaauuuggagcauuucagaauuugaacauuccuucaaugcuuuucaucaaugaacuuaucugaaugugguuuuauuuauuuagaucuaugaaaaauuacuacccuagaauuucuucagucuuugguuaaguccauucugcaguuuaaugcucauaugcaagaaacucucuuuucuuuaguuuuucucuaaaacauacuuaguaagcguauagguaaaaaauauuuugaacaguuauaauggucauacuuuuaugauguauuuaauuguuuaucauacagacacuucauuuggaguaccuuaacaugauguuaucuguauuuaccuauagucuaaauuauaccaucuauaaugugcuuaauuuuuaggguucaacuacacgaauggaccaugaaacagccaguguuuugaguucuaguagcacacacucugcaccucgaaggcugacaagucaucugggaaccaagguaacagaagauuacaaacccuggucacuaaugccaugacuacuuugcuaagacauucuuggccaggugcaguggcucacaccuguaaucccagcauuuugggaggccaaggcagguggaucacuugaggccaggaguucaagaccagccugggcaacguggcaaaaccccaucucuacuaaaaauacaaaaauuuagccagugugguggcacacaccuguggucccagcuacucaggaggcugaggcaugagaauaguuggaacccaggaggcagagguugcagugagcugagauuacaccgcuuucuaguggagaauucugauucacagucucuugaagaaauuacauauuuuuauacaacgaagcauaaacaagggaaaaaucagguuuauaaaaagugccagauuagcuaauuuuuaauucuuuuucagucuuuacauccacuuuucugcaagaauacugaguuccagccaaacuggcucacuuccugcuuccugaacauucccugugacuuucccccucccuuccuugccugcauugguggggaccaccauaaaugucugucagaauccuagccagccuucaaaacucuucuugggcuuugcuuuuucacaaaacauuuucugauucccaagguccucuuaccuccccaugugauccaucugccucauuugaaucacuaacaauuugcaugaaccugucuuuuggaaaucaagaaauguuuuuuuacuuaucuuuugcugugucuaacagagugccugcacaugaguaaauauguauugaggugaauggaaaaauuguugaaguugaguguuauuucaugcugauaagugagcuuucuuagaguaucuuucuuagauguuagcaaauauuuuaggauuugggaauaauguuugaaaagaaaauaguuacuuuaagccggaugugguggcucacaccuguaaucccagaaauuugggaggcugagguggguggaucacuugaggccaggaguucgaaaccagccugaccaacauggugaaaccccgucucuacuaaaaauacaaaauuagccaggcaugguggcacauggcuguaaucccagcuacucgggaggcugaggcaggagaauuguuugaaccugggaggcggagguugcagugagcugagauugugccauugcacuccagccugggcaacaagagcaaaacuccauuucaaaagaaaaaaaaaagaggaaaauauaguuacuuuauuauuuuaaagucagagauuugauuuuauuuuuauuuuauuuauuuauuuauuuuuugagauggagucuugcucuguugcccaggcuguagugcaguggcacgaucuuggcucacugcaacccccaccuccaggguuuaagugauucuccugccucagccucccaaguagcugggauuacaggugcgugccaccaugcccggcuaauuuuuuguauuuuuaguagagaugggguuuugccauguuggccaggcuggucucgaacuccugaucucaggugaugcgcucaucucugccucccaaagugcugggauuagaggcaugagugaccacacccggcccaucagagauuuuaauauucacuaagaugaaaugaaauucuaauauuacuaaacgauguauuuucgauuaacucgaauuccauuaauuguuuucacagcauacucuguauacucuuucuuuacuguaaauaauauaauagcucuugggaaagguauuacugaaauaacuaauguugauuuaaguaaugauuuuagaauaaucaaugauauucucacuaugaggcuuaauccuguuuauacuucuugggaccucauaugccauucacugugccaggaguuguauguaccuuaucucugguccucuccaaaauucuaugaaguauccauauuucucuaaaugagaaaacugaagcaaaaaaaauuuuaggcauggaaauuuaauuccagaucugucuaaccucaacauguaguuuuuacuauaaagaaaaucuugaauauucaagaguaauauugugugaaaacuggcaauuagaauacuguuucuuuuugaaguaauuuaugcaugauaauauuaagacccuaguauguauuuugaaugcuagcuacuguccuauacauguauuauuuuauuucaccuuaauggagaaaaccuuguuagguagguaaauuucuccauuuugcagcucagaaaacugaggcucagagaaaucaaauagcuuaacuauaauaguaucacagcuugcuccuaagagguggagccaaaauuugaaccuagcuccgaugaaaacccauuuauccgcaguccuauacugccuuccuaaaacuuucauaucuaaagguguauguguauuuacgcaucuaaagcagcauuucuaaaccucagcacuauuggcuggauaauucuuuguugcauucuagaauguauaguaacgucccuggucucuccccacuagauuccccuaaaauacccauccuacaauugugacaaccaaaaaugucuccaagauguugucaaaugugucccgaugggggcaaaauugcccccaguugagaaccauugacuuauagagaaugaugcauucuuuauauaauagccucuacuuuuauauaauacccucuagcguuaaaaugaguggaccauggcccaggauaacugggugccacuuuccgguuucuaaucugcuucuaacuaaauacguagaauuuauugucagagaguaauuaguacuuaccaguugcuuuuuaaaaaacugacuacaaauccuggcucucacucuguaugaucauggcauuuuccuuuuuaugacaaaauguuuuuaaauuuauaaucguauaauuuuaauaauauuaucaucugacgagaauuaaugauugcugagaauuaguacuuaaaauuguugcagaaauguuuucuguuuauugcuuauagguauagauuaaaagaaauaagauaaaguuuuaaauuauguaaagauuuagauaaacuacauucucuaugugugugaaauccguuguuuuucacugauuauagucaguggauuagcaccaacuuaucuaggcaaacagcacuaacaguuuguuagugaguaugcaaaaaccuacuuuugcuuuuaauacuguauauuaccacucauacuauuuacucacauaaacaaauuggugaugauacauagauuuugaaauaacacugauuacuucauccuggaaagguuuuccgguuuuuuguuuuuuuuuuggcgggggggguuguuuuguuuuuuuagaguuauaguaaauaucccauucaucacuuaauugguuuuuggcuuuuggauauuaaagucguaauuuuguuucuaaacucauuuggcccacagguggaaaugguguauucauuguugucaaugcuugguacucaugauaaggaugauaugucgcgaacuuugcuagcuaugucuagcucccaagacagcuguauauccaugcgacagucuggaugucuuccucuccucauccagcuuuuacauggcaaugacaaagacucuguauuguugggaaauucccggggcaguaaagaggcucgggccagggccagugcagcacuccacaacaucauucacucacagccugaugacaagagaggcaggcgugaaauccgaguccuucaucuuuuggaacagauacgcgcuuacugugaaaccuguugggaguggcaggaagcucaugaaccaggcauggaccaggacaaaaauccaaguauguucucuauaguguacaucguagugcauguuucaaagcaaaugugaaauuuuuaaacagaaaacauguuuaguuaauaugcugucuuuaugacuaagaggagaaaauucauaucagccauuugugcuacucauauuuaaaagauuaagucuguauuucccuagaaaaauuuagcaaaggaaaauguuaugugcacuacuauaagaacaguaagucaagagaaauuuauacaaucauagcauaguagggccuuaguagagcuagaaagaacuugagcaauuauguugcccaucuuucacuucauagcugaagcucauuucauagaugaaagugacuuuacguaaguuccuauagccauuaguguccaaaccauaaucuuuuacauuugcauaucauuauauucaggggauacagagcagcguuacaucuguuauguuauuugcuccucacaucaaccuacugaaguaggaagggaagguauuaucaucuccauuuuacagaugaaaaaacugaggcucagaagagcuaaaggacuuaaccauggccucacaccuaguaagugguagacccaggaacagagcccagaucuccugacucucagcucggugcucuuccuacuguaccauccagcuguagacagugggccucaguugcugggagugauaauccacccagcucuucacucaggaagggacccuuagaccucagccccacucccgcaggagcagcaugggaguuaggaccuauggggauauaacuuauuucauuccuguagccaagaaccaaaagcaguaaguauguaagguaagaccuuccuuucaccugauaagaacugacacacacacacacacacacacacacacacacacgugcacuacaaguagaugauucuacuguaucagccuauugaugugaagaggagaugauacaaacaugacuuaugaaccuauagcagauuuuuuuaagcuuagguaugaaggugaauuuauuugaaaucuaaaaauguucaaggauaagaaaggccagguguggugguucaugccuguaauggcagcacuuugggaggcugagacaggaggauugcuuaagcccaggaguuaaagaccagcugggcagcacagugagacacuaucucauuuuuaaaaaauuuaaaaagcauaagaaaaaagggauugccuuucauaucuauuuguccuggggugaggggaacuaguaagauuuuacugggagaacauugccuuccuggauuguuucuuuggcuauccacaguuacguaaugacccacauuuuguacuccugauauuuguucucaaaaaauuaaauagaauaaaaugauacuucuuuugagaaguuuuuuaaaaacuuacgucaaaugaguuuugaaaccucgugcauaguauugaauguggagguacauuuucuuagucacccuuuuaaaaaauaucuguuuacugucuaguauaucuguguaacuuuuuguauuagagaucacauuuguacauagccacaugcuuuuuuucucuguuuguauugagacagggucucacacaagcgcccagacuguaaugcaguggugcgaucacaguucacugcagccucaaccucccaggcucaagcacuccuccuaccucagccuccugagaguaucugggacuacaagcaugugccaccacaacugacuaauuuuuuuuuuuuuuuuuuuugagagacgggguuuugccauguuucccaggcuggucuugaacuccuugggcucaaggaucugcucacuucagccucccaaagugcugggauuacuggugugagccacugcaccuagcaccaugugcuuuuaacccacacucaugauaguaguuuaaauagaaauuauaaacugggcuaagcacgguggcucgugccuauaauucuagcacuaugggaggcccgggcaggagcggcacuugaggccaggaguuugagacuacccugggcaacauagcaagacccuaucucuacaaaaaauuuuaaaaauuagcuagggauugugggguaugccuguaguccuagcugcuccggaagcugaggcaggaaggucaauugagcccaggaauacaaggcugcggugaaagcuaugaucauuccacucgagccugggcaacagagcaagacccuguuuuguuuuuuuuuuguuguuuuuuuaaagaaagaaagaaauuauaaacaaaauuaaaccauuuuauaccaaaauauuuuuauuauuuuguauacucaacauaauuuuaaguuauuagcuauaugaguaauagcauaaaccuccuagacuuauucuaagagacuuagucaagggcagaugagugguaaacauuuuuauggaaacaaaucccuuuauuccuauuuuuuguuccacauuuguaguauuuauucauccuuucagcaaauauuuguugauccacuaaaauuccgugaauuaggguuauauuagugaucccugcauauuuuuaaaguacaauaaacaucauugcucuucaaauaacaaagcauuaugguuuauguugauuuuauuuuucagugccagcuccuguugaacaucagaucuguccugcuguguguguucuaaugaaacuuucauuugaugaagagcauagacaugcaaugaaugaacuagguaagacaaaaauguuuuuuaaugacauagacaauuacugguggauuuuuaaaucaugguagaaauucaguauaguaaauaaagauuuuuaaucauugaugaauuaggauauaaggccaccaacuucuguuaucagcugcuuccucuguguagcaaaaaauuguacccugguuuccagcauagaaaggauccugaaucacagaaacugcuacccugucauaagcuaacuuuuucaaaaucgaagccggagauugaaaaaaaaugacaaaaugggucacucuuugucccuuuugccaaaguagacucuauaugugccagcugaugaggaugguaauuugaauuauuuugaaauguggagcugcuguauugugauugaacucagucacuuuugaugagcaucagagggaauuauuauuaagauugucauuuaucuucaugguuauugguacuuuacaggauuuucaucauaagcagccugguaucuuugaaauugguuaauauagaaaaguauuaugcuuuaagucagaaacauuucauuauaacuuuggaaugauuacuucuuuagguauguauuuucacacacuaagccuuauauaaccagcagugcacuccauuuuuuauguaaugguuuuucuuugauuucuagguucauuuuguacaugugguauuuauaaauugcaucaugcugaaccaucucaugugaacuggaucucucuagucaugccacaagcaagaaccauacgcuuaauucccauuuuaguguaauugugcccuugcuuuuugugccguuuauguuacauuauguuccagccaccacuuuauauuccuauccccucaucguuucauucgucauuuaucuuaaaagugaugaagucaugagacucuuacacagagaaccugaacagccaaaaguauugucuccuucagagucaucacuuugggaggcucugcaccuuaagauuucaggccugcccucuggccaugcuuuccuuccuagugguguagcaauuggccuaccugauucucuuuccucccccuggucuccuguggauucucaguuaaucuuaugaauucuccccucguuaauacaaucucagcauuugugaacauuuuaaauuuuuuaaaaugcuaaucauaacaggaaggggauaaaaaauaaugaauaaacaggaaaacauucaguuuuaagauaccucaaaaguuauucuguaaauguuccuguauuccaauggauuguagacuaggacugagacauuaaucaucuggauuucaaaauaaaaccuagacucaguauuuguuccucuuccuucuucagguaggaaggcuacccggggcauuucaucacaggagcuagggcaggggcuuucaggugaggagcaggauggggccucugggggugugacugcuggggacauagccacaggggauuaccuucuucucacuccucaccuccagauuugcacuggggcaaaaggaggauuaggguguguggauugcggggagauaauaguacaagacagcacaagguuuuggcaguaagggauaaggagaaaagaaaucccaaauagguaaaggggaauuccuuaguucagucagcugggauggucauuuguacauauaugaagauucuacagcuaucagucauuuaaguuugcacuuauuaguauuagaaguuuuagaauauaauuuccaugauauauguuuauugauucccuaaucuaccccagaaacugugcuaggcacuagauuuuuauaaugauuaagaccugguccuggcuuucagggaacucacaguuuauuugcauuaguguuucacaaaauaccuaaaucauaaugaucacccagaggcacucgucaaacuggauuuucuggcacuguagcaaacagaaucuccaggggaagggccuaggaaucaaugugauaaguggccuggcugauucuuauguucgggaaauuuugugaaacaccaguagaauauucuuguugagccugugauauuuauuuuagaacaaggcauuucaugcuaauggugacuaucuaaaccaaauaaaacaaaagcaauaugcuuuuuaaaauuaucagucuuucuuuuguucauaagagucuaaauuaaggauucuguugaaugucaccugagucuguuggugcucuacuaucgguaguuuuacccuauugggcaauaguccggucuauuuagaccacuguuuucuaacaggcaccaagaaaauuguagaaggacauguucaucaucuuugcauuaccaugaaacauccugauuuuucuuagagcaaccaguuuuuaauuguaucaauccagucaugaauuugcauauuuuagcaaauccauuuauagguuuaaccuaugaauucuauucugugccucaaaauucucugaaaucuuuucauuugccugaaaucaaaaagcacuuccucuuuuaucugauagucuaaauuuuuuugaauguucuuuuuuuauuagccauguucuuccugaaucuguugauaucugccacauucuuauuuaaucuuuauuuucaguaucaaauccuaagauuuuuaguuuuuccauacaagaguacucaacucuuugaucauguagugccuucuuggcaucuucuuuaggugcauuuuaucuuucuuaagaaaguaucccaguuauugucacaccaggcaagauuuuauacagacaaaaggcauaguuuguuuuguuuugguauugauccucugcuuuaaaauacucgacaucuuggggaucucauuaguauaccaggccaagucuuaaggucuucccugucaauuucaugggucaaaauucucaguucuuuuacaggcuccuuuucuuuuacccaaguguaaaaugguggaauuccuugaagcucugcccuaggcucuuuuccuuucucucuaugcuucuguuauaguuuuuguuuuuguuuucaaauuuacagcucaauuugaguuuuuucccugaguuuuagacacauuauugaacugacuaugugacaucuucccuuaggugguauuuuagacacuucuaacucaacugucacaaacugaauucguaaucuuucccaucccugaaucucuuaucuuuucccaguuuccuuuucucagaaauuccaauccaguugcucaaauuucaaaaucuuggaaaucauucacgaugccauccuuauccccugcaaauagcaacugacugcuuuaauucugcuacuuaaaaguaucuuaugucaucacucuucucuucauccccaguccaagccaccaucgucucuccuguucuacaauacuuugucuuacuucucuucccauuuccacucauagucgauuuuguucacugaaaccauaguaaucuguuuagagugugcaucuaauuauuccuuuuucugcguaaaaucuuuaauguggcacauaaagucuuaugugauccggcaucuacccauguuuauagccucauuuuguggcccucuccuugcuguuaaauauuucaggcccaggggcccuuucacaugcuguuuccuuugcuuagaacgcaucuuucuucuuccugccccacccuuguuagauacgcauucaucuggccagaccugauggcucaugccuguaaucccagcacuuugggaggccgaggcaggagaaucacuugaaccuaggaguucgcaaccagcucgggcaacauaguggcacccugucucuaccaaaauaaaaauaaaaagaaagauacacauucauccuuuacguuucaacuuaaacauuaaaagauuauuuccucagccuuuuucuuauggagccuaaucccaggucuaaguuaaguccaccuauuauaucacccugugguucuacauaguucaucuaucuuugcuccaaucuguacgcucuucauaaagacagugacugauuuuuguucacugucucuguauuuugccacuguugcaggugaauggaggaaaauuuuccuaaauaugauuuggauuuucuuuaaccaaauuaauuuucacuuaccuacauucaaacaugucugucauuccugcuaguaauaaaguuuugcauaaaucuuccuacauuuaaaucccuuggcuuggaauucuugacccacgacagaacuuuguuuuacaaacuugcagauucuucugcauauugaacuucccagaucacuuauuaaaaauauuaacguacuggcugucuugcagaugaaugaccuaauuagacuuguaguauccaagaauugccuguuuauauucaucuuuuucuuucugagucccgugaugauuaauauuugaugaauuauauuuugaauagccuccacaugcauuuuucucuuuuguucacuuccucaccauuuugcuucacuuuuuuuuuaacugcuuccuuugugucuuucccauuccuuuaccuuuguuuucuccuugacuuccuauuguuggccauugugggcauuguuuagcauuuucaguggaaagaaucaggggaaagaaaauacuaaaucuuaguauaguuaauauuugauauuaucaacgagaaguaagaaauguuuugaaaaacacaaaucaguaguuuuauauaacuuaauaaauugaacagaugaucauuuuuuguaaaaaaaaaaaaaaacaaaacuuuuuaguuuuucuucaugcacaguuucauuuaaaggcauccguauuccuaaggguaauuauuugccaaaaaaaaaaaauuaaaguaguuaggccacaguguaugacaauaaagaguguuuauaaagcccuaauaauaauaauaaguuaccuuuuucugcuuauguucacgaagaacuaguguuagaaaauagccuucuucacuguuggcaaggugcaguguauaugcaguaaauagaaaauaauuauuucgcucagcaagauaaggggcuggggguggagaaacuggcauaaaauggaauaauugucaguuguacuuuauaaauauauuauacagaaguucuuuauaacaguuuuuguagcuuauaauucuaaaggcaaauuuaaaccauauauucucauugauugaguuuuuuuuuccuaguauuuaaguuaccaacuugguaccaguuuguuuuauuuuagaugauugucuuuuuccucuugcccuuuuuaaauuagggggacuacaggccauugcagaauuauugcaaguggacugugaaauguaugggcuuacuaaugaccacuacaguauuacacuaagacgauaugcuggaauggcuuugacaaacuugacuuuuggagauguagccaacaagguauguuuuuauaacauguauuucuuaagauagcucagguaugaguuaauuuacuuucauacaaauacauuuuacugauuuucuuuuuuuucacucuccucauuaaacaaugacugauaaaaaccugugcuucacauucgcuuaucuuuacucauuuguuugucuuaugccuaaacaaaggcaaagguacaucuacagauggaacacaguagugaauuuauguaauugcauuaaaaacaccauucauaagaauauacuuguagggaucauuucugugauccauuacuagagaaguuuaacuguguagaauuaaaaaauaaaagauaaaacacuuccuaggaaugggauuaaaaaucuaaaaauucuuaagaccaaggcaaguguuacacacacauugauuccauccaaauaagaggcuuuacucuaaaaccuguugcuuaucauuucucaccacuuauucacuuuauuucucuaguuugacaaaggaagaacagauagcaaagaauuaggagaauauuugucuuuuauuuagguaaucuuauucuagauuuuuuaugagugaaguaucaguuaugauuaaaacaaaauaaugaaaacugaauuagacauuuaguagccaaaaauaaagcuuggcuucaaguugucuuuuuaaugauccucuauucuguauuuaauuuacaggcuacgcuaugcucuaugaaaggcugcaugagagcacuuguggcccaacuaaaaucugaaagugaagacuuacagcagguacuauuuagaauuucaccuguuuuucuuuuuucucuuuuucuuugaggcagggucucacucugucacccaggcuuagagggcaguugugcaaucucagcucacugcaaccucugccuccaggguucaagcaauccucccacuucagccucucgaggcugggccuacaggugcacaccaccaugccaaacgaauuuuuguauuuuuuauagagacgggguuucaccacaccugggcucaagcaaucugcccaccucagcaucucaaaaugcugggauuacaggcgugugccaccacacccagcuaauauccugauuuagauuguugcucaguauuuaguaucucauguauaaaagauaguuccauuaacacuagaaaaagaaaaauaauuauauugugguuagacuguaggaaaucuuuuuggcacuguaguagcauuuaggaggaauuuaaaaaaaaaaaaaaaaacaggaucucccucucuugcccaggcuggagugcaguggugcgauuauggcucacaguaaccucaagcuccugggauccuccugcuucagccucccaaguagcuagaacuacugcaggcgcaugccaccaugcccagcuaauuuuuaaaaaguuuucauagagacagggucucacuguguuacccagaaggucuugaacuccuggucucaggagauccuccugccucagccucccaaagugauaggauuacaggcgugagucaccacggcuagccagaauuucuuucuuaauagauuucuauucuuacugcuagcauuaaaaacaaaaaagcaacuaguaugauuuuauguauaaauuaaucuaaaauugauuaauuugcagguuauugcgaguguuuugaggaauuugucuuggcgagcagauguaaauaguaaaaagacguugcgagaaguuggaagugugaaagcauugauggaaugugcuuuagaaguuaaaaagguaccuuugaaaacauuuaguacuauaauaugaauuucauguuuggcuuuuuuuugcugccuucuuuuagccaugagauuuccuaauuucuuaccuguguauuauucaguacuauaauaugaauuucauguuuagcuuuuuuugcugccuucuuuuagccaugagauucccuaauuucuuuuuugagauggggucucuuucucucgcccaggcuggagugcaguggucugaucuuggcucacugcaaccuccgucucccauguucaagugauucuccugccucagccuccugaguagcugggauuacagugcacgccaccacucccggcuauuuguauuuuuaguagagaugggguuucaccauguugguaaggcuggucucgaacuacuccugacuuugugaucugcccaacucggccucccaaagugcugggauuauaggcgcaagccaucacgcccagccuagauucccuaauuucuuaccuguuuaucucaccaguccauaguuuuagaguaccgcaaacuccuaaaguacuaagguagaaaagauuauauaaggggauuuaauguauaucaggguuucucugccucagcacuauagacauuuuugaccagauaauucuucguuuugcuggggcugaccugugcacuguagauuguuuagcagcaucccuggccuuugccaacuggcugccaguauacccucccccuaguuaugccgaucaaaauugucuccagauacugucagaugucugugggagggaggaaggacaacgucaccaccaauuaagaaucacugguauaaguguaccuuugugcucuccaaaccucaauccccucaaauuuugauggucaacuuaucaagaggugaucagagccaagggugaggaaucaucaaauaauaauuuguuuacagaaggaaauaucuccaggcaguccaucugcuucagaaacuaggcuaaauuuaaaaagaaaaaaaaaaguaaacuugaaaucugagagggaccaagcaaguugucuuagcuagucuagguuuccuuucacccagcuaguccuccuauacccacagccuacauguucuucuucaaaacuuuccucuucagagaaggcaaaagguuuguuuuuuuuugguuuaguuaugcauuuuugguaaaguauauuauuuuguucuuggaaaacccuugaaaauuuauuagauagaaaagcauucagcuaaauuauuaguuauaaagauaauauucaaauauacuuagcaucugcauaaaaauaccuguaucacuguugaauggagagaagacauuuaagaaaagaacauggccgauaagcccuugaaaagauacuuaauaucauuaaucaucagggaauacaaauuaaaacuacaaugagauaccauuaugcauaucauauugguuaaaauuuaaaagauugaccaugcauuuucaaggauguugagcagcuggaaaucauguauucugcuagugggaauauaaaaugguauaaucacuuuggacaacauuuggcaguguuuuuaaguuaaacauacaccugccauaugacccaaccauuccacuucuaaguauuuacccaagaggagcaaaagugcugacacgaagacuuacacacaaacauccacaauaauuuaugauagucaaaaacuagaaauaacuaugucugucagcaggugaaugguaagcaaauuguggaauauuuguacaaaguaauaggauucggcugugaaaaagaaugacuauugauacaugcaguaaucuguaaugacagaaaacagauuagugguggccugggguugggaguagaagagaaggggaggauuaugagaggguaggaaacuuuuggggaugauauaaauguuuguuaucuugauuggacuggcaguuuuauggguguauacauguaugaaaaauuaucaaauuguaaacuugaaaugugugcaguuuacuguucuucaauuauauuucaauaaaguucaaaaaaauuagugcuugcacacuuaaguacuccuacucuaauaacccuguguaguuucagaaggauuuaauguguguguguauuaugagaauuugcacugcugcuaacugguucaugacuuaauucucucucaaggaccuaaacucuucuauaaauuuuuuuuuuuuuugagauggagucuugcucugcugccaggcuggagugcaguggcaggaucucggcuaacugcaaccuccaacucccugguucaagcgauuauccugccucagccucccaaguagcugggauuauaggcaugcgccaccaugcccagcuaguuuuuguauuuuuaguagagacgggguuucaccauguuggccaggauggucuucaucuccugaccucaugacccgccugccuuggccuuccaaagugcugggauuacaggcaugauauaaugcauggucaaucuuggaaaaacuagcugucagaaauuuauaauauccaguucugauuugggccuaauucugguuagcaguauuagaauuuauuuauuuuuucccucuuuuucuacauuuagugcagcagucaugaacauucuucuucucuuuuucauucaauaucaauucccucucaacuucagcuacuaaugagcaagagaaucagaacuaccuucuagcuccccugcauguuccacaucacuuuaacucacucagagcucuuacucuagagcuuuccuuuaccagcacucuguacuccguucacuuaaagcuguuggucccuuacucuugucuucuacauauucucuacuggauccuucuuuuuuauguuucaguucucuagaagaagcccaauguuuugaaaaacaaaaauuuucuguggcuucuauuacaguguuucucuuuuccaguaacaaccaaaacccugaacaaugguuuugaccaaauaccuuuguguaucagaguguuucuggggcaguuacaauuugacaguugacuuugacuugcuucauuucuaaacuggcuguacuaucuugaguuccuccuaauuuugcuucugacacaacccuucuccuugaucauagaaucuagauuuguagauuuauuuaaguuuuucuauucuaccuucaccuguauuuuauacuuuuuggucacucacuuuugcuguuacuacuuguauuaauaaccucuaauuauuuauuuugugucuucuaauuugaacuauaaaaacauuuuugaaacaaaaccucuggcccuugacauguagccccacagagaggaacuuuuguauuuuucuaccuucaacucucaacucugggccaguugcaucuuaauucaguccuuuaaauucuugcuuuuuuuguucucaggauacuuggagugccccaccuuuaucucagucacaauguaauuaaaauugggcucaucuugauugaugugagaaggacaaaggcacuucuugcauaaaagcacucuaucugccuccuaccacuuaugugacaaauuaugucuaaaccugcuccuagauuguuuuguucacuuaauuucuugaugaagagaguaaaguagcuauuuauuggguuagacccaaaauguuugcugugacauucaaggccuggcuuuugucucucuggacuuauuuuccacuguuccccaucauggacugugaucuccuuugcaucuucuuucugggucaucaguacucccgcgcugauucccacuucccugccuuuccucauucuacuuccccugccagcagcaacuggauucucuucucugggaauguacaggucuaauccuccuaaagagcuguucuccuccaugaaauauuugauugauuugauuaaauucaggguguaauaguuuuuucuuuggagcacuuuguuucauguauauuuuuguaucuuuuuuuccccccaaagcaaauugcuaacaccuucaaucacugguaucaguuugcuauguuugcauccucuagagugccucucauugcaauaggcacagaguugauuucuaauuaauguuuguuuccugauggauauauaguaagaagacagauugacaucaccaucaugccaaguuuuggguuuggguuuuuuuuuuuugcuuuugcuuuugcuuuugcuuuuuugagacagggucucacucugccacacagccuugaccuccugggcucaagcuagccucccgccucagcuucucaaguagcuggaccuauaggugugcaccaccaugccuggcuaauuuuuuuuuuuuuuuuuuuugagaccgagucucgcucugucaccuaggcuggaguauaguggcgcaaucucggcucacugcaaccucugccucccugguucaagcgauuccccugccucagccucccaaguagcuaggauuacaggugcccaccaccacaccgggcuaauuuuuuguauuuuaguagagacaggguuucaccauguugaucaggauggucucgaucuccugaccucgugauccgugcaccuuggccccucaaagugcugggauuacaggcaugagccauugcgccuggccgccuggcuacuuuuuauauuuuuuguagagauuggguauugcuguguugcccaggcugguuuuuaacuccuaggcuuaagugauccacccaccucagccucccaaagugcugggccugaaggcaugagccaccacacccagcacauggcaaguuuugaccaaauaccuuuaauuguguaucagaguguuucuguggccauuacaauuugacaguugacuuugauaauuguauguuagggaguuccagguuuucauaauuuguuauguggggaauuuuaagaaauuauagcuuuucuaguacccuuuauuguuuuuauaaauuacauuguuaauuuugaaucaaccacuuguauauaaugcuuuuuauauaaacagaauauuguauauacuacacugcaacuugcucuugucauuuaauaauacuuccaagauaucuuuccauaucuauguaugguuuacagaauuuuaaaaaucuacuuucuuuuuuuuuugagacagggucucacugucaaccaggcuugagugcaguggcgcgaucauggcuuacugcagccuugaccucccaggcgcaagugauccucccaagcagcugugacugcaggcgcgugccaccauacccagcucauuuuuuuuuuauuuuuuguacagacgggauuucaccauguuguccaggcuggucucaaauuccuaaacucccagucacgccagucagccuuccaaagugcugggauuacaggcaugagccaccacguugcgccuuuuuuuuuuuuuuuuuuuuuuaaaaagaguuucgcucugucagccaggcuagaaugcaguguugcagucucggcucacugcgaccucugccucccagguucaagcgauucucccaccucagccucccaaguagcugggauuacaggcaccugccaugaagcccggcuaauuuuuuuuuguauuuuuguagagacgggguuuuaccacauuggcgaggcuggucuugaacuccugaccucagaugauccacccgucagccucccaaagugcugggauuacaggcaugagccacugugcccggccacaugccgggccuuaauccacuuccuguucacuuuuuuuuuucuuuuuucaagcaaccccagccugagaauaacccacauucuauucugaaaauguuuucuuuucauaaugcacaucaguugugccucauauucuaagauguguguacuaucuaaacacuuagaauaaaguuuauaaaagucauuaguuaaauauuguguucugcuuguuuuauagagauaucacugauauaaauacuauuugguauuuuaugaacauuuuucuaaauggaaaguucuuaauuuaccagugagggacgggcaauaggauagauuaaaaaauagcuuuuauucaauaucaguaacauagaaguuaaugagagacaaauuccaacucuaauuagaugacccauauucuguuucuuacuaggaaucaacccucaaaagcguauugagugccuuauggaauuugucagcacauugcacugagaauaaagcugauauaugugcuguagauggugcacuugcauuuuugguuggcacucuuacuuaccggagccagacaaacacuuuagccauuauugaaaguggaggugggauauuacggaauguguccagcuugauagcuacaaaugaggaccacagguauauauagaguuuuauauuacuuuuaaaguacagaauucauacucucaaaaagaccuaauuguaagcaauguuuuauauaaucaugaaaguuuuaagccaaaauauauuuauuacugugaaaagauaacuacuaacucuuaguuuaacucauuaguguacuuaauguaauaacaguuuauaguauuauagaggagacuaaauuaagcaaauuauaguugagagguguagcccauagguggaggaaaaaauagucacaaauauuguaacaaaauaauccauuucuauuaguauaguauaaaagaguaugaaaacaaaauuuagaacaagacaaaaacuaugagcgugauccagagaauauaaagguucacauuuuucuaaugaugucuuaguauccauaauaauaauuuuuuuuuuuuuuuuuugagacagggucucacucugucucccagacuggagggcaguguugugaucuuggcucacugcaaccuccaccuccuggguucaagcgauucucccaccucagcuucccaacaagcugggacuacagaugcacgccacaacacccggcuaauuuuucuauuuuuugguagagaugggguuucacaauguuguccagcugcucuugaacuccuggccuccagugacccaccugucucagccucccuaagugcugggauuacaggugugagccaccgcgcccggccaauaaucauaauauuauuuagcuaacagccauucauccaaucugcuagaguuguaaaacccaagagagugcuucagauacagggcacacauuuucagaacucggaugcuguauuauaucaacaaaaauacaacugucuuuuuuuuuuuuuuuuuuuuuuuuuucuugagauggagucuugcacucuugcccgggcuggaguacaguggcacaaucuuugcucacugcaaccucugccuuugggguucaagcgauucuccugccucagccucccgaguagcugggauuacagguccccccccccccccgccaccgugcccggcuaauuuuuauauuuuuaguagagacggggcuucaccauguuggccaggcuggccuugaacuccugaccuuaggugauccgcccaccucggccucccaaagugcugggauuauaggcaugggcuacugcgccuagccaaaaauaugguuguuuuuuauagcuuauucauuuuuuaagucugugaugcagaaacuacaagccuagucucccuuucugcuauacagagaagauuucuuaaguccaguaacuacuggacugcuaagagaagacgaccauguuaaagcucauuauguacccuugccauucaguuuuaaagcccacuaaagcugaauaugcugucauuaaucuucaguuugccugcguuaaacaagcuguugcucuuucauguccagaguucauuaugcugauucucacuccuuguuuuuauaugccuuaaauguuucaaaaacuuuaauuuacuugauuuuuuaaaaauaauaagcacacagucugccaaagagcaguuuuucuuuucuuuuuuuucuuuuuuuugagauggagucucacucuguuguccagguuggagugcaguggugugaucucggcucacugcaaccucugccucccaagugauucuccuggcucagccuccugaguagcugggacuacaggcaugcacuaccaugcccggcuaauuuuuguauuuuuaguagagacaggguuucaccauguuggccaggcuggucuugaucuccuaaucucaggugauccgccugccucagccuccuaaagugcugggauuacaggcaugagccacugugucuggccaagagcacucguaagaaggauggcaguaucacaaaaucaagccagagauacagagauuacucuaaaaaguaaguguucuaaucuaagagcuuauaaugugcacugacugcagaaaaaucuucaaucaauucuaucuaccucuuccaagauaacucaauaucaauaucagaguggcacccaaccauagauuaaauuaccacaaaguuccuauucaacauaggauuucaugauauaguuuuuaaauugggaaacuguuauaugaauagaguaaauguaugugccccacccccugcaaauguuuuaagcuauugggucagaauaggaaauguagaauugacaaaaaauaacaccuuuacuuuuuuuagugugacagauuaguacuuuaaaacauuaaacauuacaugaaauuagaacaaaaggagauguggaauacuuggaauuuauaggauaauugguacaaucauauuaugccuuuugucuucuauccuuuuauuuguuguuacugcauacacauugugaccuuaauuuugugaucucuugauuuuauuucaggcaaauccuaagagagaacaacugucuacaaacuuuauuacaacacuuaaaaucucauaguuugacaauagucaguaaugcauguggaacuuuguggaaucucucagcaagaaauccuaaagaccaggaagcauuaugggacaugggggcaguuagcaugcucaagaaccucauucauucaaagcacaaaaugauugcuaugggaagugcugcagcuuuaaggaaucucauggcaaauaggccugcgaaguacaaggaugccaauauuaugucuccuggcucaagcuugccaucucuucauguuaggaaacaaaaagcccuagaagcagaauuagaugcucagcacuuaucagaaacuuuugacaauauagacaauuuaagucccaaggcaucucaucguaguaagcagagacacaagcaaagucucuauggugauuauguuuuugacaccaaucgacaugaugauaauaggucagacaauuuuaauacuggcaacaugacuguccuuucaccauauuugaauacuacaguguuacccagcuccucuucaucaagaggaagcuuagauaguucucguucugaaaaagauagaaguuuggagagagaacgcggaauuggucuaggcaacuaccauccagcaacagaaaauccaggaacuucuucaaagcgagguuugcagaucuccaccacugcagcccagauugccaaagucauggaagaagugucagccauucauaccucucaggaagacagaaguucugggucuaccacugaauuacauugugugacagaugagagaaaugcacuuagaagaagcucugcugcccauacacauucaaacacuuacaauuucacuaagucggaaaauucaaauaggacauguucuaugccuuaugccaaauuagaauacaagagaucuucaaaugauaguuuaaauagugucaguaguagugaugguuaugguaaaagaggucaaaugaaacccucgauugaauccuauucugaagaugaugaaaguaaguuuugcaguuauggucaauacccagccgaccuagcccauaaaauacauagugcaaaucauauggaugauaaugauggagaacuagauacaccaauaaauuauagucuuaaauauucagaugagcaguugaacucuggaaggcaaaguccuucacagaaugaaagaugggcaagacccaaacacauaauagaagaugaaauaaaacaaagugagcaaagacaaucaaggaaucaaaguacaacuuauccuguuuauacugagagcacugaugauaaacaccucaaguuccaaccacauuuuggacagcaggaauguguuucuccauacaggucacggggagccaaugguucagaaacaaaucgaguggguucuaaucauggaauuaaucaaaauguaagccagucuuugugucaagaagaugacuaugaagaugauaagccuaccaauuauagugaacguuacucugaagaagaacagcaugaagaagaagagagaccaacaaauuauagcauaaaauauaaugaagagaaacgucauguggaucagccuauugauuauaguuuaaaauaugccacagauauuccuucaucacagaaacagucauuuucauucucaaagaguucaucuggacaaagcaguaaaaccgaacauaugucuucaagcagugagaauacguccacaccuucaucuaaugccaagaggcagaaucagcuccauccaaguucugcacagaguagaaguggucagccucaaaaggcugccacuugcaaaguuucuucuauuaaccaagaaacaauacagacuuauuguguagaagauacuccaauauguuuuucaagauguaguucauuaucaucuuugucaucagcugaagaugaaauaggauguaaucagacgacacaggaagcagauucugcuaauacccugcaaauagcagaaauaaaagaaaagauuggaacuaggucagcugaagauccugugagcgaaguuccagcagugucacagcacccuagaaccaaauccagcagacugcaggguucuaguuuaucuucagaaucagccaggcacaaagcuguugaauuuucuucaggagcgaaaucucccuccaaaaguggugcucagacacccaaaaguccaccugaacacuauguucaggagaccccacucauguuuagcagauguacuucugucaguucacuugauaguuuugagagucguucgauugccagcuccguucagagugaaccaugcaguggaaugguaaguggcauuauaagccccagugaucuuccagauagcccuggacaaaccaugccaccaagcagaaguaaaacaccuccaccaccuccucaaacagcucaaaccaagcgagaaguaccuaaaaauaaagcaccuacugcugaaaagagagagaguggaccuaagcaagcugcaguaaaugcugcaguucagaggguccagguucuuccagaugcugauacuuuauuacauuuugccacggaaaguacuccagauggauuuucuuguucauccagccugagugcucugagccucgaugagccauuuauacagaaagauguggaauuaagaauaaugccuccaguucaggaaaaugacaaugggaaugaaacagaaucagagcagccuaaagaaucaaaugaaaaccaagagaaagaggcagaaaaaacuauugauucugaaaaggaccuauuagaugauucagaugaugaugauauugaaauacuagaagaauguauuauuucugccaugccaacaaagucaucacguaaagcaaaaaagccagcccagacugcuucaaaauuaccuccaccuguggcaaggaaaccaagucagcugccuguguacaaacuucuaccaucacaaaacagguugcaaccccaaaagcauguuaguuuuacaccgggggaugauaugccacggguguauuguguugaagggacaccuauaaacuuuuccacagcuacaucucuaagugaucuaacaaucgaauccccuccaaaugaguuagcugcuggagaaggaguuagaggaggggcacagucaggugaauuugaaaaacgagauaccauuccuacagaaggcagaaguacagaugaggcucaaggaggaaaaaccucaucuguaaccauaccugaauuggaugacaauaaagcagaggaaggugauauucuugcagaaugcauuaauucugcuaugcccaaagggaaaagucacaagccuuuccgugugaaaaagauaauggaccagguccagcaagcaucugcgucuucuucugcacccaacaaaaaucaguuagaugguaagaaaaagaaaccaacuucaccaguaaaaccuauaccacaaaauacugaauauaggacacguguaagaaaaaaugcagacucaaaaaauaauuuaaaugcugagagaguuuucucagacaacaaagauucaaagaaacagaauuugaaaaauaauuccaaggucuucaaugauaagcucccaaauaaugaagauagagucagaggaaguuuugcuuuugauucaccucaucauuacacgccuauugaaggaacuccuuacuguuuuucacgaaaugauucuuugaguucucuagauuuugaugaugaugauguugaccuuuccagggaaaaggcugaauuaagaaaggcaaaagaaaauaaggaaucagaggcuaaaguuaccagccacacagaacuaaccuccaaccaacaaucagcuaauaagacacaagcuauugcaaagcagccaauaaaucgaggucagccuaaacccauacuucagaaacaauccacuuuuccccagucauccaaagacauaccagacagaggggcagcaacugaugaaaaguuacagaauuuugcuauugaaaauacuccgguuugcuuuucucauaauuccucucugaguucucucagugacauugaccaagaaaacaacaauaaagaaaaugaaccuaucaaagagacugagcccccugacucacagggagaaccaaguaaaccucaagcaucaggcuaugcuccuaaaucauuucauguugaagauaccccaguuuguuucucaagaaacaguucucucaguucucuuaguauugacucugaagaugaccuguugcaggaauguauaagcuccgcaaugccaaaaaagaaaaagccuucaagacucaagggugauaaugaaaaacauagucccagaaauauggguggcauauuaggugaagaucugacacuugauuugaaagauauacagagaccagauucagaacauggucuauccccugauucagaaaauuuugauuggaaagcuauucaggaaggugcaaauuccauaguaaguaguuuacaucaagcugcugcugcugcauguuuaucuagacaagcuucgucugauucagauuccauccuuucccugaaaucaggaaucucucugggaucaccauuucaucuuacaccugaucaagaagaaaaacccuuuacaaguaauaaaggcccacgaauucuaaaaccaggggagaaaaguacauuggaaacuaaaaagauagaaucugaaaguaaaggaaucaaaggaggaaaaaaaguuuauaaaaguuugauuacuggaaaaguucgaucuaauucagaaauuucaggccaaaugaaacagccccuucaagcaaacaugccuucaaucucucgaggcaggacaaugauucauauuccaggaguucgaaauagcuccucaaguacaaguccuguuucuaaaaaaggcccaccccuuaagacuccagccuccaaaagcccuagugaaggucaaacagccaccacuucuccuagaggagccaagccaucugugaaaucagaauuaagcccuguugccaggcagacaucccaaauaggugggucaaguaaagcaccuucuagaucaggaucuagagauucgaccccuucaagaccugcccagcaaccauuaaguagaccuauacagucuccuggccgaaacucaauuuccccugguagaaauggaauaaguccuccuaacaaauuaucucaacuuccaaggacaucauccccuaguacugcuucaacuaaguccucagguucuggaaaaaugucauauacaucuccagguagacagaugagccaacagaaccuuaccaaacaaacagguuuauccaagaaugccaguaguauuccaagaagugagucugccuccaaaggacuaaaucagaugaauaaugguaauggagccaauaaaaagguagaacuuucuagaaugucuucaacuaaaucaaguggaagugaaucugauagaucagaaagaccuguauuaguacgccagucaacuuucaucaaagaagcuccaagcccaaccuuaagaagaaaauuggaggaaucugcuucauuugaaucucuuucuccaucaucuagaccagcuucucccacuaggucccaggcacaaacuccaguuuuaaguccuucccuuccugauaugucucuauccacacauucgucuguucaggcugguggauggcgaaaacucccaccuaaucucagucccacuauagaguauaaugauggaagaccagcaaagcgccaugauauugcacggucucauucugaaaguccuucuagacuuccaaucaauaggucaggaaccuggaaacgugagcacagcaaacauucaucaucccuuccucgaguaagcacuuggagaagaacuggaaguucaucuucaauucuuucugcuucaucagaauccagugaaaaagcaaaaagugaggaugaaaaacaugugaacucuauuucaggaaccaaacaaaguaaagaaaaccaaguauccgcaaaaggaacauggagaaaaauaaaagaaaaugaauuuucucccacaaauaguacuucucagaccguuuccucaggugcuacaaauggugcugaaucaaagacucuaauuuaucaaauggcaccugcuguuucuaaaacagaggauguuugggugagaauugaggacugucccauuaacaauccuagaucuggaagaucucccacagguaauacucccccggugauugacaguguuucagaaaaggcaaauccaaacauuaaagauucaaaagauaaucaggcaaaacaaaauguggguaauggcaguguucccaugcguaccguggguuuggaaaaucgccugaacuccuuuauucagguggaugccccugaccaaaaaggaacugagauaaaaccaggacaaaauaauccugucccuguaucagagacuaaugaaaguucuauaguggaacguaccccauucaguucuagcagcucaagcaaacacaguucaccuagugggacuguugcugccagagugacuccuuuuaauuacaacccaagcccuaggaaaagcagcgcagauagcacuucagcucggccaucucagaucccaacuccagugaauaacaacacaaagaagcgagauuccaaaacugacagcacagaauccaguggaacccaaaguccuaagcgccauucugggucuuaccuugugacaucuguuuaaaagagaggaagaaugaaacuaagaaaauucuauguuaauuacaacugcuauauagacauuuuguuucaaaugaaacuuuaaaagacugaaaaauuuuguaaauagguuugauucuuguuagaggguuuuuguucuggaagccauauuugauaguauacuuugucuucacuggucuuauuuugggaggcacucuugaugguuaggaaaaaaauaguaaagccaaguauguuuguacaguauguuuuacauguauuuaaaguagcaucccaucccaacuuccuuuaauuauugcuugucuuaaaauaaugaacacuacagauagaaaauaugauauauugcuguuaucaaucauuucuagauuauaaacugacuaaacuuacaucagggaaaaauugguauuuaugcaaaaaaaaauguuuuuguccuugugaguccaucuaacaucauaauuaaucauguggcugugaaauucacaguaauaugguucccgaugaacaaguuuacccagccugcuuugcuuuacugcaugaaugaaacugaugguucaauuucagaaguaaugauuaacaguuauguggucacaugaugugcauagagauagcuacaguguaauaauuuacacuauuuugugcuccaaacaaaacaaaaaucuguguaacuguaaaacauugaaugaaacuauuuuaccugaacuagauuuuaucugaaaguagguagaauuuuugcuaugcuguaauuuguuguauauucugguauuugaggugagauggcugcucuuuuauuaaugagacaugaauugugucucaacagaaacuaaaugaacauuucagaauaaauuauugcuguauguaaacuguuacugaaauugguauuuguuugaagggucuuguuucacauuuguauuaauaauuguuuaaaaugccucuuuuaaaagcuuauauaaauuuuuuucuucagcuucuaugcauuaagaguaaaauuccucuuacuguaauaaaaacaauugaagaagacuguugccacuuaaccauuccaugcguuggcacuuaucuauuccugaaauuucuuuuaugugauuagcucaucuugauuuuuaauauuuuuccacuuaaacuuuuuuuucuuacuccacuggagcucaguaaaaguaaauucauguaauagcaaugcaagcagccuagcacagacuaagcauugagcauaauaggcccacauaauuuccucuuucuuaauauuauagaauucuguacuugaaauugauucuuagacauugcagucucuucgaggcuuuacaguguaaacugucuugccccuucaucuucuuguugcaacugggucugacaugaacacuuuuuaucacccuguauguuagggcaagaucucagcagugaaguauaaucagcacuuugccaugcucagaaaauucaaaucacauggaacuuuagagguagauuuaauacgauuaagauauucagaaguauauuuuagaaucccugccuguuaaggaaacuuuauuugugguagguacaguucugggguacauguuaaguguccccuuauacaguggagggaagucuuccuuccugaaggaaaauaaacugacacuuauuaacuaagauaauuuacuuaauauaucuucccugauuuguuuuaaaagaucagagggugacugaugauacaugcauacauauuuguugaauaaaugaaaauuuauuuuuagugauaagauucauacacucuguauuuggggagggaaaaccuuuuuaagcaugguggggcacucagauaggagugaauacaccuaccuggugccuugaaaaucacaucaaguaguuaauuaucuaccccuuaccuguguuuauaacuuccagguaaugagaaugauuuuuuuuaaagcuaaaaugccaguaaauaaaagugcuaugacuugagcuaagauauuugacuccaaugccuguacugugucuacugcaccacuuuguaaacacuucaauuuacuaucuuugaaaugauugaccuuuaaauuuuugccaaauguuaucugaaauugucuaugaauaccaucuacuucuguuguuuucccaggcuuccauaaacaauggagauacaugcauauaggucauacugguuuccuuucauuuuuugauuuucuauuucuaauuuucugaauuacugcaugccaguuguugcaaaccacuucaaguacuucuauggaaagagauggauguuagucaauuagauaaacuugccuuuuaauucaaauaaggaagaaaauauaaaugcugaaaaugaacauuccacaugccagaaaaguggaauuuuuguaggcaacacuugaguggggggagacgggccagucuauacuacccauugaaguaaagacugcuggaugaggcccucuguuagagauagugguucugaauuaguaaaggggcaaaucucaauucuaauuauagauguucacagggugcugcuauaaucgauagcaggccaaauauucccaguuuaugcuuguuaacaaauggcauacuaagcccagcguugggaauuagucaggaguuacgaugccuguuuagagaggagugggggagggagaguuaccuaacguaaggcacuucaaaggagugcguugggaucaccaggagugcuuaacaagacauagcugggccauacccccaguuugauucaggauguuuggaauggggccuaagaacuugcauaucuaacaaguucaaaggugaggcuaaugcugcuggucuggagaccacacuuuuugagaauuacugcccuaagaucacagugaagcuccuugagugguugccuucagcucuagcgauuccucccaacaacuggacccuuaaucugacaaaguauagcaacagauaaaagacuuccccuaggcauaaaagauuucaauauuaagccauccaauuucauaaugcucaucucaacuccugacagcagacaaacuuagccagacaugaacaaacaaguaauucuaaagacagugauuauauuugaaggaucaguuaauguucccuuugagacugucauuauaaaaagcaguaacuucagcaaagaucuaauuugaauuuucaauaagauuaaaagacuaugaaaagggaacuuugagaugagagaagguugauuucagaugaaaauauccaguuuuuuaauauacaguggaagugaucaauaauuagcaaauaagauauuugaggacaacuuuacagauuaccaggguaaugaaaaggaaguaaucaaagauaagccccauaaggaucaaauagcacuguaaguacaguaaaauguuucuugauuaaaauauggaucauguugccacagguuaauuacaugaaagaaugaaucucuugcagaggaugggagccaguugcacaauaucugaauauauguuaucccaggguuucuuggaaucuaaggaaaaaagcagagcaccagaaaugcaaaaaguaaauugcccauaguuaaaggaacaucugaguagucagaucauuaaaauuuaugaaacaauuauuuuucacaagucaugguggcugaaauagaguguauaauuuuuuuccuuucaaauaagcguauuuuccucauauuacacugacuuaaaauuuaaaaauuacuuuguaauguugaaaccuauagacuguggcuccuguaaaccccaggucauuuuccugccauucuuacaacucugucuaagaucuauaaaaguauauucugcuuuuuguuaggccauucaugcuuuuuucaaccuguacauucuauguauauaauauuguucuuggugcuaaauacacuuucuuuuaucugauauucaggauaauucuuucucuacauuugugacuauccacuuauuuucucgaauaauuaaaaauauucaacauaauguauguuagugaaggugaccaaugaauauaaagcagcauuagugaaaaauaacuauugaaaaaaaugccaaacauuaacuucccuaccuacaccaccuuuuggaauccagacccuuagccucauucacuggucacugaacuacguacccagucuuucucccugaccuuggcuauuuguaccagaguuguaucugaccuagaggaga

SEQ ID NO: 18505 - RNA, 9527 nt, Homo sapiens
uguaccggcguugguucgcggugccuccugggaaaugucguuuuuccccuuaagacaaagcaagcacccuaaaccaguuacccugugcacuccuguuaagauuguugcuaaggaaggacaggaguuggcugcugaagccucaagauuuccuuuaggcucuuagguaagaaaugucuaagguucaaggaaaaagguuaaguuggaagaaucccaggcaaaauaagugcgaauccacgacaguugguaacccggacccacauuagaacucagaggucaagcagaagcgaacgacuggaauuccagucaggcccgcccccuuuccuuacgcggauugguagcugcaggcuucccuaucugauuggccgaacgaacgcagcgcguaauuuaaaauauuguaucuguaacaaagcugcaccucgugggcggaguugugcucugcggcugcgaaaguccagcuucggcgacuaggugugaguaagccaguaucccaggaggagcaaguggcacgucuucgggugagugugcggcugugcuggagcccggguuaccagcucuugcccgcgcggaauaggcuuuaagaaaucggagcugcagccaucuguuuuucucuuaaugcugcaucucuguucucacggugguccuuggggugagguuagagaaggagccgagggauccugacaccaccuccacagcaccggcgggcgaggugcccuacuuuaggcguagccuucugcuuuuggagccagaugucuguggacuucuguucgcguucagaaaugccgccucaaacuucucucaauuguucauuaagugaacuucucucauucccuuccccuuugccgauaauuggaggggaaaagaaguaggaagcgggacacgguguccuggggcaagggacuuauuaccuaaaauucgcggccccuucugucccuaaagguucuucucccugcccacuuuuuggucucuuuuuagaccuaggcugccccugccgucaugucgcaagggauccuuucuccgccagcgggcuugcuguccgaugacgaugucguaguuucucccauguuugaguccacagcugcagauuuggggucugugguacgcaagaaccugcuaucagacugcucugucgucucuaccucccuagaggacaagcagcagguaaaggaacuggggaguggcuggggcggaaagugauauccucaggccaauaauuguccauacaggguaguaugaggucaaagacuagcaauccuaaaggucugagaucaauucaaaauuaagggcauuuaggacaaaauggcuaugaaaagaaaaaaagaaaaaaaaauuaagggcaugacaaguaaaaaaaaaauugaguuguguguccagaagaacuauaauuugcauugcauuaaugaaauagccucaaaugcaugcucuuaguuaaucuuucagggaauaauaguuaucucucuuugccuugaggcccaguugugcuaaauaauuugcacaaggucauauaggcauuauguaaguggaauguauguucagguuuuaauaguaucaccauagcuucaauuuguuguagguuuccugcuaggccaggguuucucaguuacagcauuauugacauuuggggcuagacaguucuuguagggaucuguccuguacauuucaagauguuuaauagcauucuuggcauuuacccacuagaugucaguagugccuucccauuugugacaaucaaaaaaugucuucaggcacuucaggcauugcuaaauggcccuuggaguggaaaugacccugguugagaaacacuguacuagguccuaugcuaaacauuaacauacauugucagauuuugugcucuuauagaguuucucuuagagacuuauaaaguuccaugagagcaugguccuugaugaugucucucacuauggacuaucagagcuucucgguuccuaggccauaguagacacucuaaauaucuggguuuuuuuuguuuuuuggguuuuuuuguuuucgagauggagucucgcucugucccccaggcuggugugcaguggcacaaucucugcucacugcaaccuccgccucccggguucaagcaguucucccugccucagccuccugaguagcuggaauuacaggcaccuaccaccaagcccagcuaauuuuuguauuuuuaguagagaugggguuuugcuguguuggccagacuggucuggaacuccugaccucaggugauccacccucuuuggccucccaaagugccgggauuauaggcgugagccccugcacccagccucuaaguaucuguugaaugaaugacauaggugcuauuauuaaccccauucugcagaugaggaaacugaggccaagaauuucaagaacucauaauucaaggucucauaguuacuaagucauggaauugggacucaaauucaaguguuugccucugcuuugcuuuaauaucacauacuaauuuucauaccagucaauaaauucgaacucagaucaucgguguggcaagccacauuugcaggauaaugacgagacagggaagggugacaaaguaguaaaaauguccauguggguuggaaugauuguggaaccaaagaguagcugcacagagacauuugaggugaaaugggguaguguuaucauaguuccuagaaacuacuguuugcccauuugcucagagguaacugcugaaauuaaucugugguucugggcugggauucugccacagguuccaucugaggacaguauggagaaggugaaaguauacuugaggguuaggcccuuguuaccuucagaguuggaacgacaggaagaucagguaagugucugagaagggaggauucaaggugaaaugaugcaguacaaaagauucccaggaaugccuucugugacaacuguauuuucucccuucucaggguuguguccguauugagaauguggagacccuuguucuacaagcacccaaggacucuuuugcccugaagagcaaugaacggggaauuggccaagccacacacagguucaccuuuucccagguauggaggguacugguuugugaacaaaagaccaacauguaagggcaacuuuauucccucuuuagagggaaagcuucucuuccugacugugaguuccuuguauaugcacaccuacaauuuugagggcccuaguuauguguuagucaaugugucaaguaacauauguauaucaguucugaaaaauucuauuguuauuaucauuauuuccuuauuuuccucacaaggauaguguggcucaaugaauguaauauugcugaagccauguagcuagucacuaguagaguuaggaccugagucuagauccauguaucuccaaagcccauacuugugggccauuauauugccccauugugugugcagcaucaggccuagggcauagcauuccuuaaguguuuguugauuugguggaaagauggacuagcagagagugcuugaguccucaguguuuagggaacagccagcagcauugcaggaagaagcugcuugaguggucuccagagccaaccacucaggaaggaauauaucugcuggcucugcacaggaggcaagugggagaugaaggagaggccucuaaaaaacugggucucucucuagaucuuugggccagaagugggacaggcauccuucuucaaccuaacugugaaggagaugguaaaggauguacucaaagggcagaacuggcucaucuauacauauggagucacuaacucagggaaaacccacacgauucaaggugaguaguaagccuucacgggauuccugauuggcugguaaugguguuguuuuuaccuuuugagacucugaguuagggggagaagggcacuugccucagcuguccaucuuucauaugccuccagguaccaucaaggauggagggauucucccccggucccuggcgcugaucuucaauagccuccaaggccaacuucauccaacaccugaucugaagcccuugcucuccaaugagguaaucuggcuagacagcaagcagauccgacaggaggaaaugaagaagcugucccugcuaaauggaggccuccaagagguaaagcauugguauccauggcaguggggguaggggguacaaaucucggggaaguuuugugcuuaccuucucccugugccccuccaggaggagcuguccacuuccuugaagaggagugucuacaucgaaagucggauagguaccagcaccagcuucgacaguggcauugcugggcucucuucuaucagucaguguaccagcaguagccagcuggaugguauguaccgugacugggcucugccaaaaaauaguaggaacucacucccuguuccuaauagcugccaggaguacagaccagagguugcaaucuaaggucugccuuccaaggccccugcaggccaaaagagaggugaacugcucuagguugaugcccuauacauuggcuucuucuccagaaacaagucaucgaugggcacagccagacacugccccacuaccugucccggcaaacauucgcuucuccaucuggaucucauucuuugagaucuacaacgaacugcuuuaugaccuauuagaaccgccuagccaacagcgcaagaggcagacuuugcggcuaugcgaggaucaaaauggcaaucccuaugugaaagguaaaggaacauggggaaagcuggcaugaacccuggagggcaacuggggagagacuggcaaaagaguuggauguucccaucuuacaccccucuccuuuggccccagaucucaacuggauucaugugcaagaugcugaggaggccuggaagcuccuaaaagugggucguaagaaccagagcuuugccagcacccaccucaaccagaacuccagccgcaggugaguagauuguaagaauaaacucuucacuguguuccaggaaacauuaguccucugccuggucauggaaaaugugcaaugacuuuuuguuuuucuuaacuuccagucacagcaucuucucaaucaggauccuacaccuucagggggaaggagauauaguccccaagaucagcgaguaaguuuauccauuuagaaauuugggcuucuuggccauaaaugauaguugggaaagcauggaggagguccucaggggaacuauguguucuccuucuuuggguacagagauucuuagugggccguccccucuccagaauuauacaaagggccagaaggcucauaacaugugaggcccuuaugucagauccugugcaucauucuaggcugucacucugugaucuggcuggcucagagcgcugcaaagaucagaagaguggugaacgguugaaggaagcaggaaacauuaacaccucucuacacacccugggccgcuguauugcugcccuucgucaaaaccagcagaaccggugagcuuuugacuauaauuccugggcucugcaauuugcuaagagacuuccuggacaccacuggggauggugcuaggauacccaaagggcugguguucugcucacagcucuauuaucucugauucucugccaggucaaagcagaaccugguucccuuccgugacagcaaguugacucgaguguuccaagguuucuucacaggccgaggccguuccugcaugauugucaaugugaaucccugugcaucuaccuaugaugaaacucuucauguggccaaguucucagccauugcuagccaggugagaagcuagaggugugaugggugugcgcacuuggaacugguaacucuaagaaagcuccuagggacuacuuauggagucaaguaagauauuuuuuuucccucuagcuugugcaugccccaccuaugcaacugggauucccaucccugcacucguucaucaaggaacauagucuucagguaucccccagcuuagagaaaggggcuaaggcagacacaggccuugaugaugauauugaaaaugaagcugacaucuccauguauggcaaagaggugagaauacaagaaagcuuuaguguagcagcuuaguagcuacacauuuuuccauggugccuuccaggugggcuugugccuucugagggcaugagcaucugaugaccucugacaugugugucucuccuaggagcuccuacaaguuguggaagccaugaagacacugcuuuugaaggaacgacaggaaaagcuacagcuggagaugcaucuccgagaugaaauuugcaaugagaugguagaacagaugcaacagcgggaacaguggugcagguacuagcugagugaccccucuugcucugucaccugagacagagggugggaaguaaggaguuagguggaguugugccucaagaucuguuccccaaguucacuccucagaaccuucacuuaccucucuuuucuccucuguuucugacagugaacauuuggacacccaaaaggaacuauuggaggaaauguaugaagaaaaacuaaauauccucaaggagucacugacaaguuuuuaccaagaagagauucaggugaguugcccugagccagcuccaauuagcugcucagauuuccaucacuagcuugccugaaguaaagagauuuuauaaacuacuccaguaagggcaggaauauauaacucccuuuucucuauuccccauagugcuuuggguucaaucuauguuuggugaauugauuaaggguuuaguuggccaggaaaucguauuaagugcuaacaacagguuuucaagggaucagugucacaagugcuuuguuuguucagucaucugucuuagcaauauuuuucuggcucugcaaagaauugugcucucugcuucccucuuaggagcgggaugaaaagauugaagagcuagaagcucucuugcaggaagccagacaacagucaguggcccaucagcaaucagggucugaauuggcccuacggcggucacaaagguuggcagcuucugccuccacccagcagcuucaggagguuaaagcuaaauuacagcagugcaaagcagagcuaaacucuaccacugaaggugaggaaagagacaggcaggaaacauaacagugguucagggaagagcuguuacuuaaacccaggccuucuaacuccugcucuaacauaauuuccuaaacugcaagcuacaucccccugacauuucaaucuaggauacacauagccucacuuuuuauauuugcugcaagcuacuguuaccucaguuaaagagguuaguccaaggcuaaaaaaaccccacauauuuuaaguuuccuguuuccuucccucagaguugcauaaguaucagaaaauguuagaaccaccacccucagccaagcccuucaccauugauguggacaagaaguuagaagagggccagaagguaauuaccaccauucucuguuuaccaaacucuuaccuaaggcaauuucccacauccaacacucuaucacugguucaugugaagacaagauguuuuuugugcacaguucuggagaguggcuauuucacucagcugacuagccuuucuaauuuuacuucucuucaaauggcuaccugaccccuccagaucauuauccugguugcucuuggccacaauaugauuccuacuuccccuuuuucagaauauaaggcuguugcggacagagcuucagaaacuuggugagucucuccaaucagcagagagagcuuguugccacagcacuggggcaggaaaacuucgucaagccuugaccacuugugaugacaucuuaaucaaacagguuagggcaaacuauauacccacuucuguccuaccagcccacuccaguguauaugugagaaaggaaagaggaccagaagaaaaagguaaagauuuuuaggcugaauuuauagugagagcaguauauuugcaaaauaaaaauaacuauucuuuguuaagcauuuacuaaguaccaggcacugugcuaaguaauuuauaggcauuuucugucacaaccaccuuagggagguaguuacugucauauuucaucuaagaugcuacugauuauaagaaaccauuauuuuauguacuacuaagaaaaaaguaacaauuucucaucaguaagaugcauccugauuccaaagagauuaaaauguuaaaauuguguaucuuaaacuaaacucaacauuuaauuugacauuuagagacugaggcacuuagaaauuaaauuuacucaagcucauacuaccuuauguguuagaagauguccuauucagcacugcuuauguuuuguucucagaaaauguccccuuauucaguuauaagcuccgaccuuaaagaguuuuaaucuuugaagaaacaguuguuaguaacuaguaauggaugguauguauuacccuuagcccucucguuucucuaauauaccagacaaaaguguuuucuauaacuuuauugaucuuccuuaggaccagacucuggcugaacugcagaacaacauggugcuagugaaacuggaccuucggaagaaggcagcauguauugcugagcaguaucauacuguguugaaacuccaaggccagguuucugccaaaaagcgccuugguaccaaccaggaaaaucagcaaccaaaccaacaaccaccagggaagaaaccauuccuucgaaauuuacuuccccgaacaccaaccugccaaagcucaacagacugcagcccuuaugcccggauccuacgcucacggcguuccccuuuacucaaaucugggccuuuuggcaaaaaguacuaaggcuguggggaaagagaagagcagucauggcccugaggugggucagcuacucuccugaagaaauaggucucuuuuaugcuuuaccauauaucaggaauuauauccaggaugcaauacucagacacuagcuuuuuucucacuuuuguauuauaaccaccuauguaaucucauguuguuguuuuuuuuuauuuacuuauaugauuucuaugcacacaaaaacaguuauauuaaagauauuauuguucacauuuuuuauugaauuccaaauguagcaaaaucauuaaaacaaauuauaaaagggacagaaaaauuaagaaucaaacaucauucuggaccaugggaaccuugaaaaggcauggcaguggagaccaguaacuaguauacagcuugccugagaaggcuuaguaacaaaugaauucaagucguauuagauauucuaaaccuuccuuaauauaagaugaagugucauauguuaggagguaaaaacguaacacaaaauucugggaauaagaauaaagucuggacccugagcucagaaugauccauagcaucuacugugcaaauauauuacagcagacauuauagcauauuaccuccugcuguacacacaugcacaggccugaaacucuccaagagcaccauaagaaugauucccuuuaccucaucuagauaaaggcugaaaaaaauguauucuguugcagaugggagggaaaaaaauagacaauuacguugaaaauuuauuaaaacagaccagcuugaagugaguuuauucuugucuguauaaucaccaauguuauuucc

SEQ ID NO: 18506 - RNA, 20856 nt, Homo sapiens
cauuauaacagcccuuccaaaucuugaauuugcauuuuuaaccaguguuagcaaauccuguauuucccucuuugggaaauaugggaagcaugagccauggcauauucuugaagcuaaaucucagggcaucaccccucacaaacaagagaucaagaugcuuucuguauuuauuuaaaaaaaaaaaaauuccagaauggguaagagaacaaucaucaaggauguaggugccagacacagggcagaagguagcuagaaaaguaugccuuagggaaguuaaaggucuagccucauuccuaccuuguuuuaauagcuguaccuaauauaaauagcuaaguuucccauuguucuagauuccucugccccaucuacaaacauggcacagccagcuugacuugcaaggccucaguugaaggaccccauguacauacaggccaguacagcaguacuaggcuaacuagaaggaucucauccccauauguggucucauuucaagucuauggaugacuaccuucauugcugugugcgagaugguuucaccccuugaaaauauggucacuucagcauaaaauaguuaaaucuuuauaaugaucaauucauccuaccuccuuuuacaugcagcugaaaaaugacaggcuagggacauagaauauugugaacuuuauacuguuagaaucacuguccauuaaaugaucacuagcuaauggucacuaaauuuacaaauuaaggaaauuauauauagaauacugcaaaaacacaguaaaaagacugaaguucgcccauuucugcucaggaagucucuucacuccuaagcuucauauguuguccuucuggcuucaaaauuucugcuauuauuacuguuuuuccuccuuuugaucuuccuuuuguuccccagugccagaacuuccagagccuucucgcucagaugccaucuguuaagaaaacauuugagagccacucagauuuaacguuagagcuaaccauuugcucuuuguugcacuccaagaugagggacccacauauguccucaucauucauuucuauuccacucccccuccccacuuucuacccuacuggugguuucuggauuccuucccuuugacacuaacuccaaugccaaaguagagucaagacggcaggagacuaucucccaacucuaaucucacucuaaauuccacaaauggcuauggagggagccaccagugacagucaucaagaacaguuccauccagaucaaguuagaaucaaaauccacuucagcccuuguaccuuuuuguaugccauuucgaacagcuucagugaugccugcugaagagaggaugcugccugucuaauauuuucuccuguuucgcugucuuuucuagccaggagcucccucauuuuggaaaucucuucuuucagcuuguugcacuuaaaaaaagaaaacaaaaauccuuacuuuuccaggucuccuguaccauuacaaguagaaguacuauuuagaaacauuuuaaaauaauuaaaccccuaucaaaacccacagaaaaauaaacuucacuggcauugguaaaaauguguucaaccucuugaguuacuuuaaaauagaacucaccucaucagcagguaauugguccuugaauucuuccaucuugguuucugugucgugaaugauuccuucagccauauuaacugcuucaacucguuccuuagagaaauuagaaguuuaaacgaagacuuuccaaucaaccaaaguuugcugaaugucuauacucagacaauaagcuauguguuacauacaguuacagauaaaaauagaguaagagggagaaaucagaguggcaugaaagagucugggauggcuuugagagagauuugggcuagauuuuguaacaucagaauugugacagggaaaacagaagaaauaauaaaggcacugcaaacauaagguauaaacaacggggaaggaagaauagauuaucuuagguuuucucuuacccacaaccuaugacauguccaaacucucccacuuucuuguucaagcgauucuccugccugagccucccaaguagcugggacugcaggcgugcaccaccacgcccggcuucaaacgaucugcccaccuuggcagugggcuuacagugcugggauuacaggagugagacacugcgcccagccccaaacucccacugucaagacugagcuuuacuaagauuaaaguucagaagacaagaaguaaucaccuucuuucgccggucuucuucagcauauuucucugcauuuuuaaccauauuuucaauaucaucuuugcuuaauccaccagaagacuggauuacaacuguaguaaacagaaggcauuucauuaauucccagguaaaguuauaugccucuucuuccuccauugcauuaagaguacuccugcucauagcagccaaucuugauacaaauuaugaagaggagaaauacccuauaguccuauaaagcaaaaugaaaccaaggacccaauauauacacaaacaccaacuggccuguuugcccaucaaaacuucagcaauccacaggcucagugccuguuuguggggaauaaacauuacacuuguacaaguaaaucugauaacugaggggcaaagaggacucaucauucuaagagggucuauucccaagaccucccucaccucacucuuagggucugauaaacaaggugacuuacucugcugcucacguccugugccuuuaucuuuagcagaaacauguacuaucccauuggcaucaaugucaaauguaacuucaaucugaggaacuccacgaggggcugguggaauuccaaucuaaaauaaauaauauccagaguaagguccucuuacagagggguccagugcuauuauuuccaaaucuauaugguuuucuaguaaacaagucacuugguuccugggagaaacaagugauuuaauguacaaaacacaaaguuuauaagcaacaguaguaguucgcugccugaaaucaacugguuuuauaccagugaaguuuagcuauagcaaguaaccauaauggcuguauguaccuguggacacacuaaaugacagauagcaaaucuccuauuauucaccucaccaauaaccaauaagcaaugcugaucagaaaccaguaacaauaucaaaugucuuuuaaaugaguaaucaggaguuuauuucugaggaaauuccuaaggcacaaggaaaaagcaaggcuuucagguaaaaacugaugccauggguaucuaguugcaucccuucuucucaagacuacucaguauguauguguaugccagcaguuuauacuaauauuuuuauggcuuagaauauuaucucacuuuacagugaaggaggcauaguauucaggauucacaauaaccuaccaaaguaaacuguccaaggaguuuguugucuccagccaucucucuuucacccugacacacuuuaauuuccacuugcguuugaccaucagcggcaguagagaauaccuagggaagaagaaacccuccuggguugucaaugugauuaaccuacuccauuucuauagaaaaaaugaaagccaaagguuuacauuccaagacuggaagacuccuaauuuacgguauguucagaacaaaggcugaugucuuuauagggaauagaaguaggauuaguacagcaaaugggcauacaauagcaacuguuucagcuaagcaaaugcauuguacaaagacgcagcauuaggacagaaguccucaaaaggaacuaaaauguugaaacaugcucaucuggggaaacgggaucagagaaagaagauguaucaugcucagucacagaaagucaccacauacuuuucuucagagugauguguugacaaauacaucacggcacaaauauaccaacaaccauaguuuuauggaaaaacaucacaagauuggguaagucaggaaauaauuuuuuuuuuuuuuuugagacaagaccucacuucauacugucgcccaggcuggagugcaguggcaugaccucagcucauugcaaccucugccucccaugcucaagugauccacccaccucagccuccugaguagcugggacuacagguacacagcaccaugccuggcuaauuuaacuuuuuggagagagggagcuucaccauguuacccaggcuggucucaaacuccucagcucaaguaauccucucgccacagccucccaaagugcugggauuacaggcaugagccacggugcccagccagaaauaauuccuacuucaagaacaagccauguccaaguagcccugcuugguaucucggcacccucauaccacccccuucauucauccauaagauaagaacacuccccuaagucugguccagacuacccuuuuuacugucuuugagaacagaagacuacaggaaauucagucucaaaugacugagaucccuuuuagcaaauuauguuaauccuguggaggagacuacugauguccuucuuauaaucaucacuaccagcuaacauguaagaacuuuucugguaacaaaaaaacaaaaaacaaaacacaggauucucaccacccacaguuaacuguuuaauauucuaaacuguaaaacagauaaaaaugaaguuuucuagaaaaaacucaugaaaguggcugcaauuacauccgucauagaaccuaaaacccaugugacaagguaggaagugauggcucuuaccuggcucuucuugguuggaauagugguauuccuauuaauaaguuugguaaagacaccuccuagaguuucaauacccagagacaggggagugacaucaaggagcagcacauccgugacaucgccggccaacacaccucccugaauggcagcuccaauggccacagccucaucaggauugacagcuuuacuuggggcucugccaaaaagauccuguacagucugcugaaccugaacaucaaggaaaaagaaccugucggcccacacuugggaacuaccugagcagaacaaaagggagcacguguccuacgcucccagccagaucucaagacaggcuaacucaaaucugagaauguuuauucaaauaaccauuucguacuuggguuccugcuaaugaucuucuaacacucauacacuuuauaccuauagaaguaucuccuucaugacccuuguaaaucugggaaggauucuccuaaguuuuauuaucugcuuuccuacacaacacauuaaaucauuugaaacagaggaugcaaggcaaggggacuuagaaguccacauucucuuguauauuaucaacuaaagaccaaauuaucauaggcagcuguagcaauaauuugcauugcuaacauggggcauggucuucccuuguguuuauuagugauaaaguuccauuugaauaguaucggggauacuuuuucuucuucuuuuuuuuuuuuuugagacggagucucgcugugucgcucaggcuggagugcgguggcgcaaucuccacucaccgcaagcuccaccuccugcguucacgccauucuccuaccucagccucccaaguagcugggacuacaggcgcccaccaaauuuuuuauauuuuuaguagagacaggguuucaccguguuagccaggauggucucgaucucuugaccucgugauccgcccgccuuggccucccaaagugcugggauuacaggcguaagccacuguacccggccucggggauuucuuaauauaugaggcauccaccugguccaggaccuuuuuuuuccagguucauuuuuuuuuuuuuugcauauuuccuuaaggccauguauuucaauggaaaaauuaagaaaaaaaacaaggucacuaucuuagguccaagauaauccuauuuaggcuaccaagaagaacugcaucuucaacagguuugugcucagucauuaguuuuccacacguucuuucagaaugauguguugaauaaaauacaucauugcacaaaucuuugucaaagagaugcacuaagcugcaaagacacauguacaaagaugguggccgggggcgggguauuaccaagguuuuauguuccccucugaccucaaacuuuguuucaauccuaaaaauucuaugacugaguucgggauccucccugcuacugccccuaaagaaauucugccccucccuaauuuuucauacauacauacauacauauauauauauaaauuagacucaugugaucugcccgccucagccucccgaaguguugggauuauaggcgugaaccaccaugcccagccuauuuuucaauuuuaacaaaacaaacagaaaagaauucuuuagugaguauauaaucucaucucccuuuuaggucaccccagcagaaugggccauauauuugugccaccugucccaagaauacacuaugcgccagcccucucucuccacgacagaauuccacugguccauaccuugggcauccuagucaugccacccacaagaaucacuucuccuaugucacucuugcugacuucugcaucuugcauagcuuuuuggcauggagcgauaguccuucugauuagaucagugacaaucccuucaaauugagcacgggucaacuucauauucaaaugcuuggguccagaagaauccauuguaagauagggcaaauugaugucagucugcaaaggaaauguuuaauugcaugucagcgagcaggccaaaugacgguuacauuuauuauuucaacuaaaauaugaccaugcccuaggacagaagacuugcaaaaccaaagggagggugagaucuaauuuaaaugaauagucaccaagaauacuuuuuuuuuuuuugagacagagucucauucuaucgccaggcuggagugcaguggcaugaucuuggcucacugcaaccuccgccucccagguucaagcgauucuccugccucagccucccaaguagcugggacuacaggcaugugccaccaugcccagcuaauuuuuguauuuuuaguagagacaggguuucagcauguuggccaggauggucucgaucucuugaccucgugauccgccugccucagccucccaaagugcugggauuacaggcgugagccaccccacccggccaagaauaguuacucuuuaagaugcaauguuuugccgggugcaguggcucacgccuguaaucccagcacuuugggagggcgaggcggguggaucacgaggucaggagaucgagaccauccuggcuaacauggugaaaccccgucucuacuaaaaauacaaaaaaaauuagccgggcgugguggcacaugccuguaaucccagcuacuugggaggcugaggcaggagaaucgcuugaacccgggagguggagguugcggugagccgagauugugccacugcacuccagccugggcaacaagagugaaacuccgucucaaaaaaacaaaaaaacaauguuuuaucuccccagagauaagcacuauagaauguuuuaauaaaguuuauaguuauuaacaagaaugcagcagauaagcaggaaaaaaauccccauucagaagauaaagaacuauucugccacuacauauucauuagaaccacacuacugauguuuuccuucaccaaguuuuaaaaauaucccauguaggugaagagaaaugucaaaguuauguucugaaccaaauaacaugccauuaacccugggcucuguaaguuccaggacguuuacaagugauacgaaagcuacagacaugcucucauuaauguaugaggacugacuuguauggccaucacauccauggagagcagcugacagucacaccauguaauauccaguauuuaauaaaucccaaaucccaguacaacaugggaucuuacaguguguaacugagagugaguccuuaaccaccuuucuucaggagaaguauccuaaacauuugaauacuuaauaaauagaguuaacacaccaucuguagaauagugauaccuaaauauuauugacaauuucuuuuuugcaaaauguugauuaaccaaaucagaacacagaauuaucuaaaucaaugcuauccaguagaauuuucugugacaaugaaaaugcuccuuaugcugcucaauucagcaaccacuaacaugacuacugagcacuugaaauaagacuaguguaacugagaaauguaauuuuaaauguuauuuaauuuuaauuaauucaaaacccauauuuggcuauuauaguagcacgacucuaaacacuaaaagcuaauggcaaccugaaaaucuccagcacuaacucucaacccucuacaaccaguccaacaucuaucacaauguucuuuccuuacccuccucucucaaacccaaucacuugugucuuacucucacucucauccaagucuuuucucaacacaugguuaccaacagccccccuacacccacucagggugccuucugcccuucacaauucuccacucuacuccagccaaagggcuuuucacaaaucgacacaugaccauguuacuauccucaacuccucugggguuuguauucacuuaucuagggagagacaccaaaucccaaaucuauaaagccucuagcccaaggguauccaaucuuuuggcuuccuugggccacacauaaaauacauuaacacuaacaauagcugaugagcuuaaaacaaaaacaaaaaacaaaacccucaguauuuuaagaaaguuuacaaauuuguguugggccacauucaaagccauucuaggcugcagguuggacaagccugcucuagccucauuuuccaugcccaccaacaaccgaccccaaucuucacucugcccuuuuggccacucuggcccuuucucaggucuucaccugagagccuuacucuuaacccauuacacaugcccauuuaucuuuuucugauaaacucaucucucagaugcuauucuuguuaugcugaacaccucucucagguaccuucuuagauuauuuuuauuauuuuuauuuuucauuuuuauuuuuugagacagagucucauucagucacccagacuggacugcaguggugccaucugggcucacugcaaccucugccuccuggguucaagcgauucuccugccucagccuacugaguagcugggauuacaggcaccugcaaccacacuuggcuaauuuuuguauuuuuaguagagacacgguuucaccguguuggcgaggcuggucuggaacuccugaccucaagugauucaccggccuuggccucccaaagugcugagauuacagaugugagccacugcgugcggccccuucuuagauugcuuuuaagagaccugcucugucacccagguuggggugcaguggcauucacagcucacugcagccucaaacacuugggcucaaaagauucuugugccucagucuccugaguagcugggacuacaggcacgcaccugugguguagugcaccacgcccagcuaguuuuguagagacggggguucucacuauuuugcccaggcugguccccaauuccugagcucaagugauauuccugcccuggccacccaaagugaggccccuucuuaaauuguaacugcauuuuuaccacuuguuacauuaauaguaacuuacauuuagaguauucacaauuuccuauguuuuccuaagcauguaauauuuaugaacuugguaaugcucacaacucuuaggggaagaguaccacuauuauccuuguuuuguagauaaguaacaguaauguuaauucauccaagaucaccaauuaauaagcaauacaagggggacuugaaccccagcagaaugcuugcagaaccacccuuaaccuuuacuuuguaucacuucuaguuuaacguuuacuaaucuguucuaauuaauguccaucuuuccaaaccacaauauaaucugcaugaggguaauaaacgcuaagaauuuauucuauagauuuaaaaucaccuaugcaaaacugaauguguaaggaugcucaauacaucuugcuauaauaaacacuggaaaacaaucaaaaugucuaucaauaggaugcagccacacuaauuaaaaccaaccaaucucuuccaacaccucgcauccccuaccccaaaugucaaaucccugggaagaauuaucuucuggcagugccagguauuucaaccucaacccuaaccaacguugcaauguucugccacuccaugauagcaggggcaaaguaacaucagcaagaccauggaugcguguguauaacuaugucacuccucacagccacuuaaaaaaaaaaauccagguuugaggggaagguucauuagcagcaaccacagugacaaccaucauaaauaccucuucccuugugggugaucaaaauaaaggugucaccgcucugcuuuuccugcugucacccaagacaccggaaauagaucugcugcuuucuaucuucaugggucucuaacacagaucuaaaaugguuuauauaauucuauucuugguggugaagacaaguuucaccucucagaacuggagcuaaccaaacugacaaagaggcuguguaaaucugaugcucacagacggaaacuugcacaagcuucagcucuuuuucuagacuggugauucaaauuauugucauuuuuugacacagggucucauuugucacccaggcuggagugaaauggugugaucacggcucacugcagccucaaccuccugggcucaaacaauccucuuagccucuggaguggcugggaccacaguuguauagacuaugaccagcuaauuuuucaaauuauuaagugagagacaauuagccgggcucaguggcucacgcccauuaucccagcacuuugggaggccgaggcaggucaaucaccugaggucaggaguccaaggaccaaccuggccaacauggcagaacccugucuguacuauaaauacaaaaauuagccaggcaugguggugcacaccuguaaucccagcuacuugggaggucgaggcaggagaaaucacuugaacccaggaggcagagguugcggugagccaagaucacgccauugcacuguagccugggcaacaggagcaaaacucugucucaaaaaaaaaaaaaaaaaaaaaaaaaagacacucagagacucuccaauucacaaggagagagguuauuuaauauugucaguuaagacagcaguuuuuccaagcuaguaauucuaguuuuaaacacugccagagcagguuuuaaaauaaaugucuuuaacugaaaggcaaacaaguacacccagcacaucauucacacauuauuuagcuccaguauauguaacugauuugaguggcuaaaaaaauuucagcucauaaagaaacuaaagaccuuacugucccugugcucauggcaaaggucucuagaaaccagaaaacugaaaaaacaaacaaacaaaaaaaacucaacugacauuaggccaauuagaaaauacuauuuauuuuaaauaagcuccggcugaaaauauccaucaagacugcucgaauuuuccgugucucaccugcacagaugaggagaguucacauuuagccuuuucagcagcuucccguacccucugaagugccauguugucuuuagucaaaucaaccccugucuauaaagugaagacauugaacaccaaacaccagcauuagugaggugauaaauaaacugcaguaauaagguggaacaacacaaaauggagucauaccuuuauauauaagcaugaauuacuuuuuauuacccuuaauguguagggaaaaaaaauauucugaaaagaguaucugugucuagaauaaggggguugaacugaacucguaaacaaagcaaagagcaaucugaacaaagaauuucucaauaucccaacgucuacauauuaaccacauugguaacucaccucucucuugaacuccuucacaaugugccguagcaaggccuggucaaagucuuccccaccuaagaagguauccccauuuguggauuucaccucaaauacuccuuucugaauuuccaggauagaaauaucaaaaguuccaccaccuaaaucauauacagcaaugcuguaaaugauuugugaaaaaaaaaagaaaagaaauccuuaagaacaaaaccuaucaccaggauauaaauuucaauaaccaaauacagauaaucuaagcuauuucccugagauauguacuaguuaaauuaccauggcccaaaagaaaagaaaagaaugguuuugaaaugaaaaaacaaagacaauacagacuuaaaaucaguaaaagcacuguaaaaggcucaauuacuaaaaaauuaagugacacuuuaguuucacacauccaggugagaaauuuacugcacaaacuuacacuuugucuucugauuugucuagaccauaggcaagagcagcagcugugggcucauuaaucacccgaagcacauucaguccagauaucuggccagcaucuuuaguggccuagagaaaacaaagagaaaaacauuuuuguacccuuccaucccaggcaccuuacuuuuugugaauaagaaugcuaauugaccucaccugucucugcgagucauugaaauaagcugggacugugaucacagcauuuuuugcugugugccccaaguaauuuucuggaaaagaaugaaauucaaucauggaauucugucagaacagaauuauuaauauagcccaacaaccugugucauccuuuugcagccacagacaacauucuucagucuuuugguaagugaccuaauauguccuugcaggaaacacuccaaguaaauacacugguuaaaaacccaagaucaggccgggcacgguggcucacacucguaaucccagcacuuugggaggcugaggcgggcagaucaccuaagguugagaguuuugagaccagccuaaccaauauggagaaaccccaucucuacuaaaaauacaaaauuauucaggcaugguggcgcaugccugucauuucagcuacucaggaggcugaggcgggagaauuguuugaaccugggaggcggagguugcagugagacaagaucgcaccacugcacucuagcuugggcgacagagcgagacucuugucucaaaacaaacaaacaaacccaagaucggccggccaggcacgguggcucaugccuguaaucccagcacucugagaggcugaggcggaugaaucaccugauuugucgggaguuggagaccagccugaccaacaugaagaaacccccaucucuuuacuaaaaacacaaaaguggcuaggcaugauggcgcaugccuguaaucccagcuacguugggggggagggagagggcaggauaaucgcuugaacccgggaggcggaggcuuuggugagccgagauugugccacugcacuccagccugggcaacaagagugaaacucugucucaaaaaacaacaacaaaaaaaccccaaaaaacagaaaccccuaagaucacucuuucaacauuuuagugaagguucacuaaacuacaaugaccuuuagacuuacaacagccacuucaaauaggaaguucuaauuuauaccuaacagggacaaaagcuuaauguguagucuuguggcuuucaauauagaacauuacccccuacuggaaaaaaagaaacaagccagccaccauuagugagauuugaagauuaauucaaucugcagggaaagcaugaaguauaacacaguuuugccauuccuaguuuuucuauacaaaagggaccacagauucaucuacaggagcuggagcacagggagcuagugaucucacaggaaucauuguucuuagaacuuucccagaugugaacuaaacccacucaccugcagucucuuucaucuucaucaacacaaaugcuccaaucugacucggagaauacaauuucccaugagccucaacccaggcaucaccauuggaggcacggacaauuuuaaagggaacauuuuuacuguaagacacaaaaauucuauuagagaaaacuaccugaacaacuuaccaugacaaaauuaccacauaccaugaacauccaucuuccaccccaagagacucauucauggccaacaaaugacaguuugugaaauucuuuagaaagcaaucacuaacaugguuuaugagaauuacaaggcaaaaugaaauaaauaaauaaaaagaaagcaaucacuaacauauaaaaacauuaugaugaaaccucaacauucuuuauuuagcgccccaggcagaagauuuuugcagccacuuuagaauaauuugaugaaaccguuacuguaugauccagcaauucuacucucuaagacaaauggaaauauuuauguccacacaaaaacuuguacacaaauguuuauggcagcauuauuucuaauagccaaaaagcagaaacagcucaaauguccaucacuugacaaauggauaaacaaaaugugcuguauguccauacaguauaguauuauuuggccauaaaaaggaaugcaguacugacacaugcuacaacauggaugaaccuugaaaacaugcuaagugaaagaagccagucauagagguccacgcaacuccaugcauacagaauucauauucuacucaagcucaauaaagcuguuuaaauuuuuaaaaauauuuaguuuauauauauauagacagagacacacacagucuugccuuguuggccuagauggucuuaaacucagccucagacagucuuuccaccucugccuccuaaagugcuaggauuacagacaugagccacugcucuaggccuaaaacauuuuguauacaacaggaaacucuaccuaugcuucuaguuuuuuuuuuuuuugagacaggguuucacugcuauuacucagacuggagugcaauggcaugaucucagcucacuggaaccuccgccccucaacgcucaagccucacuaguagcugggacuauaggcgcgcaccaccgagcuuggcucuuuuuuguauuuuuugcagagguggcuuuuccccaaguuguccaggcuggucucgaacuccugagcucaccucagccucccaaaguguuaggauuacaggugugagucaccccaccgagccucuaguaugucuauuuuagaaaaaggcaggcugggcaugguggcucacgccuguaaucccaauaauuugggaggcugggguggaagggucaguugaguccaggaguucaacaccaacuugggcaacauagugagccccguuucuauugggaggggggaagaaaaaagaaaaaucaagucuuuuucuguacuggaucaacacaugauagaaccuaugccauuucugccuuauguauucaacacugaacuaugugguuuaggaaugcuuugcaaauuuucauguaucaugucaauacauagcaaagaccuaaucuguaaagacaaaaaugaauuuuuuucuuuugagacagagucucagcagcccaggcuggagugcaguggcagugaucucggcucaccgcaaccaccgucucccggguucaagugauucucccgucucagccuccugaguagccgggauuacaggcacccaccaucaugcacagcuaauuuuuguauuuuaguagagacaggguuucaccauguuggccaggcuggucuugaacuccugacuucaggugauccacccaccucggccucccaaagugcuaggauuacaggugugagccacugcacuggccaaaaaugaauuuuuuaaagggauuacccuuuuggcagugguacagauuuccccuagggacaauaaguaaaauuacuaaaguaaggugcuccagggauccucaucaacaugcugaggcucuucuguguggcccuugcaaauaacugcuuuuugcaaaaaacuuuugcuguuacucacaugucuuucuguacuucaggaucaucauaucgccggccaaugagacgcuugguagcauaaaauguauuguuuggguuggugacagccugucgcuuggccggcauuccaacaagucgcucaccaucugcuguaaaggccacaacugaaggggugguucuggcaccuucggcauucuccagcaccuaaacucccaaaaugugauagagaguaaguuuguaguuaucacugguauguuuuuugagauggagucucacucugucgcuaaggcuggaguacaauggcacaaucuuggcucacugcaaccuccgcauccuggguucaagcgauucuucugucucagccucccuaguagcugguacuauaggcgugcaccaccacaccaagcuaauuuuucggcauuuuuuaguagagacggggguuucaccauuuuggccaggcuggucucgaacuccugaccucaggugaucugcccgccucagccucccgaaguguugcgauacaggcaugagccaauacgcccagccuauuacugguauguuugcagcaaucauuuaagacacagaaacagcucccaaauugcgaaacaaaugcacaucaacaauacuaccgggcaugcuuuacugcugauaguuaaugaacaguagauauuuaguuaagguaucuuuagcccuuuacuuucaaacuacuauuuuuuuuuuuuuuuugagagggagucucgcucuugucacccagacuggagugcaguggcgcgaucucggcucacugcaaacucccuguccuggguucaauucuccuacuucagccuccugaguagcugggauuacaggugccugccaccacacccaacuaauuuuguguguguguguguguguguguacuuuuaguagagaugggguuuugccaaguuggccaggcuggucucgaacuccugaccucaggcgauccgcccaccuuggccucccaaaaugcugggauuacaggcuugaggcacugcgccuggcuuuuuuuuuuuuuuuugagacagagucucacugucaccuaggcuggagugcaguggcacugucacggcucacugcagcauugaccugccagccucagcugauccucccaccuuagccuccagaguagcugggacuacaggggcacaccacuaugcccggcuaauuuuuuguagagacaguguuuugcuauguugccuagggugaucuucaacucccacacucaaguggccuccccaaguguugggauuacaggcaugacccaccaggccuggcccugauuuacauuuuaaaaacugcuuugguugcuuaagacucuugucaggugaaccuuuguagugcugauaauuguauguaucuaacuucccagaaaaggauuuaaaugugguauagagguaggacuacuaauuuacuauuaagaggggugggaauggcuugcacuguuugguuacucugguaaccaccaaagugcugcauuuucuaaauugaaacaaaguugggugugcagagacagacuagaaguggagcuucaucucugaaguaaugcauguuguucauuggagcaggcuauuucuuuugaagccuccuuacucuguacaugcaaccuuuauucccaccggguucuuagcaagauuuagaacaccuggaauucuugacucuugcuucuuccauucauggccucuuuugcuuucauacuuccuuuccccccaaucuccucuucugaaauaaccugaacugucuauggucuucuuaucccacuuguuuggcaccaagagauuauuccuucucuuggcccuaauuugggcuucuuggcauuuuuccuauaugccugauaucuguggccaaccccccaaaaaacuuagaaguagauauaauucuccauguggaaguaaagauucuugucccaacauuggguaugaaaaaccugaucuauagucucuucuuuuuuuuuuuuugagacaaagucucgcucugucacccaggcuggaguacagugaugugaucuuggcucacugcaaccuccaccuccuggguucaagcgauucuccugccucagccucccgaguagcggggacuacaggugugugccacuacgcccagcuaauuuuuguauuuuuaguagagacagguuucaccauguuggccagaauggucucgaucucuugaccuugugauccacccgccuuggccucccaaagugcuaggauuucaggugugagccacuguacccggccaauuuuuugcauuuuuaguagagacgggguuucaccauuuuggccgggcuggucuugaacuugggaccucagguaauccaccccccuuggccucccaaagugcugggacugcaggcgugagccauuaugcccggucagcccugaucuauaguuauguuuuugcuguuuuaguuggaaguacuucgaggccaggcuuagugguucacaucuguaaucccagcacuuuggaggccaacgugggcggaucacuugagcucaagaccagccuggccaacacaguggaacugucucuacugaaaauacaaaaaauuagccaggaauggugguucaugccuguaaucccagcuauguggccaaggcaggagaacuguuugaacccaggaggcagagguugcagugagcggagaccgugccacugcacuccaccaugggcuauagagacugucuccaaaaaaaaaaaaaaaaaaaaaaaaaaagcgcaaaucagguucucaaauuccuuaacuaaggaaaagagcacagaauucuggacagauucuggauaagguacuaguuaucaaucaugcucaccuuugcuuguuuaccuuccauaacugccacgcaggaguugguaguacccaaaucaauaccaacaacugcucccuugauugcuucugaucuguaagacauuuagaacagugucacagcuauuguuaucuugauagaccaaagucacuggaagauaauauuuaauuggaaaauuaacagugguauacuacauaaucucuaaauaaauacagauaaauaauuacagagaagaauaaucacaaauguagaaaacacugcuuugaaguuuaauauguauucccucucaaaggaaaugauauuauacuuacgcauaaucccgccuugaaacaagucuaaaagccucaugacuaaggccauuccagcuauccuaaaaaagaaaaaacugacucagucaccaaccaguguguauccugggaggaaaaagagaaaacuugggcucacuuaguauauaaaauacauuaagcuacuaaaacaguaaauauuaaaguuucccaaauaaguaagacgaaaaaagguaaauaaaagauggccuuagaaucacauuacaguaggauuucucaaccguggcgcuauuaauuuugggcgaaauuuuuguggugggggcuguucugugcauuguaggauauacagcagcaucccuggccucgacacccuagaaaccaauaagcaccccaguaaguaagugacaaccuaaaauauccacagacauugccagauguccccugggggaaaacacuuccccuuaccuugccgugcaauuaguuuaaaagaacuagaguuacuaagggucuuugaaagaaaaaagaaaaguaguggcguuucacuaggauaaaagaccuuuauuacaacuuaaccucaggcuccuuccaagccuuccuuaaugcccacauacaauuccuguucucuaaagcauuugucuuuuauuuuagaaaacaaguaaccacuccauagccuuuucuccgccccacgaucugcuuuuuuuucugaaguaacaaacgaguacaaucuuacaccacagauuuugagaaaauguugcuaagcacgaaaacuggaguuccgacucagagcuuucuuauuuuauuucaccguaucaacgggauccuuacacacucuguauucuguagaggagccaaaaauaaaacugaaaauaguggcuuucccaauagacugcaucccucacccccaaggccaaaccuuuccauucagccacagaacaggccaugaggaccacuaccugguaauuuugaaaugacacucuagaucgcgaggggugugacucagcagggcccaagccggaggcaaaaccuugggcaaaaucuugacccggcagcgcuaacuauggaaggcccguuaccuuccuucccgccugaccuauacuggagaauucaaacccuaaagggcgcgcggccugccgcagcgaagcccgaggcccaaggcccgaggccgugaccccauucgggaaggucccaguuccucaccugguggcgggcggccguagggccccgggaggcugcggcgcccacgagacgggcugcugcagcucggcuggcacuuaucauggcggauaaauggaggaguacgaggcagcaaacaagcgcuccgacggcaaagagcugcgcgaugcgguggcggcagcgcuucuggaaaccuccaaccacguggggugaggggcggggguuggucacugcggcccagaggcccgcucuuccgcugaggcgccgcccgcgccgccugaccagaggauacucgacugccgcucccggagccagggcguacagguaauaugcuccgcagcaugaugguuggagaaagccugcccuccugucccggcugcggcggcucugagcucagaaagaguccaggggaggaagagggauaugaaggccguaucucggacagccccgguccucggcgacaggaaagacucaaggucacacgggauaaauugcgaaccgauuacagucuucuugcgucaguugcgcgggaggaggagccuguuggcgcaacagacauccagcuaagaaccuagagcgcaugugcgcaaggaguggcggaaaacauggguggagacuaacugcggcgcucacugggugcccgagugcacgccagcguucccuggggcgagcccgggcgcgugcacaccccccgggcguggacguguucccagcucccgcuccuggaggacggcgccaucuugucuuguggcuuugugaagugaggacgucaguacuuuuguuguuuggucccgcccguuguucacaacuugaaagacacuuggauau

SEQ ID NO: 18507 - RNA, 5160 nt, Homo sapiens
uuuauucuuuauuguuuuaauuuucuuccagucuuuggauuuugaggugguccauuuaucaucugcuucucuggugccucuuggaccuuccaucuucacagcuggggcugcuguguuggcccagguguccccagacuggacaucggaaccuuugggaagagucugauguuuggcccuugucacauuucacauuucacaucuacagagaaauggggaaggguauguuucugaggucugcucauaggcuauguugugacugaggaaguucuugaucaucccuuuugguuaccacuuaucaucacuggcagaaaaacaucaaaguggucagugaacucaucuccacaucuggcuacuuccaucucugcaaguaguuugcuucuucagucuugugaugggaaagagaucuagaaacuggaagaauaaucugagauacauccuaaaguucuggugaggaaagcuaaugccaauggacuuuuuuuuuuuuuuuugagauggggucuugcuauguugcccaggcuagucuugaacuccugggaucaagcaauccuuccaccucaaccuccugaguagcugggauuacaugcauguaccaccaugccucacucgccaguggauuuuuuuuuuuuuuuuuuuuuuugagacagcaucuugcucuguugcccaggcuggagugcaguggcacaaucucggcucacugcaaccucugccucccagguucaagugauucuucugccucagccuuccgaguagcugggacuacaggcgccugccaccacgccuggcuaauuuuuguauuuuuaguagagaugggauuucaccauauuggccaggcuggucucaaacuccuggccucgagaucugccggccucggccuuccaaagugcugggauuacaggcgugagccacugugccuggcccuuuuuaagagggucucacucuguugcccacgcuggaguauaguggugugaucauagcucauugcaaccuccaacuccugggcucaagugauccucccaccucagccucccaaguagcuaggaccaugggugugcaccaccaugccuggcuaauuuaauuuuuuuuuuuuuuuuuaaagagacagggucuugcuugcaacauugcccaggcugaucuuaaauuccuggccucaagugaugcccuaccuuggccuucuagagcacugggauuacaagugugagccaccaugcccagcuauaccagugggcuuuuaaauggacauuucuuuaccucuggggauagucucauuuuugugaggcucccaaggggaaagcagccaucugaccaaacuagaaaacuagcaggcuucagcccaguggaauaacauaaaguaggacaaucgauacagacaacauugauuggccaugcuuugagugcuguggauaguguguauuggaagcuuaaggggccagcucauaaguaaguuguaaguaaguauuuaaggaugcuuuuuuuuuuuuuuuuuuuuuuuugagacagagucucacugucacccaggugugagugugaucuuggcucacugcaaccucugccucccagguucaagugauucuugugccucagccuccuaagcagcugggauuacaggugcuugccaccauggccggcuaauuuuuguauuugcaguagagaugggguuuuaccauguuggccaggcuggucuugaacuccugacaucagguaaucugcucaccccggucucccaaagugcugggauuacaggugugagccacugucucuggccuaagguugcuucuuguuuuuccccacaccccaucucauacucauggggaguuggguuugacuguauucuugaaguuaagucuccauccuuggacccagcugcuaaagucuaaaaugauuguguuuugggcuggaagauauuauagagaucuuuauuuccuugcaaacaucagggcuggcuguuugugguacuguggaugagugaagagucaggagauacacuucuaguucuguuacugcccaaugccuccauuuugcauuugauagguuuuuauuuuucugacgacaaaaacugagccccagagaagugaagugggccacguaaugguaggaucuuuuuuaggccacccacauaauagugggacucuaguguuagagcugggacacaggcuaggggucuuacaaaggguggccauagaaguuguuagaauuguuuaaagcauuguaaagaugcaggaugcuuuugcaguuaaaagucuccugggaaggaggaggcccugucuccacuuacugccuuguacaugaucuuauacccucaugguugaagauuuuugcugucgugcuguuuuuccuccuacucaugucgaaauguguuucucuugcucuuaccucagaggaaaugaauuugaagccuuccuccguguuagaaacaaauagugcucaggccagacuuguguguuucuguaaagaaugaggccagauguaacaguggaccuuaucuggugauccaagcaaaccuucaagacaucucuaagagaaagagagaaggaaugaguguauuucagagugguuuaaacacacuuuggagucagacucacuuguauuuacguucugauaucuacuuacuaguugucagauuguaaguuacuuauuuucucuaagccuuaguuuuaugaucuguugaaugggaauaguaauauguauuuuuauagcuaucuuaagaauucagagaauagauauggugcuuccucuggcacaauguaaaacagcaguccccaaccuuuuuggcacuagggacuaguuucauggaagacuauuuuuccauggacugggggaugugggggaugguuuggggaugauucaagcacauuauauuuauuguguacuuuauuucuguuauuauuauuuuugagacagagucucacuccaucacccaggcuggaguucaguggcacagucuuggcucacugcaaccucugcuucccagguucaagcaauucuccugccucagcuuccugaguagcugagauuacagauguguaccaccacacccgcuaauuuuuguauuuuuaguagagaugagguuucaccauguugaccaggcuggucuugaacuccugaccucaggugauccacccgccuggaccucccaaaaugcugggauuaugggcaucaugcccaaccuauuucuauuauuauuacauuauaguauguaaugaaauauacaacucaccauaauguagacuuagugggagcccugagcuuguuuuccugcaacuagacggucccaucugggggugaugggagacagugacagaucaucaggcauuagauucucauaaggaguguucaaccuagaucccuugcaugcacaguucacaauagaguuugugcuccuaugagaaucuaaugcugccacugaucugacaggaggcggugcucaggcguuaaugcaagcguuggggagcagcuguaaauacagaugaagcuuugcucacucacuugcugcucaccuccuuggauggguuucugauaggcuacagaccaguaucggggguuugggaccccugauguaaaugcucuguguugucaucauuauugacaacaauaguuuccaguuucugagccacgucguaguuucaggauagguuaugcugaccaagcaaguuuuaucuuaaccaucaccucauuguugucuuaguugguuuguauuacauauuauuuauaccaauaguuauagguauuucaugcugaauaacuaaaaguugugaguagcaaggaacuuugcugcuucucugccaucuccuuccuuacucagcuuagugcuuaucuuucucagguucucucuugucaggugcucaagccagcaggccuuguuucgggggcagugucugaugaggggauuuuauugggguagggcuggcuaguccagagccugccuggucccucagauaguauguucuccuuaucucuugcuuucugcucuucagccagacaugaagcaauuagcucaucaagggaauguugacuuuugucacugcuuuccucugauuuguaugcucauuucugguccuugugcaaagucacggaggcacagucacauacacugacccagauuuugugcucaaguugacugucucucucuuugagauguacaacugguuccauguagcaagggagugaggaaaaagccccuggagccaaucccauuauuuugaucucaaguugaguuuuuaaaaaaauccaagcacuaugacuauagaccaugccucacuucucuguaugaaacaaauaagguaaaaaaaacucacuauuuggagggaaggccaaucugaauugguaaacaauaggaauuaguacauucaagaaaaugccauugucuuuuucuuuuuagcgagccucugcaguaucuuuuuuaccuaguuuuguugcuuccccuguuuccugugacugugcuccagaauuauuacagaagcgcccucuuauuucuugcuuuugcuuccuccaggacacuauauaccacugccacuuugggucuuccuauauauugugcuuaucagagaauacuuaugcuuggaagcuguauuagucuguucucauacaguuauaaacaaauaccugagaauggguaauuuauaaagaaaagagguuuaauuagcucaugguucugcaggcuguacagacuucugcuucugggaaggccucaggaaacuuaccaucauggcggaaggcgaaggggaagcuggcacgucuuacaugucuggagcaggagaaagagagcaagggggacaugcugcacauuuuuaaauggccagauccugugagaacucacuuuugugaaaacagcaagggggaaauccgccccuaugacuuagucaccucccacuaggccccuccuccaauauuagggauuacaauuugauaugagauuuggguggggacacaaauucaaaccauaucagaagccuucaauggcacccacuagcuccugaauaaauuccaaauguaucagguuguugguguuccaagccuauugcaguguauacccauccuaccauuuuaauuaauauguccguaccaucacccacguguaccccuugcuccugaugaacugauccacgugguccucugaguaugcuucauguuggugucucugccaguucuuuugcccagaguacu

SEQ ID NO: 18508 - RNA, 518 nt, Homo sapiens
uucuuuucuuuuuuucugcuccagucaaugaaagggacacuuuauugaggccccagggccauggggccugggcagaaggcugcugcccuucaaggaaggaagagccuuauuugaccuucuuccugggguacagguuguugguguggccgcauuucuucuuguggcaguugauagcaccggggugcaggcaagcauagcacuugcagcagaucaucucgucgcaguuguauuucuggacgagcuggcggagggaaggcucaguaaugccaccucgcaggcgcagcaccagguuuaggguggacucuuucuggauguuguagccugagagaguguggccauccuccagccguuucccagcaaauaucagacgcugcuggucaggugggauacccuccuuguccugaauuuugguuuugacauucuaaauggugucggugggcuugaccucaagggugauggucuugcccgugagggucuucacaaagaucugcaucucugcgucugcagcccggccgccu

SEQ ID NO: 18509 - RNA, 17077 nt, Homo sapiens
ugaacuaaucuguacaccaugauuaccuaugaagcauuaaauacaaaaaucaguucuuuaguuacaucccaacaugcucaguugucugggcauguuaauuuuuuaaaaguacuacagaggauuuauuauacagccaacuugccugagucggucauuuggaaaccauucuucuaaaggaugguguagagagcacugaaguuuacauugugguauauagccuuuguugcaguaagugaugguaacccauuugagcagcuguaugaucugaauagucuggagggggguaugauuacuuacggcuacauuagucaccauaaauaauccaguugcccugcagaguaacacucuuggcugagcauaauguauaacuuuaaucuggacccaguauaauuccauaguacagaagcugguuuguucuucucagucuauuugauauuacuuuguuucauucuucuguugcucccagaaaauuguucauuuaagaacacugugccuggaugugguggcucaugcuuguaaucccagcacuuugggaggccaaagugggaagauuacuuuggcccaggaguucgagaccagccugggcaacaaagggagacccuguuucuacaaaaaguuuaaaguuagcugggugugguggcacaggccuguggucccagguacuugggaggcagaggccagaggaucacuugagcccaggaggccgaugcugcagugagcugugauuguuccgcugcccuccagucuaagcaacagagcgaguccaugucucaaaaaaagagaaaaggaaugcugcuuuuuuuucuuaaacuucacacuuuuaaaauguagauacauuauuucccuugggggaagggagaauauauccuguccaaagaaacugcuauguauaaauuacgaaacuaaaauuauuucuucaacaugauguuuaauauuaugcauuagucuugaagugauguagggucaaauucaauguaaaagccuugcagcauaccuacauuucaggcccuggaaccugcccucauuucuuuuuauuuuuuucaacuugcagucuaaaauaucacagaggaaaauuucuagcuguucuuccuagaugcugacaagucuacuuaggagaguaaagauuuagagacauagcauaacauugguacaagucucuaagacucagacuuuggcccauucccccccaccccuuuuuuuuuaacugaugcaaaaauuugaaucccagagaaaggugacuuaucugaguuuacacagaaguuaguuaggggcagggcugggauuucaggcuuaggucuucugguuccccauguaguuuucuuuuccuguuauauaccaugcuuccugugggaauuagaagauggcaauuguagaaaaacaacuccacauuuuuagugaggauucuaaaguaaaaucagcaauuccccaguuacuuuaaucauaauuucaacacuuguuuaacaugguuccuugguauuuaguguuuaaagaaagcuacauaccauaguucgauuaacagaauuccuuguuccgugcuauuccuuuaacuuaugugaaguuacuggauuucugguuacacuuaagcaaacugaauuucaauuccuauuuucucuuuagaaaauugauguaauuuaggccgggugcaguggcucacgccuguagucccagcauuuuaggaggccgaggcaggcagaucacgaggucagaucaacaccauccuggcuaacauggugaaaccccuucucuacuaaaaauacgaaaaauuaggccgggcgcgguggcuuacgccuguaaucccagcacuuugggaggccaaggcgggcggaucacgaggucaggagaucgagaccauccuggcuaacauggugaaaccccgucuuuacuaaaaauacaacaaaaaauuagcugggcguggcggugggcgccuguagucccagcuacucaggaggaugagagacaggagaauggugugaacccgggaggcggagcuugcagugagcugagaucgcgccacugcacugcagccugggugacagagugagacuccgucucauaaaaaaaaaacuaaauaaauaaauaaaaauacaaaaaauuaguugggugugguggcacgcgccuguagucccagcuacucaggaggcugaggcaggagaaucgcuugaacccagguggcagagguugcaguaagccuagauugugccacugcacuccagccugggcgacagagcaagacuccgucacaaaaaaagaaaagaaaaaguugauguaauuuaauaugauauauagcuuacaucugguucuuccuuuuugggguuuaguauagucuuacagacugaguucuuuugucuuuuuuuuuuuggaagauguuuuugcaugaggaucuagauugaauuaguaccugaaacuguguuaaugaacuugcuuuuuuauguacuuauuuuccaggucaagagcaaucugaauccaaaugcaaaggaguuuguuccuggggugaaguacggaaauauuugaguagacggggcccucuuuugguggauguagcacaauuuccacacugugaaggcaguauuagaagacuuaauuguaaaagcucucuugucacuguguuacacuuaugcauugccaaaguuuuuguuagucuugcaugcuuaauaaaagugcugagacuguuacuaaguaaaaagcugucaaacauuuacugaaaauagaauuggccccauggcuugaugugaagacagcaaggaaagaagcaccagucaaguugugaacaagcaccaaauuaaaagaccuaaaccuuaccaaauugucuuuuuuugaggcuaaucuaucacuuguuaaugucuaaacuuuaaaaucaguacauuuaauuugaguuccaacuguuaagcauauuucucagacuuaaauuugauuauguccccaucaaaaagaaucuccauuuucugaaggucuguuaguuaauuugagauaauuuguuaaaggcaaguaugucauauuacugaggcuacaaguuagucagcagaugagugccaguccagccuuuucugguauguuauuguuagaaauauugaguucuaauguuacaucugaggaaguauguaauuugagaauuguaacuucuaagggauucacugcaucauagcuaugccuguauggagucuaacauaugaccaauaccaacccauaauccagcugaacaaagauacuguaacaugauuugaguggugcuuuuccuugcuuuguuaaccaucacgagagucugcagcacaacuuuuaacaaagcuagaacaguuuuggcuucuuaaacuucauauuuggguagguuaagcugccauacguguucagugugaauaguguuuaaguugaaaauauuguaaaaaaauuauauuuuuucaaaaauauuuaaaaaaauaaauaauaguagaacugagcagaugguuguguuuauuggugcuggaauguacuguagugguguuacucacuugaguaugggcccagugccucaggacaaucuugcuggcaaaaugugcuaagcuuucaggcuuuguuagauucuaacagguauguugccaugcaaguaccuuuccagaauauagcaguagaauaacuccauugcccauccuugcuucuuaaucaccucagacuucagugucaggggaauccuagauagucauguaagaaacuuuauggcugaccaauaugauggugaccuuacucuaauagaaccuccauuguuuuuuguucuucacaagggcuuuuuuugagcuuauuagguugaaaaagauuaagagagccauauagucaguucugacucacauucuucuggcaguggguaugggggagguucuuuggugugggcaccuguaccccagugugugguugguugguugguugguuuuuggagacggaguccugcucuguugcccaggcugaaguacaguggcacgaucucagcucacugcaaccuucaccucccagguucaagugauucuccugccucagccucccaaauagcuaggauuacaguugugugccaccacaccuggcuaauuuuuguauuuuuaguagagaccgaguuucaccauguuagccgggcuggucuugaacuccugacuucagguuauccaccugccucggccucccaaagugcugagauuacaggcgugagccaccgcacccagccuuuauuuauuuauuuauuuauuuauuuauuuauuuauuuucaagacagagucucacucugucaccaaggcuggagugcagucaugcaaucucaguucaaugcaaccucugccuccugggcucaagugauucuccugucucagccucaaguagcugggauuacaggcgccuaccaccacgccuggcuaauuuuuguauuuuuuuaguagagaugcgguuuugccauguuggccaggcuggacucgaacuccugaccucaggugaucgcccuuaagaguaaagauucuugaauguggcuuuuguugggaaaaaaauuuaaaaaaagaaaagggggcucuaggcugggugcgguggcucacgccuguaaucccaguacuuugggaggucaagguagguggaucauuugagguuaggaguuugagaccagccuggccaacauggugaaacuccaucucuacaaaaauaagcugggcauggugguagacgccuguaaucccagcuacucagaaggcugagacaggagaauugcuugaacccgggagguggagguugcagugagccgagauggcgccacugcacuccagccugggcgacagagcaagacucugucucaaaaaaaaaggaaaagggaacucuagccagacuuccuggaugugaauccugugaucaugggcauaucacuuaaccuuucuguaccuuccuuuccacaucucuaaaauagcaguaauaacugucucuggauuaugugaguaguuaauauauauaaguacuuaagacauagaaaguccuguuuuaaguguuguuauuuuuacuauuaaggagucaucuaggcuaaccucucuuuuugggaacuuuucuugucugucugagggaacgugcacauugaacccacuucaguguuuaguagagagccaggcaucugcauuacagauagugauggaagguuuccgagcaucagcugcccaugcguucugaagaccuaaggacaaagugucaccucaucagggcuuguacaggcaucguuuuaggauaaaggcauccuguuuuaaaggguuuuaauuuuaugacguuauugagacaaggcaguguauaugagaggauuuuuccuguucuugugcugcauuucucaacauuuuccaugucgcauaucaaagugauacuuguuuagcauacuggaguacaagaaugaggcugccaguggcuagaguucuuagcucaaggacuccaauuggcccagauucugcccaggugucuggaaggcuagaggaucugcauuucagcauacuuguagccucuuaguggcccacacuaguugggaaguucugcuguuacuaugaaaugguaaaggaauuccacccaaaauccguauguugacuuuuuacccagcucaccuucucuuugaggacauucaaacaguuuacaagaaagagaacugaguaguuugguuuuucuuugguuaaagcauaagaauguuuugauuauucaacccucccacaaaaaccauagacacauccuaccuuuccuggaagucauuuuucagaccuuggugcacacagaugcaguuucuguauuuucuggagugucuucuggaauugcaaucugaucuuuugaacuugaagaaaauccuuugaagacugggcagauaggaauguauuucagaaagguaauucuuuuuacuaugcccaucccaauggggaaaucguagcucuugaggcuggaagacaugucacuguuggcaugagccccagcuuuccacuguaucagaccacgcuccucugggcucccuggaagaggauagugaggucauuuaccaaggccagcaacccucagccacccccacuucccauaacccaguccuaaggcagacuucuggaaucaaguaucuuccuuaacuaucauuugguccuaaaacguggcugaaucuaugguuucugagcuccuaacuuggccagagcucuaaggaacacuaaaggauacuaguuauaguaguauuuauuguguaacuacagugugccaggcucugugcuaagugcuuuaauuucauuaucuuguuucuugaaaacauaccccugggagauguauagacaccauuguacaaauuuuuauuuuauuuuauuuuauuuauuuauuuuuuugagacagucucgcucuguugcccaggcuggagugcacuggcacgaucucggcucacugccaccuccuccucccggguuuaagcgauuauccugccucagucuccuuaguagcugggauuacaggcaugcaccaccaugcccagcuaauuuuuguauuuuuaguagagacggggugucacuauguuggucaggcuggucuugaacuccugaccuugugaucugccuggcuuggccucccaaagugcugggauuauaagcgugagccacugugcccggccuauacaaaauuuuaagaugaagaaagggacaaaaaguuaaguaauugugaaccuaaaucugugaguaugugguaauguguguuaggcccauggggaccaaaucaaguccagauugcguucuggggguaagggaggcauauuuugaaacacuauaaucaguguuaauauuucauauuaugauuccauaugugaaaaacucauuuuuauaauacaaacuucagaaagucaagcuaaauaaaaucuuuggagguagggauacaccaaauaauuuguuuuuuuguguuguguuuuuuuuguuguuguuguuguuuuugagacagagucuugcucuguugcccaggauggaguacaguggguugaucucgguucacugcaaccucugccucccagaugcaagcgauucuccugccucagccucccgaguagcugggauuacaggugugacccaccacgcccggcuaauuacuguaauuuuaauagagaugagguuucaccauguuggccaggcacuggugucgaacuccugaccucaagugaucagcccgccuuggccuugcaaaguucugggauuauaggugugagccacugagccgggcuaguaauuuuuacaacuaggaauucucccucagguggggcagggucacaugagaucucagguuuucacaagagggcugggaucgacaaagacugaaauacuauaaaucuagcaggagugggaauuuccacuugcuggcagcccaggcugagaacaaacccaugaguagcacaaaccaaguuauguuccaaaaucucacaggagagggcacugagggaagguggagucccuagggaagacuaccuggaagagacacuguuugggcuuggcucuacaaagggcacacacagucuggaagagaaaccuugauugggcuuggcuguacaaagggcacacacagugggcacaguagagugggaugagccauagguguggcguaggacuauguuucugguguccgauuaccucgcaccacugccaagacacacauggcagccagcccagagcucccucuagcagaccagucagccugcccacuacaucccaaccuucagugccuucuguacuucuccaagcccccuccuuuuuccuaggccucaccuacucucccucaucaguaaacccucccaauaacuccagcccggcuuccuugacuucauugcuugcuuaaaucuaguuuuaccaccuaucuugugccaggagcuccucuaaacaaauuguuacugacuuacacuuuuuggcauauccuccucagugucugauucagggccaagcugguaagcucuagcagcaugugcugaacuaaacggacugcccucuaagguugggcucuggauagguaaagacaaagagcacccugugucuacuaaaaauacaaaaaauuagccaggcgugguggcgggcaccgguagucccagcuacucgggaggcugaggcaggagaauggugugaaccugggaggcacagccaagauugcgccacugcacuccagccugggcgacagagcgagacuccgucucaaaaacaaaacaaacaaacaaacaaaaaaaacaaaugcaaaauggcccauccccagcaggaaguuaagggcuggaaaaggcuuuugcuauuccaugguuaaggacaggguuuugagccagcuagaccuuaguuugaauccagguugugugaccuuaggcaagugacaaccccccugagcuuuagguuccucaguggauacugaagacugcugagcuuauguggcaugacacacaggaugauuccuggcagggacaguugugaugcucagguggguugaaaugugggguauaagggacucaggcaguucugcagcuguuguuaaggaugacuggauagcuuaaacuagccacccaagucacaaagaagccucuucauguacagaugccuacccagaugcucuccaucuccucauauucccuaggcauugaggcugccacuugacugucucaggcccauaggauggucuguuccagcccccagucuagcauccucuaaaugggcagggguaccauguucaaauagccacccauccaucgaagggacagcugcuaccaagagcaccuuccuuugauucugccuaaaauccuacggggaacccuggcccuccucuguccuccccagccccaacccaccagcuguucagagacagccucugacaccuauguuaugugaacaugaacacuuggaucuugagagagagggaggcagacaggaccuguggcugugaucaggcugguaagugacaaaauggaggcccaucaucuugcuacuaccaucccuuaugucccuauacugaugcagucauuaacucccaucuccauggagccuuccccaguccugcagcccagguccccugaaacccuccagcagaggcaguauggugcaguggaugggacacaggccauugacugcgucagauggauguuguuaaaaaucccagauuuagccagaugguauauagcaugcaccuguacucucagcucuucaggaggccgagacagaaggauugcuugaguccaggaguuugaggcuguaguaugcuaugaucacaccugugaauaaccacugcacuccagccugggcaacauagacccccaucuuaauuuaaaaauagaggcuaggugugguggcucacgccuguaauccuagcacuuugggaggccaaggugggcggaucaccugaggucaggaguuugagacuacccuggccaacauagugaaacccugucucuacuaaaaauacaaaaauuagcugggugugguggugcacaccuguaaucccagcuacuugggaggcugaggcaagagaaucgguugagcucaggaggcggagguggcagugagccgagaucacgccauugugcuccagccugggugacaagagcaagacuccaucucaaaaaaaaaaaauugaggacaggugugguggcucacaccuauaaucccaguacuuugagaggcugagaugggaggaucacuugagcccaggaguucaagaccaaccuuggcaauaaaguaagaccccgucucuacaaaaaauucaaaaauuagccgggcaugguggcaugcaccugugcaccgguagucccaauuauuugggaggcugaggcaggagggucacauaagcccaggaguuugaggcuguagugagcuaugauugugccacuacacuccagucugggugauagucugagacccugucucaauuaaaauauacaucccagauuugcgauguuuuaauuuuuuuuuugagauggagucucacccugucacccaggcuggagugcaauggcacgaucucggcccaccgcaaccuucgccucccagguucaagcaauucuccugccucagccucccgagaagcugggauuacaggcacacaccaccacacccagcuaauuuuugcauuuuuaguagagaugggguuucaccauguuggccaggcuugucucaaacuccugaccucgugauccacccgccuuagccucccaaagugaugggauuacaggcaugagccaccaugcucggccgugauguuuuaauuuugugacuuuaugacuuugugguuuuugaggaugaaguaagacacuuagcucugccuuacccauaguauauguuugcuaaauguuaacuguuuguuaucagagcaccuggugacauuuauuuuauauauuuacuggcaucuuuaugcgggccccacaaaguauccuccacgaucuuugcaaaaagcucugguaccaaagggaaauguuaguggcucuucuagucgccauuguggcaggcugcugacauauuuggaguggauggauuuugccaacaaacugaugcugcauuuaucucuguccuacucugaagaaagcaaagacaucccucagcccaguggcuauuaagaaauggagaggaggccaggugcaguggcucaugccuguaauccagcacuuugggagguugaggcgagcguaucacuugaggucaggaguucaagaccagccugcccaauauggugaaaccccaucucuaccaaaaauaugaaaauuagcugggcgugguggcagccaccuguagucccagcuacucaggagacaggagaaucacuugaacccuccgggaaguggagguugcagugagcugagaucgcaccacugcacuccagccugggugacagggcgagacuccaucucggaaaaaaaaaaaggaaagaaauggaaaaaguggagaggaaaggauucacaggacccagcagugacucuuccggccccauccucuucaagaccucugaggcaugucugugccucauucucucccuccagccagugagcacuccaccagcccaucuauuccugaugcucccugcagggccugcauugcaugggaccuaaccacacagcuccagcucagaggccaucuguuggagugcaugaguccagccuaguucuucauuccccucccaggaccgaaccauaccuggcacuguguugucaaguaugaaagcaaggcacccgcccacaaacaucuccguggucagcagcacaaucagaaucugauccacuucaagaaugccuguggaauaggccaagggccaaugggugucauggcccaaucuggagagcagaguugagggacuuccucuugugcagcuauggcaaaggaacaguacaaagcccugucucaaaccuaucucugucuuuccuaucucuggguucaagucccaauucugccaguugcuaguuguucaccugggacaaaucacugagccucaucuuccucaucuguaaaguugaaaugauaauggagaaaugauaaauguagauaaauggagcuguuuugaaaauuaaauaagcacauguaaaggucaauaucuguccacaggaagugucuuaguaaaggacagcugugacccaagcucucagcugcugguugacacccagaguuggguacgauuuguggcuguagcuguguggagccuuugagggagggggcugugcucaaaauuuugggcccaccccgccuuuggagacaguaaacagcuggaggcaccuguauugauggcgccaggguuggacuccagguaauugggcagcgugagcccgaagaacauggaaaaucccagcacgaagagguugcgagaggaguucauguccacaaauugcagguuggacagccccacagcuguaaucaugccuaagggcgcaagagaacggcuggaggcgccgcacacgcguaauccaggugagucccacucggcgacccgcaccgcgacccguggcccgcgccagacacucaccaaagagagugcagaacaugccccccaggauggggucagggagcgaggagaagagggccgugaacuugccgauggugcccaggaccagcaugauagccgcaccauacugcaccacgcgccggcugcccaccugccggggagccagcggggaagcuagaccuggggacgaggcuggggcgggguuaguuccaggggcggggccuguuauaagagcgaggcauaaaccggcuggggcuugaugcgggggcgaggccucucaaagacaggguggggcuaaaccaaaguggggaccgaguuggggcggggccugcggcccacggaauuagggcaggauuuggcucuggcucgucgcgacaccuugguaauucccaggacgccaauguugggacuggacgagguggacccguugcccgugcccaauagccccgcgaugaugcagcaaaugccuucggugaagaugccccuguaaggaaagggagagucggggcuugguccagccucugcaccagucuguguucccccaucaucuuagcaagcugccguccucuggggcugugggggcugcagcuaucagcuguagcacucccuacuacaggccagaaugcucaggcuccagagcuaguccuagugcccuggcacuuacuccuguggguaauucuggccuucaauuuccuccugggauaaauaccggugcccgucucacaaaaugcuucaaagauugcauaagaaugcacagucagagccgggcacauggagggcugucaaugacggugguucccuuuggacuccaccaucuucucagcuacucccagcaaagacagaggggugaugagagggcacccccaucgcacaaacaaggagaaugaggucuggagcguguucccgacuugccuaagccuacccccugggccuccaccccguuccugugugugcuuccuggguggcgccugaggagaucagauacugaggagggcagguaggcuaccuguugauagcauguacuggaggggguggugcaccagccaggcgggcacaggcguaguaaucuccgauggacucaaugaugccugccagaguggcgcugaacauucccaggacagcagccgcagucaccgugggcaggccccacugaccugugcucggagggagacaggaugguggcuacagugaggagacugugaugguuaggaauagacagggcagugcuggaaggagcaagagcagaucaggagaccucaggcugggaugggagcuauacaguugugggagcuuauuugagucacucagagccaggaagugggacugaagcuuugucuaaguaaaacaccacucugcugggcgcacuauaaaugugcggcuaaugcuaggugugucaccugcuggauuggggucaccaggagucugucucauagguggucucaguugggggcagaggggcccaagggguguugcucacagggguaggggaugcggauccagggugcaauagccaugaugucaccacgggcaucgguucgugccuggaagccauaggcuuuugggucugugggcagcacgucugucaaggucaggacauagcagagcagccacacggucaugauggccagcaugaucugaaggaggggggugagggggcacugaaggcacuggaggucucuguccaggcuaaccugcucccaccucagcccaagcccuggccauagucccagccccagccgccugccagguccucacaggaaacauuuugaagaucuggaugcggaggagagugaggcccuugccccagcgguagacaggcagcaggaaggugagguugcgcagguacugggagaagaggaugaucaggagaauggagcugggggcagaggcacaaucaggaaguggaugggaggccaggcuggggccaggagccgggaagaaggaccaaggacaugaagaggguagggugcuggggcugggcagggaucaggccuggugccugcucaccaagcugagaugccccagugggagccagcucggucgccagcagcuuggaagacagaaaggccaaugagggagacagugggggugacugugagaggcccaauguaguugagcagggccccaggcagccccagcaggccaaucaccaccuccaccacgcuggacaccaugauugcacccuggaccuggaagggcaaacaucagccguaagucaccauguaaaggucaugaccuggcugcugcuagcaggaacaaagcuccuggaccaccuccucaaauccccaaacucagcggccacccucacucccauauagccccuccucaggacccggccucuucuaugcuuacaugcaaacccaccucccguauccgugggugccaaauaugagagguguucaggggcagacuccaguuaccguagaucuccucuggggguagagucagggauacacacacggaccagguacagagacagagagggagagaagaugcugccauggcugcacccugguguugacccgggacaguugcucagaccuccaggucucugggccuccccuuuuccccagugcagaccccagaaguguacccaccuuccggggggcauuuccaucucuccagagccaguauggcuuuggcuggaaccagaaaugcaaaggcacuggccuggaacagcggcagccuggaggagaggcacaaagcaacagggguggggaggggcggguggggaggagggauaaagaugcggggagagaucaggaagggagagcacagagagagugacagagacacaagggacaagggcagauggaaaucguugaggccccagggaagaccaucucuaacauuuuggcugcccaaggaagaaaacaaauggagcccccagcucaaaaccugcccccuucccaccaccagcuccugcacugugaggagggggcaccugcccggaaguggacaccucaguucccgcauccagguuucucucacaaucuuccccugucccccgcugcucaaacagcucaaaugccacccaggccuagggcugugcacucgggagcguggggcccugggagggugggcugucgaagaggcuggcaccaacccugggagcuagcucagggcugccaucugggcaauauucagaaugggguuuaagaggggagagccggcuaggcuugguggcucacgccuguaaucccagcacuuugggaggccaaggugggcagauacaaauacaaaauuagccgggcaugguggcgcaugccuguaaucccagcuacucaggaggcuaaggugggagaaucgcuugaacgcgggagaaucgcuugaacccgggagguggugguuguggugagccgagaucacgccaccgcaauccagccuaggcaacaagagcaaaacuccgucuccaaaaaaaaaaaaaaaaaaaaaaaaagaggggagagccagcgaggguacaaucccuuaaacuugcagaugccuggucuuugaagugugccuagaucaagauucccaggguuggggccacgcugcccagcucuaaggcuggccugggauaggagaagcagguggaggcagaaagcggcuuuuuugucucaccaguguccucugggagcccaccugcuccugcuguguggaucacaguggagggguggcgggggacggguuggggggcugggcggcucaccggaugcccacgguggucuggaugagaguggugaugcccacgcacgugaagauggugccgaugagcugacuaaccaugugcuggucguggcccacacacagcgccucagccagcaggaagggcacggcgaugguaccacugaagcaugucagguagugcugggcagagggagacagcagagugcaugaggcaggaccccagagcuccagggagaggggacaaccuaguguccucaugccugccucagcgggccuggaaccggcugccugcccaggacuggcaguccccacaagggauucccagagagcuacugcugaccacucugggggucacuaauuuccacucaagauauuccugcggcuuccguggagucggcucugcucccugucaccaacaccccaccuggcaagcgucacacucccccagggaguucaucuucuuucaggauucagccucuucccgacuccugcuugcugacagccacugugcugaccucagguuuuucuuccuguuacccaagauacucccugcuggccagggaggggcuggaguccccggggagugugcagagugagggcggggaggcccugggggacccaccuggaagcccagcaggaugcacagguaccaagguggcacguccucgaucuuguacaacaugucaaacuuaggcucuguggguagcggggucgaggggucccuggugguuucaugcuggaggcagcagagauaaguagcuuagggugaagugauggggacaggcaaaauccauucugccccagaaucaaucaggcagcccaaguggcuugucagcaacugagagcgggguucccgcccuccccaacaguccauccacccgggugccacuuggccuggccacaguuuucucccacuuugcauugcuucccgcagggaugagucuacugugccagcuucuagagcccucaggaccugccauuuuagccagggaaguggacccuuaagucagaagucuuggagaccacaggagagggggccaagagggcucaagacuguggacaaguccaauccggucccaccucugcccccuggagauccuuggggugucacuggccgggagauuaggccucuccugaaccccaaccuggagucagccagucccaaagcugcaggcuccuucacccccaccuccacccaucccccaguugccacauucaauuugggacagucacucuuaucaaguucaucagaacguuuaucucuggccuccaggaagaaggccugcacaggcccuccagccccccacccccccugcccccccuagcccccacccccagcccccagcaccuguguccggcccucgagguccuccugggcccucaucuuuggggcacagguuugagcaguuccugaggagaagaggggaugacuugacaaaggccaaggaggaggacuuuacuccacauaucaggcauuguuugaaguaaaucugua

SEQ ID NO: 18510 - RNA, 7355 nt, Homo sapiens
gggcgacggcgaggaucacccccgaggcagccauuuccaacuagcuggcgggggcggaagauggcgacgccccucggguggucgaaggcggggucaggaucugugugucucgcuuuagaucaacugcgggacgugauugagucucaggaggaacuaauccaccagcugaggaacgugguaugcagccagaggaguuuggggagaggcggggccggaugccucacuggugggggcggggccagaaccuguuccgaugcgggggccguggcuagaacgcauggcccauggcgucaucaggaggaggccgggcucagucgguagggguggagccaaaaaggggcggaccuuccugaaccagggaauuuuaacuaaaaucaagccauauucucccuuccguuugccugguugcugcaagagcugguagagagucccugagccucaguuuccccauuuucaguggagaugacgucacugaguucccauggcccuccugugcaggcagagaaacugucaucccuucuauuauggacaccauucccgagagucaaaggcagugccguguugaaugcaguaagcgcagauuuggcccuugccagcgcuaacuuaggggccuccaagaacuuuacaugccuuagcuuuugccuucucaaucaaaccccagcuaaugggugcaaagcauugcagucacagauuaccuggguaggcaugauagaauccuggccaucuggaguucaugguuuuucugguuuuguuuuccugucuugauaagaagguuaggauguaucuccaucucagaaauaaaacuggcuucacaucuacuucucauucuaaguuguucuuagacaauuucuucccuucugggaaguugaaugugggggaaaggggagagagaccuguccuauuugcuacccuaaugcucucauucaacaaaauauauggagcucuaggcacugaauugccuuugauucccugaagguacccaggucuuccucuuggcagcugaccuuggcauguguguccccaccauccagagugcuuuucucucuaucccucuucuggcccacccuauauagcagucagaucucaggucuaacauccccuucuccggaagugauucugacccuuccccaggcuggguuggggccuccucugagccccagauccccuuaugucuccccaucaaggcacacaacauguuagaagugcuaacuguggacugccuccuccaugagacuggcugcuccuugagggcagcacuuagagcugagucucaguuuaucuguggaacugaauucucccuucccaaggccucagucucauccuagguaccacgagcaucauccuguuauccgcuuuugguccuggucccuagagggcgccccuucuacuccagccccaggcccucccucagccaggcucuguugcagaugguucuccaggacgaaaauuuugucaguaaagaagaguuccaggcaguggagaagaagcuggugguaaguaauggccucugcggucuccuaaucuucccccguuucccaggaucccugugguuaggcaggcucauuaaguauuagccucugaugggugcaguggcucacaacuguagucccagcucuuugggaggccaaggcgggcaaaucacuugaggucaggaguucgagaccagccuggccaacauggugaaacccugucucuacuaaaaauacaaaaaaauauauauauacauauauauauauuagccaagcaugcgugguggcaggcgccuguaaucccagcuacuugggaggcugagacaggagaauuggcuugaacccaggagguggagguugcacugagcugagaucaugccacugcacuccagccugugcaacagagugagacucugucuaaaaaaaaaaagaaaaaagaaaaaagaaaggucggccucugagaaccuccagccccuguagcaagguggccagaaucucccugugcucuggcuucugugugucccucugagaaggggggcugguuaagggagucuaggagacccaaggcggccuaggguaaugaggugacugcugcugccccugcaggaagagaaagcugcccaugccaaaaccaagguccuccuggccaaggaagaggagaaguuacaguuugcccucggagagguagaggugcuauccaagcagcuggagaaagagaagcuggccuuugaaaaagcgugagugggccucaguacggggugugggguuugggggaugcaucugcuugcuagccugcccacccucccaucuuaucuuccccacccaggcucuccagugucaagagcaaaguccuucaggaguccagcaagaaggaccagcucaucaccaagugcaaugguaggcgggaggcccgugcucuccaccacgguuauauaaacgggcucuuuccuaaccacccagugccugugucaaaggcaggguuucacucuaacaccuguccccagcugaggauacaggcaggcccgggugggccacaccuucgaaaaggccuuaagggaccaggcaggccacggaaaugagggaagcagucgguguacuauauucuucaccgccauaaaggaaugggcuugcucccauuuuuccugaaacauacaaccuucuuaguccaccuuuuguuuucccacuuuugauggguuacuccuaacugauacaagaggaacacagggcaagcacuguccuauuugggaccugauccuuagucucagggucaggacucaauagggaaggaugcauguggugacagggggcuaggauugccagaucuuuaaaauggaaacuaagaguuauuuuuauuuuucuaagacugggugucacuaugcugcccaggcuggucucaaaugccugggcucaagugauucacccaccucagccucucaaguagcugggacuacaggugugagccaccaugcccagugaaaccaaguuguuuuauuuuuuuugagauggagucuugcucuguugccuagguuggagugcgguggcacacggcucacugcaaccuccaucuccuggguucaagugauucuucugccgcagccucccgaguagcuaggauuacaggugugcaccaccaugcccggcuaauuuuuguauuuuuaguagagaugagguuucaccauguuggucaggcuggucucgaacuccugaccucaggugaucccccaccucagccucccaaagugcugggauuauaggcgugagccaccgcacccagccaaaaccaaguuuuaauggaagcuuuucugacuuuuuaguguuggcaguugauuuugaaauuuuaaaacuaucguguaggccaaguaaaauaucugugggcugccaguuuucaacucugcucugugcagaugccugggggccacuuuuuuggcucaguuggugccauaaguuguggggcaccuucugagucagcuacacaugcccguacaccucaggagccccuuucauuucccggaaugcuaaacuccccuuacccaguuuaaguaugggcugggcgcgguggcucaugccuguaaucccaacacuuugggaggccaaggcaagcggaucacaugaggucaggaguucgagaccagccuggccaacauggugaaaccccaucucuacuaaaaauaccaaaaauuacccgggcauaguggcgggcaccuguaauaccagcuacucaggaggcugagacaggagaacugcuugaacccaggaggcagagguugcagugagccaggaucaugccauugcgcuccagccugggcaacaaaagugaaacucugucucaaaaaaaaaaaaaaaaaaaaaguagguaugaauuccaggcacaacaucugcuuuguucacugcagcagaucuccaguaggccagagcccaagcgcaagagguucaagguccuuacugauggggcucccauguggagccuugaguacccugccuuucaccuguucagccuucucucuccccuagugagugcucucacugggaagauggcagcaggcugacaucuugaucuggccaggcaggcugacaggucucauaguaguuuggucacuggcuccugccauggcagggcgcaacaggcagucacugcccccaugcucgagaccauugguccccucagucuugcccucucccugggcauccccuuacuucccaaaaaagaaccugggguucuuuccugguagggccagagaccuccuuccccuaggucauuuccuuccaacagagaucagucaagcucacggggcuuuggaucugcuuguuggaaggugugugugucauggggacagguccuggcugccucccccagaauauucuaaaccccuccugugggacacaagcccuccugagccagucuggugaugugaaccucacccuggccagugccucccaccccuacaaacuccccuugugugguuucaguuugguuuuuacacuuacauaguucuuuacucucaaagggauuuucuaaccauucucucaccaucgggugccacaggcuuuuauuuucaaagagucacacaaauuucuaauucuuuuucccaaacgaacuucacaaguaauuaauuccacuuagcuggacgccugggaaggagguucaacaguccucgucccaugacccggugaacucaugucuucauucucucccuucaccugucuccucuuuuccaugcugugccuucacuuuuuaccaggucuucucuuuugaaaucuuaaaugcuuagacauuucuguauuuucagaguuuguguucuaguuaauucuuguccaaccuuuuuuuuuuuuuuuuugagauggagucuugcucugccgcccaggcuggagugcggugucgagaucucggcucacugcaagcuccgccucucagguucacgucaucuuccugccucagccucccagguagcugggacuauaggugcccgccaccacaccuggcuaauuuuuuguauuuuuaguagagacaagguuucaccguguuagccaggauggucuccaucuccugacuuugugauccacccaccuuggccucccaaagugcugggauuacaggcgugagccaccacgccuggccuuuuuuuuuuuugaagcggaaucucgcucugucacccaggcugaagugcaauggcacgaucucggcucacugcaaccuccgucuccuggguucaagcaauucuucugccacagccuccaaaguagcugggauuacaggcaugugccaccacacccagcuaauuuuuguauuuuuaguagagacgggguuuuaccauguuggccaggcuggucucaaacuccugaccucaggugauccacccgccuuggccucccaaagugcugggauuacaggcaugagccacugugccuggccccuuguccaaccuuugaagacaguaggauuuucuuucuguaggaaucagaauuuuccaaggugccauguggggcaguuauguaaaugaagcacccccagaucccuacagccuccuuggauuuugauccaacacagaaaaauuaucauuuauuuauuuauuuauuauuuagagacagggucuugcucugucacccaggcuggagugcaggggcacagucauagcucauugcagcccccaacuccugagcucaagugauccucuugccucagcaaguagccaggacuauaggcauguuccaacaccaugcccagcuaguuuuuuguuuuuuuuuuuuuuaguuuuguagaggcgaggucucacuauguugcccagacuggucucuuacuccugggcucaagccauccuccugccucagaaagucaucuuugccucaaauguacgauuaauuuggggguaggcuuugccaccacuaucucacuggguccuccccagaccacugugggauagggcugucucuuuccccaucuuugaaaugaggaaacaggucugaaaaucgaggcaacucccaucuucucccaccaccccugaagcccuagcacaaggcugggcauccagccagcccucgggaaguuuguuuggacugggaugacugaacuaggucuuuuuucugaguccuaaacccccagggacaucccguucauucggucugcaaauauacuuuuuguauaccuacuaugugccaggugcuguuuuaggccuuagggauaaagccgugaauaaaacaaagauccuuguccuuguggaccuuacaucccagcagcggagaagacagaugaguaaaguauaugguauguuagguaaaaguguuaagaaaaauaaagcaggauguugggcaugguggcucacgccuguaaucccagcauuuugggaggcugagguggguggaucaccugaggucagaaguucgagaccagccuggccaacauggugaaaccccaucucuacuaaaaauacaaaaauuagcugggcgugguggcaggcgccuguaaucccagcuacucgggaggcugaggcaggagaauugcuugaacucaggagguggagguugcagugagccaagaucaugccacugcacuccagccuggcgacagagcaagacucagucucaaauacaaaaaaaaaaaaaagagaaagcaggaagagggaacaggaaguacugggaaauguaauuuuuugaugagggagaguuucuccaaggaggcaacaucuguaaagaccugcaggaguugagggcaggcgccauucaucuuccagccuuuggucaggccugcccacuucucuccaaggaccuucuccugcccucauguggguccucugguccagaauagacuugugaagucauugacaacaauccucaaacacugcacucccccaagacugcauaauaaacucauucauacuaagguauuagcaguucuucauggagaacucuuggguggggagccaagcucugaaaagccccgugagggaaugccuuaucucaggaaggagcccugggaugggaaccaccccuccucccugccucucucccccacagagauugagucucacauuauaaagcaagaagauauacuuaauggcaaagagaaugagauuaaagaguugcagcaaguuaucagccagcagaaacagaucuucaggugaggggucugggcccggcuggggguuguugaugacacuggggagccagaccucuggccccuaccuacccuuggcuguccacagcccaccaccagccggcuccguugcaggaaucacaugucugacuuccggauccagaagcagcaggagagcuacauggcccaggugcuggaccagaagcauaagaaagccucagggacacgucaggcccgcagccaccagcaucccagggaaaaauaaaauggccgccgcuuuccuguucucuggcuguaau

SEQ ID NO: 18511 - RNA, 7235 nt, Homo sapiens
cuuuauaaaaauagcucuuguuaccggaaauaacuguucauuuuucacuccucccuccuaggucacacuuuucagaaaaagaaucugcauccuggaaaccagaagaaaaauaugagacggggaaucaucgugugaugugugugcugccuuuggcugaguguguggaguccugcucagguguuagguacaguguguuugaucgugguggcuugaggggaacccgcuguucagagcugugacugcggugaguguuucuaaacacccuugguuuggggguagcaaagggcaauggaauggaggcuuucucaaaccucaccccugaccccaggacucaggcccagcucaucagggcuuugagggaagguuccuaccucccuuccugaggaacaggaaauacccuccuucccagcaccaguaaagcugcgguuuggagaaacgccagggcuagaguguuguggagaaaccaaucguuguuaacaucucauuuucaggcugcacucagagaagcugcccuuggcugcucguagcgccgggccuucucuccucgucaucauccagagcagccaguguccgggaggcagaagguaggcucaagaucagccuggcagaacgccaaaccuagggccccuggcacccagaggcgagggggugccugcuggcugcccuguccccacucccugagcucuguuuuccacuuuguugacuaagguccucccugggguggguuccggggacaggggaacccagguccccaaggguucuugguuggguacggcugcacaggacagcuucaagucugggucugggauaguugcugccuucuuucuucaccacaccuguggucucccugggucuugguggggcguguaugugcaggcccugcucuguuuucagcaaaccucgcugagacaggagcuuuggggugacuuauucccagccugccuccuagaggugucucuaagagcagccucugggaguggcugggcaccagggaaaggggaacugggaggaagugcccagccagagccucagucccagaagggcaggagggcaaggggagaauggucauggauuucuuggugcccacagaugccccacuccagccugcauccauccaucccgugucccaggggucacggggcccagaaggcagccuugguucugcugagugccugccuggugacccuuugggggcuaggagagccaccagagcacacucuccgguaccuggugcuccaccuagccucccugcagcugggacugcuguuaaacggggucugcagccuggcugaggagcugcgccacauccacuccaggugacucacugcaguacccagggacgggguauccaacgugugucacucccuugaugccuagcccugccccuccuugaaccucucuggcugagcugggcugggggcuggggucuggggucuggcugucacucacagguaccggggcagcuacuggaggacugugcgggccugccugggcugcccccuccgccguggggcccuguugcugcuguccaucuauuucuacuacucccucccaaaugcggucggcccgcccuucacuuggaugcuugcccuccugggccucucgcaggcacugaacauccuccugggccucaagguaugacacagggggagguagaagcucuggccaagugguggcuguggcuggugugaccugcccugagcugaguacugggagugggacugguuuaaaggcuggaguccauggaguagaaccuauaauguccuggaacaguggguuuggcaauggcaaaagagggaucaagucaggagcagguugggaagccuuggaggaggaggaggaguucucuggguguccuugauggaggccccccagccacauccugcuguccacagggccuggccccagcugagaucucugcagugugugaaaaagggaauuucaacguggcccaugggcuggcauggucauauuacaucggauaucugcggcugauccugccaggugggccauccucucugcccccauuucucgaucuacaaaacagacacuaagacacacagccucuuguguuucuaaacacacagaacucacuauauuuuucaaagcauuuucaugucuaccaaauccuuuaaucccaaggcaugaaggauguugcuaugaugccuaguuugcagaaaggaauauggggcuuagagccauuaagugacuugcccaaggucacuugugaauucuuuuuuuuucuuuuugagaaggaaucucccucugucgcccaggcuagagugcagugguaccaucucggcuacugcaaccuccuccuuccaaguucaagugauuauccuggcucagguucccgaguagcugggauuauaggcacccaccacaacgcccggcuaauuuuuguauuuuuaguagagacaggguuucaccguauuggccaggccgguacaaacuccugaccucaagugauccgccugccuuagccucccaaagugcugggauuacaggcgugagcccagcuguaaauucuuucaauaaauauuuacugcaugcugugugcucucaugugccuuuucuaauucacacccuaugaggaaggaauaaucuuuauuccuguuuuauuuuauuuauauauuuuuuaaaaagaagaggguuuugcuauguuacccagccuggucucaacuccugggcucaagcaauccuccugccuuggcuucccaaagugccgagauaacaagcaggagccaccaagcccauaccuauuuuagauuuuuuuuuuuuuuuuuuuuugagacaaagucucacucuguugcgcagacuggagugcaguagcacaaucucagcucacugcgaccucugccuccuggguucagccucccaaguagcuggaauuacaggucccugccaccggcauggcuuuuuuuuuuuuuuuuuuuuuuuuuuuuguauuuuuaguagagacaggguuucaccauguugcccaggcuggucuugaauucuugaccucaaguaauccacccaccuuggccucccaaagugcugggauuacagacaugagccacugcaccagccuuagauuuuuuuuuuuuuuuaagauggaguuucacuuuuucacccgggcugaaguagaguggcacaaucugggcucacugcaacuucugcuucccagguuccagugauucuccugccuuagccucccaaguagcugggauuuuaggugccugccaccacgcccggcuaauuuuuguauuuucaguacagacgggguuucaccauguuggguaggcuagucucaaacuccugaccucaggugauccacccaccucggccucccaaagugcuagaacuauaggcaugagccacugugccuggccuuuuuuuuuaagugcaguucugagagguaaagugauuuauccgauaucacauagcuuagagagaggaagagaaaggauuugaacccagguuuguccagagccuggacccuagaccacugcaccguggagccuguguuuguuguuguuguuguuguuguuguuguuguuguuguuguuguuguuguuuugagaugaagucucuuucuguuacccagccuggaguacaguggugacaagaucucagcucacugcaaccucugccucccagguucaagugauucuccugccugagccucuugaauagcuaggauuacaggcacgugccaccaugccuggcuaauuuuuguauuuuuaguagagacaauguuucaccauguugcccaggcuagucucaaacuccugaccucaaaugauccaccugccucagccucccaaagugcuggauuacaggcgugagccacugugccugcccuaagccuguguguuuuauucuucugacuugcaggcuaaagcggcagcucuuccauaucucauugcuaucuccuagggcuuccgcuaggagacugaucuggggcuagaggccucccucugugcacacgagaaugcuggaaaugucaccucucagggcucugccugccucucagcccugaaagccaugguggaaagggguggcgcugacauagacaucugaggaaagaagugagggaggguaaaggguggugcaguaagaggagggguggggagggcuuuuggaggcgcugccccuccuggccuccuguacaaugagagugcacuggacucuccauucucuggcacccacacacugcgggggccaaugaccugggucucacuccugaaucaggugggagauaggguuagcaggaauaacuucuugggcuucccugccucagagcuccaggcccggauucgaacuuacaaucagcauuacaacaaccugcuacggggugcagugagccagcggcuguauauucuccucccauuggacuguggggugccugauaaccugaguauggcugaccccaacauucgcuuccuggauaaacugccccagcagaccggugaccaugcuggcaucaaggaucggguuuacagcaacagcaucuaugagcuucuggagaacgggcagcggguaagugugcaggggagugggggucucugaggaggggucaggaccccagaacccugggcccuagccaagcacugaugaaaauucacugcccuucucugagcuguagugucccuagcuggucccaggucugggcaggauucagcucugaaugauaaugaugaguaacauuuaucgagcacuuacuacaagcuggaugcuauucugggugugucaucugaucaccucauugaauucucaccaccacccuaugggguagggacuguuagcauucccacuuuacagaggaggacacugaggcucagagacaccguaggaaaguggacgauuuaaacuugacuguaccaugcucuugaccauaaagcugccccagacgaaggcugugagaacaucugaaggauucaugugggugcaggggaacccagaccagaguugaacccagagccuagccccagaccugauucccagcuggagcaguugacagccucgggucuugcccuaggaucuuggaagaaggaucugugaaggguaaauuuagcccagccgugucccugauuucagaguuggguaucagaggcaaaggcaggccagacagcauagaccccauuaggguggccaccucccaggacucuaucguuacaggcugagggaguggggccucagcccguggcacugggggccagagccuggacuggacccuccauucuccauccgccuggccccuggcuuagucuggucuuccucuuaccuccucuaggcgggcaccuguguccuggaguacgccacccccuugcagacuuuguuugccaugucacaauacagucaagcuggcuuuagccgggaggauaggcuugagcaggccaaacucuucugccggacacuugaggacauccuggcagaugccccugagucucagaacaacugccgccucauugccuaccagggugagggguugguagggugagggguugauaggcuggagggcaggaggagucaggggucccagggucucccaaagagucagaaggggcuauggagcaccaugcccugggccuguccuuccuucccugggagaagcccccucuucccagcacaccagauugcuuuuuaggucuuugacuguaaucccucaggggagccugaagagguggguucuaggggccucucacuucaucuaggauuccagaggaaacagaagagucccaggccaguauguacugggcacaggagacuagggcugcagccucggcucuacuacucccucacugugugaccucgggcagguuucugcuccucucugagcauuagcuuuaaaaguaagaggguggaauuucauucucucugaaaucacuuuuuuuuuuuuuuuuugagauggagucucacucuguugcccaggcuggagugaaguggcucgauuucgggucacugcaaccuccaccucccggguccaagcgauucuccugccucagccucccaaguagcugggacuacaggcgcccgccaccaugcccagcuaauuuuuguauuuuuaguagagacgggguuucaucauauuggccaggcuggucuugaauuccugaccucaugaucuaccugccucggccucccaaagugcuaggauuacaggcgugagccacugugccaggccugaaccacuucuaccucuaggauucuaugaaacucuagucccaguggcuggggcuuggguaggaagggggguagggaggguuaggggaucuucccagcaaguucucuagguauguuugagugggaauggguaagauccucauuacucucuccccuaucucccuguuccagaaccugcagaugacagcagcuucucgcugucccaggagguucuccggcaccugcggcaggaggaaaaggaagagguuacugugggcagcuugaagaccucagcggugcccaguaccuccacgaugucccaagagccugagcuccucaucaguggaauggaaaagccccucccucuccgcacggauuucucuugagacccagggucaccaggccagagccuccaguggucuccaagccucuggacugggggcucucuucaguggcugaauguccagcagagcuauuuccuuccacagggggccuugcagggaaggguccaggacuugacaucuuaagaugcgucuuguccccuugggccagucauuuccccucucugagccucggugucuucaaccugugaaaugggaucauaaucacugccuuaccucccucacgguuguugugaggacugaguguguggaaguuuuucauaaacuuuggaugcuaguguacuuagggggugugccaggugucuuucauggggccuuccagacccacuccccacccuucuccccuuccuuugcccggggacgccgaacucucucaaugguaucaacaggcuccuucgcccucuggcuccuggucauguuccauuauuggggagccccagcagaagaauggagaggaggaggaggcugaguuugggguauugaaucccccggcucccacccugcagcaucaagguugcuauggacucuccugccgggcaacucuugcguaaucaugacuaucucuaggauucuggcaccacuuccuucccuggccccuuaagccuagcuguguaucggcacccccaccccacuagaguacucccucucacuugcgguuuccuuauacuccaccccuuucucaacggu

SEQ ID NO: 18512 - RNA, 1645 nt, Homo sapiens
auuuucagaaccacgugccaaacaccaugauaggcguugaacguauuuuguaucaauuaggccucacaacaauuccauuuugcugaugaggaagcugaggcgcagagagguggugacuuggccgaagucacacagcuaguaaguuaucgaggcggggcugggcucugacuccaaagccagcguuguuagccucggguggucgcgucuuagcaagagcucugcaguugugcgccaauauaggucgauuacccagggcauccacgaaugcagagagccccuuggcggcgucuugccgcacguguucuugucuugggguugggcacguguuucguggugcagucccgcguguuagagcccggggacagagguauagccuagcgcacuggugcccaggugcgccauucgcgguugggaccuggcagagucauauggcuggggccugagccgcgagcagggcggagcgggggcggagaacucggagcugaguccacgcgggccgcggcgccugggaggccgcaaucccggcgccugcagccggcgaggcgcggggugacgcgcgggggcccagcuaccgugaccuccuccgcgguugccauggagaccgugcacuauaaauaaaaaaaaaaaaaaaaaaggaggaggaauuucaaacccguuuucuacggcgcuuggcgggaggggggaggaaagcucucuuugaaucgaguuucccauuucaccuucccaggcggcgggagcgcuucccccgcagcccagccgggaaauugccgccccucacgccgcguggcgcccccugaggaagcuaauuagcgcagcccagggagcuggagacagggggacagagccccggggggccaggacccgccucuuuugugugggggggaagcgccuacaaauugccccccaucucuccaggcgcgcgcagcccagcgcgggccggggcaccgggcgcaggcgggaggucgcaucugcagcuuuggcgcaaugaaucaggcgcggccgccgccgccgccgccgccgccgagcgcgucuggcauccggagucucccgggaucgaaaauaauuugggcaaagcggugggaggugugugcgcgcgcgcuccgaggggagggcgggggagcaggccgggcggggugcgcggggcggggggaggugccauccgacagccccgcuguggugagaacagaguugacacuucuuuccuuuccacuuacugcggcaaguacugcgaggaagcuuaacccucucgcuacuuggaggguuagaggcgcugggagcgcccucaugagggcgcgccguagggguggguuccaggugugcagacuccuuuggggugggcuauuguagcgggcuggaguuagccuucuagcuccucagacgagcgcuccuacccgacauuccucaaggcauccuucuggggcuuucuuaauccuuccguuugccuucccugcaucuggcuagugucagcgcuauggccucaguuuccucaccuauacaagaggguggggguucuauagcagcuucccugucggucuggugacccugguuucgugucgcucucucuggcuugaucccugggccuggcaggggugagccgguuagggcagccgggggugcaggagucagaaccugacccuccuugucu

SEQ ID NO: 18513 - RNA, 195422 nt, Homo sapiens
gaugcggcagguuugcugcucagcgcugccgccgccgccacuggagaagggucggugcagcagcuacagcgacagcagcagcagcagcagcgagaggagcagcagcagcagcagcagcagcagcgagagcggcagcagcagcaggagcagcagcaacaacagcagcaucucucgucccgcugcgcccccagagccgcggccgcagcaacagccgcagccccgcagccccgcagcccggagagccgccgcccguucgcgagccgcagccgccggcggcaugaggcgcgacccggcccccggcuucuccaugcugcucuucggugugucgcucgccugcuacucgcccagccucaagucagugcaggaccaggcguacaaggcacccguggugguggagggcaagguacaggggcuggucccagccggcggcuccagcuccaacagcacccgagagccgcccgccucgggucggguggcguugguaaaggugcuggacaaguggccgcuccggagcggggggcugcagcgcgagcaggugaucagcgugggcuccugugugccgcucgaaaggaaccagcgcuacaucuuuuuccuggagcccacggaacagcccuuagucuuuaagacggccuuugccccccucgauaccaacggcaaaaaucucaagaaagaggugggcaagauccugugcacugacugcggugagucgcccccucccuuugcuggagaaaggggggaggggcgaggugguggagaauggggguggggcggggaggugcugcaggugcccgggccuggcagcguccgggcgcuggggggguggggccgccccugggcagggcgccuggcacgggugggugaggggguugggguuggagagaagaaggaucaggcucaaagugugccagggguggggggcggagggaggcgcuggccugugccagcggggaucugcggcugauguauggcauguggggcuggaaagcugccaucauagcccaguagcggaaggaaaaacggagagguccuggcggugcuggccugaggcucagugagucaggagugacccucggaggccuugccugcccugcugccgcgggccugccgugcccaggcuggcagggucugcgggagcagcugggcagacucccaggcugugaaggccuccgcuuacaaguucuccuagggaauggucgcccccgcccccuccuuccucuccugggcucguugcucugcucauccacaccgcuggcgcaggcagaguuggacuuuuucugcuacuguuuuccguccuccauguggcuccaguuuuuuucuucaucgugauugccugucuuugcuaagcagguagcacauccuucucuuaagacuagcaagcagacaccuuuuuuuuuuuuuuuuuuuagcuguuucugggggaauuacaaggucuguugauugugaugaugaugaaagagaguaacuucugcugaaugcuuuaaguucagcucuaacgucuuacucgccggauguauuugacugcaucucucaucuucaugauguuggaugcugcacaggaaugcaggugauuagaaacaaaacacugaaaucuguagaucucugcagcugggaauggaagucucccaugucaaaagucaaagaaaugucagucuaagagcuuuuucuucuugucccugaauccaguacuuacuucuuaguaagauauuucaaaucaaauugucccacacuggaguauuugguguaagccugucucgugcuuauucaaauugagguuucguuuugucccaacuaaagcugaauuuguuggcaugcgguaugacuugcuggacuguguaaucgcugaauuaugauagauguccuguacucucauagaaguugguauguuuaccaguuuuaccaacugauucuggguaguguagacaggcuuuguuugaguagcaaaauauguguaacagcuuauaguaaguuuugcugccuucaucuuucuagaucgauaccuaugauuuuuggaagcuuuccucccccacccccuucaggaggcaaauuuuaggaguuuagugaugggaguauaucuagacacuaacuauguuaaacugugaucacuuuaaugagaagaaucuuggcaaugucuuaauaaggaggggaaaacuuugggggauaacagcaguuuaucgcucugacauuauccuuaggaauauuguugacugcuuuuuauuauugguuuuauguucugaaauguuuuauaaagacaaguagagaccagcuaagaauuucuaauuuuuuauucuauuaaguauuuugauacuuggggaguauuaaaauacucugagaugccuuggggagcugugaaacaguauuguacaguggaaaauagauaguaaaaauauuuauugaaucuuguccaaggacagcuucuguuugguuguuggugaguugcuccugcauuugcacaguguacaucuccacauaaucccuagucugggccgcugaggacuugauggucuuugucagauaaccccauagaguaacuggcuucucugcucccuugucucccuccuccuacuuucuccuucccccaacacaauacaccuuaucaauuacacauuguuuguucuaguggguauucaguagcuuaacaguugaaugcagaaaucaugaaagauuugaggggcagaaauauggucuguuucuagguuaugaucaucucauauuaucaaaauagcauguguaguauaguucuuaaaaagauacauuuagaacugcaaucacugguaaaggaagggcccucacauaucacaaauuaucaaggaucaggaauguguauggcaguaaacauuuuagaaugcaaaaaaaaauugcuuugaauugauauucaaagggaaguauauaaauagguaccauuuuggggagccuuauauaaggggauuagaaauuaaaggacauauuugugagacuuguggaauuggugauaauauaacagaagagcauaaacugcauuuucuuguuuucuacuaugugguuaaagaaaacauguacugguaaugcuauauuaaauaaggaaacaaaaucauccuaacuaaccacaacacuguccuugugcuuagcaggaaauaacuaacaaauucauuuucuguuuucuauucuaaagaaagcccucugggccacagggucauugggaacauuuucuccuuggagcagauuugcccauugcaaaauagggaaacuggcacuuggaaacugucgucauggccguuacauugagcaacugagguugcauuguugcuuuguuuagcuaguuucaggucugaguguguguagguucugagaggugugguucucugggaagucaccuagaaagcccguggguuuuuuuuuggaggggggcaaaauauggagggauaauauuguguuuaaaaauuggccucaggagcaucaaugcaggaggucacacuggaccucuucuuaucaguccucauaaauggcucguuuccaccaugaaauguugacuugaagucugugaucuaagguggggaaagguagacaggggucuuucuggaagagcaagaccugccagagugauauuuuuacauaucuaauguguaucauuuauccagaaagaguacaucuggugauagaguugaguaaaaucuuugcauuucuuagaagauugcauuguauggagggagguguuuucugugccuucuguggaaaggcgaggaaaaagaguuagaaaggccuugcagggauuagcaauucuguacaauguuauaaaaacaucauguucugcaaauaguccugcauuuuaaaagaugguugcauauauuuugguauaauuacacccuaucuuguuguuuucuuauauucauguuuuuaagcaguuuccuuauugaauagaugcaguaaauagcauaaaaaaugaagaucauuucuuucuuugggauuuccugauuagcaguuuuccaguguauaguguacuuuguugcuacaaggaaagguguauuccuaaggauuuuuacauucuuuaggauaguuuuaaauuaauguggcacccagauucacauauuagagaaaggugguucacaaaauucaguauagcaaaagcgacuacauauuuuuuaaaugcuguuuauuuaaagaaucuuuucuuccccagccagcuggaaacccagcugugcugcagcuugaagaugggaaagugaaacuagauuagaaacugaccaguccuagugaugaggacaaggcaugguuguagauuuaacgauugaauuaccacccuaaugucauuauuucuuguaguggcugcuuuccucggcagacugcauucuugggguaggaacaauagcuuaucuuugaggucuucuuucuccuaguucuccugcccugccgcguuucguacuuugccugguuuauagaaggacucuccaucagugucauuugaauggauaaagucaagugaaguuaaagaaagccuccagauuaaaacuaaaacaaucuuaacucucugaccugugacaucaaguccugugcugaaaagcugaguuugaugauagccuuuaccugucgcuaugggaaccuuucuuccgaaagaaucauuaucaacuagaguacuuaaccacaaugugcuuaaucauugugcugauuaguguuaaugggauuugagcacuggagaauaaagaucuugcuggaaaagacccucuuauuuuuuuuucuuuuggaagguagauuacuacuugcccacccccaaauuuaaacaaaaauaaaacaaccgucgguuugaauuaacaaacaguuugagagcuagggauggugguauauuaacaaucuaggugacuaacuuccucucggccccuaaucaaagcaagugugcuuccccuuuacuauccuguuuuaucuagggcauuuuaauuuuauuuccuaauaucaauuaguuuuuucuuuauaaaauuauauuuauauuuuuggagcuguagcacauuuauauggcucaaaauucagaaaauacauaaaaauauaugaugaaaaguuuccuucuuaaucccuguucucagcuaccccgcuuuaaggcucugugguaaaauauucaggaauaauuuauucuugaaguguguguuucucuaaaaacacaauguuuuucaaagcagucuuuuuuuuuuuuuuuuuuuugagauggagucuugcucugucgcccaggcuagagugcaguggcacauucucagcucacugcaaccuccgucucccugguucaagcaauucuccugccucagccuccugaguagcugggauuacaggcacccgccaccgcgcccgauuaauuuuuguauuuuuaguagagacggguuuucaccaucuuggccuggcuggccucgaacuccugaccucgugauccacccgccuuggccccccaaagugcuuggauuacaggcgugagccaccgcgcccggcccaaaguagucuuaaauuuucuuucaacagagggagaauguuaauuuugccauuaagccaauuuugugguaaauucuucccagguaauacauauuuucuuaaccuggcccaagaucuuaucuaccuaguuccagugaucucugaguccucuaucucaaguaucuauuaaaggauccucuuuucuccucaauaccuuaccucacaaauauaauucuggacucaggaaugaaaauaccaacuuauuuuucagauacuuugccguuaaguuuucccugacaauacauuguauaagucuuaacugggaugcucaaaggagagauccaaagguuuaucacugagauuuagggcugcaucucaacccauacagcaauucuuauuguuucacacgcuuggugaucucacaguagaguccaugugggagaucacaugauuucacagacaaaaagagaaaacuccacagugcaugauugcuuugauuuucauucagaagacagagaccgcaguugucaaugaagaguuugauuuugaccauauucaugcacagcugguacaaucccagggaauuuagcuaccugaauacuguucugaaguacguuuaaaguaacugauuggaacauaguguuaaaauuucagaggaucagggaauugccauuuggauacauaggaaaaaaguaaauaugcaaauaucaaagcagcagaagucuuaacccucuaagcgcuguuugcuuaguggcauuuggcaauuuugaaaauuugugaaaggaauggugauaucaguaucauugaaguuuccccagugcaguuuucaacaacuuguucuuagaucuuucuuugcaagaucugaagugcuguuaguauaauuugcacuaaaaguaaaagaaauuucccccaaauuuuguguuuggauggauggguguauaugguguggggauuucugucuuacuuguugcuagcaaauuaacccucuccucccacuuacuuuuucgaauuuguacauagaaauaaguccaguuuaugaauuucaagagaugauacaggcaacucuuuaggaaacuagggaaaguagaugaauuaaucgguagaagugcuaaauuaugacaaguuugaacaaugacuuuuauauuuaauuaaaguagacuucuuuaaaaacaguaauacacgcagaugaaucuugcugaacuagagcuccaugucagguuguaagaacugaagcacacauagaggacgauuaaaagguauuaggaugacaugaaaggacauucuguacccaggcaaagagcuaggaagcuuuugccagucuggggucaaaagacaaauuugcacuuauggagugugauuaauugcugcuaaucagcuauaauguuuuugauaauuaugaaaugaaguuaaauuaaggagccuuccuucucuggcuaguugggagaguguggcauaugagcuccauucuacaguaacauucccuucccacuuuguauaugcaggaagauccaaauggccucuccagggaccuucucugggacagaggccugacacuuccggagccugucagcucugcucuaugccucuguucaggaccugauugugcugcuagccuccugaguguggggcaggacuggugguuaacauuucauuuacccuugcagauguuucuagagcagcagaggcacagguacuguagaaaguuucuguauucugcaagcaacgcagaccuccaagaugugaugaucagauuacuuuuuuuuuucucuccccagaaacagaauccacagugguucuguuuaucauucacaguuuccugcccugugcugaggacacuggcucccuuacaccuucuuucccugaucuguuauauaaagacugaggaucugucuuuguccuuuaugcugggauguuuuacuuggucuugaucuugauauugauccaacuaacagaagccaagcugaauugacauuccucagaauugaaugagaggaaggucacaaaauggcuaaacaucugguccagcccaugcaaaagucaggacaucaugaauucuauugugacagugaugcaauuugguaucccaaaaguuuuauuacaaaaauaacuuucuuuuaauucaaucuuuucaauguuugcuucaacaaauauuuaaauauauauucuguguaaagaacaaguuacuuuagaggagcugcaucagauacagucaccaucauugaugagcuuacaaucauauaacaguaauuuaacuuagaauaugauaaacacuguaaaauaugccaacauagugcuuuugggaggaggagaagagucaaaaaggaaagaaagauaauaucugguuagaagauuaaagaaaguuucuuggagaaguaguuugagaaggguuuccaauaaucagagauaguugaggugagaguaguuuggggauagagaugaaucaauugauuauuucaugcagcaagagcagcauucucaguagcagaggggggauguuuauggaauaauaaaaaacaaaaaacaaaaugaaaggggaaugaaaaugaggagccuggagagguagauuagggugauauugucuuccuuucuuugcagagauaggguuucgucauguugcucaggcuggucuugaacuccugagcucaagugaucuucccacuuugaccucccaaaguccugggauuacaggugugagccacugcguccagccuagggugauauuuuaaucagucuugaaugcuagacugauuaauuauucuuaauuauguaaguaguauuugaaggcuuagguuaaaaguaacucaguaacauuuuguaguucagugaaugggucuugcacauauuucguuaaauuuagcuggaaguuucgugguuuuuuuugcuaugguauucuauucauguuauuauaaaugguauuauucauuuaauuucauuuuucaguuacucauuguaguguguagaaauaucauuguuuuguuuuguuucauauauugacuuuguauguugugaccugaauacauucacuuauuuguucuauuaacuuucuuuuuguauauuaaucgggauuuucuauguacauaauuguguggucaaugaaaaaaagacauuuauauuuuccuuucuaaucuguuucucauuuguuucuuuuucuugccuuauuacacuggcuaggacugccaaagugcaauguugaauagaagugguaagagcagacauucuuuuucuauucaugcagaaaaacauucagacuuucaugauuaaguaugauuuuagcuaaaaguuuuucauagcugcccuuccuucagaaaaaaaaaaaaagucgacccaaaacuguguaaugacuaagagcuugagcucuggauggacccggguuuagaaaccaucuuuuguggccgggcaugguggcucacgccuguaaucccagcacuugggcaggccaaggcagguggaucaugaggucaggagaucgagaccauccuggcuaacaugguuaaauccuaucuguauuaaaaauacaaaaaauuagcuggguguggugugccacaggccuguagucccagcuacuggggaggcugaggcaggagaaucacuugaacuugggaggcagagguugcagugagccaagaucgcgccacugcacugcagccugggugauagagcgagacuccaugucaaaaaaaaaaaaaaggaaaccgucuuuugcauuuuccagcugggugauauugggcaaguuacuuucugcaucuuaguuuccuguaaaaugaagauagugauggcacuuuauagaauugcuaugaguauuaaauguaauaaugcauguaaaauaauuaacauaucacuugauugaaaaauguuaauuauuaaccaaugugagcaggaagacuagguaaaugaaaauauuaaguuccagaagcagaccagggggaggcaagaggaaacaguuuuaugaacaacuauguuuuucacccagauauucccauuuguuucaacuugagaguuauugggcuggaucugguggaggugguggugagaagagaauggguuauguguguggucacauuguggagacacccuugugagucccaggauaugaaugcucauucuguggagaucccaaguagcccacagaucuugaugugcucauggguacgugcuggucaauuuuucgagaagacugaagauagauacuguuuuucucuguuucacaaaugggaggacuaagacccauacucacagugucucuuucaaacucccaucauacugguggggugaaccaaguucuggaguccugccaggauugcucuuugacuucgguaggucuuaucuuacauuuuuacuguugucaggagaaguugcugaaagucccuggaaaauggcugaaagcuuccuuauuuucagauaggguccuugacucauccugcuuugauuuggggguuuccaggguugggaguggguucacacugaaucauucauccuuuucuuguuucuguagugaguuguaauauaucugguggcuucccaaggucagaggaauagagaugugaucauguaacaggugacauuuuuugaguuugugugauuuuauuuuuauuuuaaauaauuaauugauaugugaaaccugaugaaaguaugaaacuuacucuuuaaguguuuguaggacaaagacugcuaauuauuuuacaugcaugaucucauuuaauacccauacaauuauauuaagugcuaucacuaucuucguuuuacagaaaaugaaaacacagaaaguaauauauuuggggguucuuccuuuaaauauuuguuguuuauuauuaccccucagguccuuggcuggccaucaauccccugaccucaagaaguaguguuuauuuuuucuuauucuuaaaguccuaguauuuguggccuauauuauguauauaacacuuaucauuuaaugccacacauugcuaauuaucuuuugaugggccaguaucuuaucucguuuaccuggugguaagaucuuuaggggcaguaauuuaaaauauggugaaguuaauauuugauugcugguauugccaaguaaaaagggagcagugggagcauuugcuuucucuacugcccacuuuuuuccuagacacauuucaagauucaucaaaugacagcccaggcuaagggacaaccauggaaaguaccuuuggacauuuugaugagggcggaauuuugcuucuuggucauguuucaguucuauuuuuuuuuucucucaauaguccauaguuucuuuauuuucuugcaaguaauuguccucuuuuauugaguuuuagaaugauuucuagguacuuuuccucauguaugucaauauuuuggcuuguguucuuuuucuguguuuugguuaguuggcauucugcaaaauuuaccaguuucacuugccaccugagcuuuuuggauauuccuuauucuggucucucacuggaaugccuagcuacacucuuaaucuggccuguucaugcuucaggcugaauaccuucagagguaagagguaugaccagguuccuuuucuguaguaagcugagaucacgaauuaggaguagcaccuuuuugccuaguagacaauuugggggcuucuggaggccagugcugguccuuugaucacugguuuuuguuuugaaaggggguggugggagcucaauccuuucuccuaauguuucuccuuuggcauguucauucuuacaccauucccuugaaaugaggcauuuucugccaugucugcuuggcugaaguauuggguagggugugggcuucuccuccagcuccaaguucccaaggacuguuagacaccaccuuucagaaggcucuggcacucagcauccuuaagucugagucccuuccacuggugccuuuggccauagguaugaucuuaauacagcaccuugccgcacuugcuuagaccagcaauagauuucuuaagcacugccccacugaugccucuuuucuggaguuacuuuguauggcuuuagagaggaggguuuauuuaccagucaggaucgaacagguagugauuaagcagaugaucugucaugucugaaucccugucucuggaugagagaaaacagcaaggcugcauccagggcaacuuuucuagcauuguuauugguugauuugauuuuaggggaaaaauagugaaaauaaaaauuuuuuuaaaagaaagaaaggagucucagaccauuacaggauccgguuguuacaggcugaauccaaggcccauaagugaagaguuucuuuuaaaggacucugggacuuccaaagacagccugucagacugcuuacuguugguugguuucuuuuucacagucuguuuguauggguuuuacuucugacccucucuuaccugaggcuucaccucucccacuucaucccaccuggcuuccuuccuuucugcuuaggccugcugauagaauugcucuucucugaauguaacauccguucuucagcccccauugucaagaaucaggaaaauuuccagaaauuuuugguauaaaauucccaacucuuccuuagaccucaggucugacaggccuaauggggagguaggcauaauccugggauaggaugagggugggaccaaauccaguaaaucuggcugaguuucccuuagguuggauucuuuuggacauaacauggaguuuuuuuuuccagaagucaucuuccauaauucuaggucucauuuucaaaaggaauccuuucuccaaaaaggcuaguaacauucacuggucucuuaguaacauauacauuaaguugucuuggccaaguacugacagagauuccuuucagauggcaccuccagagcucagcccaggugauucaggccaaugcuaagaaaaucccaccauguagagccaaguaguauuaccaucugggcagagccagacaccaccaccucugagagaaaggagaaaggucuuucugcuggaaagaaucuaauuuguaaguugaagggaggcacauggguggcucccagauuggaagugagcuuuccguauuuguuucuuacuguguaaauuaucugaguagguuuccacuguguaugguuuacacucagucaacugaaagggcaagcgggagcuggagcugagacugguucccuuggaagugcuguuuucaccucugccaggcuugccccugcuucaccuaugcccacagacaaugugggcuuugcgcuucuccugugugguguuacagccucagggccucuggugaauggucugccuuacauccagagcuugucguacagagguaaaaaaguuaaaggcauugguuuugauuaguucuguaaagggaucaccuaaaacuagugcauccuagggagcucugucuaaaagaaaacauugaguugguaaagagucccaguggguuugaugggcuuccuugggucaaggucaugaaccauauauauuuuuauaaguauaagaguuuacuuuucucaugucugaaguuaaauaacagccuaauccuuccagaguaggagugaguguugucauuguaagagggagaaaagggcgaucaauagugcugcucuguccacaugacucagggaguaauccaaugacauaacucuccauucuaggguucaaagauuacuuucuguggaggaguuugcuacuagcaauguggcuuugggaggggagccuuaugguuggcuugcaguugacccagucagccuuaaaauuugaagcugguuuguggauccugccauggguuccuccaggaaugcugucauaguguuugguuuucugacacaccucuuuccccucucccuucuuucucaggucauucaaucaccaugucuucuuuugaccacuuuguagaggguacagucccuuagggguuguccuugguucuccucucaauuuaugaaaucugauuugaagauuucaucuguucauagcagaaugguuacagcugcacgcuggagcuuuuuuuuuuuuuuuugagacagagucuugcucugucacccaggcuggagugcagugguacgaucucagcucacugcaaccuccgccuuccagauucaagcaauucuccugccucagccuggagcugacuuuuaaaggcgaguccuuacucugugacuuacuagcuggauaaccuggggaaaauuaaugaaccucuuugugccucagguuucccaacuauauuauggggcucacaguaauaccuaccuuauagcauugugaugaacauuuggugaguuacuccacaugaagugcuuagagaacagugccuucuuauagaaaacauucaaugcaggcuagcugcaauuacugucaugucugucauuaguggaaagagaauggcuuuugauucggauggguaugugacucuguuccugacuguguuucuuacucgcugugugaacuugggaaaagucccuuaauuuuuuugagucccaguuucuaccugccuauggcaguuaucgauugugguauggcaaaacaccccaaaauggaauagcuuaacacagcaacaguuauuuguuauaaucucucacaguccugggaauugaggggcucagcuaggagguuuaguaucuuucauguauuuuagucagaugguggcugaacagucagacacuaguugcgacaaggucauuucaaaguuucuucucugacaugucaagcauauaauucuggcuggaauuucaucugggaguguagccgggucugaggaccaaggaccuugccuggguuuccucacaguaccauggcuaggcccaggaauaagcaucccaagagagggccagauaaaagcucuauugucucuuagggucuagcuucagaagucacauagcaucacauccaccacacucugcuuguuagaagagaguuacuaagaccugaccagauucaaggggaggagaauuacacaccaccuuuugguggaaggacggucaaagaauuuguggacauuacaguuugaccucuggcacaaauuauuuauauuccucacacaugaaaaauauacucaucuccacccaaaaccucccccuggcccccuggccaaugugucaucuauuauggcaucaggcucagguucaggagccagggucucaucgucucaaucaggucuauguguaguugagacuccucaaugcaguuccguggguauagcaacucgaguacugcuccucuugaucugaagacugugaacucaagagacaaguuaucuguccuccacaccaaauacaacacugggauagauuugggauaacuacuacagaugccuguuuuaaaaaauugguaacacuuacauuuuaaaaugacuauuuuuauuuuuuucuucagauuuugaaauaauuucagacuuauuauaauacaagaaaguugcaaaaauaguacagaguuccuaaauacucuuugccuagcuuccucaaaugacacaacacguaaaaugauuaaaaccaggacauuaauaguacggaugcaauacuauuagcuaaucuauagaccuuauugaaauuuugccaguugucuuacuaauggccuuuuccugguccaggacccaaucuagaauccuacaucacauuuaguugucaugucucuuuaauuuucuaucuacaguagaugauuccauuuagaaaggagggcaacauuagucgcuagucccuagcaguuuugaaauccagccuggcaugugaguagggcucaguccuauugccugggaaugauucuucacuguuuguuguucuacccuguggcuccugguucuguccucugaauuacucuuuuuuucccauaacauguagccuguguuugcagcuaagcaguuuucucagccugcuuccuacuuguagaugucccuuuucauccaagcuggugauguuccugcuaguauaguaguccccccaauccaugcgggauauguuccacccccaguggaugugcgaaaccacagauaguacuaggccuuauauguacuauguuuuuccuacacauacauacauaugauaaaguuuaauuuauaaauuaggcacaguaagagauuaacaacacauaauaauaacagaacaauuauaacaauauauacuguaauaaaaguuaugugaauguggucucucucucaaaauauccuauuguauuaaaccguggaaagugaaaccauagauaaggggggacuacuauauacuucuuuuaaaaaguguaugguuuuuccggugaauccuauugggguuuacugccuuagacaaaagccacgcccacgaaucuucuuaacauaagcucuucucuacuuugaguucccucugaagcugcagugggauaaugcucuuuaagauuuguagaauuccuauuauuuaauagaaaggaucuguggggcacauucuuaagaucuauggagaggccuggugcaguggcucaugccuguagucccaguacuuugggaggccagggcagguggauugcuugaacccaggaguuugagaccagcuugggcaacauauggagaccucaucucuacaauuuuuuuuuuugaaauuagccaggcauaguggagcaugccuguggucucagcuacucuagaggcugaggcaggaggcucacuugagucugggagguugaggcugcagugagcugugauugcaccacugcacucuagccugggggacagagugaaacccugucucaaaaacaaaaacaaaaaagacccacggaaggacuuuuguuugucucaaacauucuucgaggcauugccuuugaucuuuccggggucuuaacaaaagauauaauucaaaaauucucaaacugagcucaauaucuucuugccauacccuguuauguuuaggacacuccuauccuaaauaacagcauuuaucuagucuuccaagcuguuagaaaugucaaaaucaucuuugacucuuuuuucacucuuauccucuguauagaggacauugacgagucaugacaguuuuuacuacugcaaagucuccccaauccaauucuuuucauucaugaugcucuaguuggaacuuuuauuuucuuucuuucuuuucuuuucuuuucuuuuuuuucuggagaagagaucuuacuguguugccuaggcuggaguacgguggcuguucacaggugugauaauagcauacuacagcuuggaccucgugggcuugagcaauccucccaccucagccucccaaguagcugggccugcagucaugugccacugugccuggcuucuaguuggauacuuacaucucaccuagccugccuuagcggcuguaaauggaauucccuaguuucagacucucuguucucuucuauuaucuauugcuagaauucacuuucuaaaacagaguaauuaucucuucccaaccccaaaaucuucaauagcuuccuauuuccuguggcauaaagagcaacuucuucacagggcaugcaagaccuuccacaauuuggccccuaccuaucugugauccuucaguccacucuuucacacuuacucuuugccauagcuaaaaugaucuacuugacaauuucaaacaaauuuuacauuuguauccuuuagugcuuuugcucauucuguuuccuuggcuuaguaugccuuuccauuuccucuucucagucaguuucuugccuccucuuccuucugggcuuagcugagauuccacuucuccucaaagcuuuuucugauccccucagucggaaugaaucauggccuccuguguuucuguagcaguucauugcucuucuguaaacauaaaggccuagucuaucacuuggcauagucggaugggggaggagggcaagugugugugcgguccuccagacugugagcuuccugagugcaagauggagcugcagcaaaagauguaucuucuuuaucuuuuugugccuuauguaaguuaaccagcaacugcugggugacuugaagagaaugaccuuaggauuuuaucuuggaauuaaaacuggccauugggaauaagcaucuggcucauggaaggaaacugaccuuagguauguauauauugguagaaauaugaaggcaguaaauugagacaguuacuuuagaaaaaaagccaaaucucugauauguggauuugagucugugcuuuauuagcuucuaugggaagcaccuugaaaagauuauucaagauuggagaauauggcuguuuuuuauacuacuguaucucgaucaacuucaugguacuuggugcguaauaggcgcucaauaaacauuaacugagggaaaaaugagugaagaaacaguuucuucugugugacucugcaguguaccuacaugugccaugcccaaggaacauagccuggaaagcugguucagaaucgaggcuuauuuaucauaagugauuuauccagggcccucuugauacuuagagccuucugcuguguuacagagauggcagguaugugcacagcaugacuguugaaaaggaauggcagaauugcagucugaauccagcaagcagaagugacagcagcugcuuuuagguggcccagaggaguguugggcuauguguguuuaguugaggaagaggguacuaaucaggccuugucagggguuuuuuucguuuugaaauaaugaaaguccuuccuggaaaucagccucccuggguucagccucaguccacugcuuucuguauggccuugagcagguuguacuuacauucugggcuuuuguuuucagcaaauuguagucucuucuucagcugugagagcuugugaagagaguguuugagccuguuagguaaguggcauaaaaauagccucaaaauauagagacugcauggguuuagaguuuuucuuagaaaaguuuagcaaaauccuggguugagagacaaucuagaugucucaaauguugaauuccuuucuugaagcuggacuuccccuguauuuccuucugagucucaaacccgagccgcuuccauaagucugugauugugauaauuggaugggagggguuagggcaauuuaggaagauaaugggggacugaccuccuccugccuuugaaauccacaaaggagggagcguggggaaaugaugaagaguugaucaaaaaaugaggaucgucccucccaaauuaggacaacuggcuuggugauaaaaucacuuuacucuggccgggggcgguggcucacgccuguaaucccagcacucugggaggccgaggcgggcggaucacgaggucaggagaucgagaccauccuggcuaacacagugaaaccccgucucuacuaaaaauuacaaaaacuuagccgggucuaguggcgggcgccuguagucccagcuacucuggaggcugaggcaggagaaugacgugaacccgggaggcggagcuuguagugagcugagaucgcgccacugcacuccagccugggcgacaaagcgagacuccgucucaaaaaaaaaaaaaaaauuguuuuacucuguuaguaacccucaggaccagauacuaugaaaacaaaaauaaaacuaugacuuugggcaucucucuccauacagugaggauaggguaaccucgucccucugcccugcccagcuggguuccucuaggguagucucaggagucuugggggagggagccuguuucuggauuccagagaagggguacauucaguugacaggucucucaggggaugucaguuuuacgucuguuugaccuuuggcuuguccuuggagguccugcgccuuccuguuuuugguagggucagcucaaggugaccucucugcacuccauagauagaagacuuggccugcuuggucucuuugauauucccgagaaaccaauuuugcuacagggcugggcgaaccauauggcaaccuagauuacagagauuguuggcguuugucaacagaaagaacaggcuuuuuggcuauagcaaaucccccagguaggguuuccacaccaucugugaucacagcauauaggaucagcuagaugggugugcagucccauucuuuccacuuccugacuccaaaaggaaguaagaggcaaguucaaaaucaaauauugguuaagagauucuuuuaagcuccuugauugguuauuuucuuugaaggaugcuaaggaggucuaguaaucauauaucuugaucuugagagguuuacaguccauuuggggauauuaaacucacaugaaucaguagcaagugacauaaagcaaaauauaauaauugcaaaaagguaaaauagacuauaggauucagagaacgagaagauuaauuagggcuggacauuuucuaguacagaguuaggacuggagguuagccuugaaugaauagauuuggaggauuuaggcagauaggggauagggugcuaggccaaaaggacaaugucagcagagguagaaacaagcagaugucuuuacaggaccacaaggagauuagcaugguugggguagagauauaggggagauaagauuaggaaaggagggcaggaccagauuaaagaggaucuguagagacagacaaaggaauuuggacuugguucuggaggugauagguugccauuguagguauuggagcagggauaugauagaaagagaggaauguuugcaaauacuuuguauacacaauucauacuggacuggaguuggguagaggugcauguucuggagaucaaugaggggguuauaaaguccuagaagccagggaaacugggggaagaggcagguaaacuaggcagugucuuucaugaaucugugagacuuggugaugagcugaguagcaggcaugaaggagaaaaaagggucaagguuuugaucuuggaaagcugggaagaauaguagcaccauuaacaaaaauggagaaauuaugaggaaaagcaauuuuaagaaggaaaaugaugcauuugucaauuauuuuauuuacuuaacaaauacuuaugugacacuuaauacguacuuggcacuguucuaaacacuuuauaaauguugacucauuuuaguucccauaauaaucauauaaaaauaaauacuguuaguaucaucuuuauuacaaaggggaaaacucaaguauaaagagguuaauaauuuucccaagaucacaaagcuguaauaggagagccaggauucugaacccaggccaucuaugcuagacuuccucuuguugauagaagacugagcagaaauaugguagauaguagaucaaauguuuauuggaugcuuucuuugugcagagcccuuugcaugaaagguaaagaugaguacaacauggacauagcauuaaaaagcuuguaaagggcuaaugaggaaauggcaaauggugaaaucauaaggguacuaaaucauguacuauaagaaacaguagcacauaaggaaggagagagggaggacaaauauguauuuagggauaucagaaaagacuuccaggaggagauggaauuauugcuagacccugaaagaugggucaaguuggauuuugguaguggguaguaggggcaggucauucuugguagacauaaaagcuugaauaaaaucacgaagaaagaaagcucaaacauguuuugggaccagcacacuguacaaugccuaguucaguaccuaguucugcaaaccugaacuaggaugacaggugguucuaguuaggcugcagcauaaaguaugaguuggagaagcaguaagagagaaggcugggacugccuugagagaaagcaggagccuaagugagaggauuggacuggagauguagaauuagaaguccaggcaaacaaauaaggaagggauuguugauucuguaagggcagaggacuccuggaggucugacuguaggaaggaaagaaccgagggcuggggauggagccuucuuuugugcaugcagauaucuaagcuauucuucaggaugaacuuaauauucccuacagaaaggcuuauuagcuuguuucaugcguuguguuccucgcugaggcugggagaccauuucugacucucuaccuuugcucuucagaggucucccugccaccagaggugaaucaaguucucauuguccuuguugccuguguauucaggaaucccauggcccuucugucugaacucaagaaggcauuaauaaaauaguagggcaugcucauguuguuguugcagaggugauauuuuauugaauccugagugcuuuguguaguaugacaugaacgugcugagauugcucucucuuaggucauggacagugacuuccagggcauaggaaaaguaugguccauuccaguguuccauacccaccuuaggccuuaaaggaccauuccuagcaaaacaguggggaguagaagcagaacuucaaaauucagaggucaggcauuacuuauggaauuuuucauuggaccugcugaaauaguccuaaccucagacuuugucucauaaaacagaaagcacagaccuagcagagagagacagagaugucaguuuaaacuccauuugucacuuacuggcucugugaccuugggacaacugaccuuuuugagccuguuuuguuaacaauaaaauagagcuaaugauauuugcuuuucuuaccuaccagggauauugugaggaucagaggagaugaugucuguggaagugcuuuaagacugccaagggcuguaugaaaauaugcuguuguuauuauuacaacugugaaccaguuugcucacucaaagauuaaugcucugagagugccuuuugcauaaccuacucacagucuuucugccaaggacuuaaagggcaaggccacagaguaggaguuugagacacgggauagaguauuucuucuggcaggcauguccuacuucauuggcuccgagauguacucacccuacucuccacccccacacaugaacaucucugaaauuugucugugcuuuauaaaugauggcauagaggaugugaugacauaaacuaacucuuuucugaggcaggugggcuacguaugcaaacuuucuuuucuucuuuuuucuacaugaaaagcuauuucuuucucaaccuuugcuaggagacgaucuugcuaaaaugcaguggugcuuuugcugcuucaguaaguguaagacucagucugucuuuaagcaucauucaguguguucuggucauucuuucucauugcacagaucucuggaagcaaaagguuagcuugaacauauguguccggaucuugggacauaucuuuucuauugauuagaaaaucccuaaugacauuuuggcaucauuccuuuuccuuuuaaaaguggaaggugagaugcauuuugguuaacaguuuauguuaugcuggguuugacugcauugggcuuugagguguuagaaguugaggagcugggucucauaccucuguccuggaaauccauaacauaaacccuccaaguggcaggacaagaaaucagcuauucacaaagcuuuucuuuaggaugaauuaaccaaagaaguguguacuuguuucuuuucacuuuuugaacgugcuucagauuugacuacuacaaauccagagcugcuuacuuaguaccaauucuuauuguuucagucuuuuauugauucucuggguguggacuuuccaccuuuugaguugaauagcaaggagacuucugagccacuaauccucuguccucuugcuguacguucagaguauacagaugaaaaauuuaaaauuaagaauauaaaucccagcugggcaugguggcucaugccuguaaucccagcacuuugggaggcugaggcggauggacaucugagaucaggaguuugagaccagccuggccaacauggugaaacccugucucuacuaaaaaaugccaaaaauuagccgggcguggagguaggugccuguaaucccagcuacuugggagaugaggcaggagaauuguuuuaauccaggaggcugagguugcagugagccaaaauugugccccaaagagggguaagaaagagacacucacauuuauugagcauguacuucuauagacauuacuuauuugagucucacaacaaccuagggaggugggcccucccuuuccaauuuugcaucuaagaaccugaggcucaaaacaauuaggagaguuccaggcuugucacaggaguuauaauggagcuaauuugaacuuauacuuucuuaaaaaaaauuauuuuuaaggcuggccaaggaaagcaguggcauggagaagggauaaagaauucuguaacugguugugaugcauuaguuguaaacaccacugcacucggagcagccugaacccaugcuuucuaggaagagccagucugaaaacaaacaggacugauaaggggauuauuugcucuuacgaauuacccaguuguucccuccugucuaauguggaggcucaagagaugauugaacuugguucuuugaaggguucugugguuucuuucccuguccccaacucugggguuauggagugaccaaggcccccuuguuggaacugggcuguguuuuucaggcucugauuggcccuucuguggccccugcuuccaguggcuucugauucaggucaaugcugcuuggugcccuagaaauaaccggguuucuagcccagcaugacucccuugaguccuugggccugcuagggcagcacuggcagcaccucuccccagagcuguguuuauuuuucuuaugucauuugcuuauuauaggcagccugcuaaguguuaguuaucaccuccccgugauucccugccuuuucuucuccuucugucuuacccugugcuuugggaacuuuggauaauauggaccuaggaggcagcauucuaaguagggucccucuacauuucuucugcauucagaauucagcuuuucugcugauuuucccuugaggaugagcuuuuguuagaaacacuggcacuguaaaugaguauuuccucugugguccgagaaaggagugccucaaagguuugaaaagagagcaugcucaggagcaggaucuggauuggggauggugguguuggucuggaucugcaggagucaagcgcugaccuaugauuuggcagcaucuguuggucgucugcguccuuggcaccuuggcaugcgcuuguuguccucuuaaaucucuauguauuagugcuguuuuugcaguugggcuaagagaugcugaugaauucucauccuagagucaagugccacggcuaugagauaguaaauuggagaaacugcccucgauuccaggcuuuggaagcuaucaguuagguggcugggcaaugauguggguggcauuucacuauggacuacagcauuaaaucagauaccguugugucaggcagcgaugcugugccuccguuuuccucuucuaaaguuaccauacgaaggaguggugaggcagcuuuucccugcuaacacacccaucccucgucugcaggcuggcacuuugagaccucucuucuacuucauugcuguuuucaaucacguccccacauuugaccugguuaugccgggccaucucccagagauccuaucacaugaccuguggauagcucagcuugcagcagcucccauuuuaucuuguucugacucaggagcuuugcagagaacggaguguaguuuucuaccaggggucaagauagggccuguagagguuguuugcuuccugggaucuacauugcccaccaagaacacaugggccuguagauuuugagguuuuucuugggaaaauuggaagagcuaacuuuaugacuuugcauguuuggagggaugaaugcaaacugaccuuuauacuuaucgguccucucuuccuccccucugaugcaacagaugucccuagucugaggccaguccucccacuauguccugugguccaucccuucucaccuucucaggagccuaacaccacugacuuuuccuucucucuacugcacguucugucucuucgucucuacugaguccuuucuauucaucuuucaucauacucacgucucucccaucuuaaauuacuaccuaucuuucucuucucuuucgcaaccaaucuccuugaaagaacagcccguaccucuugucucuauaucaugaccucuucucuucucauaugcauuugucugcucuaccaucuccgacuccaucgaaacugcucuaagugaacuucuaguuccugacccuaauguacauguuucauugcccauauuauuucaccugucagcauuuugacacuguuggcuaauccugacuuuuugaaauguacuguucccuuggcuuccauuauguuaccuccuuaguuguccuccuuucucucugagguuuucuuccauucucuguuuuuuagcucuuuccugucuacagaauuuuaaaauauggucuccaacuacggaguuguuggagaggucuguaguuggagaccuuuucacuucagauucauauauucaccuucuaacucaucuucucuaccugauaucucauagauaucacaaacuggacaugccccagugaaacucucacccccuuuccaaacuugguccucuaacaguguucccucaucuaaccacuuaaguugcacuuuguguucccuucuuucuuacccacuccccacaucuuaucacuuuuacuuccuaaaucuuucuggagucuaucugcuuuuuacuaacaucacccaugucaauacugaucaucuuucaucuguuuuacuguauuugcuucauagcuggucuuuuuauauugacuuguggcucuuggaguucauucuccacauagugagcuuuuaaaaacccaagaccaaucacauuuaagucugccacuccuacucugcuccaaucucuuuagcauauauuacaacaaaacccucacguggccuccaaggcccugugugaucucaccugugcugacuucaucagcaacaucucugcccccugcuccacacuccacccuuggccacagcagccuugccaugagaugaccacgcugcaggccaguuguacguguuguccccucucuccgagaugcucuuccuccuccucaccuaguucacugcucucugcccuuccgagcucagcucagauguuacuuccuuaaggagguuuuucuagaaucccagacgaagccauagaugugcuacaucuguucacauagugccacuaucacuuccacgucuuucaaacucuuauuuaugguaguaacuaaaaaaucguuugaugucucccuauaagcuccugagggcagagacuguucugucauauucagugcuguauaccagcccuagcacaaugccuggcacguaguugacacuaggauauguuuaauuuuaugaaugaaugacagcugaacugaggagagagucaagaugaauguucaggcaaguguauugcagacaaugcuauguucccaaacuauugauuuagagaggucaauaauaauucaguuuuauuagaaucguauaguuaaauuaucugguccaaaauuuuaguuucaaauugagaaaacuaaggcccugagagugaaaucauuugccccaagguuauagaauuggacaguagcagaguuacaacuccucucccugacuuccagauucacacaagcucuccugcaccaccaccccuucugccucuccuacaagugacaaccucuauguucuccaguugaaagcagggcucuggagucaggaaggccuguugcuuccucccuaacuugaggacguggcaaguaggagccagccuaucccauaacuucggcauaaggagccauuuuacucccuuccuccccaguguagaaugaaugaugggcuacaaaggugucugagccaaugccagccauaccuauugagauguggcgccuugaaagaaaaacacaagggauguguuuguugaaguaacuugauuuuccaguuucuggguuacuagaauuuggggccuggaaaccugacguaacagcuaaagcaucugggagccuguuuugcaucuguuacuuuugagaucaccgugugcccaccuggaaacucuaccugugcagucagaugcugaagccuugguuaaagccugcagggaagcccucccugagugaggcaucccuuccuccauuguguuuacuggaccacuucuuucuaguaauugagaauuauauccugaaagauccagaaauggaaagcuccaggcugggaguggccaugcaggaaacaggauacuuagacguggacccuagaaugcugguaccgcacagauccaguccuaccucauucauuuucagguuuuuuucuuuuaauuaaccaacacuuauggaaucuccguuaaugucuuggguacuggggacacaaagaugaauaugucacaucccugcccaugggacacucacagucuagugauaaauagaccauuuauuucuccauucauucauauauaagauauuuuguaggcaucuaucaugugcuaggcauuacauugggcuuauccauucauugaguaauauuugaguuccuccuauauauuaaaacuucuuccaggugcuuggaauauugagaagacagaaaucucugcccucauggaauuuacuuucugguaguaagcgaccaauaauauacauaauaaauaagcaaauuagauaauauuuagaaaguuauaaauauuauaagaaaaaaaaauggagggagguaaugggagugcagagggguggauugcaauuuuaaauagagugguuaugguagaccuaaauuacaacgugacauuagagcagagaacuggaaggagguaagggagcuaggcagguagauaucauggugaaaggaauuucaggcagagggaguucucccuaagguggaagcaugccuggcauguuuggggaacagcaaaaaggcccauauggcuacaguagaaugagcggaguuuagagcagcaguggugccagaucaaauagggccuugugggccuuugugaagacuuggccuuuuauuucaguguaaaaaggaucugcuggaggguuugagcagaggaguaauauaauuuuacuuauuugaaagggaucacaaagugugcuauguugagaauagacauuuaggagcaagagugaaagcagggaaaccaguuagguagccacugaagaaaucuggugagacauggugguggcuugguguauuguaguugugaaagaggggaugagaagaggcuggauuguagauauuuuuaacagauaaggcccaaaagacuuccugauagauaaaauauagagugagacagaaaaggaggaguaaaaaaaugaauccaggcggggcacuguggcucaugccuguaaucccggcacuuugggaggcugagacgggcgaauugcuugagcucaggaguuugagaccagccugggcaacauggcaaaaccccaucucuacaaaacauacaaaaauuaucugggcaugguggugcaugccuguaguuauagcuacuugagagacugaggcacgagaaaugcuugaacccaggaggcagaaguugcugugaaccgagauuucaccacuacacuguagccugggcaacagagcgagacucugucucagaaaaaaaggaaaaaaaaauccaagcuuuuuuaccugagcgacuggagacaugauaucgccauugagaugggaagagucugaguggaucaaauuuuggggacaauuaagggguuugguuuuggauaguguggauguguuaaguggagaguaagauaggggcuggagguauaaauauggaaaucaacagcauauaggugguauuaaaagcuaugaaaguaguugagaucaccaaaggaaugaacauagguagagcagaaaagaagagcaaggacucgagcccuagacacuacaauauuaaaggguuagagagaagagaagaagccagaaaagacgacugagaaaaagugacuagugagguaggaagaaaaccaagagaauguggugaccuggaagaugagugaagaauguucaccaauuagaagggagagguugacugguuccagugcugcugaggggucaaguuagaugaguacuaaccucauuaucaauggguuuggcaauguggaugccauuggggauuuugacaagaacaguuucagugcaguaguggggguuaaagcuucauguaaguagauuuaccagagaauggaagagaagagaaggaauuuauugcaaguuugcuacaaaggugaacaaaggaguagggugguagcuguuaggggaaauugaaucuggagggguuuuaauuucauuauuuuuuacugugguaaaauacacauaauauaaaguuuaccauuuuaaccauuuuaagugugcaguucaguggcauuaagugcauucacauuguuaugcaaccaucaccaccauucaucuccagaacuuuuuugucuuucugaacugaaacucuguuauuauuuuuuaauauagaaguaacgcaugcuuauaugcugguaggaaugagccaguugagaggaggcaauuaauggugugggaaggugagaggagauugucuaaaugcuuucuuagaguagaagagugggaucuggcacacaaguagagggauuggcucugggaucauggauaauucaucuacaguaacaggagagaggcagaguuauguauauggaugccgacagaugcauauauguuguggugggagucaguggaaauucucuucugaucguuucaauuuucucaguaaaguaggaaacaaggucaacagcugagaguaugagggaggagauguucgaaguuugaggagaaagagggugugaaguagucaucuagaagaguaggugggugaauagaauaaacuagggagguacaguaugauugucaggcacauuaagggcucaucuuuggcucauggauaugaauuuaaagugagaccagucuaggugauugugugcauuucuccagcuacauucaauugcaugggcacagguacuggguuggauuugacuagaauugugguuuugccaaaugaagaaauagaauuauuauaaaaauugaucaugaaugaauggaagaaagaaagagaagggaagaaagaacaucauauucacugugagaaucaguaaaaaggugguaguaucaaugaauuuaaauccuguuaagauagaagaauugcuggaguccaaacaguagaggguguaagcuggaagguaggaguugguagguggagaguaggaugcaugcauuugauaucauggaaggguugcauuucuugguaauaacaaggugauggguagagaugacucucaaguaugaaugagcaugagagucaguggguagaaugagguggagcacaagacgacuagagaagaagaguucaaggaacugagaagccaggguauuggaaugaccacuuaugaguacaaugaaauuucugaaaguuaagacaggauuacuuuguguauauagugaaugacagaugugugcccugcccucaaagagcuuacaauccagcccagaagauaagcaagucagaagcauuuggcaugauggcauaauugcugugauuggaaaaguacaagguaagggggagcacaagugaaggauaccuaaaccccgccuugggauugaagaaucuuucuggaggaaagagauuugaguugggauuuugaagaacaagucaaaguuaaugagguaaaaagacagggaaaaguacuuuagaaagggggaacgguaugugcaaagggauaaagaugagacuggggcacacugaaguaacugaaaggagauucauugccccaggugccaugggcaguggugcaagagaaguuugggaaggugagcugaauuggaucaucauguagggccuugggggcuguauuaaguaguaugaauucaucccaugugcaaugggagagguauagauggacuaggggagaagaaaguauuaagaaauguuuaauagauuaaugauuuuugaguuggguccucuuauuaguuauuuguggcugcacaacaaauuaccccaaaauguaguggguuaaaacaacaaacauuuauuuucucauaguuucuaucagucagaaauccagaugugaguccuccagucuagggacuuucacaaggcuacaaauaaggugucagccagggaugcagucaucucaggcucaacaguggucuuucagacucauucauguggccauuggcaggcuucagguccucgauggcuguuggccagaggcaucaguucccugccacauggaucucacuguagggcaguucaugauauggcagcugacuucucucagagcaggugagggagagagagagagaaagggugggaggagggaggucacagucuauuuguaguaacccaaccacagaacugaccucccaucacuuuugucauauucuauuuauucuaagugagucaguagguccagcccacacucagggaaaguauugcacaggggcaggaguacuaggcgauaagaucacuggaguccaucucagaggcugccuaccauaaucccgaaggaagauuaaggaguuaucaggcagggaugaggaaccacuuagagaaaguugacacagaguuuuaaggaagaggcuauaacauaggaaguaaccugagggcaccaaauguacuauguguccaaaguggcaaaagaugcuauugcaagauauaagauaggcuguggccagauuguuaaaagucuuguaggcuaugcugagaaguuuagucuuuacucuuuguaacaagauaagaucaccugaaggcuuauauaagaaagcgaccuguuuaguuuuuggucucugacagcuguaugcaggacaaacaguagugggagggagccaggagaacccucuauagcuggaaucuaaaaacugccaguggagagaugaccagggccugcaccaaggcaaggcaguaggccuuaugaaggggggccagauucaaagaauguuuaaacaacuguuaacaagucuuagagagccugugggggagcacggauguguccgaugcuuuccaaguucuucaccuggaucacugaggguucuggcuauaacuaaaguacccaauacagcaugaggaagacacugucccuuguggaugggagggggacucaguccuggcauaugucaccuucaccugugaccuuaagguacacauuccuaguucuauucacggacaauaaagaaguauuuaguucaaagcauauuuucuguccuguuuuuuuuuuuaagacuuuauuuuucuaacagaaauuuuagguucacagcaaaauugagaugaagcacagagauaucccauauacucccugccccccacauguacagugucccaauuaucaauuguuguuguuaaaauugauaagccuacaauugauaaguuacaauuacuguuguuacaauugauaagccuacauugacacgccauuaucacccaaagucuauacauuaggcuucacucucaguguuguacauucuauggguuuggacaaguguaugagaacauguauucauuauacuaucauacagaauuuuauuuauuuuuuuuuugagacagucucgcugugucacucaggcuggagugcagugguacaaucucagcucacugcaaccuccaccuccuggguucaagcaauucucaugucucaguuucccaaguagcugggauuacaggcaccugccaccaugcccaucuaauuuuuguauuuuuaguagagacaggguuucaccacguuggccagacuggucuugaacugcucaccucaaaugauccacccaccuuggccucucagaguguugggauuacaggugugagccacugugcccggccucauacagaaauuuuugacugcucuaaaaauccucuaugcuccacccauucacuccucucuccccucagccccuggcaaccacugaucuuuuuauaguuuucauaguuuggccuuuuccagaaugucauauaguuggaaugauguaauauguaagcuuuuccgauuggcguccuucauuuaguaauaugcauuuaaguuuccucuacgucuuuucauggguugauagcucauuuauuuuuagugcugaauaauauuccauuaucuggauguaccacaguuuauuuauucauuuaccuacugaaggacaucuugguuacuuccaaauuuuggcagguaugaauaaacacugacaacaccaaaagcuggcaaggaugugggacauccucucauucauuguuggugggaaugcaaaaugguacagccacuuuggaagagcguuuggcaguuucuuacaaaauuaaacuacucuuaccguaagaucgagcaauuucauucuuugguauuuucccaaaggaguuggaaacuuauguuuacauaaaaaccugcagaaggauguuuauagaagcuuuauucauaauugucaaagcauuuuuuaaagugccuccuguauguagaaucccauuuagaauauuauggguaacauagaguauaaaggcccacucuugaaaagcugucugcuuagcucuggguaagaagagaucugguucuuagauuuaggacacugacucugaggccucuuucaacuggaggcaagacagugagagauuccauguguccagcucugcagcagcagcagaggcagccacaaucugagaugcugcugauuucuucuguggggcuuugaaaagcaaugaaucuucacaguaugcugagcuucuacuuuauugaugaugcagcucagggaaguuuguggugccauuuugccaggaucuuuuagggaaagcauaggaucagauuggaggaugagugcuaaaugacuccuaagugccagaaauaaugguuacugaauaugcacuagugcuaugucauuguuuugcuguguaauuguuuugucucucacucaguccuugcaacaacccugggagguugguucuauugcuauuaucccauuuuucauauggggaacugagacacagagagguuaaguaacuugcucaagaccacacaguaaguagcagagacaugccugucugauuucugagccuauauccuaaccauaguacuauaccuccuuguuucaugcauuuauuuuuuugaacucaccaguugagucucuggucauaucauuugucaguuauuucuccccgacugagagggauaaauaagcauucucuuauauucuagguuuuaaguuggcauuuaaugcugacccgucuggaauucacuguaguguauauacauuucauuugguuuuaguuuuucucuuuuggucacaagccaaaguuagaaucucccaagcuagcucagguaaagaugagcucacuguagggaaacuugguuuaguaaggaguaagggaucucuaagcaaucccagaagugggccuauaauaggacuagaccuuagagagaguaggucagacccaaaugaccauuaccuaguucaguuucuggcacauaauaggugcucaauaaauauuuguugaauaaaugcagcaaacaguuguguggucagcuauccaguaaaaggggccagcgauagcccuaguggaacaagagcccuuuuguuuggcugaaauaagguuuacuaggcuacucgaaggaugugguaguagcaacacuagagcuucacaucugcuguggaauagaucuuugauuuccccaugcaucuucugcauagacucugcacuuacccucaguggcugcagcaaaaugggacauguagaugucaggcugcccaugggaacacauuccuguguggugcuccccacaucuguucucaugugaaaugacacuagagagugacagcuuccuacuauaggacuggcggcugugggucucacaguaucagacuuccuggugacugagaugcuguaaggaauagagagaauggaagauccggguucagguaucggcuucgccauagcugugugaguugggccugauccuuggcuucccugggacuugguuuccugaucuguuaagggacaagguuugggccaagguucuuuccagcacuugaguccuaugaguugcuaaauugggcccaaggucacagggaaaaugaaaugcuggcauaauaucugucuucccuugaaaccccuggauaaguccaagcaagugacccucuuugauggaagagaguuuccaaaagcagaaagaaucuuucucagggguuggguggagcucuuccuuuuucuccuacccuaaagauacuuggaagugaagucuaaaauugucacccaggacuaguagggugcuggaggugaagaugcagaaggagaauguacagacaggccuccggcuccugaguccagcugguguugccugucgguacacacuccccaccugccaccuccagcuccuggcugaucuccucuuucugagcucuugauccuaagcuguguucugcuugugucuguuauggcucuggagugaaaugagcaauuucuuuuucuccaauuggaagcugaaggcugcuuaauauaaguaauaaaguccucaaugcuuuauccccuggggucuguuaacugccuguuugaagcagaaggcacuacagcucgcacaggaugugaagcagauuggagguuccuguaucuuugagccaccugagcuuuuucaaaguccaguuuccuucuccuagagcagaguuacucaacaauggcacuauuagcauuuugagccaaaugauucuuuguuaugggguacuaucuugggcauuguaggauauuuaguagcauccuuggccccuccacuagaugccaguagcauccaccuucccccguuaccacaaacaaaaaugucucuaaacauggaaaucgucccuguggggcaaaaucaccccaguuaaggaccacuauucuagaguuaccacagcacacauguaggcagcuugugugaugaacuaggcuuuugagaaccauggucuuuauuuuugauuucacuucugacucacggaagacccuagggcagguuaaugagccucucuauaauggggacuaugaauuuuccuuguuugaaaaguaacauguuuguuggagaaaauauagaagaaacagagaaguauaaaagaagaaaaauuuaaaggaucuguuggcaucucaaccaccuagagauaauaaguuuuaagguguauuuucuucuugcaucuuuuccuggcaugucucucuucucuuccaccauacucacacaccaaaucaggaucauaucuuaauacacggcaaaccguucuuagaaaauaugauuuuuaauggaugcauauuagacaaucuuaugaaugcuccauauuuauuuaauaacuuccaguuguagaacauuauuauaaccaauuuucagacuacuagagauaauacugaaugacaacuuuguacauuaaucuuugugugcaucucugauauccuuagguuaauuccucgaaguggaauuuuggggugaaaggauaagaacauuuuuaaggcuuuugauacauguuaucaaguugcccuccagaaugguuacgccauuugacaucagcaguguaggagagagccaaauuggggcaaucuguacuuaaaagcuuucuuugauagcucaggcuucuaccgaagcugaacaaucuccauuuuguuuauaauacugcacaagagcccuacaaagcacagugguggucugcuuucauguuacagcugggcagaacauguacugaucacagugagugacagacagcacauuuuaguauuauugacagaaaugagacccaagacuggaagacccucagcaggucaagccaugaguuaaugcuuucuuuugccccaggaauggggcaacaugugcuaauggccccuuucuaacuggucuucugacagaagcacugauuuucagagccuuugaccuagacgucuuugguaucuaguuuucuagaguaggaauccaguggccuuuguagaaggcuuagaggaucacacgugagguggaguuagcuagaaggagcuauugcuagugccagugcaucccucccugcacccuccccugaacccuacccccuccuaugcauuuccccaagcuccaggaugcauucuaggcacucuuggcaaaagagccaugcugaaaguguaaucucucaucuugacaugagcuuagacaugagcuugagaugccugaggagcuggggcuagacugggcaacaaaguggacaugugguagcugagguauuggcuccaugcaguucuggacaugauuuugacggcccugcagaaaauuugacgaccacgagcacucuugccauggcugucucuguccaagaauauauucacuguggggauuggaaaguauacagaggcuggcagugaugcagcuagagagacagguugugagaccaaaagcuugcuuccuucuuguggaggcagacacugucagacagaagcauagugcugugaguagaagcaugaccagucuauguucauagugcuggggaggaggaucaguguugguuuugccacgcugcugaggcgugagaguauggggaagcaccagcuucuaguccgugaccaccuuucucuggcaguggaacugagaguagaggucucuggugaacugauaggugucauuaauggcaaugucagaccuauuaucagguccuuugauguucacaggaggaguucuuauauaugggaagacagauacuucaagcuuuggggcuuucccuuucaaauccucgcuuuuggccccagggaguucaagaccuaauagacauuuuuuaggggaggugggggaauccacccaauucuacauccccugagaagaugucagguucauuuuguuuuacagguaaaaccaagggaaagauguuaaguuacagaaugguguuuaaucaaugguagauuuaaagacuuaaucuuucuuuuuaaacauuuuuuggaauuaauuuuagauucacagaaaaguugcaaaaaauaguacagagaguuucuguacaaaccucacccaauuucccuaauauuaucaccuuacauaaccauaguacaaugaucaaagcuaggaauuaacacugguacaauacuauuaacuaaacuauaagccuuauuugaauuucacaaguuuucuauuuguguccuuucuguuccaugagccuaccuaggaucccacguugcauauagucauuauuccuccuuugucucuucuaauuuguaauaauuuuucagucuuucccugccuuccaugaucuugacacuuuugaagaguguugauuaguuauuuuggagaauguacuguaccucagcuugaguuugucuaauauuuucucauuauugaagugaacuuaugccuuuuuggugagauuaauucagaaaugaugcugugucuuuccgagggcaucuuacuggugacaauaaccuuguugaucugcugaauuucuccacuguaaaguuacuaucuuacccuuuauaguuuaaaaaauaucuuggaggacauacuuugagacugugcagauccuuuuucucuuccaacuuuggccacuaauuuuagcacccauugguaagucuuaucugcaaaaguuguuugugguguuugccugacggugguuuuccucugcccaaguaccuucuacauugauuaauuguagaauacuguauugguagaguagagaauaaucuuaauaagacauaucauuccuugaugaagucuuuacucaagagcaauagcucuuucuaaaauaugaucuguuuauuucauacuuguguguauuaguuuccuacuggcacucacagaaaauuugcaaaaaugauacagaagguuccuguacacuccucacccaacuuucccuaauauuaacauguuacagaaccacaguauaauuaucaaacauagaaaauuacuuaguuuauuuaaaggccauuaaaacaacuaggcaagagauaaugguggcuugggcaaguagcuaauuggggaggugaugugaaguugauucuggauguauguugaagguaggacuuacaggauuugugaaagaauuggauguggaguaagagaagaaaggaggaauccaggaugguuucaagauuuuugacuugaacaacuggucuugcuguuuuuugaauuaggagaagacuacagauggcauccagggaauuuuuuacucuagugacaaacuccccuuuuuaaccacagugcugaaaaaauuaccacaacaaauggcuacaauuuaguggcuuaaagcaacccagauucauuaucuuacaauucuggaggucagaaauccaaaaucagucuuagugggcucaaaucaaggugcuggcaagaccguguuccuucuggaggcucuaugggagaauuuguuuucuugccuuuuccaacucuuagaggucaccugcauuccuuggcuccauuuuccaccuucaaaaccagcaguguagugucuuccaaccccugucucucugacucuaauccuccuaccucccucuuacaaggaaacuugugauuacagugggccacucacauaauccaguauccuuaauuuaaucacaucugcaauuuccuuuuugcccuguuagguaaaauacuuacagguuccagaaauuaggauaugaacauauugggggaggggggcacuguucugacuaccacacucuucaucucuuucuaucucuguauaauuacaucuuguuuuauuugcauuucuuuagucaggacucccacugaugaaguagcagcuugucuugagcaugguuuuucugaucagugaucuauauuggucaauuuaugaagaagcacauuuaguaccucuuguguugccaggcacuguagcugaaaaggagaauuugucaguugaugggaaaaaaaguugccuggaugucucuuguaaucuuccccaguucaaaaaauguuaagaccaguuauucaggucaaaaaucuuggagccaucugggauucuccucuucuuucacuccacaucuaauccuuuuacaaauccuguacauucuaccuucagaauacauccagaauccaacuaguucucaucaccuccccaauuauccacuugguccaagacaccauuaucucuugccuaguuguuuuaauagccuucaaauuggucucucugcuuccacccuugccccucuucggucuauucugaacacagcagucugacugacaaauaaaaaaaacucgugugauucuccugcuguaaaccucagagagcuuucuuucucacccagaguugaugacugaaggcucacuugcauguuuuggucugugaccucucugacuccggcuccuacguucucccuucaguucuccugcuuucuccgacuuggcccuuacuguuauuuucugaaccugucagacauguuccugucuccagcuuuugguauuuauuguucacucuacuuggaauaugcuuaaccuaaaaauccguguggcucauuuccuuacuucuuucaccccuucaaauucugccuuuucaaggaggauuucccagcuauccuaucuaaaauugcaaccccauaacccucccaacccuacucuguuuuauuuuucaccucagcucuuaucauuaucugacaucauauuuuaccaacuuuucuuauaaaugauguuuaccucuuuccacuagaauuggagacuucaagaggacaaaaaauuuugucuuuuuuuccccugucacagcucuaauauuuauuuauuuacuuuauuauuuuuugagacagguucuuucucugccacccaggcuggaguacaguggcaugaucauggcucacuguagccuugaccucccaggcucaagugacccuccugccucagccuccugaguagcugggaccacaggcucaugccaccaugcccggcgaauauuuuuauuuuuuguagagacaggggucucccuauguugcccaggcuggucucaaacucgugggcucaaggaacccucccaccuuagccuuccaaagugcugggauuacaggcaugagccacuaugccuggccuccuuaauuauuuuaauuuuuaaaauuuacuuauuuuagagacagggucuuacucugucaccaagguuggagugcaguggugggaucauagcucauugcagccucaaacucuugggcuuacacgauccuacagccucagccucccaaguagcuaggacugcagguacauggcacuaugucuggccauuuuuuuuuuuuuuugguggagauagggucuugcuauuuuucccaggcuggucuugaacuccuggccucaagcgauccucccaccuugcccugccaaaguguuaggauuacacacaugagccaccaagcccagcucacaucucuaguauuuagaauagugcuuggcaaauagcagguacucaauaauuauuuguagaaugaauuauaucugcuuuuauaauugggcuauauauuuaucaauugcuuccugaggcauauaagguacaaugcuauauguuuuggaggauaaaaaauaaauuaagacaugaucuguauuuucaaauugcuuauaauuugguuaggguaaugagauaaccaugugugaaaaaacuaaugguaucacuaccauaagcuguagguauguauuaaauacgcuuaaguauggggcaccgugguagguacuagggacaaacaaauaugccauacacgauuucuucuuucaagcuuuuuuaggcuaguuaugaggacacaaaggaaaacaagcucuacccgacuggaugagccaagugcuaauaaaugguauggauaccgaugggagaucagagggagaggaguccaguagcagggccugcagcagcaggcuucgugucacaggucucuucugaacugggucuggaaaauccagggaacucugagaggucugauguagcuagaacauggggcgugaggguggagaaaaggcagaagacgaggcuaucaaaguaggucacagagagaucgagaaggacguugaguccuauguuacaguuugaugucauucuguaggugguaagaagccacugacguuuuugaagaggggauugaaaccaucacaucugacguugacagagauggauuagaauggauugaagcuagggagagcaguuaggaaguuccuauaggaaucuauggccgcuccucugcccacugccuucagcuuccagagcaauagugcagaccaagccaauccuggcugcagcaggaggagguguggugccuggggaacauuuucgagagcuccgaagagagccgacagagugcaggaaggaggcaugcaaugccugagagccaaguucagcucagcucuauuuugggugacaacauuuacaauguuccuucacccagaaucauuccgccugccugcccgccuucgguguuuccagcugauggguucucacgccuacuuaacaacuggcuugguucaggggcucccuggcucaccgacugcugcccuucaguccucucccucuuuggcaggaugccuaaguccuuggaguggcuagagugcuaagccugguccuccaugccucugcggcaggggaagcuggaaggguagugcaaaagcucgaggaagggaggggugguacugcuaaaugccagaguucaagcacagagguguguaggcaauugacucgcaguucugugcuucacuuccucugaaagaccaaauuauaagggagagaaugccugauaauaauauuuuguguuuccacauaucuugucugagaaccuccagacucaagaucuagauucugcuguugucccagauuaccucauuaacugaaucugugggcguuuauaggucauuuuuagggcucuguggauaucauaguguagaagagacaaauguuguuuuuuuauaauuaaaaaccuaagaguauuacacauucauuguagaaaaugcaugagcguauaaagaaaagaauaaaaauaacccaucaucccaucacuuagcgagagcucuggcuaauaguuugauguuucuuccugcuuguuuuccccugggcaugugucuguuuguguguggcacauaugcaugucagauauccccagguucccucuggguggguauagauuggggcacccacccucagcacugaaauguucucacccagaguauauuucccauguagucuggauaauuucccuccugucauucuccuuggauuucucuccugugauucuccucuuucaaaagugaaaggaugcuccuuguaaagacuguucuuccaggagggaccgauguuuggaggagcucagcaugggacacugcacaguggggaaaaugagacugaagcuguacuauaaucauucuucuugaacaaugauuccaaagugcuaccagguacgaacagagaacgucuggucccuucucucauuccaugaggcuugcuggauagggcaaugcaggccagguuugccacugaguugaauaacuggaccugguggauuauugaggagccuggugcauuacagagaaaacuuuucagagcaacuuggcaucccuugaaaaaauaugcuaagucaccauagaaccuccaaccaguuuguaaacaccagauucucuacugauauuuugggucagauucaccagaaagcagaaucuaauacaagaauugggugcagauaguuugagagguaauugcaagaagcaggaaugaggaaacggcauaaggggaaugaggcaggaauagaggauaaacuguuauuaggguguauuauuaagguuccuacugugugcaguggggacuuaauuccaccagaacuucaggagaacgacacagaaugccucauggaguugucugcuugaaggaugaggaacuccagcuagcuucugucccccacuggcugagccucguccuuaggacagugaagucccuagaggguuguguguuugaggugugacuuucaagcaggaaguggaucugaacucgcauaggacagcugugcugaaagaggugguggggcaaggggcuugugauguaggauucagagucuucugcuauaaucuaggaaauuuagaaggcuucuugguuucacugauuugagcaaguuuuuucucuugucuuaacuccucuuccuaucuuccccuauuccuauaauucucuagucuuacccauauuucaaguaacaguaugguucuuugcccuuggaugguagauaguguuuguuuguuuguuuuuagccaauuacaacauucugacucauaauucuaagcucauaauuuuuucagacucgucaggagcaagcauugggccucuugagcauugagauucucuacuuuuggugacuagaguucuguacuucuuuccacaucacuaguagagaccaaacuuggagaauuugagggaaugagaacaguagaaggcgugaggcaggcuaucuucaccugcagucccauggcuagauugggucccaguuuggaacuggagcagaucuuguguggcuuuggucugggguugauugccaguagaugggaacacaggcuuccugaguauaccugagauggucacguggccggcccuccaggacuuucuuggccuuggguuggucuggauauacaaauguugaacauaauagaagcacuuuuccagcccucugggguuuuguucagaacaauauucugaccugcucuucuguggggaguauuggcauuggucuuucaucuuuccagaguagaaacuagaggcccaaagaaguuaagugguuuacccaagguggugucauuuuucacugguaacagagagagcuagaaccaaggccuccugacuuccaaucuagagucuuugacuuuugacuccacaccuccacucccaccccuugccaccaauguagaaacaggguauuuuuguuccuuguucuaucucucacuuuggacuccuagccagauuauaacucugugaagggaggacccaggccccacguaccccacuccucugagcccaggucuagccagagcaaguguuuaacaaaagcuuccuaauuuaccuagaggggcaauccucagggcagcuggcuccuccccagcgggaaacccggcccauggcccucucuuaguuccaggcuccauggagaggggaaccauguccaucugugauagaccucagcuuguaggcagcaggcuuggaaguucuaccuucuugauaagcaggauucacaugcuggcuguucucaggaauuugcuucauucuagggcccauugagggcugagugaggguguccucacugacuccugagcccuuggcccugggggcugguuucuaucuauuucugcuauuugccagaugaugccccauacagcagagucagcucugccaugucuguccucagucuaggauuagacaguggugucuucccuuaaccuuugggggcagaccuguauuguugaccuuugcucuucccucuuucacuaaagagcauguaaaguacuguuugaagauaaaggcagcuuacuaguuaaccccuuagagccagcacuggcaguccauguaucaaauggucuucguaagauuauuccaguuauuucugcugcucuuugaguuauagucagaauuuugauuguuuagggccaaagagaugagucugggucaaaggcagagugcugagcuuuaguagugccucuggguggguaaaggaaggguggguuuuuuucuaguuccucauucccagugacuacccauaaaucuuaauuaaaauuggaggaguucuccuccauguuccccucaagcuuuucuuuuauuuuuauuuccauuuuuuauuuauuuauuuuguggugacacaggaucucauucugguugcccaggcuggugugcaguggugcgaucuuggcucaccacggccucgaccucccaagcucaggugauccccccaccucagccuccugaguagcugggacuacaggcaugugccaccaugcccugcuaauuuuuuguauuuuuaguagagacaggguuucacuguguugcccaggcuggucuugaacuccuggacucaagcaaucugccccccacccccaucggcuucccagagugcugggauuauaggcgugagccaccacgucuggccacccccucaaucuuuuaaaugaaauaauuuaacaaauauuugagagcuaauuacaugugccaucauuuugggacuaaaagagguaauugaugggaucucugccuucaagggucuuacgguauacuuggagagacaagcggcauauguggcaaagaccacacuagacaggugugaagggcaggccugcuaagcagggcaucagaguacuugggagagagagagaaagcacuuuggauggaucugguuaagagaagccuucuuggaagaaaugagauuucagucaggucccugaagauacguguuuucuuuacaacagguuuauggguaucucucuuugugguaagacuuuauugcacauucaacaaugacaacaauuuaaggauccuggggacaagguuauuuuguuccuagauguucauuauaguauuguucauaauagccaaagauuggaaacaacuuaaguauccagugaugaggcaucgguuaacuagacuguggucucccguauuccccauguuguggaauauuuuguagccaucauacaucauuuuugcagaaguuuauuuauugacaucaaagaauauucacaauagguuguucauugaaaaaaaucagguuccaaaguacuauguacaguaugaguccauuuauauuuguuaacaguaacaaacaaaacauggcuucuuaaaaucuuuuugcuuacucauuuucugauuuuugcuacaugugcauuaacuuguaaauaaaauaaccuucugugcuuauucauuugaggaugaaauaaauaaauaacuuucugauguuuucccuucuuuucuuucuuuuuucuuuuuuuagagacagggucuuucucugucacccaggcuggagugcaguugugugaucauagcucaugguagccucaaauuucucggcucaagccauucuccuauuucagccuccugaguaccuaggacuacaagcacaugccaccaugcauggcuaauuuuuauuuuuauuuuguagaaauagagucuugcucuauugcccagguuggucuugaacucuuggccucuguagauccucccuccucagccucccgaagcacugggcuuacagguguaagccaccaugcccagcccuccuuuuuuucaauaagagaguuggaaugccccauaauaccuguagguggacagguccaguggagucacaugucccuuauuuuguggggaauauugcccacagcucacucugguccucaguuucugaagacaaguuggcuugcuugagacaggagguacuggggagccugcccgcuccuggucuaaagagcaaugccugggaggaagccucuaagugcuucuuccuucuaguugugggaaccugcauauuucucaggcaugcagcaucuggggcugaacugcccgucugcgucuguggcggcucuauuuuuuuuuaaauccacuuucuucauacuuugcauuuuagucaggaaaucacugcugcccacugucuaucuaauuagagugccaggaagaaaaaggugcuuuugccauucugagccucucugggaaaagguuaugagacaagagugauagaauucaucuucuugcguuagugauggggggcagggucucuguucccugaaaagcuuauucagaugaccuauuuggucuagacucugucugucucagcaauagcugucaucugaaugucacuuuagaagguuugggugcuuccuuuuccuucucuuucagcaguacuauauuacaauucgaaugcuaauuaguauguuuuaaaaguaccccuuuuaucacacauuucccaaaucuaaaaccuuuuaucucuccucauugccucuaggcugaaguucagacuccucagccuggccuccaaggccuuucacauuuugacccaaccucccuucacaaccuccuuccaucuccucaucuucuuaaaacccuuguaguucaucagagccaauccauccuuucauuggccccaaauacauuuacaggcuggcuucugcauaccccucucugaaucacccuccuuccuuuuguggaacccaauucuacucuucuuuccuaggccagcucaguccuuccucuugaagucuacccagaccucuugagugcacagugauuucucuugagcucaacucuuuuagcacuaucuucuauacaagucuauaccacuucauuuggcauuaaaaaaagugauagugaagaacacaacacaaaauuugccaucuuaacuauuucuaaguauacaauucaguaguauuauguguuuauauuguuguguaacagaucuucagaacuuuuuuaucuuguaaaacugaaacucuauacccguuaaacaacaacucccuauuucacuuuaguuggcauuuuauccagaaccaugcugugauaucacauaugcugaacuguuuaauuccacuagccuucacuaagcaccaguguuccagguaagccacugguagauucuagaggaauacaaagcugaauaagacacagcuaccaaaugugaagaguuugcaauuguucucaaauaagaguuugcucuuguauucaugugucucaugucccuaaauagaugaaaugagaacaaacuucuuaugagccacaacaauuucuuuuuuuuggaacaaagcagaauaaagugacuaaauaaaugcagguaucguucuuaugacacccaggauagaaaugggcauauacuuacuauguguuguuugauaauuacacaugcuaauguaaaugaguuccugggcuauuuggggagucuguguucucucaaauaaaucauacauuuuuaaaaaagaaagaaauuguucuuucauuauaauaagauuacuuuuuuauauaguaaacacaauaugugccugucaaagaaguaaaaagacagaaaagacagacaagcaaaauaacauaaauaccaguaauagugaugacugcugugaaccuuuggcuugcguccuuucauauauuugacuauauggauucagacacacacacauuuuguguauuuuuuaacaaaaauaaaaucauaucacugauacauacuccuuuaucagcguaacauaguuugaauaucuuugccuguccauaaauaauuuccuguaauauaauuuugauauaacaaaucuuuauugaggaccuaugcugucccaggaacuaauuuagggauuacaaauaaagcaaugaacaagacuugcaugaagcuuacacuaugggcuggagcaagaugaaaaucaaacaaauaaguggacaggauaauuccagauacugauaaggguuauuaaaacaaugaugugagacuauuuuagauuggaugguccauaaaggucuuuugaggaaggaaauuuugaguugaggcuuuaacgauacuagcgagcucccauguaaagauuaggaaaaagcauuccaggaagagagaauagcuaauggccaaagcuuaagaaugaacuuggcauguuugagaaaucauaagaaagccacuguggcuaaaacgcagugaggaagagggaaauuggguauuaaaucagagagguagauguagaugagaauuuuuguggggcucuugugggccucauagcccauggucaaaauuuuggauuuuauccuaaugucaaugagaagccauuagagggaaaugauaugaucugauuuguuugaggaggacuguucucccuaaagguaauuuacauuauuaacaaaagagagaaccucccccuccccaccacacacacaccacacacaaaugcaaucaucacauuauauucaaagaaaccuuggauaaaaaucaacacacaacagaggaaaacaccacacaacaaauaaucuggugucuuuaccaaauggauugcaagaagaaaaaaaaaaagauggaggaacaaccuauauagaucgaaagagacccaaaagacauacuaaaaauuaggcaaaaccaaaccaugguguuuaagauucauggcugggugagcgaacuaugagaaaacaguaaggaggugauuaccaaaaagucaacagagcaguuacucuugggcagaaggaaggaggggcucauagcugggaagggacacacgugaggcuuuugggaugguugauuugucuccuuucauggguagugguacaaagguguuuggcuuagaauaauuaaguucuauuuuuaggcuguuuucuuuauuuuuguuauuuuagcuaugaaaaagguuuuuucuaaucgacaauuauucaugauaaaugaaaugaaggggaacuucuaaccaacuauaaaaacacuagagcaaacaucuuucuacauaaggacguguuaguguuagaagcagucacuuuaaaacaaggaaugaaacaaaggucccccuaucaucagugcaaaaagacaagaaaaagaaaugagagacaaaagaaugagaagggaggaaauuaaauggucauuuuggcauuauuugucauuauuugcauaaaaaacucaaaacaauacauagauaaacuauuagcaguaauaggagaauuuagucaguuagcuugauauaagaugaauauguaaaaguaauuuacauucuauauaccaacagcaaacuaaaacacauaauuaaagagcagacgcauuuaaaauaguaccagagaaaauaaaauacuuaaaaauaaaucuaacaaacguuacaugccuucuacuuuaaaaaugugcaauuucauuaagagauauuaagggaguacuuaauaaauuaagggagauaacacuuucauagauaggauaauuuaauaucauaaagaugacaauucuccaauucuacccuauuugaccuacagcguuuuuuauguuaccugguaaggauuuaaaauacugaaaaaagaaaaguagggagagaagauuugccucaccaaauaucaggacuuauuaugaacuuauaguaauugagacaaugugguuuuggcacaaggaaaaacaaacugaccaauaaaauauauuagaaagcucagaaacugccucacauagauauggaacuucuguaaaugauagaaguagaaugucaaaucaguagggaaauaaagaaugauauaguacuuggaacuggaaaaaaauucauaugcaaaaaagcgaaacuggaacccugcucauacccuauacaaaaagucaacuccagaugguuuaagaauggaaauguaggucagcccaguggcucacgccuguaaucccagcacuuugggaggcugaggugggcagaucaccagaggucaggaguuugagacuagccuggccaaaauggugaaaccucuucucuacuaaaaaauacaaaaaucagccaggcuggguggugcacacucagugagcugagauggugccacugcacuccagccugggcgaccgagugaaacuuugucucagauaauaguuauauuaauaauaauaauaauaugaaauguaaaaaacaccccauaacuuaaaaauucuuaguagaaaauauaggugauugucuuucauaaauugaguagggaaauauuuuuaaacaagacacaaaaauauugacugcaaaagaaaaacggauacauuugaccauauuaauauugagaauuuuguuuuuuuuugagauggagucuuguucugucgcccaggcuggagugcaguggugcgaucuuggcucacugaaaccucugccuccgggauucaagcgauucucugccucagccuccugaguagcugggauuacaggcacccccccacaccaugccagguuaauuuuuguauuucuaguagagaugggguuucaccaucuuggccagguuggucuugaacuccugaccucgugauccaccugccuuggccucucaaagugcugggauuacaggcaugagccaccgcgcccugcugagaauuauuauauaccaaaagaccgcuuaaagaaagugaaaagacaauuuacagacuggaaaaaggucuuugcaacacacaaaaccagcaaaggauuaguguuaaggauacgcaaaaaacaacucuuacaaauuaauaagaaaagcacaaacaacccaguuuuuaaaaaaugggcaaauaacaagcauuucauagaauaggaaacacuuaagaucaauaaaaacauggagagauguuuaacaucauuagugaucagggagaugcaaauuaagaauacaauucaauaacuuuuagcacccauuugcuuggcaaacuuuaacaguuugauaaugccaguguuggaaaaagaaguuagaaucauaggaucucuucaaaauugcuagugggugcugggcaccauggcucaagccuguaaucccagcacuuugggaggccaagucagguggaucacuugagcccaggaguuugagaccacccugggcaacauggcgaaacccaaucucuacuaaaaauacaaaaauuagcuugauguaguggugugcaccuauagucccagcuacuugggaggcugaggugggagaaucaccugagcccaggagguggagguugugguaguaagccaagaucaugccacugcccuccagccuggaugauaagagcaaaacuccaucucaaaauaaaauaaaauaaaauaaaauaaaauaaaauaaaauaaaauauugcuagugggaauguaaacuggugaacaguuuggcaaacaauuaaaguuugacauuuacauaccacaaaaugcagaaauuacaugccuagauauauauccaacagaaauucuugcacauacacaauaagagacauggaucacaauguucauaacagcauucauaauaauaaaauaauaauaauaaggccaggcacaguggcucacgccuguaaucccagcacuuugggaggccgaggugggcggaucacaaggucaggagaucaagaccauccuggcuaacauggugaaaccccgucucuacuaaaaauacaaaaaauuagcugggcgugguggugggcaccuguagucccagcuacucgggaggcugaggcaggagaauggcaugaacccaggaggcggagcuugcagugagccgagaucacgccacugcaguccggccugggcaaaaggcaagacucugucucaaaaaaaaauaaaaaaauaaaauaaaauaaauaauaauaauaauaauaaaaaccuagcaaaaaaucuucaaugcccaucaacaagagacugaauaaacuaaauccauaacuacaguggaauauuacacagcuguuugaaugaaugaacuguggugacaugcaacaacaugcgugaaucuuaacaaauaccacuaagugcaaaaauuauugcgugccacgggauauuuuuuauuaaauuaaaaacuuuaaaaauauguguauuuaggaacucuuauagaugcaauaacacuauauaaaaaggaaagcaagggagugaggauucagguugauggcugccuggcaugggagguguuaggacauggcauggguaggggccaaaugugguagguuuaugggugcuuuuaauacuuuaaacaaaugguuagcuagcuagccaggcagcaaaguagacagcucugacugcuaugugaagaauggaucaaaggaguagaagcuggagcaggaugaccaguuaggaagauguuuaguauccagaugaaggagggugaggcauuguucuccagugguggccauugagauggagaguaaugaacagaaucagaaucuauuccggagauaauggagaacuugcucugaugacuuagaugugggaggcaaggaauauucuauuguacaaaucuuccauaauuuaacagucugcucuuaugguacaucuaaguuguuuacaauauuuuuugcuccaguaaaggucuaaaaugaacauccuuguaccuuaaucuucaaacaaauucaauuaaugucuuucuuuuuuauggugugagaccggggccaauuuuauuauauuuaagacuguuuguuuuagagcaguguuaggcucacagucaaauugaaaggaagguacagagauuucccauauggccucugcccucauacauguucaggcucccaauuacaauaucccccacgagagugguacauacauuacaacagauaaaccuacauugacacaucauuaucacccaaagucuauaccuuacauuaggguucacucuuggugguguacauucuauggguuuggacauguguauaaggacauacauucgcuauaguaucauauaguauuuucacugcccugaaaauccucugugcuccaucuauucauccuucccuugccccaaccucuggcaacuacugauccuuuuacucucuccauaguuuugccuuuuccagaaugugauacaguuggaaucauauaauacguaaccuuuucaauuggcuucuuuccuuuagcaauauggauuuaagguuccuccagaucuuuucauggcuugauagcuuuuuucuuuuuagcacugaauauuucauuuacugguuuaccacaguuuauucauuccucuaaugaaggccaacucgguugcuuucaaguuuuggcaauuauagaagaugauaugaacaucugugugcauguuuuuguauggacguaaguuuucaacuccuuuggguaaauaccagagagcucaauugcuggauuauaugguaagaguauguuuaguuuuguaagaaacugucaaacuaucuuccaaaguggcugugcccuuuugcauucccaccagcaaugaaccagaauuccuguugcuccacauccucaccagcauuugguguugucauguucuggacuuuggccauucuaauagauauguaucuugaauuaguuucugaaaaucaaccugcagaggcugggcgugguggcucacgccuguaaucccagcacuuugggaggccgaggcaggcggaucacaaggucaggagaucaagaccauccugucuaacacggugaaaccccaucucuacugaaaauacaaaaaauuagccaggcauggcggugugcgccuauagucccagcuacucgggaggcugaggcaggaggauggcgugaacccgggagguggagcuugcagugagccgagaucgcacuacugcacuccagccugggcaacagagugagacucucgucucaaaaaaaaaaaaaaaaaaacaaccugcagaaaugaaauucuuauaucaaaggauaugugcauuuaauaaggcuuuugauacauauuaccaaguuagcuuccugaaaugaaagauggcaccacuuuagcucccacugguaugaggcaacauccaccuguccuuuucuacauucaaagcucuguauucagggacagucucauuggcaguggaagauagguagaucugucuagugaauuucuccuggacagaugugugguuacucagcagucucuggcugggaucgucccaguuagagcauuuacuucccugcuuccugcagugggcauccuuagagcacuggaccccugccuuggguccuuuccuggagcaugagucaggaugugagguggcauaauauccuuuuuuuuuuuuuuuuuuuuuuuuugagacagagucuugcucugucacccaggcuggagcgcaguggcgcgaucucagcucacugcaacuuccgccucccggguucaagagauucuccugccucaucagggacuacaggcgcucaccgccacgcucggcuaauuuuuuuuuuuuuuguauuuuaguagagaugggcuuucauuguguugcccaggcuggccuugaacuccugagcucaggcaaucugcccgccucggccucccaaagugcuaggauuacgggcgugagccaccgugccuagcccauaauauucuuuuuccuaggaaaggcuccuuagcauauggaucaaagagaucucuucccuuuuuuccuuaccagagucuuccacucagacucuggcugccuccaaccccuaaagagccuuuggggauuucuaacaaaccugggauuuuuuucugagucaauuuggaaagguuaagcaagcauauaaaagaauuaauuaauuaccgaaguuuauguccccucagagccucuaaagcugugcuguccaauacaguagccacuagccacaggaagcaauuuaaauuggaauuuaaauuagucaaaauaaauaagauggaaaaauuccauucuccaguuccacuaaucacauuucaagugcucaagagccacaugugcuaguggcuaccauauuggacaacccagauauggaacauuuccaucauacagaauguuuuacagaacaucacugcagagguugguuuacuccagaaauauucccaggggcccuuuuaggugugcaguugagauggucaguaaggguggguaggaguuauuguuaccaauuaauaugacuugccggauuucucccugcucaucuaaaaaauaguucucauuuaugucuagguucuuuuugcuucuuucucuccggucuugaguaagggucuccaguugugucacaguuauaucuuaaagacuguguguaugugugcuuuauaagagaagucugaucaccaauuuauaucauugacugaccuacgccaaagccccuuuccucuagugcaagguccuggggugugggaggauaucccaggggccacgccugacacauagacaggcugaaguuuugccuguguuugcaguggaccuaaggacaaauguuaggcuaacgccagaaauucagaauuuuucauuccuucccauuaccucaguuucuucuugugcaguaugaagauggaguuucuccugagcauuuuggagaugcaagaagggauugcuuggagugacgaagcuccagauucuguguucauucugcuaauccuggagcugggguaaacaugugacuauguuuauagccugccuauguccagacccugcugugagaagcagcucuucccaguggccuaaauauagcccugggagccccacaugccacauucuaucuagucuuggcuugcacacugacucacuguaugacucugugaaagucacuuccccucuccucccagugggucauugggaguuggggggaguguggauaauugcccugagucaccucucagagaggagcugauuagggcucaaugaagcgaaagguguaagcugaaagggcaagggaagaagcaacucuggauagagcucgaggagagggggcuuggcuuucacacugcuugggcaagcuguccccugagauugggaagccugggaccuaugguuagcuucaaaagguccguaaaccucuuugaauuaugaacagggauacguggauguaagccugcaugcauuuuuauggggaaggucuauagcuuucaucagauucucagaaguuaaauaaccccaaacgguucugaaucacugccuuaggaaguuugacuuggguucugaggagaggaggugcuguuccuguuucgggaggggcagcaaagguugggcuuccccaggaagucagaagccagcugugcuagguacagugcuuagaacagcccauggagaaaggccaggcacucuuuugggcccuugagauagaaaugaaauacuuuuuuuuuuuuuuuuugagaccgagucuugcucugucacccaggcuagagugcaguggugcagucucggcucacugcagccuccaccuccaggauucgagugauucuccugccucagccucucgaguagcugggauuacaggugugugccaccacaccuggcuaauuuuuauauuuauaguagagacgggguuucacaauguuggccaggcuggucucaaacuccugguuucaagugauccaucuaccucagccucccaaagugcugggauuacaggaaaugaaauacuuuuugacucaucuacaucucccauccccuacucugaagucugcucuucccagguguuuggcccuaagugaggucaguaucugcaugggcacacccuggaagacaagguugaagaacauaugcaugaguaugguaugcuaugcaaguaucugggcugaaaguaaaccaugaauaaggaauagaaaagcagucaucuguggaggccauaucacaaagcaaaagggguguuagaaugggacugaggacacuugggcccugauucuuacguugauccuaaaucacuuugugaccuuagcggucacuuagcuucucugugcuuauugugccaucuauaaaaugggcuaacuuccccugaccuaaauacugacaguggcuguugugagaaauaaaaaggaauuuaacaaaaauuagcauuuguuauguuuucuuauuuuaaaaguuaauaaaugcucauuguaggaauaugaaaaacccagaaauaugugaaaaaaggaagaauuauuugcaaccucuccauucugaaguacaucuuauaaaaucuuggaaauuaugcucgcuuuggcagcacauauacuaaaauuggaacaauaaagucucggaaauuuuccuuacaagucauuuuuccaugcauauauuuuuucuccuuacuugaucuuaauguucauguaauuuuauauacugcuuuucuuaccuacuauuguauagugaccauuuaucuauaucauuagucguucuucagcaaucucauuuuuaauggcugauguuccaucacuggaaggcaccaaaauuuauuuaacaaauucccaaguguaggccauuuauaaguugcuuccaaauauuucauauauuauaaauaaugcuauguugaacagccuuguguauaaaucuuuauguuugucucucuugccuuaaaagaaauucuuagaacugagauuacugugccagaauguaaagcugauauaauuaaauauuuuaauauauauaaaauacaaggcauugaugagacugauggcaaauaccuguucauucauuauuaauguaaauucuugcaugcccauugcaguugagacauuucugugaaugggaggugaauguuucuaugauccuggcgcaggguagugcaguugaauuagugucuauuucucucuuuuggaauugugcuaugccaggaaaacaaaucauuuaugguaagaaagcuuucaguaugagagagcagggaguuuuggcaagguauccuuuuaaaaggaucaacaaacaagcucuugucaaaguguuugaaacucucaguuccagucaauacccuauauaucuuaauagcaugagcaagucccauuauuucucggacuucuguagucccaccuauuaaaauagggagacuaauccuuaacccaucugacauaaaggaauauugugaaaauuuaaugaaauugcgugucugugaaaguauaacaguauaagcaaagguucuuuugccuucucuuuaucacgagauugagggcugcugggaguggaaggaaacaauggagaaccaggggcaauggagggaagcgucugagggacugaaagagaaauaaggccaagaaauagcacauggaguuugguagagcucugaccuggaaaagcccuggaagaggagcagauccagaugggcccgccuucccuuuaggcugggccuugccuugggccagcuguguccugaggaccacucucagacgcagggcacugaaacuuccccagaaacagagaccuuucucaugugacccugggugccuugggacucacucucuuggaggcaguuuuuaguggcuaaucaaacucacagccaccuucuccuccaaaucuucagauaggcuggauccugcucuguggaaaugaggaagggaaggggggucccucugagccaucugcucaccuccaggggagugacucugagaaucaaggagaauccuaugaaugacuccccacuguccacaggaaugugcaacacuucccaggcucccauagccaaagaccuaguguuauaaacagaagcugugguccugagcugucagagagguuaaucccccagacaucagggccuggccuggcagaguugggagcugggcugauaaagccugauaaagggaagcagcaaggggagaggaacugcaggagugugggauggacccccaugaaggcaguuucugauggaggcaagucauaaaauuucccccauucauucugcugccccugggcaagacuacuccucagccagcuaagaguacgacacaaaagaucuguccccugcucacuggaccaggggaaagcaaggcgccuugcgggggaaugggaagaggauaacacccgaaaguuguaaagaaauaauuccuggcauuuucugagcugcccugaggcagaagagagagaagaacaauuccaacaugguuccaacucucaaagaaccggaaacucgcugucuaggacugacgcgcucugcuggcuuucuuauagcucuucccuucuaauugacuacgacuugaagaaaagcaacuaacuaaugaacaaugugagcugcuggaaaugugccaggucacgugguacaggccaagagugcuguaggaguuuagaaaaggcagagauuggugugggcugaagugauuagaacagguuucccagagaacgggggccaggacacaguccuggcgguuuggauccaccguaaagagggcagggagguggaaaggagcagcuuuaggagugaggggaaugugcuuggacagugcugaggcucaggagugccccgggaucaugcugggcagcuguaggaugagugguugggagugcaggagcagaucgggggaggaagacagauuguagauugcuuugaauucuaggcagaggaguuuaggcuucacuuuacagaaaacagggaguagaaagaaccccuagagugaggaggugugggaagccaugcuuugcuguuuacuuccaccaaauuaauuucuuucugcccucagugaggccaccucaaccccugaaccauguaaggucucuucuaagagcuaaaugguacugcuccaaacgugcucuaugcuggcacagccuuggagauugcugucaagcucuucuuucuccagcgccaccccuagagaccacugucauucuucauuuuucuucccaugccuccucuccagcauccccucuagguuagcaggcuccagggaggagggcagauacugggagcuugcucugugcuggggcacagccuuaaacaggauccagccucugucuacaaagcccacagccugguagagccagacuaaauggacaugcaaagcaugacaagagucuuuuuuugcuggcagccuggagccucuaaugcugaacugggucuuccucauggugcuccuggaaccauggaacccuagauggaguucuaggaguucugggaccuguccccugaucacuccccuauuccugagggaaucccugggcuuuggugccugggauagaaccagagccucagccuggcucugcacagccacuuggacucucucuggauuagcuucccuguguuaagagaagggaaacggccacagggaaugccuuccagaggcaggacuugaacacugccagcauggcggguuaaggauccguaagagucccauaugagggagacccaggccagggccauggcugcugggaggccggcccuucccaccauggccauguggggugagugggcuacauuuuccugccugugaacuccaacccuaggagugggaacagugcuccaagccaccucuggaggaaggggaugucggaggggcacaggugguaggggagcagcacccagucccaaaugagcagcuugcucaggcuggugcugggugugagcaaucgcucugcacucagcaacagcucucgucugccugaccucagagcguguacagcaagcccagcauagaugcugcuggcucuauucuggguccucaucucuguaucagucacaccacagggaguccuucuuaggaagcugcugccacuguugaugcuuuucccaacucuucacagccacgcugcaccccaggagcuaaggcuuagugucuccauccuucugccugcccccugagacacauuuacagaaaccacuucucugcacaaccaagcuccuaguaggggguaaucaagucaagagaugcauagauuucaccauuugggacaggaaaguaggagggagauuccccagggaaagggaguugccugacaagcucagaaaaaauuguggggagaauuagugguaggaagaagagacagggaagggaaggaaacuggguggaaaauucuguauugaagccaacugauuguagagauuagugcugguguucagguggagcccauucugucugaacagacaauucucuccauccuuuccccacagagcucauugggguugaaaguguugaauggcagucggugacuuuuagacucuucuuggaagguauuuuccugcccccagccuucaaggauaucugccaggggaauggugggcaugaggauggugugucugucuuggaggguacacgcugaaagcagacuugggcuaagagcagagcuuauuuaucugcacauuccuauggaucuaaggcuuggacucugacuucaagagguucucuauauccugaggacagccuuggaaggaacaaaaccagguacagugaagauuuuuuuuuuuuuuuggugaugcugugaacauccugugaauuagaaagacaaaucucccaaagagcuggggcuggauguuuggcuucaccugaagcagggccccuccguuuucaagagucaggagagagcugggcugccucaccugugugucccuggcccccaggacugcugagcuguuuccaguguggggagagaauuucaugggcugucaucaccaaacccaucugccuccggauguccugggaguaagaggaagaaagaggcagugauaagcagaaauagcaugggaugugacaaacuggagggaccuuccaugggaucugaugggccugaggguuuugcuuuguuuuguuuuguuuuguuucugguguuaccaaauuucuuaguuuccaacagaguauuuucacacauggccucuuauauuaguuauauauuacugcauacaaaaucauuucaaaauuuagacuuacagcaacaagcauuuguuaucucacaguuucuguguaucaggaaugcagguaugacuuagcugggugcuucugguucaaagucucucaugccauugcagucaagcuguccuccaggacugcggucaucuuaaggcucagccagcguugcaggaucagcuuugaagcucacucaugugucguuggcaggauuuggaagaucugcuuccaagcacacucacaugaggcucuccacagggcucccuuauaacaugacagcuagcuucccagggacaagcaauccaaaauggaagccagucuuuuuaugcccuaaucugcaacaugacaucccaucauuccccacauucuauguguuagcagcacaucaauaaguccaacccacacucaagggagaagauuacacaagaacgagaaucccaggagauggagauuuucgggaggcugaccuagaggcugccgaccacgucucucauuuuggccucauagcaacucugugcucuagccagggagaaaucgucugcagguaaggaggaaaaggaaaaggagcucuagggaggugaggggcucuacucgugaucaaagaguugugaagugguagauuuagaauuugaacguaggcguccaucugacuucagacuuaguagucuuucucuuuuuuuuuaaauuauacuuuaaguuuuaggguacaugugcacaaugugcagguuuguuacauauguauaugugccauguuggugugcugcaccuauuaacucuucauuuaacauuagguauaucuccuaauacuaucccuccccccuccccccaccccacaacaggccccggugugugaugcucccuuccuguguccuuguauucucauuguucaauucccaccuaugagugagaacacgcgguguuugguuuuuuuguccuugugauaguuugcugagaaugaugguuuccagcuucauccaugucccuacaaaggacaugaacucaucauuuuuuauggcugcauaguauuccaugguguauaugugccacauuuucuuaauccagucuaucauugauggacauuuggguugguuccaagucuuugcuauugugaauagugccgcaauaaacauagugcugcaauauuguggcugcgauagugccacaguaaacauagugccgcaauauaaaaagagucucacaauauugugaauagugccacaauaaacauacaugugcauguuuauaauauagcagcauguuuuauauguuuauaauauacaagcauguuauagcagcauguuuuauaauccuuuggguauauacccaguaaugggauggcggggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggugugaaauaguaucucauugugguuuugauuugcauuucucugauggccagugauuaugagcauuuuuucaugugucuuuuggcugcauaaaugucuucuuuugagaagugucuguucauaucuuuugcccacuuuuugaugggguuguuugauuuuuucuuguaaauuuguuggaguucauuguagaugcuggauauuagcccuuugucagaugaguagauugcaaaaauuuucucccauucuguagguugccuguucccucugaugguaguuucuuuugcugugcagaagcucuuuaguuuaauuagauccuauuugucaauuuuggcuuuuguugccauugcuuuugguguuuuagacaugaaguccuugcccaugucuauguccugaaugguauugccuagguuuucuucuaggguuuuuaugguuuuaggucugacauuuaagucuuuaauccauccugaauuaauuuuuguguaagguguaaggaagggauccaguuucagcuuucuacauuuggcuagccaguuuucccagcaccauuuauuaaauagggaauccuuuccccauuucuuguuuuugucagguuugucaaagaucagauaguuguagauacgcggcauuauuucugagggcucuguucuguuccguuggucuauaucucuguuuugguaccaguaccaugcuguuuugguuacuguagccuuguaguaucauuugaagucagguagugugaugccuccagcuuuguucuuuugucuuaggauugacuuggcaaugcaggcucuuuuuugguuccauaugaacuuuaaaguaguuuuuuccaauucugugaagaaagucacugguagcuugauggggauggcauugaaucuauaaauuaccuugggcaguauggccauuuucacgauauugauucuuccuacccauaccuugacgccugccaaucccauugucuacugauaccucugguuagaauuuggagcagacuugaguugauugaacauuaagagcuugaugcuggcugacuugccacuugauucuuucuggcuguuucuggauucuuagggacaugguucauaaucauuccccucuauagcaaggacaacuucuaccuaccauacuucuuuuuauauuuuuuaauaaacuuuuuauuuuagaacuuuuagguuuacagaaaaauugugaagauaagccagagaguuccauauaucccaacccaguguucuauaguauuaacaucuuacauuagugugguaccuuuguuauaauuaaugaaccaauauuaauguaguauuaugaacuaaaguuuauacuuuauucagauuuccucacuauuccuuuguaauugaggcaggcacugggcgauccauucauuugauuaauuccuagucuaguccuucaaguuggcaccauuauuaucuauauuuuacugaagaggaaaguaagacacaaagagauuaaguaacuuggcagaucacagagcugugcagaagcaaugucagcacuuuaacuaugggcucucucacucccaugcagugcucuuaaccauuuaugcuuuucuuccucucucucauccucugacuccugcucagaaggagggaauuauguacauaaguaauaaccuaacagcugguccuaccccuagggucuaagcuuuuggaaaagauaagaaccugucaggaaacuggugguguuuuaguaccuucuccuucagccucaacuuucucucugagaacugauaggauuauauuaaugacccuggggucucuucuggcucugacuuucugaaacccagugagucugucccagaggauuuaggggcuaccagugggaaaauuggggaggagguggguucugcuucccccaagcccagugagucauuggcaccucagggaaugagcccacuguuuggccucacuggcuucuuuugcaaaucacugcaauagaucacucauuauauaggauugaaucauguggcugcccaucaaguuaagacccuaagacuguuggcucugcauuugagguuauuaccuuuaacugguucaaagacuucaggaauaaagccucuggggaaggcauugugagcaauauuuuuuucugcaacacaaaugaaacccauucuuugaggagcacaagccuuauacaaagaauuugucuccucauuuaaaguggugggaggcucugacaacccugacuugucaggaauuccaaagcaggauugucgagagugucccagaguacugaaggguguggacuugagagucacauagacccagccugccucuuacaaguuggugaccuuggacaagucucucagccucucugugucaccuuuucaacaucuauaacauaaggaaaguauaagguuagcuaccucauggaguuguucuuagauuaaauguaauaauuuagguaaaaugcuuaguugagcccacaauaaaugcuuaauaaauguuagcauuuuuaggacuuguuggaauaauguauuauuuuuaauuuuaauuccagcucuaaaaguuauauuuucuuuuauucuauuacccuauuggagucccaaguaucuagaaagcaccaauugcugaaaagcauguucagccccaggauacagacaguuuucuucugguggacugaggcagagguaggggaggugaucuauugagcuucaccaacuauuuccuucacuaccaucugcaaaggaagccuguggccuuggcaagacagucucagcccagcccagcugccccagccagccugccuugcugcuaucugauauuccccagauggcccuagggcucuggagggccuccucucuugucuaaggaagugagcaggacugcccauaggguuacuccugcagggcucaucccagaccuggcaccuggcuuugugucugcccucucuggcucuccacauaccagucaggcugggguccuggacaccaagcucagggagggguacugaggcuacuccuuccuugaaaguaggacugggguaaggguggcagacuaggucagacuggccacacugcggggccgguuccuguagcaggaggcugcugucugugccucggaggcccuggggcaugcagaacaggcaaaagggucugaccaugaagugcugggaaagguguuuagacccagucuuuuuuuucccuuuucaccagaaagcacugcaccagagaagcuggacuugauuuugauucuaaguccuuugcugacugcgauuagaauuggcugagugauuccaagauauguaagaauggagagguacagggacaucgcgauauuauuggggguggccugcacauucgugcacauguaguacacaugacaaguagacauguacgacacacauaugaggcgcuuguguaucagcauucaagaaaccucuucuccagaggcacauuggcugcuagcccacacagggggcgcauggccuacauacagaccaggaaauggguuuuccacauccagagaacauuuacugcaucuaagcagccauucugugggccugucccccucuggguuuagaaaggaaguagucuaaagcuguggaccagaagcagaggcccccuaaagguaggagcaccccauaggcaugugccacguugcagaguugcuguccucaaccuuggugcugagaacaguuggucccgaggcuggguggaggaccaggccauuucugaggccucugaucuacggggagaagagaaauaggggcugguaacagccaaggaggaagaggaggcuggaaucuuacauuuuuaaugauguaggcucucacugguagaaaaaaaacuauugguaaauuauauuuuuuaaaaaauuaugacugguugagugugcgauugccucaugucuuaccugacaccuugcuguucgauggucuagguggcagcucaucauccucacaaucacguguugucaacuuagcccaagcuccccuguuugccagaccacagccuucuccccuuccccuggcucaaagugacugguguggcuugugccuuuugggguacccugcugccuccaaggcauagcccuuccccauuuugccaaggacagagguacuccccuugagaauggagggaggggaagaggaaaagggggaaaucuuggauccuugucacaucauagccuuuugugguaguuuuucauuuucucggugaggaggaaaacccuagugaggaauuggaaugaaacuauuugggguuggggaguauauauuucuaagcuauuggauuauuuuaccugaaugaaacauuuuuaucuccagagcaaaaagggccagggaggacuggguauguaggaauuguaaguggcuccuaguuuugcuuuuaaaaaacauuuuuaaauuacacaagaacuauugaauuuugaacaguuagacgauauggguaaucaaaaagaagaaaauaagaacacucauaaucucacuacccagcaacaaaacuaaagauucuggaguaaauucuuccagaacugucacuguguagaaaaacucuuuuaaaaaugggaucauacuauaccuacucuuucauaaccugccccauguuucauuuaaaaguaugugaggccgcguugugagggcaaucacgacagcugucuacgaaccaggaaaugggcccucaccagacacugaaucugucagaaucuuuaucuugaacuuuuggcuuccagaauugugauaaauaaauacuugcugcuuaagccaaaauaaaauacaaguauaugaggaacauuagcaagacgcgguggcucacaccuguaauccuagcauuuugggaggcagaggcaggaggauuguuugagcucaggaguuugagaccagugugggcaacauggagaaaccccaucucuacaaaaaacacaaaaauuagccagggguguaggcacaugccuguagucccggcuacuugggaggcugaggugggaggaucaccugagcccaagaggugcagcugagcugcagugagcugugaucgugccacuguacuccagcccaggcaacggagugagaccucgucucaaaaaaaaaguauaugaggauauaaggaaggaacaucuuucugugauaacagcuguguuuuuaugcuaucauuuuuaaaggucacaugguauuucauuauauaaauacaaccauaauuuauuuuaucaauuauuuauuauuagaaauuuaguuuauuuuuaauuuuuuauuaugccaguugcacuuccagauaaagggcuuuuuuuuuuuuuuuuuuuugcauauucuuacuucuuuaggaugcauucccagauggaacuaaagagacuaaagauauguauguuauaaggcuuuugauacuuauugccaaguucagaaagauugugucaauuuaugcuucacuaccaguaugugacuacuaauuucugcacacacucaccaauguucuuuucacuuuuacauaucugauaugcaaaacguuauuucauuuuaauuuacuuugauuaugauuuagguuaacauuuuaauaagcuuauuagcaucuuauguuucuuuuaugucuuugcccauuuuucuguugagguauuuaucuuuuucauauuguuacaagguuccuuauauaucuaggguauuaaucuuuauuuugauaaaugcuguauagaguuuuucagcuuauuguuugccuuuaguaguuuugugccauucuuuuuuggagacagagucucgcucugucacccaggcugaagugcaguagugcaaucucggcucacugugaccucugccuccuggguucgagcgauuuuccugccucagccucccgaguagcugggauuacaggcguacgccacauacccagcuaauuuuuguauuuuuaguagaaacgggguuucacuauguuggccaggcuggucuuggacuccugaccucaagugauccgcccaccucggccucccaaagugcugggauuacaggugugagccaccgugcccaguuuaugacauucuuuaauacagaggauuuauauuuuuuaauaugguaaacauuaucaguauuucuuuuuggucuacuucuugauucauucuuagaaagacucuucuauuccuccugugugacauaaacaucuaccuaaauguccuaguguuuuauuuaacauuuaggucucuuaaccaucuauaauuuauuuuuguguauuauaggccuaguguuuuaaaauuuuaguuaacuuguuauuccaguaucauuguuggacaguccauucuuuuuguuuuaauacaaaaugucacuuaacauucuacauguaucuauaauauuacauuuuauauacgcacugguccuguuaauaaagccuuuguucaacaccugcaauuguuucuuggcuuuauauuauguuccacugauugaucuauucugguaccugaacaucauuuuuaaaauuauuguagcuuuauaauacauuuucguaucuggcagugcacguucucuuuuuuuguucuucuuuaucaguauuuuucuuggcuauucuacguuuauucuucuagauaaauuugagaaucaauuaugcccuuggguuuuuuaguuuggaaugcuguuaaauguagagguuaccuuggggagauauguuguaaaguacuacauuuuuacuuucauuuauuccuuuuuguuuguuuguuuccuuuaauagagcuagagcauaauuuucuauugauagauccugcacguuucuuacuaacuuuaguccuaucauuguauguuuuauugauauuacuaaugggaugguauuuucauuauauuuucuaauugcauauugcucaugcacuugagaaugcuugauuuuuuuuacauuuguuuuguaacuggaaggcaagcaugcugucuucugguuuuuccuuuuguggguuugggccaaaggcauguuugaccuauuuugaggccauuuaauuuccuucugggucugggccacagcuccuccccgcaauuccuugccauugugaaaggaguuugggugaagaauggugggcacaaucaacuccuuguuggcugcccccuaaggacagauguguugcaaagcaaaugccuaccuaguucuuucccuacuccaaccccagcuguuuggaugccaggaagaugacuuaccgucuaguggaaaauaggcccaugaaucaaagcugacacaggcagagugaucguggaggagcuaggguguuaaaaugaaauugaugccaacccugggggcucucagggaaacuuuaagggccuacaugugucaucagcuuggucucugggcuggcugaaugcaucugacugagguaguccuuuacuauggcccagaggcagagcuagaucugcuucuuuucuccccauguuggggaaacugagguugagcaaacaggauagucuccaggauggugguguugucacuguguucccuucuaagaaggauggagauucauuaacuuucaaagcucaaggggaaaaaauaaaaaaaaaagaaaaacugguuauggagacuggccucauuuucaagucugaagcaaacgcauguuuggaaagguuucauggauagugcuaacuaaggauucccagcagguuuuacacauucuacuuugguggaauguaaagauuagcacugccuuuucugucugauuuuuagcacuugggguuauaucccagucaugagcacucucucagcuuuccugccuucccacugcuuccuaccacaggccacuucuucucuucuuugcucucuggucuuucaugcacagguugcaugcuagaggagaagauggucccagagguacccugaaaaaggagauaagcucaucaggggauagcagggcuggaauaguuagagagaaacauggagggauaaaggauguuggugggagugguggacacagagggucagagugcaggguagaacuuagaagccaaguagucagcccaaauuagccuugccugcaucuucuaguggcucacucuugagggccccuccaguggagguggggauguugcucuagucuuggugguccuaugaagccuaccuccuuaucaugugagguuuuaucaaccugacuugaaagcucugauccuguacccagaccuuauccauuggccagaccaguucauuuucucuacuccuuuccuuuuauccuuagaaccaaaugaauauccagguuguuguucaagugcucuaaagaaggaaacaccaccaucuugguugauguuuuacuccaguguuuuggaccaucuuguucccagaauguucuauuuuauagcuaucuuaggccuucuuguaauacaaaaccauuauccuguggcaugaauuggagaauguggagaauagucagacaucuuuuuucuguauagcccuuuagggacuucuaaagguuauucgguuugucuuugaacuuuugccagcacaaugaaguaaaaauaauacuuguaaagugaggggcacaaugccuggcacauaguaaaaugacauucauuguuuuuauugcuuuauuuauauuauucuuaggcgaugauagcacacuccauuugcaauauuauuuaaguucauaugucaaugggaggcauggaauuguuccaguaaggacgggaaaggcacauaguguuucccuugcccuuccuguuugagaggugaaugcaguguaagccaaaggucaucaucuauuauuugggguggaacuagaagcuagagggcucacuacuccacuaaacucuaaaauacuugagggcaagaguugugucuuauuugucucugaaaucucuggagcugagcauagaguugauucaauaaacauugguaaaggaagguaaggagacagggauaagcugguguggcaucucagcauugcaggagacacuaagaucccuguacaaaaacugucccucuaacaugucugccaaacuagagauccugccuugcuugaacgcaccuguugccugauaacucacuccuuuugaaggcugccagugaggucagcucuaauugguagaaacgcuccuuucauggaggcagaaucugcuuugccuugacuuuuaccuguuagccuuaugucugucccucugagcuacacaaaauaaauuuagucuuucuuccagauaacagcccuauagauauuucaagauagcuauuauuucuuauuuccuuuugccaaaucuagaacuugcuucagaaaagcuucaggaaacugugucagagucauaacaaguuauuaaaagccagauauguuggccuuaaucuuggcggguuaaauuagaauggcccuuuccuagcacuggcucagggccagagucugcuucuugggucagaagaauauggcaaggccucugagcccuagaacacuauauccuucauguucuaggcuaggacugugggcugccacgcggcugggcugauugcaagcgccggaacccucugccggcagcuuuccaccagguggcggggcauuaccugccugaacgcggacccgcgcaccuuccucaucucuccaccagguggcagggcaggcugcgucucagcuccugcaccggccucggagugcccucuccuccugggcugaggcugggaggaaagcuguaggggcuuuggaaaggucugcugccuuccccagugaggaccagcggaugccucugcugcccugugcgggugauggagcuggguucuugcugggcuugcugaguccugggcagccuguccaauaauaugccguugcuuguuggaguaguguccagaacacagccuguugggagccagcccucagugaaaggccgccgaacggagagcucccaguguggacagcuggcgcugccgcucaggagcuaccccucugcccuucccagcccuccuuccuccuuccaguccccugcaggcguggaggaaggugcugcugucucucugacccauccccuuuggcgaggaucgaccagguuccucgccucacacaaacaagaugaaguccaggcuugcagagucagaaaaaauucuggucuacaggccucuucucuauagggaggauguuccaauccugcccugcuccuaaacuaggcccccuugaggcuccggguucuggccuucugcgcccuacccucacgcaggcccucucagcuccgggcccaccacggaggcccguucuuucuguggucggccucaucagcugccuccggcuugucacuuccacaucuucccuucucaccccuucucagccgggcgggcaggcauggugauucugggcccagccucgguauuucauugggacgggacuaucggagagugggaaggccugacuugagcugccagugccugcuaggaaagcagaagcuguuucccucagaggccuugggggucagcauggccuccucccccuggaaugaaacucuggaaggggcuugaguaagcaugcaguccuguucuccauuuauuuauuuauuuauuuauuuauuuauuuauuuauuuuuauguuuuauuuuuugggacagagucuagcucuguugcccaggcuggagugcaguggugcgaucucagcucacugcaaccucugccucccagauucaagggauucuccugccucagccuccugaguagcugggacuacaggcgcccgccaccacgccuggcuaauuuuuguauuuucaauagagaugggguuucaccauguuggccagaauggucucgaucucccacccgccucggccucccagagugcuaggauuacaggcaagagccauugugcccggcccuguucuccuuucauagguaagaaaaucaagacccaagguuaaaggagucuugagggcucugacuagagcccaggcauucuacaucucugaugaggccuugcaucugagggaucuucaguuaccagccucuccuuagaagugucucugcuuuucuucccaccuggccaccaacugcccucucgugggcccaccuugugcacggcagcagcgucuucaucagcuuuuguugucugguacauuuggccaccuguggccuuuguugggcugcaggaugaggaaagaggaaaaggacacuuguccuucaguacggagacucuguugcggaggagguauguguguccugagaaugucugaguggguuuucuauuccucugcccaagaggaguacuuguuggacaucuaccuuguacccagggcugagugggauacaagguaauagucccuggagugaagguccuuauaaucuaggcaugagguugacucuaaauagcuuucuugaaucccaugaucccuggccccagcaccggccauugccuccucuuccuuuccagccacucccguugacccuauccccgugggcuaugcaguguggagacuccucacaugugauucccacaugacuggcaucucaggucuccugcaauccccuggguguuauaucucggagcaaggggcaaauaaguucuauugauguggagccacugggggaggcugggggccugcaugaccccuguuuccucccaggccuuuuuuugagcaguuccuguaagcuccuucccauccauuagagauaggagaagccucacuagccuucugcaugagcagguaugcucugagcuugcuuuucugugcacuuagggaagcuucuaaaucacaagcuuagauucuuuuaccuuucuguuuguagcccaucagcagcucaccacacaguuucccaggcccuccagguccuccugcuugcauuuccaacucucucucucagccucuccucaucaccccugaccaugccaaacuucccuuuucuccuuuuuuaagucgcauaugcucucauuucuaaacucuugcauauacuaaccucuuuuugugaaaucuucuuuucuucccucuuuccuccuccagucuuugcugcuaguucacaccaccccuaagagcucaucuuagaaugucccuccucugggaaagcuucccagcucccaagaguaggguggguccucugaucuuaccucugauggugcuugucagacugaauuguagucauuuguuucuuaauaucccuuccuuaccaaagucauaccuccguaagggaaggggccagugguuuuguuuauuuguuucguggagggauccucacauuccagugcaguaccugucgcguaagugcucagauuagacuuguacaaugugguaugaaugcaugggugggagagcuggugggccuuccuugaagaacuuccugccaucucugaucuggauucucuggguguuuaggugcaucacuccuguguuucguuggcaauggagcauagugcaccgagguucucuggacagagaccauucauugguucaguaaauauuacugagucccugcuaugugccaggcaccacacugacacuggggauaccauaguaaauaagcgagacauggucccuaaacucauggggcuuauagccuaguggaggaaacaaauaauaaguaagcaaauauaaaaaaaaaauuagaaauugugaaaaguccuaggaagaaaaugaauaggcugauauagggcaauaugagagacugguaggagggaccuugcccacaauccccucucccccuggcuagcacaccucucccucugcaaaggcugugagccccacauccauaccucugcuggcuuuaccucacagucacauccugaccuuggcaagaguuguacuagugagcacuccugacagcucuuccuuuuagcacugucugcaauuggggugacggucucuaccagacugggaaggagauauaucuuggcagaaaguauagcccugugcuuugcugcucauaggaaggccuucaggagggccaggauucaucagcagaagugucagagucccucuguccaggggccugauugggugaauauucaggcccuguuauacauuggagcaucagcagcacugcugugugguggcaugaaagccacggccuccugcuggcagcuggggcugcugcugccaucccuguucaggaggacugcgucgcucugcuguuuggccuggucuggggcuggggaaugccuugccucaagcucuguuggcaauugugcugguuugggcugcuuucucugagcagcuguuugccuucuuggaaaaccugaggcuuugguuugggaggaguugagagagucggggugucccucugggguacuguccccugacccacccuggaacauagugagcugucuggcuccacccaucucccccacguaguuccacucuggaccauucacgcaggcucuuagaagucuuagagcaugugacaacugugccuagggugggaggagguugcugucguggagccaggugggaagcuggagagcuagccugaccaugagggguuaacaagguggugguaggguucuugcccuggggcagugcugaugugucuacugccaccaacaaaaaauccuagugcccgugcaucaagacaccuuuguuuccccuuaagcugggagagugaaagccagccccagguuagaggcucuuaguggccugaggccaaaaacuccacucuccucuccagggugacacaguggcaucuccugacagucagacaaaaaccaucucuccuggcaucgcuuggccacugauggcucagggcuagauagguaugguuugagugagggucauggggaaaguugggaagggcccucccucucucuggacuugauaggacccaaccaauucaguaacuucagggguuagguggagcaagaagccaagaaguagaggcccugucagcuuugagaaccucucugacggaggagucuaacuccagaauccuuuguucuuugagccugucugcaaaugccuguguccagagaucugggacacacuccccaagcaugcaugugacaauguuugugccuaguagaaagggcauguuuauggcaauguuugggaacaugugauugggugcaugugcucaugauuagcuucuuagcuuuaggggguuuugggucccuugagguuuuggguaccucugagaauaagacuggccugggaugugugguuauugacaggcugugauucuagaaugggcauccguguguguguguguguguguguguguguguguguaucuguauuucuguguaugacuaaccauacauucucucuggagcuaguucuuuaggccggaaaggagauacauaaagucccaagacaguaggguagacauuggagggccaggcugggaauucgaguuauuaccauuuuccagcaccuuucuuugaucugcuuuucuucccaucaauucuuuguucucucaccccagccuuggcucuaaaggaagagaagacccuaaaaagguuuugugaccaaugguccugccaaauuugggggccaggcauggcugggcuuguccaagagucaggaaauugaggaacugggcagcacagagagagauguuacaguucauggaacagagcccccuuuuuuuucucuuguucuuuuuuccuggcuuggaaauaauaggucuucaaucugagauuagaagaaaaggaaaaaaccagaaaggaaccaguuugaacaaagacaaguuacuggaugugaacaaccccaacucuugugauugaguauucuuaccuagaugagguucugcaugcugggguggggcuugggguuagacagggagcagugaggacauucaaggccaccaggccuagaaagaggaaagacagcaagagugggcaggaagguggacucuagagucaggcagacgagagucuaagccugccucuuucuuuacuggccagacuucaccucuccaagucucaguuuccucuucuauaaccuacagggugcuugugaagaccaaauaagaaaaugcauauaaaguguuuggcaugguggcuggcacaugguaagaauaaaugguaccuauauguauagggcucaguucuuuccuuauaugaggaucaugggugugaagaugagggaggaaucucagggagauaugucuuagcugucugcagaagaaacccucuuuaucaaaagacuccagcacagaugccaaccugguugagauagggacggguuuucccccagggccugaugccuauacuuuauuugaacgugcaaauacauguguaugugagugugugucaggauagauaaggaggggagauauucauccuuuuaaaggaaggauauggccuaagguuaucuccagaucaccguggauggugguuauaaauauaucaugucagguuguucagugaauuuagggauguugaggacuucuauuugagaucugcuuuauggaggucaaaguguugugcuugucuggaaaccauuugucucuuuguucauuuauucacuauuuauucauuccuuuaauucacuaguauauguuccaugucaaucaugggaggcuuaggcuaguagagaagaaaccuguugagauugaaccuggagaagagaaaccuaaccuggagaaggucaaucuugaaaaaugaccuucaggucuagagagggcuuuuauauggcuccauauugccuaugaaccagagaaguuauauguuuaacugcaacaugguuaggcauagucagaggccugauuuguugguaucuggucugccuggggcaagaggcagaguaggcaaccucuugaggaccccuccaggcccaggcaucuagaauauuccacuggcuugguugcugacuuacugcaggaccuugagcauaugaguaagcacuaauaagccucaguuuuccucucuguuaaauagugaugagaauguuuucuuucaguuccucccugccuucuggggcuugggaaggaugaagaagcccccuguguaacuucacaggacuuccugugaagacggucugagcaaaugcccuggcugccccugcacuccuacccugagcacaggauucccaaagugcagucuggggccacucuucauuuaccccagccuuguaaaccuugucagaccugauucuccuagagaugccaaaccauuucccucuuccacuucugccuuguacuauucccccugccuagaauguucuccucagucuucuccaagcaaaucuuguucugucccgauaguuuugagccaagcuggcucugaucacccuucucccacuggagguuugucuuucucucuucauccuccauaguuugucuccaacacagccucccucuuucuaugcucucuuuagcuaucccccguucuggcacucggugucugccaugugaucugcuccaggggcuuugcagcauugguagaaggaggacugucaggggcugaacuugaugagcagggggagcuugagggaaagaggagaggggaaaauaugcuggggcagucaagggcuaguuccuggggccagggagacagauagaguagaagaggcaaucaggugaccacugugugugccuccugccacccggcuaucuaaaucccaaugaccagcucucugugcuggucaggaaagcaagagccucaguggagaggagacaccuugggaggcuggggggcauuugcauggggcugccucggcccccacauuauacugggauugaggcuggaugaguuugcauguccccaagcuaaugccaagucaggacaguggcuauugcagacgauuccugaaacuggauugagcugccaaggagagaccucuuccuuuaggagccugaggauggccugauagcagcugcuuuugcuuugccagcccugcuuucaccuccagcucucagcagggagcagggggccaaccacaaucuagagacugagcuggugacacauagugggaauggcccuguucucuggucagccucccaugagaaguuccccaggaggagggagggaccugcagcaucugaccagauguggaggucacagaaggaguccagccccaugcugaucagccccuacgggguugcugucgcugggauggugggagagggagggccuggccuugaagaauguuuuauucuucuggcugcagcagccaaagaccauggcucccacauguuucuaaacaagcuugauuguccucuagagugaugugucacaugcagggcuggagccugaguccuggcaggaggggaggaggggggcagggaugggggugaggggcacugaaauucucagagagacaggacaguagaggcucaagucagggagagaaggcccugccgaaaccuagaucauggcagaugcacuuaugugcaguagcagggcaggcaagggcaccggcuggggcucccccuucuccucagaccacagacccaaucaacccucccgaaacccccacuaccaaggcaagaaccguaaacagccugagucagagcugggcggcagcguacaagcguguugguucugucauuagcuguaauagcagcaucucaccuggcugccuaugccuuucauccaagccucucaaagaacuugacagacagcaaaggguucuauuaucuucauauuacuaguggagaaaugaaggccccaacgagccuggcagcuucuucagaguucauggaggagcuggcaggaggcugggaaugggcaggucuccaggucuugggcuuuuuggccucuccuccugcauccgugacuaugcugacaugugcuagaagguggugggguuaacuuguccccuugaacugauguugggagguucuguccaacauaggaaguagguucugaguucuuaggcaucuaccuguuuauucuuucuucccuaaguugucaauguugagcaauuaacaacacuaauaauugcuacaacuuacauggcguuuacugugagccagaggaugcaggugcuauauuacuuccauuuacagaugaggaaacugaaucacagauaaguuaaauaacuuucaggucauauauccaguaaguaauagaguuaggauucaggcccaaaagucugaugccauaauuuuuuuuguuuguuuguuuuuugagauggagucucgcuguugcccaggcuggaguccaguggcgcaaccuuggcucacugcagccuccaccuccuggguuucagcgauucuccugccucagccucccgaguagcugggacuacgggcaugugccacugugcccagcuaauuuuuauauuuuuaguagaaacuggguuucaccacguuggcugggcuggucucgaacucccgaccucaggugaccugcccgccucgaccucccaaacugcuaggauuacaggcaugagccacugggccuggcccgaugccauaauuuuaaccauaauauuauauuaccauucuggaccauaccuacaucagacuccuugugucaaagcagaaccccaaccucagcucugaagagaggaaggcuccagucuucccuuucuuccucauuuaguggcaauugauguguggaaugaauucccaggaaccuugcccuggaucuugguuauagggauguuguggaggagauuccuauuugacaaaguuucugaucuaucagagcccaggacccagggauagaggugcagcaucaccaaccccuacucaccuuuuccucaaugccaguugucuaagaacuggggagagaagggugucccaggcuacuugguaguggcuagcacagugaguaugcucuuugacaggacgcugccacacucaucuuccaagacagggaaaucggcugggcgcgguggcucacgccuguaaucccaacacuuuaggaggcugaggugggcagaucaucugaggucagguguuugagaccagccuggccaauguggcgaaacccugucucuacuaaaaauccaaaaaaaaaagccaggcgcgguggcccaugccuguaaucccagcacuuugggaggccgaggcggguggaugaucugaggucgggaguucgagaccagccugaccaacguggugaaacccaguuucuacuaaaaauacaaaauuagcugggcgugguggcgcaugccuuuaaucccagcuacucaggaggcugaggcaggagaaucgcuugaaccuaggaggcagagguuguggugagccaagaucacgccauugcacuccagccugggcgggaagaauaaaacuccaucucaaaaaacaaacaaacaaacaaacaaaauuagccaggugugguggcacaugucuguagucccagcuacucgggaggcugaggcaggagaaucgcuugagacugggaggcggagguugcagugagcugagaucgugccauugcacuccagccugggcgacagagcaagacuccguaucaaagaaaaacaaaaacaaacaaacaaacaaacaaaacacaaggaagucuuauucucugucucaaggccaacacccucuccuguacaaugcucaccuucucagugguggccauaucaaagcacagccacagauggcuaccuauucuggcuucucagagagguccacaggcccugccccagucugcccugcagcauuuuugggguuggagguuauagccugguaaaagccacacugggaaucugauugugccaaagcuugcuguggggccuggggcaagucacucaugccaccaauggcccucgguuuccucaucuguggaaugaggaaguuaauccagugcugaggucuccccaaacacucuguucuguacuuggcuccugguucuuggaugucuagaagguaaagucucuugagagaugccugggugaaucacagacgugagugguggacagggguggcaggaaauagugggaaauugugcuaagcaaggucgccggccauuucuauuacaugcuuccaguucaacuauuugugacuuucugaaaaguuuaugguuuggggauuuuuuuuauuuggucauuuuuuccauauuuggucauggccuagagcagugauuuuuggaaagauagaguaaaaaaccccuucagcuguuuguaagcauugcaaacacccacaaaaaauauccuuuuuccauuuagaagaaauaacaacauaguuauguuuuccuuuucagcucaaauaacucccaaacaacuccaaagacuucaaacuuggcugguaauuaauccuuaacaaaggggacuggacaguaugugcucugcaaaguuuggaaaagagagauuucaaaucaaaaaguauugaugcuugaaaaagcucgccauuuuuuccuguuugcuggcccuagcucccacacagcagcccauucccaggaaacccagagucucaagcuauagcucaugugagaaugaacugagagcaaggugaacacaucuucugcuugaagauacugguuguuuucuuuccuacgcuaguggucuuugccuauuucacaggcuguaagacugaggcugagcaaaguuguagucaggccuugcauugcuuuguaagaugaauugaaugggcuugugaaagcuuauauuugggguccuugucccaggaaacuuccaggagguaccuuccaguccuagccaacguguccagggaagucacugguucuggagucuaggacccaccagagugagaauccagaagugcuggcccuugcagaaugaagcaaugauggcuuaagcgcccauaggaaguggaaaggcucuccucugggugagcaaggaaccuucuccuuaucagaccacauccucagagaccagugcuuggggcuucucuuccaccaucuacccacucucaaaucucucuuggcuucuucuuuuggagacuuuuaucuugcuuacuccaggaggaaugcuagugcuaacauggaagagaaauugccaucuuucaauugcucuuccucgaucugauaccugcacgucaccaccugcagcucuugacagugagugccucaccccaggaaagaggcucccccuacucugcauaucaggcagagauuggaccugguggguuggcagguggaacagaguggggaagagguggcaguguggaaagaacacuggacucccagugccugagaucuagucuacuagacccauggcugacuuccucccagccucugcagaccucuccuucucuccuucccagcugccuuaccuguauagcaaguggguggggcuacauccucucuggggcccuuuucagggcaagggaucugacuuggccucuuguucucaggauucuuuauaugaaugugcacacacacacacacacacacacacacacacacacacacacacacagagauucuugaguggggggauggugaccagcuaguucccaucucuacugaagaagagaaugcauagauucugggguggaccaaagcuggacaugagaagcuacuuggccaaccaugagagucuugcagcccaaagcuauguaaccaagagaggugugcaggcaggagcaugggcagaaggaucuugagagggccuggccagcugggagaguugaggauggacucugaacuugccuaccagcucaugccagcauaucauuuucucacaucugguuccacaucuggaaucagccagauguuccuuucaaagugcugaugagcccugcccugauugccucagggggaaagccauuuggugacacuguccuucaggcccugucaucuucuccagaugguagcccauuuuucagcuuuguguccuugggcacacccacuguaccacgaagcuggggagggguugagggcagcugcuuggggugaggccuggccucagacccuuugucgggcacugaaaccuacagugccuuuccauuucuuucugagcagccguuggcuuccuggaauuuccacauccugccuguugacauugggacacuagcugcccugcugauuuagccuuuccaucuaauggcuacguggccauugcuuccaccuuaugaccuuugccuggugaauccgucuccaucccugggucccaguucuggcccauucagacuaucauguccucuucacaucuucagaaaggaagggaugagaaccaaccaccccaagccuucgagaagccugcgcuggggacccuggaggaugcuggagaggcaacagcuugauccuucccucaaggaccuuagagucuuggggcuaggaagggucaucugagagcccuuagagagaagucaaagucauguacuucauguagguagggccuggaauugcaaaagucagagaggggggagauuacugugaguugggggucagggaagguuucugggggaggugcuagcuggucaggacagggacagcucggagccuccugaccugacuauccaggugcccauauugugcaguguguugggaaaggugacuggaugccacggauuguugacagugauuccuacaagcuagggagggagaaauggacagagggagcacaugugaauggggugggggaguugcugaccugaggcacacauuuguuuauuuucuuucuugguuugagcuuccuucaccagccuccagagccugccccacagggggucccaccuuccucugccugucucagcaucugccugcuccuauggagagagcucaccuuugcagggcuuucaccuacauucucaugugugguaggcagguagacagauggcccgaugcucaccuuacagaggaagaagcugagggugaggacguuucaguggcuuaucucaggcuccauggggcugauucuggccugggacucccccuggagugcagagcaugcuccaggcuccuguuacacuucauggcccucccacuuugucacguuucuccuccuccucccucaacucacugggcuugcauggaaguccugcucugugcaguccauggucugcccucaaaagagcacccaauagauaucuacuuacugauaucccaccucacugauaaaagagacgugggaagacacuggguucuaaucuccugaggagacaagucuggcagccaugagagaguuaacaacaguccaaggcacauguuaagggcagagugagcaccacagccccucccaugauuacccacugccuacaggacugggccccaguguccuagcccaguuuauguagccuuucaccuucuggcugcugccaaaccucucuagccucagcuuucacuauuccuccccacaguccauucuuaaccuuccugagcucauuguaguuuccauaugcaucacccucccucuccccucugggccucugccgcugcugcuccuccucucugcaacaccucucccucccuccacucugcuaacuccuauuuggcuuucagguccccacuuguccgucaccuccucugagaagcccuccugucccucaauacugacccugccccuguuccuugauggcguugaaguguacguacccuaagcucagcacuugcacacccuguaacugccuuuuacuguuugacuuucucaagacuguaagcucuucaagggccggggauaacccucucauucuccauuuucuccaugcugucuagcaugauaccuagcauagcagaggaugccugacaaauauuguuuaaacauacaugaauugaguuggcaaaugcaagaagaagggugaugacaaucgugagugggcaggucagggacacagugcccuacagagaagguagaacuuggggucagacuggaaggaucaugaauagaacaauaauaacaacaccaauagcuaauguuuacugugugccaggcucuguuccaagcauuuucuaauuuauccuuacaaaaacccuacgauguaggcauuauuacucucccaauuucacaggugaguggaauguaaaaggggaauaacaaugauuugauagagacaaaaaggcauuuuagguuaagaaaagugcaugagcaaagagagaggaacuuggcgggauacgcgcaggggccucugcggagagucgcugggguggagggcuuggccuggagagccaugggagugaggauugaugacguccaggguugcuaaaucacagagaaccuuuaaguuggggcuuagaaguuuauuuaucuugacuaaggcguugagaagccauugccacuuccucagcaggagaguggguggugggaugaauuuggccauggugugauggaugaauuggaagggagaaaacaggcaggacagccaggagagugcuggcacaauuucccucccuuccugccccuccagucauuucauucuuccuuuucaucauuguccacuauaggugcugacaugggcgaccuugggaccuggggcuagacagccgcugcaggucuccuggggccccaggcugcuccucucuggcuuggcugcugcuggcugcucagggcugugaccgugaccuggguugggcuggauuucuccuccacggucacuuuugcuaaugagaagcaguugucuugccacgaucgugcaggaggcaaggggagagaaccgccagccuggccucaugcuugcucugugucccccaccccucccugggucucuuuuuuucagcuuccagccacccccacacccugccccuugccucccagugagcaggcuaccugcccucaacucuggcccacuuuuucagguucucuucggguuuccagugcagagaaacugccagggaugggggagggguuucaugagggccuguaaauccugcguugggggacccuucacugcuuccuccugcuguauucaccucuuucuacauuuucucccuauugucagauggggggcuuggaucaccugagcucugaggugcuucugguucucaugugguuuuuugcuuucagucuugcuuacucugucuuuccuucucccucucagcaucucccgggcuggggcccuccuacgaugaacagaauauguccuuuccucuuaucaucaucuggucaaauccuucuuaucuuuugagaccccauagccuccaggaagccuguugugaccacuguaccuugucaguguuccagaaaacgcuggcugggcccuagugcagugccccagguagucagaccaccuagcccugauagccuugcguugagucuuugugggucaucuggcugguucucucaggaugagagcggugggaagggguuggaggauggagugcagugaggauaggaguggggacaagaggcguagauagauauucuagugccuucccugccagaagcauccagaaugccuggcuucaugaaggcagaggagaggggccuagaguguuucucuggcugaccuguuucuuccagcucuugccagacucaggacccccuuccccagguccguuaacccuucagccccagucacaaaggcccuuuuuggcuauguccacggcuuugagcuuucaguagcucucucugcagggcaggagacccaccucccagcucaacccccucucuucacaagcacaagggcggccacagcccaugguuaagugcuaguccauacucccuccccacgucacccccaaucccagaaagugugucagaggcccacugacaauucuugaggccuugcucuuucuucuucucucuuuauugaggccucuuuuuuauggcaauguuguugauagugcacauauuccagaguaauauguucaggauuaggccgcacaaugagguuaugacuuccuccugugcaacccccacccaggggagcuugcccuccaucuggccggcgcacaucuggcucaggcucacagcuggccagauguugccucccucugaacccaggccugcagccuccucugcuagaggcuggagcugcacacauacacacgugcgcacauacacgcaugcacacacacgcacacacacacgcaccgccccacuccauuuggagcauugaagcacugaggucaucugacucuucaagggggaggaggggagagcucggccuuagugcaauuauuccuccuccaccgugguagggcgagcaggcuguggggacacaucugcggagguauguaaauaucagguucccugcuuccagcccagacaggcuagugggaaggacccacuugaaaccagguuaugaaucuggagccuucucccaccccauccaggggccagcugcucuuagcagauuccuugugcacugguuuuggggugcucugggggucuaagccacggaagcucuccugucucaggcugaggccgcccucugcaccuuguuucugcccacccaccuguuucccacccuugccucauuuuccucuuuuccucuucccaccuucaguaguucauggauuguguaguuuaaaggacaaaagguacagaggcugggcccuggacccucaaauaauugagacgugaucugccaaauuuguuuccccauugguguuggcagaggcugggcagaggagcaggguaggaaaaggaaacugcauuuauugggugccaacuaugugucaggcacugagcaagaugcuuuaaauauauuauauugguuaaucccugcaaccauucugcaaaguagauauuauuaucuuuauuuuacacacaaggaaaguaugucucagaaagguuaaaucccuugcccauggucacauggcuaggaagaggcagagccagaauuccaaagcuucacuacaaacuaaaugcccuuaugccaugcuuucuuccuggcgauguaguugguaaaugccucuacccaucuguaaguccuccuggcuggccacugcaugaccuggaucuuccagggcuaagacccugaggcugcgagccuuguccuuccugccaggccaggccaggcugccugggugagccagggggagggcgugccauaggagggugcaaggcuuagguugcaguguuguaaccaguuggguuuucugcaugguuggucaagagccuggggacugagcucucagaaacacaauuaggaguugagaaagcugggugguguaggaugaaaggcaggcggaugggccaaggaggcaucucuggggaacuugggagcuuuccauggcugugggacagagaaaccucauuagaggagccacggagcucaggcugcuauuguuagcucaucguuccaucagacuuccaaagggcccccagcagauggaauauuccaagggccuuccaggguccccucuuccugacuacagcauguggcaccccagagaggcagcagggggugagcaggcacccuccagccuggcugugauccacuauguccccaugacagcaccagcauuugacugcccugggcuugaagagcaggaacaaugaaaggccucacuccuaccucucgauaaguagccaaagagagacauagacacccaagacacacacacaaacacugcucuguaucuuucugccucaaacaaaacugucauuuuagagaugaaacugaagcacagaaagugagggacuuggcaaggucacauauccagcaaauguguaccuucucagucugcauccagggcuuggcccacauuagggagguagcauggggcaguggaaaaagcacagacuuggggucaucuaggccuagguugaaagcccaguucugccucuucucugcagugugacaacacuuggagccaguuuccucuucauuaaacuugcagauuugcacugaggauuagagacaacauagaagaugaucaauauaugggagcuguuauuggcagcaguggccaggauacugacugggcuaguagucacgaugcagcuaggaugguggcugggagaggggcugagugguggguugaaauggcggcagugaucaucaaagugaugguaacaauuaugugaaguggaucuuuguuugugggaaaggagugguccauucagguuaggucccucaggaaguucagaccugaauuucuuucccaccacuagaaggcucaauaugugggagccuugugguuggauaugaccagaugucaguugcaaugggauuaguuuaauucuggcguguggaaaguauuugccccaggaaaggcggcagcugugauugcaaaagcaccugcaggaggcauggucagcuuggggauguccaaagccaccuuuacccuccuccuacucugguucuccaggaaacugcaagucacaguccagcuuugggaccagaaccuuccuaaagaaguggaaaugggaagcucuuuagguuucagugaaaggggagaccuuagcucucuuaacaucagggaauuuucuacuuugaaagaagcuaaauguucuacagaagguguaucauacuccugggugugagggaacuacuggaauuuccagcacuguaugccagcucccaagggacaggcaaacccuccagcucuccccugaaguagguugagaugguaccgccaaucauggagggggccagcauuaaucgucugugucccuggcauugggaguuuggucugugguguguggcucacucuagcugaccuucugaggaacgaagaagaaauguugaaacagagcuugguucaaaggcugcucuacccaagggagccuacaauucucuuucuacuaaugauccuuugaaauaauccuuuuaaucagguuucccccuaggaagagucuggggcacugcucuuaacaaauuuucccuugugucuuugucacacacaugccauucccagcagccuuuugcuauuuagacagaggaaggagccaugcaaagaauguagcaguacuaguugcccuuugggaggccucuucccaugaccaggcccccugccaagcuuugagggugucuauuacuucccuuuucucaugcuccaaaaccaaggugagcaggacuugucuaggggcagcugguaaauaugaacaccuagccauggccagacacccagcaaagccuucuuuagaaguaaccauuuaugugugaaccuuagaaacgugacuuuugaagacuaaaggaaaguucucugcaccaaauagcaguuaugcuggggucauuccuuagaguaagauauucuucuuaaguaaaauauaaguuccuuagcuaaaauagaauagaagccuagaaggaaaaaaauauauauguacagaagucugacaagacguacaucaaaauguuucuaauuauuaucuucagguaguggguguucuagugacuuuuaugccuuacuuguacuuauugagaauuacuuuugaaauaagaaaaaaaaaaguauuaguuaaaaauucccuuaaaggaaggucacacuccauuacucaucuguucuucaguaaaaauuaguucugggucuuuuccuaagagcaggauuugcuagagagagggagaucaucucugaauccuuaacccuaaaauagugauaucauaguuuguacauagcaugaccauuauaugucuguggaauaauguauugauugauuuuuuaagggcuguuggagugguggaaaugaugaaaauuugagagaggaaagaugggggcuccucaaaccuccuuaauaugcagcuucuuucucccuuaaagggagagaggaaacaggagauuauuuuuauaguggucaaauuagucuuaucaguuucauuccucacugaagugucuacacuacagauuuuuggagaagccuauugguagggaauugaagccucagggucacugagaauccuagaagccucagggucaccgagacucagaggcuuuguuaauugaacauggcugccuguggcugcggagcuugccuaugccgagggaaucuugacucuagccucugucuuacccucauguccaaucugaaaucaaguccuauacauuguaccuccuaaacacuucucagauucuaccaguucucuucauccucacuaccacuacccuugucucacccagaacuccugcaacaaccugcuaacugggcuaacuccagucacuucuauuuugugugcugcagucagaauaaauauuuuaauauauggauauuaucuuaugauuauacugcuuaaaaccauucaacaacuucccauagcacucaagauaaaguccagaccuccugguauucaguuuugcaaugaggauuagauacaacauugcagaugcucaguaaaugggagcuguuauuggcagcaguggccaggauauugacugggcuaguaguugagaugcagcuaggauggcggucaggagaagggcugagugaugggcuggaaugguggcagugauaaucaaagugaugguaacaauuauaugugaagcggaccucugugugggagaaagaguggcucagguuaggucucucgggaaguccagagcugaacuucuuucccaccacuagaaagguugguaugugggagccaagagguuggauaugaccagaugucaagugcaaugagacugguuccguucugacuacgaagaguauucgucucaggaaagaagccuucugccucuuuugguauaguucauugacauuaugcuaaaugaaauuaucuagucacaaaaagacaaaugccacauuaauucuauugauaugaggugccuagaguagucagauucauagagacagaaaguagaaugguggcugccagggguugggugggggaggagaaaauagggaguaauuguuuaugcauacaguuuccuuuucaaagaugaaaaaagcucuggagauggagaauggugaugguugcacaacaauguucauguacuugguuccacugauacacuuuaaagugguuagaaugguaaauuuuacauuaugugcauuuuaccacaauaaaaagaauuggaaagaacugguaaaggaucuaaacaggcacuucuccagaggagcuauacaaauggccaauaagcaugugaaaguauguucaacaucauuagucauuagggaaaugcaaaucagaaccacaaugauauaccacuucacaccuauuaggauagccagacuaaaaaagaugcauaauaauaaauguuggcaaggauguggagaaaugggaacccucauacacuacuaauaggaauauaagauggugcaugcaguugguuuggaaaagucuggugaaccagcagugcacucccagguguacauauacccaagagaaaugaaaacguaugucuuuacaaaaacuuguacacaaauguucacagaagcauuauucguaauaaacaaaaaguagaaaccaccuaaauggccaucaacuguugguuggauuaauaaaaugugguauauccacaauagaauauuauuuggcaacagaaaggaaaaaaguacugaaacaugcuacaauguggaugaacuuugaaaacuuuauucuaagugaaagaagccagucacaaaugaccaaacauuguauaauuugauuuauaugaaauguccagaauaggcagaucuuuagauacagaaggcugauuagcaguuucuucaaacuggggaguuguaggaggccaaagaguauggguuuacuucucagguugauaaaauguucuaaaauugauuguagucaugguuguaccacucuuugaauauauuuaaaaaucauugaauugcacacuuuaaaugugugaauuguaugguaugcgaacauaccucaauaaaacuguuuugccagcaaugcacaagcguucaaauuucuccacauccucaccaacgcuuguuaucuucuguuuuuuuuuuuaauaguagccauccuaauaggugugaggugguaucucacuauagucuugacuuguguuucccuaacgauuagugauguuaagcaucuuuucauaugcuuguugaccauuuguauauauucuuuggagaaauauguauucauacccuuugaauagacauuucuccaaagaagaaauuaaagacauuucuccaaagaaaaaauuaaacccauuuuuaaccagauuguuuuauuguuguugaguuguaagcauucuguauauauuauagauauaaguuccuuaucagauguaugauuuacagauacuuccuacaauucaguggguugucguuucacuuucuuaaugauguccuuugaaauacagaaguuucuaauuuugaggaaguccaauuuaucuauuuuuucuuuucuuguucauacuuuaagugucauauccaacaaaucacugcccaauccagugucacaaagaaauacaucuauguuuuuugagaauuuuauaguuugagcucuuccauuuaggucuuugauccauuuugaguuaguuuuuguauacagugugagguagguauccaacuucacuauuuugcuguggauaucuaguugucucagaacaauuuguuagaaaaaacuaacaauuuguaauucuuuccugauuacauuacuuuuauauccuuguugaaaaccaauuaaccauaagugugagaguuuauuuccggauucucaauuuuauucuauugaucuguuucuguccuuauucugauaccgcacugucuuaauuuauuguggcuuauaguaaguuuugaaagugggaagugugagucuugcaacuuuguucuucuuuuucaaaauugcuuugacuauuuugggcaccuugucagcuugaauuuuaagaucagcuugucaauuuuugcaaaaaaagcaagccaggaauuugauugggauggcacugaaucuguagaucgaucuggggaauauugccaucuuaacaauauugaaucuccugauucaugaacauaugaugccuuuauauuuauugagagcuucuuuaauuucuuucaacaguguauuuuguaguuuucagaguuuacauuuugcacuucauuuguuagauuuauuccuaguuacauuacucuuuuugaugcuauuauaaauggaauuguuuucuuaauuucauuugcaaauuguucauugcaaguguauaagaauauaauuuauuuauguagaucuuauauccugcaacuuuguugaauucauuuauucauucuaauggcuuuuuuuaguagacuccuuaauacuaaggaguauuucuauauauaagauuauuucaucuaccuaucaaaaugccaaugacauuuuucacagaaacaggaaaaaaaauccuaaaauuuguauggaaccacaaaagaccccaaauagucaaagcaauaccuccaguuuuguucucuuuccucaaaucuguaguaaccaaaacagcaugguacugccauaaaaacagacacauagaccaauggaacagaacagagaaccagaaauaaacccacauauuuacagccaacugauauuugacaaaagugccaggaacauucuuuggggaaaagacaucuuuucaauaaagaccuaaauguaagaccagaaauuauaaaacuacuagaagaaaauauaggagaaaugcuucaggacauuggucugggaaaauauuuuaugaauaagacaggcgacaaaagcaaaaauaaacaaaugggauuauaucaaacuaaaaaagcugcugcauaucaaaggaaacaaucaauagagugaaaagaaaaccuauagaauggaagaaaauauuugcaaacuacugaucuaauagggaauuacuauccagaauauaugagaaacucaaacaccucaacagcaggaaaacauacaguucgauuaaaaaaugggcaaaaauggucugaacagauauuucucaaaagaagacauacaaaaggccacacaauauaugaaaaauccucagcaucacuaaucaucagggaaaugcaaaucaaaaccacaaugagguaucaucucaccccaguuaggauggcuauaaucaaaaagacaaaaaauaaaugcugguaaagaugcagagagaagggaacucuuauaugcuguugguggaaaugcaaacuaguacagccacuauggaaaacaguaugggggucucucagaacaauacaaauagaacuacccuaucauucagcaauaucacuacugggaguuuauccaaagggaaauuauuacaugugagagacauuugcaucccuaugcugauuacagcacuguucacaauagugaagacauggaaucaaccuaggggucgagcaauagaugagugaacaaagaaaaugggguacauacacacaauggaauacuauucagccauaaaacggaaugaaauccugucauucauggcaacaugaauggaacuggaggacauuguguuaaaugaaauaagccaggaacagaaaguuaaacaguucgcauucucacucauauguggaaccuaaaaaaaaguugaucucaaauaaguaaaaaaguagaacagaggauacuagaggcugggaagaguauagggaaggaaggauagacagagauuuuuaaaaggauacaaaauuacagcuagauaggaggaauaaguucuaguguucuauaguccaguaggaugacuauaguuaauaauaauauauaguuucaaaaaccuagaaggaggauauccaauguuccuaucacaaagaaaugauaaauguuugagaugauggauaugcuaauugcccugaucuaaucaccauaccuuguauguguugaaacauuuuuuuuuuaaagaucguaucaucugagagugaauugagauacuuuugcuucuuccauuccaaucuggacaccuuuuauuuaauuuuuuuugcccacauauuuuuuagggguugaaaaaaaucaaauaacuacaaaugaguauaguugagaaaacauuaauucaguacaaagaauaauauuugugaugugaaaauuguaugaaauucaaaacuguguccauaaauaaaguuuuauuagaaugcauagccaugccauuuguuugcauauuguuuauggguuuguuuguuuguuugcauugccagugagaaguugccauaaaaauuguauaugacacuccccucacugcacugcugcagugauaguuauaaccuaacaauguuaauaagugacauguguaucacuauacugugguauuucauuuuauuuuuauuacuggugcauccucauuaugucaaaacaagaaaagaaaaguggacuuugaaugucuugcuuuugaaacacaauguacuguagauuauuuuguuauuaaauuagaugauaauuagcuuuauuacacaauggcauuauagacaugcuaaaagagcauaauauaugucaauauuaccaaacacuuaacauuuaucacaauauucccagcucacagacaagaaacagucagaaaaauuagaaaauuuaaaaucaaagaucucauuacagcacaauuucuucacaaaaaucaaaaguggggccgggcaugguggcucaugccuguaaucccagcacugugggaggcugaggcagguggaucaugaggucaggagauagagaccagccuggcuaauacagugaaaccccaucucuacuaaaaauacaaaaaaaauuagccaggcauggugguacgcgccuguaaucucagcuacucgggaggcugaggcagaagaaucacuugaaccugggaggcagagguugcagugagccgagaucgcgccauugcacuccagccugggugacagagcaagacuccgucucaaaagaaauaaaaauaaaaagugaggccagacacgguggcucgcaccuauaauugcagcacuuugggaggcugagacggauggauaaucugaagucaggagcucaagaccagccuggccaacauggugaagccccgucucuacuaaaaauacaaaaacuagccaggcguggugacaugcaacuguagucucagcuacucaguagucugaggugggagaauugcuugaaacuagaagguggagguugcaguaagccgagaugccaccacugcacucuagccuggaugacacagugagacuguuucaauaaauaaauaaauaguggaaaucaggcuacaucaaacuaauuuuccaaguggcucauuuguuagcaaagcaaggaaaguuguuuacaaauggugaguuaauuaaacuguguacagagaaaauaaauucacuaaagaguauuagucuuucugcaaaaauaguuguucaaagagcuguggacauugggagaaacauaaauaguaaaguuaaagacaaggcaaacaauuuugagugguuuuccuaggcucuggaugaguugacagauguuaacaauaaugaccauuuauuauuguuuauuugaggaauggaugccaaguuugaagucacugaagaauuugccucuaagaauaguguagaauaacuacggaugagaauaguugggaaaacacuaacucaguacaaccugaaguggaaucugcuaagauguguuauaacuaaugaucacaaaaauauguaugcagcagaaaaaaggcuuaauuggggaaauuuacaaaacuuaugaaaacauaaaauguuuaaagcuuguggucauucauuguauuauuuaucuacagguacuuugaaggaaauauuuuaaucugucauguauuauugaaccaguggugucaacagugaacaccauucacucuuaggaacuuaaccauugacaguucugugcauuuuuugacugaaauaagagcuaaagauguuaacuuguccuaucauacauuuugaugauuuaacaguaguaaaauuuuguugugauuuuucuuuuagcucagagcugacauugauauuuuucuggaugaaaaaacuacccuuaaccaguguuaucaaauacuaaaugauuuuggauaauagcuuuugcuacggauuugguauuucuuaaugaauuuaaccuaaaauuacaagguaaaacaaugcuuauuugugaaauuuauauggcgguaaaauaauuuugacuauaacuaauguuguuugaaucacaaaucaugucaagcugcuuuacacucuucccaugcuaugggaaguugaaacaagaagcaagcucuccguuccacacaaguuugcaauggacauauuuucugagcucaaacuauaguuccagcaguguuuuauuccaauguugaugcaagugcaaaugaaauuucuacacuucaaaauucacuuaacucugcaauugagggacuuccaccuaaccuucaacuggaaguaauuaaccugcaauguaaugacaagcuaaaggcaaauaucaagagaagacucuaucagaauucuauaaaugccuuccaagugaugaauaugcucaauuaaaaucauaugcuuauggauugauaucaauauuuggcauuacuuuucuguaugaaaaagacauuuucaaagaugaaauacaucagaucucauuacagaucagcauuaacaggugaauauaugcaaucaauuuugacaguaagacacacuagauuugcaucauaauuaaaugaaauguuaucccccaccccccaaaaauucuauuauucucauuaauaggccuguauuacaaaaaaaguauucaaugauuauauguugaauuuugucaauucaaaauuauaaaauuuuuguguuugucuugugcaaauacccacaaaaaauguuugauuuuuugccuuuuggcccaugaagucgaaaaucuuuaauaccuggcucuuaacagaaaaagucugcugagcuuuagcucacaagaugaaaacccagcccccaucagucucauauuuguccuucaauauuccagcuucacagagcuacccugcaguugcccaaucucacauuuucuuucuuuccuugugaucuuuguauaugcuauucucucugucuagaaugaucuuuuuuuccuucccuacuucuguuggcuaauuccuuacuguccuucaggucuuagcuuaaauauaacuucuucaaagaaguauuuacugacgcuguccaccacugugagacagauacccuuccugaugaacuuccacagcauccuguacuucccuguaucagcaucuuuuuuuuuaaauguacauggcaaaaaauccaagaaugcaugauggaaaauaaagucucccacauaucucagacuccagacacugaauucuuauuccuagaggcuaccacuguuauauuuucuuggguauccuucuagagauauucucugccuacauggcacauaccuauguguuuucuuuuuugcccucacaaaugauaguauacuguauacauauuucugcaccuaguuuuuuccacuuaacuaugaacuuuggagucuauuccauauguaccuuguagagcugccucauuuuuaaaaauugagacagaauuaagacaauaaauuucaccaauuuuaagaguacaacuugaugaguuuuagcaaauguaugcagucagguaaacaucacuacaaucauguuagaggauguuuccauuacucacaaaaaaauuucucaugccccaagcaauaauugauuugcuuucugucaguacagauaaaauggaaucacauaguauguauucuuuugugucugguuccuuuuggcaagaauaauguuucugagauuuaucuaugcuguugcauguaucaguaauucccuccucuuuauugcucaguaguauuccauuguuuuuauauaucacaaugugucuauccauucccaucuuggacauuuggauuguuuccaguuuggggcaauuaaaacuucuaugaacauuuguggacaaaucuuuguguggacauguucuuauuucucuuggaugaauaccuagcauggcaggguugaaggaagaucuauguuuaauauuuucagaaacuaccaaacuguaccauuugaccuucccagcagcaguuacuaaggaguuccaguugcuccaugucuuucccaaccuuuuguauuuaucauuuguucuaauguuggccauucuaguggguguauaguaguaucucacugguuugauuugcaugucacugaugaugugugguaaguaucuuuccauguacuuuuuuugccauugcuauauauuuuuuuuggucaagugucuguucaauuuuuugcccauuuuuuugaauggacuuuuuucuuuuuauauuacuuaguuguaagaguuuuuaaaacauauauucuagacauaauuccuuugucagauacguuuugcagauuguuuuccaauuucuccuuugccuuuucauuuucauaaaacugucacuugaagagcagaaguuuuaaauuuugaaguccuaguuauauuuuucuuuuguuuccuacauuuugacuccuauuuaagaaaucuggccagauguggugacucauaccuguaaucccagcacuuugggaggccaaggcgggcagaucacuugaggccaggaguucaagaccagccugggcaacacggugaaacccugucucuacugaaaauacaaaaauuagcugagcacuguggcucaugccuguaaucccagcuaugcaggagacugaggcaugagaaucgcuugaacccaggaggcagagguugcagugagcugagaucaugcacuacccuccagccugggcaacagagcaagacuccauuuaaaaaaagaaaggaaagaaagaaagaaagaaaaagaaagaaagaaagaaaggaaggaaggaaggaaggaaggaaggaaggaaggaaggaaagaaaucuuugccaaacccaaggucauuaagaauuucugcuauguuuauuucucagacuuuuuuagcuuuuacauuuaggucugugauccauuuugaguuaauuuuuguguauggugugaucuaagggucaagguucucccuuccuuccuuccuuucccuuccuuccuuccuucuuuccuugcuuccuuccuuccuuuccuuccuugcuuccuuccuuuccuuccuucccuuccuuccuucuuuuuucuuucuuucuuucuuucuuucuuucuuucuuucuuucuuucuuucuuucuuuucuuucuuucuuucuuucuuuccuucucucucucucucucucucucucucucucuucccuuucuguauaugacuguccaauuguuucagcacuguuuguuaaaaagauuauccuuuuccccccaagaauccccuugaauugccuuaaaaccuuugucaacaaucaauuuguguggguauauuucuggauagucuauuguguucuauugaucuacauucuugauuauuuuaacuuuauaauauaucuugaggcuguacaugguggcuugagccuguaauucugggcagccaaggugagagaaucacuugggcucaggaguucaagaccagccugggaacacagcgagacuucaucucuaccaaaaauuuaaaaaagaaaaaaauuagcggggcaugguggccugggucuguaguccuagcugcucaggaagcugaagugggaggacuguuugagcccgggagauaaaggcugcagugagcuaugaucaagccacugcacuccagccugggagacagaacaagacccugucucaaaaaaaaaaaaguauugaaaucagguaguguaaggucuccaacuuuuucuuuuacaaaauugcuuuuggcuauucuggguccauugcauuuccacauacauuuuauaauuagcuuaucaauuucuacuaaaaagccugcugggauuugauuagauuucauugaacccacagaugaauuuagagaaaaguuacagcuuaguauugagucuucucauccaugaacacguauuuccauuuauuuagaucuuacuuuuucucaccaauauuucauaguuuuguuauuauuauuuuuucguagacaaggugucacucuguccucuagccuggagugcagaggcacaaucauagcucacuguagccucaaacuccugggcucaagcaauccuccugccuuauccucccugaguagcugggauuacaggugcacaccaccuuguccggguuguuucauaguuuucgguguguaguuucacacugaaaauaauguauguguaagaguuuuuaaaaaauauauucuguguguucacagaauauauauauguguucauaguuuucauuguguaguuucaguguguaguuuuauauaucuuuuguuaauuuuuucucuagauuuuuuguauuuuugaugcuauugcaaaugauaugguuuacauuucaguuaugucauagaauauuuccauuacucccaaaaguuccccuaugcccuggguaaucacuguuaauauacagaaauacauuugauuuuuauauaaugaccauauauccuacaaccuugcuaaacucacuuacuaguucuaguagcauuuuuguagauuccuuaggauuuucugcauagacaaccaugucaucugugaaucaagacacuuuuacuucuuuuccaaucuguaugucuuuuuuuuuccacuuacauuuuugcacaggcugauaccuccaguacaauguugaguagaauugauuccuagccuuauuccugaucuuaagggaaaagcauuuaauuuuuugccguuaaguaugauauagcuguaggucuuuuguagaugccuuuuaucagaucgagggaauccccuuuuguucuugagaguuuugucaugaauagauguuagauuuuaucaaaugcauuucuacaccuaugaagaucaucucuuuuuguuuguuuguuaauagagugaauuacauugauuuuugaauguuaaauuaaucuugcaguccugagauaaacuccaucugaucauaauguauuauccuucaaaauguuguuaaacuuuauuuccuggccaggcacgguggcucacgccugcaaucccaacaguuugggaggccaaggcaggcggaucaccugaggucaggaguucgagaccagccuggccaacauggcgaaacccugucucuacuaaaaauacaaaaauuagccgggugugguggugcacaccuguaaucccagcuacucaggaggcugagacaggagaaucacaugaaccuagaaggcggagguuacagugagcugagaucacaucacugcacuccagccugggcaacagagcaagaugccaucucaaaaaauaauaguaaugaaaauuuaaaaaauuuuuaaaaaucuuuauuuccugaaauuaauuuacaauuuuuuucaugaggaauucaugaggaauauuggaauauaguuuucuuuucuuauaaugucuuuguccaguuuugguaucagagcaauaccagccucauagaaugaguugagaaguguucccuugaccucuauuuucugcaguaguuugcauagaauuugguauuccuucuuucuuaaauauauuuaguagaauucaccaugaagccuucugggcccggaguuuugacugugagaaggguucuaacuacaaacucaauugguuuaauagauauagggcuauuuagauuauccacugcuuuuugagugaguauuaguaguuccuuucaacaauuuuuaaagaauuuaauauaauuauuagcauaacauugcucaugagaugccauuaucauccuuuuaguguauguggaguugguagugaugacucuuuucucauuguugauacugcuaauuuauaucuucucucauuuuuuccugauuuaucuuacuagagguuuagcaauuuuaugaaccagcuuuuagcuucauugauuuuuucuauuauuuuugugucucuauuucauuuauuuucuugcuuauuucauuauuucuuuuuucuauuuacuuuggguuuaacuugcucuguuuuucuaguugcuuaaggugggagcuuauuucacugauugaaaccuuucuucuuuucucauauaagaguuuaauucuauaaauuucccucuaagugaugcuuaagcugcaugccacaaauuuugauuugucauguuuuucuuuucuuuuucuuucuuuuuuuuuuuuuuuuuaagacagagucuugcucugucacccaggcugaagugcaguggugcagucuuggcucacugcaaucuccaccucccagguucaagcgauucuugugccucggccuccagaguagcugggauuacaggugugcaccaccacgcuggcuaauuuuuguauuuuuacuagagaugggguuuugccauguuggccaggcuggucuccaacugccagccucaagugauccacccaccucggccucccaaagugcugggauuacagacaugaaccaccacacccagccuuuauuuucauuugauucaaaauauauucuaguuucuguugugauuucuucuuugacccauauauuauuuagaaauuuauuguuuaauauguaaguauuugggugcuuuuccauauaucuuuuuguuauugauuucuaauuuaauucuauuaugauuagagagcaugguuuguaugauuugaaucuuuuagaauuuauugagauuuguaguauggcccagaauguggucuaauuugguaaauguucucuaugcacuugaaacaaauauaucguuuuucaguggaguauccuaugaauguuaauuaggucaaguugguuaauaguacuguucaaguuuucuauauccuauugauuuuguccacuuauuguaucaacuauucagagaagguguugaaaucucguuauaguagugaguuugucuauuucucuauuucuaaauuucucuauuucuaaagcuguaucaucaggugccaaauauuaggauuauuucuuuuuucuuuuuuuuuaacugagacaaagccucgcucugucgcccaggcuggaguacaguggcaugaucucggcucacugccaacuucugccuccuggguucaagcaguucucaugccucagccucucgaguagcugggacuacaggcacgcaccaccacucccagcuaauuguuuuguauuuuuaguagagacgggguuucgccauuuuggccaggcugguuucgaacuccugaccucaggugaucugccaggcucagccucccaaagugcugggauuacaggcaugagccaccgcgcccggccaggauuguuauuucuuaugaaugaaugaaucccuuuuucauuauaaaaugacccaccuuaucccugguaagauuugcucugacauauaccuugucuuguauuaguacagucacuuaagccuucuuuuggcuagcguugacaucuuuuuccaugcuuuuacuuuaaccuacauuguuuggucuuucuuuuuuauacaauuugacaaucucuuccuuuaaaauugggauguuuacaccauuugcauuuaaugugauuacugaugugguugggcuucaaucuaccauuugacuauguuuucuauuugucucaucuguucuuuguuuuuuucuuuuucgugauuucauuuuaccuuuuuacuggcucguuaguuuuacauuuuugcuuuguuuugauuuguuuuuagugguugcuuuaggaccuauggcauacauguucaacuuaccagucuaucuucaaguaacaugguaccauuuuauguauaguauaaaaacucuacaaccauauacuuccauuucccauugcuuagucuuuucgcuauuguugucauacauuuuacuucuguauguuauaaacuccacaauacauuguuauuuuugccuuaaaucauuaucuuuuaaagagauuuuaaacauaagaaaaaauauauuugaggauuuucuaaauguuuucuuuuaauuauuuuauuuuauugagacagagucucacucccagccuggagugcaguggcacaaucacagcucacugcagccugaaccucccggacucaagcaauccucccaccucagccucccuaguagcugggaccacaggcaugugccaccaugcccagcuaauuuuuguacuuuuugaagagacgagguuucuccauguuuuccaggcugaucucaaacuccugagcucaagcaauuggcccaccuuggccucacaaagugcugggauuacaggcgugagccaccacacccagucucucuuaauucauuuuuaacuuuaauuuugucauggucaaaaaacguaucucuuaaaaucuacugagauuugcuuuuacggccaagcauauuauuaaucuugcuaaacguucuauguguucuugaauaugcauuuugcauuuuggggguauaauuugcuauaaauguaaauuagguaagguaguuaauaguucacucauuucuuucauauccuuauugagauuuugucuaacuaaccuaucaauuacucauagaaaaguauuaagauuuccagcuuugauuguggguuuuucuauuuuuuccuuaguucugucacuuuuugcuucauauaauuugaagaucucuuuuuagaggcauauauauuuuaaacuguucuguaucucucaugaauugacucuucuauuauuaaauuucuuugauucuaguauauuccuuuucuugaagccuauuuugucuuguauuaagagagcuauuccaguuuccuuaccuuuaagguuuguguaauuuccagccuucugcuuuuaguuuuuacuuuuguuauuugcaugguuuuacaguauuuuacuucuagucuauuuguaucuuaguauuuaaagugucccuuuugaggaaagcacauaauuuguucuugcuuuuuuuuuuugagacggagucucacucugucagccaggcuggagugcaaugguaugaucucagcucacugcaaccuccaccuccuggauucaagccauucuccugccucagccuccuaaauagcugggauuacaggcaggugccaccaugcucggcuauuuuuuguauuuuuaguagagacaggguuucaccauguuggccaggcuggucucaaacuccugaccucaagugauccgcccaccuuggccucccaaagugcugggcuuacaggcgugagccaccgcgugcggccuguucucacuuuuuaauauagucugucaaucucugccuuuuaauuggagucagaccacuuacauuuaauauaauuauuaauaugauuuuuuaaaauuuuuaaauaaauacuaguuuauuugagccuuuuucauuuaugguuuaaccauccaauaugucuguuuacuucaguucuuuuucuucuugacacuucuaggagauuucuuucucuauucucuuucucuuuccucuuuccugaauaaauuuuauuguguauacuugagauuuuacaacaugcuauuaugggauacauauagauaguaaaauacuuacuauaauaaaguagauuagcauaucuguuauuucacaguauuuuuugugugauaaggacagauaaaaucuacuuaaugaaccaaaaucccaaauacaauucuauuaacuguaguucucauguuguaccuuaggccucuagaucuguucauccuacauaucugcuauuuuuauccuuugaccuccaucucccaauuuccuaccuugccacucucaugguaacuaaugcuucauucucugucucauguauuugagcuuuuuuuaaaaaaaaaaaucuacuaauaagugagaucaugcaauauuuuucuuucugugucuggcuuauuucccuuagcauaacaucuuccuguccuccugguccaucaugauguggcaaauggcagaauuuccuuuuuaaagccugaaaaauaguucacuguguauacacacacacacacacacacacacacacacacacacacacuacauuuucuuuauccauucauccaucuaugggcauuuagauuguuuccauaucuuggcuaaugugacuaaugcuuccaugaacaugggagugcagaucuuuaugaaguggugauuuugucuucuuuggggauauaccgaaaagggggauuucugggucauaugguaguucuauuuuaaauuauuuuaggaaucuccauauuguuuuccauaauggccguaccaaucuacauuuccacuagcuuuguacaaugguucccuucauuccauacccuugucaacauuuguuauuucuugucuuuuugauaauagcuguccauacaaaugugaagugauagcucguugugguuuuaauuugcauuucccugguaguucauuaaauaagccaguuucuuuucauuugucuucaaguuaacugauuauuucuucugccaucuuaaauccucaguugagcccaucuagugauuuuuuaauuuuacauuuaauuuguacaccuuagcucuguaauccauuuuaaaauguguuuccauuuccuuguugagauucccuacuuguuuguuucuugauggcauauuuuccuauaauuauuugaacauauuuauaauaaauccuuugaauucuuuaucuucuaaauccaauaucuggauccaguuggaguuccuucaaaauuaacuugguuguacuuggccuuugggcuucacucuuuaaccuuggccccagcauuuuccuuguagccucggaccaggggaagggccuccuuucuguuucaucucuuccuacccuacucucaggaaccuacugucaucccaccugcucuauguugacuucccugaugauugggacccucagagaucuuguuacucucugaacuacuauguuuaaauuuauaucccauaauccagugcuggaccauguccuguuguuugcuaauguuuauguacuuuguauuccuaacuagauuauaaacucuuucaggauugggaauaugucuuuuccucuagaauaucaguacauugaguucccucuguaugacaggucuuggccugagcacuuuauacuaccuuucauuuagucuucagaacacccuuguaugauagguaucauuauccucauuuuccauaugaggaaacuaagacccagaaagguuaaaugaugaagccaaaguuagugccaaaguuagugagagagaaugacuaggcgagcauucaaacucagaucuaucucacucaaagcucauguggccauggcuuuuuauucuaguuggacuuguaaccucuuauucuuucuggccacuagucugacuguuaccgugugaaacagacccagauaaaucuguggauucuuugaauggggucugguggcccaauguucccugcacagcgucuuguuacuucagacagcaucccauggccugccugucugcuuuagcccuggcugugcucuucaucaggauccacccaugggcugcugcacucagaaccccugcuugguagcccaaaauagccuuuguuuucuccugguggcugguggauuuuccucagccauuuuugccaaguggagccaugaguuggaauagcaacaggugguaaguaucuagaagccaaugaggcaugcacuuuauugucagaagcagaaguguguucugcagagauggaaagcagaccuccuaccagcagaggaaacacaaaccaaagggaaccuucccgaaaguuugaacagaacucuguuccuuuucugucucugaggcguggaggagugugguccucuuuguugaauccuuuuccaagcauaccuuacaccugccuaaaacagguaaaauguaaaucaucucuuugcagggauucuuuaggauacaucuuguuuuccgugccuuauagacaugaucaucuccuugcugcuuagccaaguccuuugguuuacuccagcaucugcagacuggaagagaagacuucucuuuuaacucacucaccuucuugccccagggaaaguaggaaacagcacauuuguugaaagagacaaguucugcauuaggcugguuguuuacuugggucugaaagacaauaaaccugguccucacuuggaguaggagaaacuuaggaaaaagcaagggugccauggaaaaccacuaauccucguuugucccacaaacaaucauguuaaaaucuugguacagaagcccccucugaagcugaaaugaaugucuuggguuaagaauguugucacaauggcuuacccuaugugacaucacgaauucagacaaaugaggugugacugucccacuuugggggaugcuauccuauuuggugauuuucuugcuuuuucuccaagguaaagucagaaucgauugaaauaucagucacuuucucacugacaaagugacacagcagccgaugggaggguugaccugugaggaauuuguggagcgucaagccccagccagaggaaggagucagacuguuggagggccugccgagaagucacggcauccaaucuuuugaccaaggggggaagcaauccugugguuaaaaacauuugagaaaagagaccuacagauagccuuuugggcauacuguuucuuggcacccauauggaaguguggcuucucuucugggcagguauuucuguacaacugugaccacucuuccuaccuggcuucugaggaaugcauagccuauaccugaucucuucuauucucuugcauccccuaggaagcaggaauuauauuuucauucaucugauaagcccuaugaacagccauuguuaagugcugagaguacaauaaggaaugagaaaacgucccauacaucaaagauuauggucuugucagggcacugaggccacaggauucauuguaguagaagguauaacacgcuuaaugucauuggagggaagcaacaucauauucuguucuuuaggaauggguagguuuagaaauagcagauauggcaugaggugccuaggagccagaauaagaaauguugggaaguaagguauguuugggaagcauguggccagaugacagacugugugaggcagaacaaugacaaaggacacaagacggagugccuugaguggcaggccauggggcuggacacucuuugagaguugaccaagagcucagaaggacuuuugagcagagaagugacaagauaaaagcuuuugggggaagacuaauagagcaacuaugucugggaccuuucauggggugcuagaauagagaaccaggauaaagggggaaaguugggagaugcuggaaggcuugcuuuugauggccaugaugagaaugaguagaggggaagaggcaaauguguuagacgaacauugggcaggcagaauuagccaggcacagcuagugacaggaugugaugccacacugucagucagagacaacucuggauuuucagcucaagugacugaggaaaagcugaggcagguaacagaugucagaaagucaagagccagaggagcaggcucagggagaagaugguaaguuccauuuguaguggcugagcuucaucuuccaggggcaaguuuccagcuggaguuaagagcacagaguugaccaucaggaaagaccagcaucagagacacaauuugguuguucuaggggaagugguagcuguugcucuggggguuguagaaauccuugaguggagaguaggaaauagauggccaaugccugcccaacacuuggcccagguccgggguucauaugcuucuagaaaagaggaauaaauuaguggaagaaugagacaaggacaacaucuggagaagcacuuacguguagagugugcaucagugaagaagaaagagaagcaaccuucagaaaacuggaaaagccaggagagaacccugggagaagaggacaagggagggcaggaauuucaggaagaaggugacacacuauauucauugcugcagaaaaaaauggaccuccugagaaggcuaucaggaugccugggcucauugcucuuauggggcaagacacagaguuugccucagugaugggacuuaggcccugggcauucaugcucacuuguucucguugucacaauggcagcucugauucuaagaguccuggucagaaagggcugacugauaguaagggagcuccuuuuuguaucuugccuuuggcuguugguuggggacuguggggugugcuguggggugauugugugaggauugggauggcucaugcuuucuaagacaaauggggcuuuuucuagaguaagaggcagaguaagggccuagcacccaucucuguaaagaccacaucuugaccucccagaggggagguagauaaaguugugaacugguggccaucucauccaaagccagugaaauaauccuggggauaguuuccuuuuggaagugagacaaggguagaggggaccagagagugcucaaaacuuguccuguagacuuuaccagauuacuuuuuuuuuuuuuuuuuuuuuugagacaagguuucacucuugucgcccaggcuggagugcaacagugcgaucuuggcucaccgcaaccuccgccuuccggguucaagugauucuccugccucagccuccugaguagcugggauuauaggcaugcaccaccaugcccaccuaauuuuuguauuuuuaguagagacgggguuucuccauguuggucaggcuggucucaaacuccuaaccucaggugauccgcccaccucagcagauuacuuuuuuauaauuuuauuucucuggucugauucauucuuuaaggagcuaucccacaguuucugaacagggaacuagaggacuuugggaccaggagcaagauuaagugcagugggggaagggagggagagaagaguugccuggagcucacugcaaugaggguuucaaaugcaacagggcaauagggcaggugugaggcaucugagcccagagugagccaagaauaagcacagcagggaagggagggaggaaaggcugcuacucccacuugcacacacucccaguauggucuccuggagagacagcugugacccuugccagguaccacauccuuguauuagguucuucuuggccucuuagagcaggacuguaugagaauccugacugcacaagaaacuaagguuagguaaauuagagacagcccaauguggaguccuggggguggguggcuggcacaaggcccuggacuccuucccuguaggagccaggcagccuuucuuccuuccauggucacagaaggugcugugcucaacugccuggcagaaggucugguuggaaugugcuuggaaggugagcucaggugauacacuucacagauggggcccaucacauccacuuuggaauggaaagaacguuguaaguaguaauaucagacuucccaaaggagggcgaauggagauucaauccauggagggaguagggguucaaucgcuggacagauuuacuugcacccaaacaagacaacaggaaagaagaaaaccagacaguggaaguuauggaugaacugauagaugaacauucaugcaucaccuuuggguuagaggcagccuugccugagccuggagguuggaggcugaacacuucuagccuaaggauguaaggaagcagaaaaagcagagguagacuguuuuccugcccagaggucuaugcacaggggcccugcucauucuuacucagcagcacacuugaugcaagccauacugaggccauaagcauagcaucaucacucacggaagccagccugaggucugauaagcagggcgaaucagaaagggguggcuaccuuggcagaccacagagagccaggcuuauaugaccagaugccacugagcacgaccauguguacugugugugcacugcucccugcagagggcucacacaccagcacuuccuccucugcugccucuguggggccauccuucccuggucagcauccacaccaagcucagaaaguacagagacaaauaucaagugcagggagcaaagaggcucaugcccaugccaugcugacccuggcagagcagccacagcauguguggcaugacacaucaccucuuggagacccaaagaagcaaaucuucgcguguucaucuuguggguguuaaagguacuucugcucucuuccugugucagaggaaggcccuaggcucucuccacacccuguugcuguguuaggggcaauggggugacucagaggcugcaacagccacauuggcugcaucuacugggugcauguggcagggggcugaguuggaaggaaauaagauaaaguugccugggcagccagaguggagcuggccagcugucaggagcugccucagugcauccauggaugagcugcuugggagacccuguggaguggguagagagguggggccuggaggucugugcuggccaggcaggugaaggaggauggaccaaaagagugccaacaucuuccuucaagcuccccaucccugcagggguccucuaccagaccucaggagccugcgcugcaggcuacugcccguggccucugccagcacgguuguacaucccagggccugguucggcugcagggccucugcuuuuccccucucucaguuggcucaagagccugaacuguuuuacuccugggggcuagcuuaucuacagauagaaggaccucuggagggagcuuuuagucuagacuguaguagaaaccaaagauaauauuuaccaggaaagaacugaacccagccacuuagcugcaagcuuccccuucugagccuuucaggguacacagugggcaccagcccucgagaucugggauuguuagugcuuuagggaucaccaucucaguuucuuaccaguguggaaguuccuugaauguagaggaagguccccccagcaccgcguuuucaggccucaugaguguccaguaaacacugacgaagcugaggagcagcggaagacagcagagagcugagugcggaauuugugggaugcagauggcuguacagugcagccucagucagaacacaggacauuagcuucauagggaauuuucuacccugguagucaggauuuugcuccugaccaagaaaacaacaaaaaggaaaccauacaauagaacuuauggaugaacugacacacuccaccaccccuacuucaucugaauauguuuauuagccucacaucuuccuugaguccugggcuauccuccuguuccuccuccccaugcccucccugcaggcuacucccaggcuucguguguccuacuguccugagacucgggccggcccuuggcagcaauccccaucucuucucgagauccccacaccugugucauuuucacucuucuaccuugaccccauuccaaaaauguauuagcaacuuaaugccuuugcguuccucagauccaggcuccaagugagcaguggucuuugucccagaaguagcagcgaagagaccucagcgaggccccggaaagggaggcggcugagggagccugugccaagccccaucagcccaggaaagccuuacagaaagauucuuucuagaggaaagaagagauuagcugagccuccccaaaaaagacaaguaaagaggacacagaaauauuuccuuuaaaagggagcaagagcagauggaaagaggguuuauauuaaugaaaucuccggauauuaaggaugaaaugaaugccagggaagguuauuaucauuucauuagaacacaaaggaagaaacaaacacauuauuaugugaaaccaagaaguuaugaacaagggaauccagcagggaaguuauuagcuggguuaauuaaaacagaacaagccgguugaguaauuccaucuguagaacccaacaaggaaggcauaauucauugcccuuaagaaaaauacucaggguauuuugcuuuuucuccuuuaccagaaauucuguacuuuugauauugucucacaaaccaaaaagauuuauucuuaucaacgcugaauugauuuagcacucuugugagagaguucaguucugaccaaaagagauggcaauccccccggagauucuugagcccagacagccaggggcucucccccaucuaggaucaugggccccucaaagauuccuccauugccuagcuugcaggauuguggcagguggcaacugaacaugggaccaggccuuacucauccauccuagugauccuggggagggcuggaccaggccagguuugccugcuaucuucuccacugcuuccucuugccauccugaagcuggaaacuccuuggcauaguacugcuccuuagagcugucagagccagucuuucuaccuagcuuuguuggcaucuagcacaagggagaugaccaacaagacugcuguuugcagcaucaacccaccugguauuguuuggguagugcucauauagcuggcugaguugcugcucccuucaggaggccuagaggucccaaguaugacagucccgagcaggccaaaugggucccaucagcccuugggauuuucuucaucucucauuugucaggccuuaugaauuaaaauuaggacucuggguuugggugagaccuuggagguugaucuuaagggcuauuucucaaguuaacguaccagagggccagagcccccaaguucuuuggcccuugaacacagguauaggacaugagagcuggaaggggccuugcuaaggguauaguccaucgaaaccuuuuguuggagagaaggaaacuaggcuccagagugagagaggaaaugucugagacagaucugaggcuacagagcuaacucguggcugagcaggacaggaaccaggguuucuuagcaaguccugguaaccuacuucugcccugugacccucaugcucuaucccugcacuucagggcuauccccaacagagugccuaggagacuccuagagagcgcaagauacauuuuaauaaggguaagagcauguggcacaaacacugcuucauaauugucaauugcuuuuuuuaauugauguacuuuuuuuuagagcaguuuuaagguucacagcaaaacuaggcagaagcacagaaagaucccacacccucccugucccacacacgcacaaucaaacccacuaucgacauuccccgccauggugguacguuuguuacaauugacgaaccuagauuaacacaucauuaucacccaaaauccauaguuuacacuagaguucacucuugauguuguacauucuauggguuuggacaaguguauaaggacauguauucauuauaguaucaaacagaguauuuuucacugcccuaaaaauccgcugugcuucaccucuucauuccucccuccccucaaccucuggcaaucacugaucuuuuuacuguuuccauaguuuugccuuuuccagaaugucuuauaguuggaaucauacaguauguagccuuuuccgauuggcuuccuucacuuaguaauauacauuuaaguuuccuccaugucuuuucauggcuugauagcucauuucuuuuuuaaugcugaauaauauuccauugucagguuguaccacaguuuauuuauucauucaucuacugaaggacaucuugguagcuuccaaguuugggcaaugauguaugaagcugcuauaaacauccuugugcagguuuuucuguggauauaaguuuucagcucauuuggguaaauaccaaggaguacaauugcuggaucauaugguaagaguauuuuuaguuuuauaagaaauggcuaaacugucuuacaaagugacuauauuguuugacauuaccaccagcaaugauugagagauccuguuguuccacauccucaccagaauuuggugcuguuaguguuuuggauucggggcauucuaauagguguaucaugguaucuuguuguuguuuuaauuugcaauuuccugaugauauaugauguggagcaucuucucauaugcuuauuugccaucuguauauuuucuuugguaaggcaccucuuuaggucuuuugaucauuuuuuaacugggucuuuguuucauuguugaguucuaagaguucuuuguauguuuuggauaaaaauucauuagguguguauguuuuggauaaaaauuuauuagauguguccuuugcaaauauuuuaucuguuuauugcuugucuucuuagugucuugacauuaucuuuuguagaggagaaguuuuuaauuuuuuuuuuuuuuuuuuuuugagacagaaucucgcucugucacccaggcuggagugcaguggcaugaucuuugcucccugcagccucaaccuucugggcucaaauguuccucccaucucugucuccugaguagcugggacuacaggcacacaccaccaugcccggcuaauuuuuuauuuuuauuuuuuguagaguguuuugguguuucgcucuguugcccaggcuggucucaaacuccugagcucaagugauccaccgaccuugaccugucaaagugcuggaauuauaggugugagccaccacgccuggccaaguuuuuaauuucaaugaaguucagcuuaucaauuauuucuuucauauauuaugccauugguguuguauagaaagucauugccaaacccaaggucaucuagauuuucuccuaugucaucuucuaguaguguuauaguuuuggauuuuauauuuaggucugugauccauuuugaguugauauuugugaguggugaaaugccugugucuagauucuuuuuuuuuuuacagguagcuguuaaguuaccuguaguauuccagcaccgcuggguguaaagauuaucuuugcuccauuguauugccuuugcuccuuugucaaagaucaguugacuauauuuaugugggucuauuucugggcucuccguucuguucuacugaucuauugcucuuuucuuucaccaauaccccacuguccugauuacuguaccuuuacagaaagccucaaagucaggcaguguaagucuucuuuguucucccucaauauugaguuggcuauucuugaucuuuugcuacuccacauaaacuuuagaauacguuuauugauauccacaaaauaguaauaacuugcuggauuuuaguuggaauugcauugaaucgauagaucaaguugggaagaacugacaucuugacaacauggagucuuugcgucuaugaacauggaauaucucuccauuuacuuaguucuuugauuuuguuuaucagaguuuuguaguuuuccuaauauagaucuuguauauucuuuuagauuuauacugaaauauuucauuuuagauagugcuaauguaaaugauaauguguuuuacauuucaaauuucacucacucauugcuaauauauaggaaagugauugacuuuuguauuauuaaccuuguauccuacagccuugcuguaaucacuuuguuguuugauuuugaaacagauaccuccucagaagaugguaguuaagcuuuuguuaguucccacacuuuuucuccacuuugggcuuuccuauaugcugugauuuguuuuguuuuguuuuguuuuguuuugucuggaguauucugccuucccuacccucagucuccacuccagaugcccccuucuuuaaaccugauuaaucuuugaggucucagagaagcaugguuuauacugggaagccuucucugacucuaugagucuggguuaccugauccccccuacuucauuucuucucuggaagguguaaucccuacucucaagaaacuaauggcuuauuugggagacaauacacagaggugaaaguaauaauaaacaagguuuauuauuuauacugggaagccuucucugguuuauacugggaagucuucucugacccuaugagucuggguuaccagauccccaguacuuccuuucuucucuggaagauguaaucccuacucucaagaaacuaauggcuuauuugggcgacauacugcaaaggugaaaguaauaauaaacacuuaucucuguucuaagaacuuuacuuuuacuuuuaacucauuuaauucucacaggaagauuaaugagaacugcucuccaaaacccucagaaacucuccuuaaccuauaaaauugaauccagacaguuuagauuggccuauaugccuucacaucaggaucuaaagcuguauuuccaaacuaagcugguuuacucacuaugucuugauauagucuauacgucuuuaccucugaaugcuugcauaugcuauucucccuguuugagauguucccuguggucucauuccuccaugaccauuccauccuccacauuucuauugcacuuauuuucuggaccauucauuuuuguuaugaaccuaagcaaguuuacaggaacaaaacuuaugggaugccaaacaggacaacucuuacugcccuccacagucuuuuggauuuuuguugcgagacuugcauagcuguuucuggugugaucucugccuaauccaauugcuguguuuuauuuacaaucuuugugcauugacauagccaacauauuugucauugaagugguugcuuaguguugcaugguguacauucauugcuucucuuuuagaguccuguauuaauauuguaauucaguuuuguuuucucaauuauuugcaugccaaguauauacaagaaacccaucucuugucauuagucuggcaauugugagcuccucaagacagagacugucuucaacauugcuguauccucuacuaucuuuagcuugcauguacuagaugcucagagaacccuguucaauugacucacacuaucauaacgccaggaauuuagccacauuacuuaacacccaccucuacccugauaaaaacgaaucccaugagggcuaagauguguaaccagagaggauccaguaacuuucuccaaaugcuugaucacucuaacaucacuucucucaucuugccaccuccucucucuagaguaucauuuagcuacaaggauucaggaaaccuugaagaucauuuucucaagcagcugaugcauacaagcuaaacauaaggaccaguucccuggcaagugcuucuugcuucuagugauacaaggcuguauggggccccaggagucgugggguggaguggguuagcgaucccauacuugccauuucccugacuuugaguggaagcucagaacucccagcguugccugcuuaaucugugcugagauugcagaaaccuggccuggcuccucuaccuuugggaggguaaucauuucagaagcauauugugcucacuucugcagucaggcauggcuagauuuaagcaaaacuuuuuuacuucuuuauucaguguuugcuacuuguugacucacccuauucuucuaagaaaauucuccucuuacuuuuccccaucgacuguuuugcucccuccuggccucuccaccacugauuucuuccuggcuucuacgugugagcaucuccccaugaaucucucugcuucugccuuccucugucuacacuuucucucuagcagucuugcuugccaugaugacuaaauugauaucccucagcagugacuccucaaaccccaucuucaacccugaccucuugagccaacucuaggccuacauuuccggaugucugcuaggcauuuccugcuggcaauccaaauccaaccugucuaaauagcucacgcggcucuuucccccuguuuucccaacuucucucaguguucuagugacugauguuaagaaccuuggggcuugucugggcuguuuacuaaccacaucuuggacccucaguuuccucaucugcuaugugaagaugguaaugcgcucccuaucucacuaaagagcacugaacgagacaagcuaucuggaagcauguuuuaagcuguaaaaggguacacaaagaagagauguaauaauugugcugucaucuuuaguuuuuuuuagcuaaaaaagcuaaaagcuacuaucaucuuuagccacacauucaccccaucaccuuauguuaccauuuccuuuaucccuguacuucucauccauccuuuuaucucaauucuugauaugaccaccagaguuuaaacucugucauccauugccuagacuaguucuauccgagccuaguuauauccucuaacucagugguucccagacugcaauccauccacauaagaauuacuaggaggaauuuauuuuuuaaaaaaugcaauuguagucucuuucacaauugugcugggacaauggaauauccacgcgcaaaagaauaccucauaccguauacaaaaauuaacccaacaugggucaaagacuuaacaguaagaacuuaaaacacaaaacucuuagaagaaaaaauaggcauaaaucuuugugacauucaauuagguaauaguuucuaagauaugacaccauaagcaugagcaacaacagcaaaauaguuaaaguagaguuaaucaaaauuuuaaaaaauguugcauuucaaaggauaccaucaagaaagugaaaagacgacccacagauugggagaaaaauuuugcaaaaauuuuaucagauaagagaguuguauccauaauauauaaagagcucuuacaauucaauuauaaaaagauaaaugacccaacuaaaaaugaacauauucaauuuauuugucaauuauaccucaauaaaacuggggaaaaaaugagucaaggaucugaauaaacauuuccccaaagaagacauacaaauggccaauauguacaaaaaaagaugcucaacaucauuaguuaucagggaaauacagaucaaaacaauaauaaggcuggggacaguggcuuacaccuguaaucccagcacuuugggaggcugaggugggcagauuacuagagcccaggaguucuagaccagccugagcaauguggcaaaacccugucucuacaaaaaauacaaaaauuagccaggcacagcggugcaugccuguagucccagcuacucaagaggcugagguggaaggaucguuugagcccgggaggucaaggcugcagugaaccgugaucacaccacugugcuccagccugggugacagagugagaccuugucucaaaaaaacaaaaaaaaugaaacaaaaugacaauaaaguaauguacuuuccaaaaaccauugaauuguacacuuuaaaugggugaauuguaugguaugugaauuauaccucaauaaagcugcuuuuaaaaaaaucacaagauaccauuucacauccauugggauagcuagaaucaaaaagucagauaauaacagguguugaugagaauguggagagacuggaacccucauacacugcuggugggaaugcaaaauggugcagcugcuuuggaaaacgaucuggcaguuccucaaaugauuaaacguagaguuacaauaugacugagcaaucuuacuuccaagugggauuucagauaauauauauacccaagauaaaugaaagcacauguccacacaaaagcuuauacacaaauguucauagaaguauuauuuguaauagccgaaaaguagaaacaauccaaauguccaucaacugaugaacauauaaauaauaucugguauauauacauauaauggaauacuauucggccacaaaaaagguaugaauacugauccaugcuacaacauggaugaaccuggaaaacauuauaccuagugaaagaaggcagucaagaaaggccacagauuguaugauuccauuuauaugaaguuuccagaacaggcaaaucuguggugacagaaagucaaucagugguugccaggggaugaaggggauggcagggggagggggugcuaaagaguacgagguuucuuuuggggaugaugaaaauguuccaaaacuuauugcagugauggcugcacaguucugugaauagaccacaaaagugaauuauauacuuuaaaugggucauuugcauggcaugugaauuauaucccaauuaaccuuaaaaaugcaguuauaaggggaaaauugaugguggggauauuuuacagaaagcuuuaaaugccaaguugagcagugaggacuggauucucugggaccaguuuucucgaagugugcuucauauaccgucugccucacaauaguuacaaauaccaaguccuggcugcaccccagagacuguaauucagaauguuuuucgugggaucgguacuugcauuuguagcaagcaccccacagaggcugcaggcuacaccccauuguuaaacauuuugcugaucaaucuugcugccuccagacucugcuccauucugcccugcaugacgcugcuggaugagccuccaagaguauaguuuggguugggucaccuuccugcucagaacccuucaauauccuuucauucccuuagcaugagcuccaggugcucugggcagccugguucccacccagucuuuuuagccuuaucuccaugacuuccuacaugucagucaaaauguaauauucaucauucucugaaccuguuuuguggauucccacucagugucauugccaggcugucccauauuccaggaaagcaucuccuguacucucagcucaucuuuugcgauacaaaugucaccaugauccuuccuuucauuuuaacuagcugaucgucuagaauuuaccacacagccuuucauaaucuuuuaagcuauacaguucugcuacuuguaaauugaaugacaauauucagaguugucugaauauacagacaauauacggagaaaacaccuguagaucaggcagugcagccugacaccuggucagagugcaguacugggaauaaaauccugguagcaaucuccucugaggaauucagcauccuuccugguaauccagagaucaggggccugcaucaggcaccaguggaauguaagcaggaccugggggacccuggccaccacccaaccugucaagucuuggcagcuuagcuggcgccacuuccuuacagaggcuggaaacugcugaauugaauccucauuucaacuggugaccccaagcagaaaugcucucccaaucccauuguccucuguacuguguccacgaaaucaccccaucucaguaggaaaagagaaggcuggaaagccauuuacagccuauuugguaauaagcucuuaaaaauaaaauuaugauugucagauaaugauuuuacagcacaacaagagcccccuugcaaccauuuccguaauuacauuaagccgguuugucugaaagaagcuuaaugggaaacaaaccauuaauuauaauuuggucuuuucucccacagccccuucccccuugaauuacuggagccacacccuggggccauguaugggagugcagggaucgcaaccuugaggaugggaaagaugaggugacaaaggccaaggcucacugggagggaagaauagagagcaauggaagguacaagguugugguggccccuguaaccagcuggggggccuacaauggcccccaccuaaguggagccaguggugcuguguguccacuucuuuagaccuggagugaaggaacugggagcuguagggcaagcugagcccaacaugggcauguuuucaggggccucagagcuaguggguggggcgggcaccugggcaaacagaacuaagaaacgggcaggaaugaaucaaagacagcuuaaauaugcagaaaugcagcucauaccucugggcaaaaauaaucccaaacagaguuauguaaugggcaggugguauaugauaggaggaaugaggcuaugagguauguauacaggcaugagugaaugagagagguugagaauggagugggaguguccuggggaauuuggcagaggagcuuaugaagcuguugcuuggaggugggugugcauguguguauauacacauacugggaacccuggaaagcagcgagaggaagguagcucugaacgaggcugaguuccacgccugggguggccuuaaggccacuccagaugugugcacuccuaauucuugaggugguagggacagagaaagaccugagggcacaggugugggguuuggagcaccacuguuucccuuauaaguuaguguaccuccuucugaccgccauacucccacuccuagcuugcucgcaucccaccuccagaccuuucugcuaauuggaaucuuccccuuccuuuuacaggaaauccaccaugacagaccaccccaggucauuuuuauuauuauuucuuuuucugagacagggucugucacccaagcuggagugcagugguagcgaucuugguuguucacagcagccucaaccuccugggcucaagcaauucucccaccucucagccucccauguagcugggacuacaggugugugccaccaugccuggcuaauuuuuguauuuuuuuguagagacagaguuucaccaugcugcccaggcugaucucaaacuccugggcucaaacgauucacccuccucagccucccaaagugcugggauuauggccuugagccacugcaccugaccccagguuacauuuaacuaucccuccaaggaaguuccaggauacuuacucugaucucucaaaggaaauuguccauaaguugcugcugcugucuuaagcugugauuuuuauccaucuguguaaguguuguccucccucuagauuguaagcuccuugaggacagggucuuuguauacugcaauggccagcacugugccugucauuaagcagguguggagcaagcauugucuggcacugagccugacagcucaaggagcaggggagggcaaagcaggggagagggcacaaaggcucucauagggaccccucaggccauucagcuaugaauccucuggcugccgggggagccccugagucuagaggguggguuaguaguguugaagcuacagaauaauuuagggggaaauuguggauaaaaucauguaaaggaaguacuccacuggacaucagucggaaacccaaaacaaugcaagcaauuagacaaaggcuuguggugggcaccucagugaccauaaguuucaggacccacugcuucagaguggguggagaggccaccagacucaucagaagccucagugacuggggcaggguauaagaaacggauacaggggugagugcagauucacaaggccauuaaggucaacauguugcaugaugagcagggugcugauuaaaugcuguugccugcagcccuaagaagccugcaaggaauucugaagcauccaguaaccaggcgcaggugcucagagcuccugagguccugugugugcaugccacuucccaugagcagccccacauacauccacagacugggcuuggaaggguagagguuuccagagaaccaguaguugaccuucaaaggugggagggaggcuggcagagggccagcuguagagcagcagcugauggcaaggaacaaagguccuagagcuggaaacauauguggagacucagggcuccucuuugaagauuuacugcuagaaagggcccuggaaagcauuucgguuuucccuugguucacagguaaguacacguugaggcgcaaagggaaaauaugacuuccccaggaaccaccagaagaaaacugauugagcuaaaaggauaauucagguuuccugacccuaucuccauaucauaucugcuuggaauuugcauauccuucuccuggguaaauuaugguauuugcaguuccaguguaccccaagagccagcagucuuggucuagugguucuuugcuuugugguuagugcuggaacuuucauaagcucuaaaugggugcucugaggagaaagaauggaugauuuggggcagugggaaggagggcagggccagagcugggucucuagggucccugagaccugccauaaccacugugaaguuagugucugugacaucguccauugaggaaauucccagaagggcuaagucuggcuugggaaccaguacccagaccaggccagggaaguugggcuguugucccaggagcagccaagccuggggugggcagggcugggcuggguugggcuaggcugggcagagcugagagagagaagagaauuuuuugccucugggcucauaaaugcuauauugggcaaggccucucguuuccuugggcggugaccaggagucucuccaaauuugccagccuggguugaauugucucucugccuggaaagagauugcauccuucuagaggaucccccucaguccucaagggaauaagaauggaugcugaccccugcagccugaccucccagaauggauagagagaugugagcaaauuccauccaagagggugggccacucauuaccucugcuaggcuaggaugggagccacagcgggggacaacuguuucugggaaccacggcucccuuggguugcugauccaugcagucacuguaccccagggugguauagauaguagcuaaggccuugcucaugguccccagagcccccaggccagcaaacaagucauuaugucauuauauaaauaaauuagguacuuacauaggccuugguguguaagugccgguuguuauuauugcugugcaauuauguaguuagcuugaugaggggggcaggcagaaggguugaaucaccccccauccuggggaagguagacaggcucccaccucucaccucagugagaacuguggcucagggucacccaagauaaagugcaggagucucccaggugucucccugcagauggggcuauuuaccccaaggcaugcccuggaagaggcuggcagcaggaauccaggcagcuuacucaccugcagcagggccugguaccaugccgcaggcuuucugccagcuccugacugccucucccagccuaacagaggggcuugcaaacaacaaccaugggcuucauccaggacaagaagccccagaaggugggggcugagagagaucauggggcugggagaagagcugguggacagaguaacaucucuucuuccucuugggccugggggucauccgcuccucuacucccaguccuuccccucucacugggagguuuagaaccuuagguuccucaggugugaggaucucucaacaucauuuaguccaaccucacauuuucuagauggggaggcaggccagagagagaaaaguacuuacccaagggcacacagcaggccccggggacacuggaauuagagccugcucugcuguccuccuuuguccucuuguucacaugcuguccccccaccccauuguuggggcugcuccagcuucucacuuccucuccccguccugcucccagcccuguccaggccugccuguugccucaccucuccccucguuugcucucccauugcugcuuggcuuucuucucccggccccuggagccaggggaggcuccccaccuucucuucggccaaugcuuucuucucucuucuggucccucccaguuugcuccugaggcuucuccugggaugggucugccucuucccuuccaccuucugcucucuccaaagagggucugaaaaugaagcagggaggaugaauucucuucuggguuugggauugggugggcugaagcaagaagagccuccuaaugugggaguggggacagaggugcccaccauggcagcuccuacaaccagagucccagcucaggcacugcaacaucugaacuugugucccauaggagcaaaggaaaaggggacagggucaaaagggcauggcaagguggugcggcuaaucacuauuggaaagggccuccgaacauaaggagcugccuaagacugggcccuuuucaagcguccucauuucagggagaugagagaugaauuuccucauccacucugaaaucccgugagaaaggccugugggcccauuuuuuguuuguuuguuuuuguuuugaaggggaaacuaagucuugcucagaacgucacagucuguggaggacaggguuuggagucuggguagguggauaucaauuucucagcuguuccaggaaucagugaaguucauucacuuaacgaggaaugugugugugcauguguugagcagccaggcacaauucugaggggaacagccaggguucacagggcuguguaugucucuagaagcauucucaccuggcaaucaaaagcuuuucugcagcaaucuguagcccuuacuccuucagccauccagauucuugguagacaggcuuuccggguuggcugacagaggaaucuggaaguguaucucccuguuucauagccugagugccugguguggaaaaugacuuuuucagauuaaccuaaucucaggagcaaaacugggcccaaacaaaaguguuccaguauccaagcuugcccuuuuuauccagccgauacagcccccuucuuucuggccaccuaguucucugcacugacugagggaggcagaggcacgaauaaacuuuuuuaagagaagaaacccauugcggcuuacagggaugcugaagcuacaggccaugaugcagauuuggcaagaggcccuaucucucagcucugaugcauuagggggcucuccaggccuaggcaacugggucuggcccccaugcacuccucaggaacugacuggcugcauccaggcccccacugcauccuagagucauguggggaaugggcuuccaggcuuugcauaauccuucuggauaacugggaauuucucugguccugcagggaguggcauuuugaucuauuuccuccucuggcagccucacugagugaggagugugccucaugacuuucaggcacuaaaaugagaagggcuaaggguagcaguagccucauauccuccaaggacuuuuaacucacgggcaaacauaccgugggcuuggagauggcucagggaugucuucaacugggauggagagaguggguucaaggaacugcuuaaggcucucccuaaucugaggccacugaagcucucccccaauaauucccaugacauagugaguccaaggggagugggaaaacuucagcaugguucccaagacccccuugcaggagaauuguauagguaagacucggagucccaaagucucagguaggggaagagguaguaugggguuuuuuccccuuucacugaaaggcauuuuugcacaugacucaaacaagucuaaacuuuccuaaacuucaaaguuugccauggcacagccucaaaguggaagggaaaauguuaaaaaggaaaaaaguuuguaagccaguuaaauauuguguuuuuucuucuuaaaggaauugaauuaacuuguuauguuacuauuagcgucccauugugaaaauagggugggucuuuuuggggugauguggucucugggcccauccccaagcccugcucacucugcaugagguuguacagggcauugcacaaccugugguaagaggaaagaguucccauggcaacaggccuggcucacagggucauuuucaagcuccuggcaagagcccugguccaggccagaggugcuccagaugccuggcuguccucccuccccugagaaaccuuugcucuggaaacugggaggcuggggaagugggagcccagcuggcaugccccagggugccucgugacucucuccaccugcccaugacccaggaacuaagcaucagucauagggcuguggagacugugcaggucuugcgaccagugguuaggcuugaggggugagggcuuucucuacucucucucaucuccuaucuucuugagcaacaccauagagcugugcuuaagagugagcucuggauacccaacugcaaggguuccuaaccuugcucugccacuuacuagguauugacuuagacaaaaauuaccucaccucucugcacuucaguuucuucaacugcaaaaugggaauaauaguagaccuacuccauagugguguugugaagaauuaagugaguuaauacuaucauauuagugacucuuccugcuaccauuuucacugucuucacugcugguucagguacuccucaccugacccucaagauguucagagccuggcgcauaaagggcucuaaggaaauauuugauggcugaccugcuuugcugacucccucgucuccacuaucuucuccuucccauccauccugcacauuccagucagauuaauuucucuaauacacaagucacucccuuccucaaaaaaccauccucaacuucccauuauuuacuaaauaaggcccaaaagccucagcuggcaguccaaguguaucucucaccugcucacaagcagucuagucucagaguaaagagcauggguccuagugaaaaauggcgaaggccggaguccuugcauugcagcuuccuggguacaugacugugaaugagaagacucguuacuccuagccuuuguuuccucaucuguaaaaugggaauaagaguugaccucccucacaggauugucgugaggauaacaagagagaaaauguguaaagugcuuagcacuaggcugaggcagauaguacgugucccguaaguguuuuccguguguauuugcagcucccauaguuuccuaacauaaaccuggucugcucauugucuccugggcaggugcccagggaaugcucccccuagaucuuugucguaucccacucaucuggaaucucucaccugacccccaucaaaauccuacccauccuucaagcucuucuucaagcccaaccucccucagcacuagaucuggauacuccaguccagggagagugcucgugcccccuuugaauuuccaugccauuucugacucguaucauucauuugauaccaagucaugagcugcucuggacugcugggagagcuacccccaggagaauugucuucaucuggcugcaaucccccaguuugagccauuuuuuucuugcugauacccuuggccauucuuuacuaguggaaggagggucacuuaucugucccacaaggagguaccuacuaccuaccuuguaccagaaacuggggucacaaucccaaaggggcuuuuacuguaguggaagagacggagguggaaaugaaaaacaacagucaaguguucuuagagggauacaucaaaagaauucaggaagcagaggaucucaucguugcccucucccaccccucacauaccugcugaagagcuuuccauagcagaccauugcucuuaagauuaaaccccaaugucuucauuggaccuacaacuguccugcuugaucugaccacugccugccuccucuccaggcuccuuuuacaacauuuauaccaucaguccacagaccucccacaaaccccacguguacacacacacaccuuagacacaggcauacacucauauguacacacaccucaugcacauacacacccaugugcacacucacacucauauacccacaucccauacacacaugugcacaugcacacacacgcacacacacagcccucagcauacucuuuuucaaagguaaaaaagcuccuucuugcuucagggauauuggaugugcugauacuucugccaggaauacucuucccccaguaccucuuaauauggccaacuccuacucauacuucaaaucccaguuuaaguguuuccuggggaaagccuuccuucacuacaguuuguucccucugucaagcugugugucaacauauauaaagguuuguugaaugcaugucuccuuaauauuucacacaaauuuuaaucaauccauuauuuguguaauuagguauuuuuccauccccaccagccuuuacguaaggagggcccaugucugucuugcucacugccguaucuccagcaccuagcacugugcccgaaacacaguaagccugacuaccuauuuaccaaacaaaugaauacagagaucagguaggccaaaaagggagagagauccugggcagagagauuaguauaguaugugcaaagguaugagaggagauagaguaagugugugugacuuguaaguaaaguggcugagguauaggcuuugggggcuagaaggcugugagcuagggccagguagaauagggcuuuggacacccaugaggaguuuagguuuaacccauggguuacaaugagugaagugaucuaguuuguguuuuagaaagcucagucugggccgggcgcgguggcucacaccuguaaucccaacacuuugagaggcugaggcaggcggaucaggaggucaggaguucgagaccagccugaccaacauggugaaacaccgucucuacuaaaaauacaaaaaguagcugggcaugguggugcaggccuguaaucccagcuacucaggaggcuaaggcaggagaaucgcuugaacccgagaggaggagguugcagugagucaagauggcgccacugcacuccagccugggcgacagagugagacuacaucucaaaaaaagaaagaaagaaagaaagcucacucugauggccuuggagaggucagaacugagaggcaagacuucaagcaaggagaccauugucuaugggauaggaagagggaaugaaccaaggcaguaccccaaaggcugaggagggauggauaugaaugccauuuuggaaacugaagagcagggguugaagcagaagugagaccuggccccuggcucugguucugcccagggccccuugcugcccaccucacagaaagugauacugugugaagugggguggguacucgcucucccucaguuggggugggguacaaggguugucucuuacaccugccccccccccaccagagcuggccccugaugagacagacuugcgccccaagaucagcccuuugcggggccaucaccuccagcuucccccuuucuguguucccaccccacaaguuuggccucaaguucuggccgcauccccagacagcccuggagcucgagucccuggccuugacccagaguccuaagccugcuucaggcucuccuaaggagaauccuguccagagaggccuucggacccuuccugaggagacagaggacugggugagaugaucuuugacuuggauucugguugggauggcuguaaggggacaccucaggcagagcuaggcaggcaaaccgcaggcucaggcuuucugggagccagaagagggagagccuuugcuauguaacccuuucagcaccacacccaggcaggagggaggacucuguccucuccagcagccccuacccaaugguuugugggaccggggcggggguggggagucagugucugaguucaccuccgcaggccuugcagagaggagccagcuggugccggcagccugggcugucggaguugcagccagagugugugggaggggggcuacaagccaccuggggcacccagguucccugcagagugcagcccgcccuggcugggaggggcuuuugggccacagaccccuugcugccaggcacaaauggugguugcauuaaagguguuccccagauggcgguaucccacggggcugaggccagaccugcaggcaugagaggcacaggcaacccgccuguacggccgggggugccucgagguuguggagacccaccgcaagagccaagggugcucgcuaccccgcugggcuggcuagcgggcuucauuuuggucccuuccugggcccuuuccucgcugucuccccacccccaugcuguccuuagccuggcccucgcugggggaucucuacuccgcccuccccaaucaugcucaggcccccagcccagcucaagcccccucuucggcgaggaggucuguggcgcccuguuuaggcgccggucuugccuaccucggugggcccagggagggggccuagggcccagaccggccgcccacacgcccccgcggcccgagccgguggagggggggcgaggguggagggcgcgggaggggaagaguuaaggcucgcugcuccccucccccggagggugugaccgccuauaagaaaggcgccgcgcucgggcacugaggcugcaggcggcgggggcgcagcgcggcagcggagagcugaggccgucccaccgccugggaccccgugcagaaugucggaguccaggaggaggggccgcggccgcggcaagaagcacccagaggggaggaagcgggagagggagcccgaucccggggagaaagguagggcaccuccgcgcgcccagaaacccgguuucccugggagaaaccugccgcccgcucacccgcccccagcgcagcgcgggugagucuaggcugcgcuagcggccgccgcggugacaggcaccgagggcgcgcgugccugcgugcgagcgggucgucgcggccgggagagcaaggggcugcgugccaggagcccgacaguggcugugcgcgccucuccccgggcggccgcguccccacgcaggggcgggcaagaggcgcugcacgccgguaccggccugcaggcgagcagcccugagcgagcggggauggagccgcggauaccgacagaaaggcggcggcugaucagacgcugggcccggccuggccgccgagcgcuccgggagcugucacugccuucccuuccucggagagaucggagcccucgggcuugccccuacccaugugccacaccucccuccguucugcucggccacuggagcgugggcaacagcgcccgccaacuccggagacucggaggggaugcccugccccgcucgcgaaccccagagagaaggggagccgcugcuucugugacaguucccugggaacuggacuagacauugggcaguugucucucucuggucuucgggagugacucucuugggcccuuggauucugucccugccuggaggagcagagccaugauuugcgacccacuuucgugcccucccugggcgguugcagagucaaagaggagugcacuggucucgggcuucucagaggcggcccggggcaugcacauccucuccguagaaccaggcuugcacuggggcccaauuggggaaacccuggauucucgguucuuuucuucaggcaagcguuuuguuaauuuugugcuaauuuuauguguuuuguacgagucacaggcaagccauguucaaaugcuuuaucuccauuuaauccucauaacaauccugggagcaggugguccuaucuccauuuuacagagggaguaacagaggcuuacugaaguuaaaguaacgaaguacguuccagagauaagacugggcuucaaaguagcauucucaggacaaagguccugagacuugcugggucucuauccccucacuggagugcccaccagaucagcaacauaaaaaugccuucaaaagagcguuugacgggaagcugggaggcuucgauggugcuugagaauuuggccaaaucccuuuccuuuccugaauuucuguguaaugauagggaagggguagcaaggcucugaggucucuauugggaagagccuaggcgucaaacacuauuuccagcaggguagagagaagcaguuaaggaaacuuaaaggccagaacuguguucuccuucuuuuuaagagaaaagcucuuugcccauuucugccagacaagugugucuuauagcucuucccaaggacagguggucugcuaugaggagccugugggucagcucaagcugggcuccugcagugugggaugagcucccaaacugagaucugaaagaaugcagggugccucuuuuuaugaucgaaaauuuauggauuugguucagugagccaccuccauuacccaccccacucccauucccccuacauacacauccuaccuugggcauuuuggaaggguagcuagguaagagcacucucucaaugucaaggaggcaggagcugagcugguagcaagcacucggugggcuucagcuggugggaaucacuagugccagggaaaugcacauggaaagcaugagcaaguaauucacuaaaaccuuuagcuuagauguggggugggaaucuggaaagugggagggagaaaggaggggagagagaaggggacacuaauuaaugggcucccccugguccuugaccacacacucagcacccuccaacaacuccuuagcaaauagcaggaagagguaccucucuccacacaaacccaggccaguguggggaaaugggcuuuuccucugccucagugcaggagugcuggcuggggcugaacugcaggugugagcucugcuccaugacucacugagaguuugugggucugaggcuugguaucccuaaccgggaacugggucucccccaucccccauuuccccuucuccccagcucauagucuugccagccuuggcagcggugcuggggguguuggguaauaagcccacucaugguauaguggaauggcacagcuggaagccaggcaccugggguucaucccuguuggaccucugugugaccucagacacuguccucccuuucugugggucucuggauaugcagucuacgcucagcccucaccuucuauaugagaagggcagagcguaagccugcauacccagcaucucugagaaccccuagaggagagccaugagauuggaggaguggggaaaauuggccuuaaagaaaaucagaaucccuguaguugcuguguuguuuuaaagaaugacuuuggaaggggauucuaaguuaccagccuuuucugugugccccaguuggucaggguuucauuuaaaaaaagucuccucugcuggaggucccugugaacugagagucugaagcugcccacaggcagacauggagcagacuuuggucuucaccagaguguccuggagugugaaggcagauuagcaucacuagcugagggcucuggacacaucucauuucaauucccuggacacagauaaaucuuugcaaagccuuucuuucccaucuuugcuaucuccugccucugauaaagaugcugcccugacuucuaaaacaaacucccuucuuuaggcuguccaggaccaggucagaggugggauaugcucaugugcauguaucggagccacaucuggggguugcuucuggcagccuccaccucuggucuuggccccuggcugacccugcugagccaggcaccuugagcuguccuccugccacucuggagcucagccuaugccucaugcucugcucuggcucccuggcaccucgagguucauuacaaacaauaacaacaagcagaguaacuuuguacuucccaacagucuuucauccugagagcucaaagcaauuuacagaccaggacucaucagucuucaucccaggucccaggcauuuggcaggggugaagaggggaccaagagcucuagucuuuccagauuggcacagcgguacagcugggguagggcagugagucaucuggguugggggaaucggauggccaguaggucugggauagaaguaaaauuggacuacuggcuuuagguugcaaacagaggguauagucccccuuaaaagaguaugagcugggccauuccuucuccuagguggagaccuaggcccucuggccugugugggcucauugaguugcuggaggaagaagcagcagcuuuuuggaagcaaagucccuuggagucagauuuuugcaggaaucccaaggugcugccuguugcugccuucuuccccuuggugcugggagcuucagggccaagucaggaaagcucugacauuagggcagcaccaaaaugaagacacauggaggaaaaggugcuggcccagccugggcaggcccuagcccuggccucgggguugguuucccaguugcuacccauaccuggucagucccacuuacuccacuagcccuccucuguucuccagcccaccaggcuggccugagggacuguuacuauauggaagaggggcuuaggaaaaaacaaaacaaaacaaaaaaacccucuggcaaagcauugccaaagcaugagaccugggccccauuggaaccauguucucauuguguuuucccaccauuucugagccaguagcacacccuuuguaacuuggugggaagcaaguagcagcccauuuucccagucuuccuccagccuagccauccucucaucaagacuuccaggcucuggccacaugguaacuacauaaacugcauaaacuacauguacguucacucaucuuuguguauucaauucugcaggcauuaacugagcuucuauuaugugaauaaacaacaggcccugucuucaggaagcucagagagacagauccuuauacaacuaccuaugaucagaaccgaggguaagaccagagauaaaugugcaacaucuggugaggagaggaaugauuuguucuccuagggugguguagggaggacuucacagaggagaugacauuggagcugagccuggauggugaauaggaacuuaccagggaaagaaaagggacuucuuagaaguagaaacauguccaugaccaacuugcaugggagacagggagacagcucucauuuacuaaggacucacuacaggccaguacugauacuauaaaguauagguauuauuuuaucauccucacuuuacagaugagaaaacuggggcagagaaagucccacgauuaaccaugaauuaguggcaggaugagaucuuaaguucaagucugcccccugcccagccucagucaugcacaguccaccuggcucugggcucuuccaugccccucaacaaaaaccagggagaggcagaggaucucuguugguccacuuggagcaggcccuccccaucagaucaacuggucagauaucuacuuccugggcucuuggguggaguugagaggauacaaagauaagugggucgagucccugcccucacaaggagcuugcagugugacuguggcaguaaggugugaacaggagccaugaacacugacagaggaggguagcacugaggccuugagccugcacaaauaggcaggagcuccugagaagacagugguuuguuauggucaaauggccuagccagaaaccaagcuagaggucuagaguccggcuagaucuagcaucagaaugaauagauaucugguccuauggagccccuugugaaaaagauggacauuuaaauuauugggaaccugauuuaaagcaccaacuggggacuuguuagaaguacaauuucuugggaccuaccccugaccuacugaaucaguaacuauggggaugggggccaguaauguacauuuuaucaagccccccucccacccaccauuuauuaugaugcaugcucauguuuaagaaucacugauugagcuggguggcccagccuccuggagcagagcccuguagagggccugucaguuccauagguguuaacccagcuccucagugucaggcaugaggcuuggggucugcagugcuggcugagauccugucaccuggcaggacgagauagacacgaacagaccuaauuucaauuacaaggcugacccuggcaagagauggcccagaacagauagaagagacuaacucuaaccagaggaaucugaggaggcuucguggaggaggagaugggguugaggcagacuuuggagcaugagaaggacuuuggcaaaggggcuaugugcccagauugaagaagucacuuaaggagguguggaggcuuggaaacaggauauuuggggaaauaaggcacaauccagaagguaugcugccaaacaguggauuuucugagugccaggcuacugaguuuggacuuuucugagucagcagggaaugaaggguucugagcaggagggugaccuaguccaagcugcacuuuaggcaucauagccacauagcucuuugugaaaggaugggaaaagggacggcacagucaggagcuccugcaguagccccagcugaaccaucagaaugugcauguggugauggcuggguagaggaggucacaggcuuugccucgggauagcucgccagcugcaaacacuuugggaggauucuggggguuuggaccuggcaaacgggcugugacuucuggugcagucaggugaggucuggaucugaacucauaguucacucccuucacuguaaagauggagaaacugaggcccagagagggaaguccacacaccaaggcaaaggacuuggcccuauagggcaagaaugagggcagcaaccugcuccccuaaaccagccacugcagcaugggucucaccucucaugccugcggugcagauggauuccucucaguuccaugaguaccucgugguuccuuccggccuuguuccugugaaccugcuguucacuuugccuggcacauguucucucuuagcaaacucuugcucauccuucagguccagcauaggcuuuguuuccuccacagggccucccugguccccaaggugaggagcacauugcucagccagaaucuccaccagggcgaaggccacaucaacuugacccucagcacucgaaaugugcucagugcucaauccauucuugaacgaacacaugaauaaggacauucucaagcuauuucaccccuguauguggagaccuagcuggccacuccuguuugaagagggucagucucauggaaggaggcugccccaguugagcuuccugcccaggcuggagccccuuaaugguugggcaaugguaggcugaucaagagucaucuuucagucagggccccgacuucauuaucugcucugccauucuagggcagaugccuguuugggcuggcagggagggagagggaugaguuggggaggaguguugggugggaaggggcucugggauuaccugucaauggaucccacccuccagcgagugcucacagcagucuugaucugggcugcucugaggcacccaucagucacaguccagccuuacagcauuaauucauuuacuuggccugugaucagugaacaccuacccagugacagacaccaggaaacacggcgauucugcagcacaugcccccaccagcuccucacagucuagaaagauaagaaccugauuuucuccaaggugagaagccccgagaagagcgugugaaagucucaggaagucugugaggcagagacugcuucuagcuggguggauuagugaaggugguggcaucugagaucuugagggauuuagauuaauaagagcugccgguuauuaagcuaucucuguuucaggcacugugcaaacuucuugacauacauuacccucauuuaauucucuccacaaucuuaaaaguggaugagacugucccuguuucacagacaaggaaugaaggcucagagaguuuaaguaacuugccuaguuauacaagugcugggcagagccagaaugcacaguggcauccgucugaccccacagcuugcaugucugacccucucaacucggcuuccugugugagggauggcauuuaggggaagcaggagcagagggcauggaggcagggcagaauaggcaugggcaaguuuggggagcaaucggugauuugguuugccuggaauauacgauuccugaagggaagugguaggggaauguagagaggcaaguuugggaaggaagcccauucacugacccagcaaacauccccugagggcccuggcugccagguaaggaaggugggcggccuuucucuacagacaucacagagccaaggaagguuucugaauggccgugaggcacauugagguggaacugccaaguguacacuguucaugucaugguacugggggguggggagcaguaugaccugagccagggccuggcagaugauggagaguuaugaggauaagaggcaugguagaagccaaauggacucagccuuuggggaaagucaagagagacacaggguugucacagauaaagugacugaaagaggaaauccaggagaaggagcaaucuuggaagagaagauggagaaacugguuuuccgcauguuauauuuaaccuaaugacuaaauacccagggaggaagguguucauucuggggugaguucuuuccaguccccuugcccucacuagccaggaccacaaggaccacauuucagcccucccaagcucccagggugccuaagcugggacuuucaugcuugcaguugaauuugaaggaaggagacagggccucuggcagccugggcacccugcacccauggugagcacaugagccuguuccugcucugcaucaggccugcuaagaccuuucuccugaaacccagcauuuuuucaaaaccuuauacuuuuauuuuaucuuaaaaauccacaugaacuuaacacuuuucuccaccauaugucuguuuguucugauacaaaggugcugcuuuuccuuauuaauaagcuuggcagacccucagaaagaggcccugagaucauccuauggcuuugcauguaucccaguuugagaagccagucuuuucugcauguacagggugccucccccuuuccccaaccccugcuacauuuccccaagacucagagcuucagaaacaacuuucuccagccaggccaaggaggcaggaagcacaggcccaccccaaagaggauggggcucugggauccccuucuuggcccuuucugaauucccugagcaagagacggccuaguccacccacagcuggcccuuuccacagaagguucuccugggccagggcccaagacuuuggcccagagcccagcuuuccccaguagggagauuaaacagaguuuggguaaaugguaacaguuuuccagaacugccaucucugcuuuguccccgaccucugcccucagcagcugaagagaugauaguggucagaggccuuccaucccuccauagagagcuuucucuugcucuauuccucuaaaauagacagagugugguuuauaaaugagucaacugaggcccagagaggcuaaacuacuuaucuaagggcagacaguugagaaauugggagacugggacaaagaccuggauugcugugucuucagcugccucucuuuccccuguuccugcucugcuuccucugugccucauccgugccagcccuaggugucuacagccugugccacaagcacugcuaagaacccagggagacugaggcaucuguacuggguaucccuaugccuaccccagcaacugcugcccugcucugugaaccugugccaucucucccagacauaggugacaaccuccucaucccccaucucugcuacucgugugccuguaucccagcccugcgcuggguggagcacugcggcguggaccugcgugacucuggggaugagguaucucucccuggccuugcagagcccugaggaggccaguguuucucucaggaugcuuggcuccuggcagagggggcugugggugggaauaguguugucccugguggucaggccugggccugugcauaccugcccucacauugcaaguugggugucaguggaugggugcuucuggaugggcaggugaagcuuuaaggcaggaaucauuucuguuggucuucaugcugccaaguuuugucuccuccuccucccuuccccuucuucuuuaucugcccuccuggugcagcuucugccuccccucuuuaguucucaucccagcuggccuggccccucuucucuaccuugcagcugagaugccaggcaccugggcugcugagcugaaagcccaucaggucuaggcugguuuucacuggugcagggaaggugguccucuuugaggaucagccucugugggagcccuaaacaggaggcagagaccaacccgacaccagggccaugucuuauuuggcaccaaaucccuggugacugguaagugccucguacaucauagggacuguugcauguggguauuuguuggauggauguaagaagagggcaaagcaagcccaggcauugggcugggcuuaggugacugaggaaauguggcucagggaaagcuaagcagcccagcugggcauacacucccuuugggagucuguccugugagugugaaauugcucuucugcaggccauggguaggaugccuggcugccuaggccgucugugccuacuuaaaccagcuguguuuuuagcuuaguggguuuuuuuuuuuucuuucucauuugaacuuggagucuguaauuaaccuccaauagguugcagucacuuugugggugggacaggggugggaagggggcuggccugcagcuggccagcagcaggacagugggaaacuuugaugccaggcaggcuggccacauugucuccagguguugcccugcaaagggaacugcucagccuuagucaugaggugaggaucauuaacccuuuuaagagccugcugccccugcccgcugggugccgggagggaggcagagccagguccucccuggcuggguugcccagccauguccugagcgucugucuugcucucagaucugaguaggcuccgcacccaccgcccacugccgagaggaaugagguuaagcugcuggcagcagcggcacccccuggucucagggcugggaugugggaagagagcaguccugguuguuguugcuguugucgcuaucuuuaaugaggagcuuccuggggauggccugucaaacagauacaggccagaagcccuggcuuggcaccaggagauaggaagcagaagccaccggauacccuguggcccaacucauggcaaccauggggagguguccuaaaguuuuauggagcccguccuggaggaaaaucuuuuuguggaggccugggccauccuugagagagcuucuuguucuuauaaagcugccaagggagaccuccccacauccccacaccucaacuccagugaacccuugucccaggaggaagagaauggaugaaguagccucugggcuucccccaaaacccaaggaguaugggagcucagcagagggugcuuggucugaggaggaaaccuuaggggaaggaagagcugcccaauacccaaaaaccuguguaggccaucagcuugccaccugccccuuucgucucuggggaaggagcugcugcagggaucagggugucaguaauggccaugggugcagagugcugggaacuuucuccccuuucuugugcacacagaacuuccucuugcuuuugcuagaugccucucaucuguccacucuucugugugcuggaccuuugaggguccccuuucugcaugagaaaauaugcaugaacccccaggacugcugcuccucccuucagccacaaagcugaauuuauggagaaauucauugcaauauuguuauuauuagcagaacguuggagacaaccuaauaugcucaucugaacaaugaaauauuaugcagcuacugaaaugauucuagacuuggaaaaauguuuugaauguauauugacugagaaaaaugggauauaaagcauuuuggagagaaaagucuuuuggcagacauuugaaaaugccuacaguggcuuucucucuguugguaauugaauugauuuaaauguguuuuucuuuuuccuuacuuguguaauuuuuucacaacaaaaauuucuuauguaacaaaacaacaacagaaggggacaagcuaaacucuuugcggaguaggggugguuacuccauauacagcggaucauuucugucuggggccaaacacagaaccuggcucauagcaggcauucaauaaacaggggaaaggagaggugcucaauacucaagggcccaaguaguccaucagcuugcugccuaccccuccaucuguggggaaggagcagcgguagggaucagagugucgacugaaugggggauaaaugccugcccacugcauugcuucaguucuuucccugacagaucccaugcaucccaggaagccuguuccucugcuugguucagcucuggccccaagacauucuugagacauggugcgaugaucucuauacccauacacuagcauuguagugugggcccugggcuguaaaagagaaacaggcaauaccagaccuagcucagagagggugucuaggugaggggccgaucuagcccagucaugucugaggucccguuagagcugucucuggaugcauaaaugucugcuaugugaacagccccucagccuuaucccacaugaccccagggccugguacuagauccaauggcuagaggaugcauagagaaaggaugguggcucaggauaagaaugagcuuaacaugcagaaaguaagaucaggucaucccccaacuuauagccucuaaugccuucccagcacaccuacaaaaccaauccagggccaucuuggggaggucaccucaaucuuugccacagaaaaccuggcagggcucuaggcccaggagugcggauguggaggacauuguuccgaggccaucugguguacauucuucucuuuccugccaccugagcugcugccacugcccccugaccccaaggaacuuuccuacaagguuugcccaacccuggcuuucaacuuucaaaucacugcaaacuaggauugccugugagcaaagaccaggacuugcagcugcuagagcaggaggcauggcuuuuagcaucacagaugauuccgaggaaccguuaagagcuauaaaagaaaacucuguaaagaacguggcaugauucaaauguaugguuauuuuuauuuugucauccuuuaaaccagggcuguccaauagaaauauaaugcaauccacauauguaauuuaaaaauuucuaguaggcacauaaauaguuuuuuuuuaauguacaaaauaaauccagacuucucauccuggcuugcacagccccaugucaaccugggcccuaccuaccucuccaggcuccccucagacccugcccaucuucuacuaucuuccagccauauaggccucuuuuggccccaugaacucaucaagcucauucccaccuuagggucuuuauccagcugcuuuuuuuuuuuaacugucucauauuuccuguugauguuuuguuuauugucccccucacuaaaauucaggcucccuaacaguaggaugcuuauuucuugguaugguugaaugaaugaaugaauucauuuggaaugaacugaauaaaugaauaaggaacaggugaacuagauaggguuguucugaagugaguggacuauccagaaauggcuacugagucacacaagguucucacuagauggagugggcucccugugaucugaaaugcgguccuguguuuuccauugguggccggcgauuacuuuggagcucucaguuccucaggcccucugaauuagggccaugccuacuguuucugggagcagucucuaugcaacacaucccccuagcccaucaccaucaccacuaagcaguggccacaggcucagugcauaauacagcacuggaacucaugucaggaaccaaggugguagaguaaccccugcuuccucccaccagcggccaccgccaucccccaccaucuuguugggagggaaguggcucaugaugguggagacaggcaguucccuugucucugaguugcaagaaaagucaacacacuccaagugagguaaggggaaacuuuagcaccugauaagagcucucuguguuguguccccaguucauaagaaaggagaagggacuaguuggaggucaucacuugaccaagagguuagaucaucaccaggugucaacccaaucuuagcacaaagccaccugugcauauguguucaguuuguaaccagucauugagcuauauacacuuauaauaugugcacuuuccugaauguauguuacauuuccaaaaauaaaggaacacaccugaagagcccuuuagaacccacaacccgaacccacacucacagcuucugcuucagaaugccuaggauaugucccagguaccugacuuguaaagcuucccaugugauuccgauuagcauccaggguuaagaccuaacauaagcaaugacuggggacuccagagcagaugcaggagggagggagguggguaagggaaggaagauaaagcaggauuucagucacacuuagaauaaugaaguuccaaaaaguccaacagauuguuagauugaugcacauagaaucucugggugccaaaaaaaaaaaaaaaaagaaagaaagaaagaaagaaaagaaaagaaaaagacgaagaagaagaaccagcaauauaaaaaaagcagguaacugaggggaaaaaacuuuguagcaaaagguuaauagccuuaauauuuauaaaaaguucuuacaaaucacuaggaugagcacucgauaggaaaacagacugcaugcaugaacaggcaauucaaaaagaagaaauacaaugggccaauacacucaugaaaaauguucagccucaucaguaaucaaauaaaugcaaauuaaaaugacaaagagacguuaucuuuugccuagcuaauuggcaaagauuaaagacaugauaauaccucguguuggugaguguguggaaaaaacaggcacugucauucacuggggggagcgcaaauuggugcaaccuuuccaaagggcaauuuggcaauguacaaagcugagaaagauugcauaccuucugacgcagcaauuccacuuuuaggaagaucgccuuaggaaauaauugugaauaauaauaauaauagcuaaccuuuguuaaaugcucucuaugugccaggcucuacaugcauugucucauauaauccucacagccaucaucccaagagguaagagcuauuauuuaucuccuguauuuuacagcuguggaaguugaggcgcaaacgaaugaaguuaauucuuggacacaaaucuaacaaguagcaaagucuggauugaaagccagacagccugagucuagagccauccucccccauacagcaguauacauggggugugugcaaagauaaagcugcaaggauguucuuuugggguuguuuguaaugggaagggggagggggcaugcuaaauguuccacacaggaaucaguuacauaaguuaugauacacccauacaggaacauuaugcaaccaugaaaaaugaugcuguaagaaaaacugagugugugaauacucgggggugcgggauuuguauaugcauaaaauauuucugaaaggaggucaaaggaacccauaagauugauuaucuccuagaaagacaacugugugguuguggccagaaguuagagagagacuuguuuuuuaauccauauaccucuuuucacuucuugaauuuugaaucauguuaauaucugucaaaauauauguuuauauauauauauucaauggaaucauuguugaaauauauauauacacaaacaaauacacauauaagucauagaauuuguuccacauaacuuucauuuccuugaaaugcuaccaagaguuccaagaaaaaagguuucaaggcccccacuuagagaacgauacugaaguugauagauacuucuuuaacuaugcuuaacccacaugcucuccaaacccauuuucccauggaacccucuugucaaguaauaucuguuuucaucucuccagauacuccugcuuauagaauacacuuugggaaaugcuauuauuaauauuuaacacccaggcgaaaggguuacacuguuucauuaaaugaaagaauacauagagccuggcacauagagagcauuuaacaaagguuagcuauuauuguuauuauuauccacaaauggcauugauuccauuuuguuuaaaaauggggggagguguuauuuaugaguauggagacaaaggaagguuuuguuuucuucuuuuuucacuccucuguauuuuuucauuuucuaaaaugaacaaaauuauuuuacgagaaucauuguguaagccuacgucauacauuuuuaaagucuuccuuucugugcuuccucugugcccugugccccucucaucuacucccugcguauaugcagcagcucagggugaaguucaaugaggggaccccuguucuagccaggcccucuugccugccuuucuccagagccagcucuggcccauugucagcacucugaguugcuagggaaaggaccaauggccgagacagggccaaucaguucccagacaacucccuggcuccaacagacccucccuucugcuacuggaaggcuuuuaaccaucucacagagagaaauaagaccacaaaaucagacaccauccugcuaccagccuaacacguggcaaaucuugauaccugagcuuuggucccagcucuguggcugccuggcuauguggcuucaggcaaguuucuucaccucucugagucucaucugcaccaucagugucaguaugacacugccucacagaggucagggaccaaacgagagccugcaugaaggcuuuguguauccuguaagggacuaucccacuggaaauuguuauacaccucagcacgagcacuggcuuagccucaucuuccugagaagagaguacuuucucuuucaggguguguguguguguguguguguguuguuuuguuuuguauuuuggugguggggagaggagcaaggaagugaagcaugggagacuggggcaugcggaaauagaauggcguuuaagaaaaauggggacagccucucagcuuggcauuugcagcuuugcauccgugauugggccugagcccaccaguacagccccauggcuuguuacccaugauuuuagauccugagcacugaugucaaggagaucuguguuugaaucccaguuccaucaucugcccuuagggaagugacuucaccauuccgagccucuguuuccccaucuguaaguggguuuaaccauugcugugagcucaugggguuacugugaagguuucauaagcuaauguaaagcuucauaccauucaaggcaugaaggaaacucuccauaaguuauaacuacauugaugucaucacagacucauuauaaaugcuuauugaauugaacuaggaaaugacacuaggagggguggcucucaggaucacccuucccuuccccaguuccagcccaaagacaguggcccuuacucuccacuacucaugcuuggcacugccccuaccaccaccgugcucaccuaccugccuuguaacccacagccacccggcccaaguugaagaagaugaagagccagacgggacaggugggugagaagcaaucgcugaagugugaggcagcagccgguaauccccagccuuccuaccguugguucaaggauggcaaggagcucaaccgcagccgagacauucgcaucaaauauggcaacggcagguaagcaauauccagccuguccuccauccaagcagcugcccucccuccucucgagaaggaguggccugaacugggcagaggccagggcugugcccccagacucacccauggaaccagucccagccccucuccauacuccccuuccuugccacucccagccuucuuccugcagcucggggacccucuggucaugguggcccagggucuugcagaccacagacaagaauuaagccuuuaacuucucuggauaguugaaggcaauuugacugucacagucagcuugaucaguggaagacccugcucaucucuaaaacuucuugaaaaaccugcuguagcgucugaaagccccaacauuuggcaaucuuuggugaaagacccugacuccagaaugccucugggaggucacacaugaugggcugguuucucagcuuagcaagcugucaguugucagagagcuagguaagggaaaagggagcaacacuuugauugguguuggagaacucuguuccucagacgguuucccccuaaaaguugagaauugucuuuaauccugaaucagugcuccagggaagugaaucagagaaguucccugagucucuaggcuaugggagauggccugucuuccaucuuggcugggucaggcagggggcuucuggcaccagagaagccgcuaguccaaggcagcccaccaccucucugcugccucucaaggagaagcaagggggaaaaccccugccugccagcuaaacaggcauucuaccugaugucugcucuguuggcuccggggaccuaguggccuucccucucugacugaggagcucccaaaccuuuucuacccucccucccagaguagcuuacaaccacuccuuuccuggcugucauuuuccuccucaccgccccaccacacacacaaaaugcaaauuaggaugguuuuagagcacaccagccugcccacaacaaaaagugguagaaggccagggcugggcaggcugcuuggguuugccauguggggcuggauguccaugcccugccucuggcccucagacucuggaaccuguaaaagagguuaaaggagucaggggacugggaguuacuuccaguucucugauucuccuuccaagaauggggagcagaaguaaaacugaucacucaagaaaaugauccuggcagaaaacagaauguaauuaaggaagaguuuggcuuagaucaaagguuuguggcugaaagaaugccgcuuccuaaggaacuugccauggccaguggcgagugggggguucuauaugucccuugucuacagcauuggcaagaagcucuggcugcccacccagcccaccuuccgagaccaccccaccccuucucacugcccuaccaaggcugcuuccaagcuggagagaaugggcaggcuucuuggagcuggggcaguugggucccgucucccuccuauccuuucuuucuagaagaugguuucuccccuacuucacugcagugacgaaagucaggagagccccccuuucccuccucauggcucccaaacaugucuacaaccugccuaucaucaucccacccuaccuggugccacacacucauacucacccucccucccgcacauucccccccaccacacacacacacccacagagcccugguaccaccaacucacuccuuucucugguaacuucagcuuucucucccuaccaacaaacccacgcccgugacuuuuuuucucaaaugcugucccuccacgcugcugcuccccuggcccuccagcgguugccccaucucacuuccgcccuccaccaccauaugaagucacugagggagcuagccucaugcccacugacugcgcacucucguccuccacucacucuuugaccugcuggaaucugcccuucaguuacaucccaaccucucgauggcugugguccuggagaaaccgcaguuaucuuugcacuuccuggcucaggccuccaggccucucagcggccucggccugggaauaccugcuccccgggcccuguggugcuccuccuagucuugcugugagucuggacacugucucuuaguugccaucaaugcuggaacuuuccugagcuuugggccucacuauuuucuuuccucccuuuccgccugugggugauuucaccuucuccuguugcuuuaagaaucugagaccccaagucuccauauccagacacaauggcuuuuuuaccugagcuccagacccaugcugccagagagacacuagauaccacaccugagaugccucacagacauuucugauucugaaggcccaaucuggccucuccccugccugcuguaguccuuucucucccucauguguuccccucucaacuguggcucaaccagacucucugcugcucaaccccugacccuuugucgucugcccagggggucgugccucuuucccuccuccugcacauuucuuaucuggccucccugccucgagccuuccuccucugucccacucuuggccacuccccaccuuuucuggaccacaggccccucugagaauucauuucugaaucuaaaauaucuguauugaguaucaacuaugugccaggcacucugcuagaggcucaagauaugucagugaacaaaacaaaacuuaccuucaugagucucuagucuagcuucuacuauagaaucugguagacaccuuguccuuuucuucaggaaaaaaaaauguggcuuauguacccaguuuguuuguaauucuagagguccacagagucacugacccccaugagugucugacgggaaaugaucuuucuaacaggaacauguauucaaucauccauucaagacagagcuugagagccuacugcaugccagguacagccuuggggcucuuccgacuccucuuccuggccuacaagucacugccaugcaguuuccucacacugccacacucucggccgcuggucuuuccuuucauggcucuggacuugggcccaggcuguucccuaugcuggcagcccuccuccccucacuugucccuggcaaggcucuccaaggcccagcuuaacugucuucucucugggacaccuuccuaagcccucuaggcagcucucauugucuccucccauggugccuuagacauggcuucauugcuuuguagagggaucugucucuccuuccagcaugagagagccucaaagccuggaucccuguacccagauacccccuucuccgcuauagaaccugacagagagcucuacacugagggcugaacugacgagaaucuugcaggacuagcccuccucuccuggguguagagucccacugagacugggcaugagaccuuuuggaugguucuagccuucugaaccaguuacuguccugguuaagccucaguuucaucuaaagaauccagaaacagggacuggucuucuccuccuggguauuauggaccccuaagagucuaaagugugcccccugcucccuaccuuucagggcccugccccauuugcugcaucuggaaacuucccuguucucccuguucugccccugggcucucagcagugaguugucagugguggaggagugggccaucauagagaacuucugacucccugcgaccaaggcgcccucggagugacuuagagagaacggccaccugcacaccuacccauccuacacuacacaucucaccuaguagaggggccaggggcaguggcaggagucugcuuucuggcaaaauguucucugucuugucugcccacacaacagcuggcuccccuaccuccuagcacucucccugcccgggccgcacucugucugggcaucucuguugaccuguagagaccccuccucagagggugcugucugucuuugugcccacugcacugaaacaucucacccaagccuuccugugccaggagcaaacugcccccccaaauccugggcacggggccuucccugcagaaucgcauguucccuuguuuaugaggggcaggcuggaacaggccccuugagcaggcagggggcggggggcggggguaggcgcugaggaaaauguggaggacacagcugcccagauccugucccugccagcagagaaccagcuggggagguaggggggaggggggagggcguggucaccaucucagggcaaacuugggucagcaugugaugggacaccaggagcagagcacagcacgcggccugccagggagacaggagaguccuggauccucaggcuuccaccuggagcugggagugaggagggagaagguggugacuccaguuccugcaggggcugagaaacccucagagcccugccccuuagccaggacccagagccccgugugcaucucuggggccggcuucuaugaaaucaucagacagcugcuaaccuaggacaucugcagcaagccucagggucauuaucucuguccccugccucuuucuuguuccucagaaggaaggggcacuccuagagaccugugccugccuucuccaggucucacaugccugcauguggggaauccuuccuuaacauucugccacguccugcuacauaugaugcuguauaagggaagcgccucugaauuccaggggggugacaaggagaaucuggcucugaguccccugugcaucaacacccccacccccggacccucaggcgaucccccuucccugcuaaucuggugugugcacagggaagugagagaagccauacccugggcaagcuggaguuuguggcaucuaauuuggcuggagcagggaaagagaugcugucuuagucagaggggccuccagggcucucuuuaaugaagggaacaaauuauaauugacagaagaggguugugggccggcaccaggccaaggagacagagaccagcuugagccaggaagaauaugguauaguuaagcagcugucaccacagcaucagcaaggacauuaccauagcaauagggucuauagacaagaccaucuuguagcacccuuguugggaggaccuugggguaaggaugccaggaugccugggaagaggcuccccaucagagguggagacagcccagguagggauugugggccaguuugcgucuccuugacccuggcccagccuaucugcuugccucuccucagccuccuuaccccaucagcuccauagcucaguuuuacauccccuaggcucagggcaaugauggcucuacugcccucccucguauucccccaucucuccagcccacuacacauaggcuggaaaucuggcuuuuuaauucagcacuaaaaagaggaggugaucauaccaugugcagaaauuaccguguuacuucuugcuuccuccugggggccagccugggaucccaggcuuuauccagagcucaugcuggcccuuggaggcagaggaaggggugagggcugugaacaggcccuugcagagccuaagcacccugggguaggugcagggaaacucugagaaggaaggagagguuuggcuggggcuucagaaagaagagggggaccaaggccaggugcccuacacaguucucagcaugcagggacuaggugcaaagcuucagggcuagccccagcuuuucucagagauagcccacguccucaugaacugcagcuccuggcauaccucugccuuugccuugccgagugcccuugggcaagucaggaagucccucuaggacucaguuuucccuucuguaagcagagaacacccaguuuggcccugaggaucaaguccaggaucuuuuuguuccccaagguguacaagcuccuggcacacaggaagugcucaguaaacauuuguugaaugaaugaaugaaacaaaaaccccuuggagaagccacagagugccccuuaguggcagcgcugauuuugagaacaagggagagccccagguuuggacuaggagucugggcaccaucaccaugggaauccgucaggacagcugcccucccggguaucugggaacaggucuugcauacccagaaugacagguugccacuucccaggagaggcagaggcagcugggaaugagggagguggccaugugacuuccuacagggccuggcuuuacucccccagaagaauguuacaaugguccagcccuagaagagcggaugugagggaucauagauuuaggacaugugagcagccacuaguccugcccuguguuguccuaagggcccaaggcucccugcagcugcagggacuccgugccccaccuggacuccagaaauugcuggggggagggaaucuccuucccaucuaagcugcagggccacuguggcucuguggagagaggcaaccgcugggugacugcuggggagccacagccggcccuggcucacgccucucccccuuuuauccccucccuaaccagaaagaacucacgacuacaguucaacaaggugaagguggaggacgcuggggaguaugucugcgaggccgagaacauccuggggaaggacaccguccggggccggcuuuacgucaacagcgguaggugggcccagacagagggaaggguccuagagggguuuggcagggcgggccaguggccccccagcccuuggggccugcaugugauccaucucgcacucaacuccccucccuccugcugcugccauaucaagcccuagaucucagccgauucagagaaaugcagucgaagcauaaauguuuagcuuuguuaucugggccuggaagagccgccagcucucauuuuaaauacccugaaaacuaaauauuuugaaaucaagagguggggguggggaaaggauauuuuuagaaggcaauuauaggaggcugggcugccaggaguggggcugcagggagaggcaggccuggggcauguacaagcugacugccuauugccuguugcuuugcugggcaccugagcacaggcagccaucuccacugggccaugggugggcagcuuggaugccuggggccccugguggcagccucuguucagggagggcaaacuccuccccgacaggccauccucacuccuugaagucuugcaaggucaggaccucacggcaccucuuaccuucucgucucuacaguggcagacccagccucaggguagaggcugccuuccugcugcacugcccucucaggcccugguucuuucccuugacugggagauugccucuccgccaaaacuaccuguccucaggcagugcccucuccacucuagcuugaguaccuuaaaucccacagaucacucuccuccccccaacacacacagacugagugugcauguggcuaccuauuuauugggguucacuuccaguccugcucaucacagaauauaauccuguaucugucauuaccugccucuauuuccaccagacagccucccaauaugcccuaaaccuagcauggucuaaaagacuacuuggaacacucucugcccuaugacccucagacaaaaaccuaguucagacccugucuuccuguccuggugagggacaccccguccucccagccccuugugcuccuuggucucccuugccacugugucuaauaagucugagucuccauguccuugccagucuucuuucuggaucuuucucacaccugccucuucugcucuaacuauaccucaaggguaacccuggcuuggguuucaucccuagucaccugaaccagagcagcagccuccuaaggugcuuuuauccugucauguuccccaccccauagaacuacagaacagggacuuuguucucaacacccuggccuaaaugaucuuuccagccuaacuuccaucagucccuuguccauuccauucuuacucuugcuccugugccauccugacucauaggaugggucaagacaguuucucucacuauguguuggccucauucuuuccuacuguaaaaugggccucucccauguucggagaguggggugggaagaggaggccauggcuucaucucuuccuccuugaccaucccaacccacugcagcgucucucccagcuagggcuccacuccugggccacuccuuggccaaccaugcucugauggcaucucuugaauucuagccuuugauuagccuucaacucucaugcuauugcugaacuuucucugugggcguggccaucccagugaaucugugagccucaggagaggggagaacagggaggaugcuuucuccuggaaguuacaaucauagccaguauuuauugagccaagcuccacauuaucccaugaacccauacucaaagccaggauauauuuuauaaacaauaagaagcucagggagauuaaauauuucaccugaagucaaacaccuaguuaaugauagagcuguacgauguaaaaguaguuggcaaacacuuagucuuugagcucuguggggcuaugucuagucugucuaccacccuagccucagggucuagcacagcaccuggcucacagugggugccugguaaauauuauauaagagaacuuauaaccugcuccaaggucuuuacugccuccucuauggcccagccugggcaugacagcagggagggugucugagcuccuacuucucucauccuaucccaaguuugggaaggugggcugugucuggggucuagcaccugccaccucugcuguaguggucagacauucucagauccacuuuggauuuggggccuuccuauuuuauuagucaagacuuucuugacuagaauuaacuuaagccuaucuuaagggauuuauuuauuggcuuauaaaacugguaaguucagagguggaacuggccccaggcaugacagaaucuaagaacucagaggaagaguccaagaacucauaggauggcucaagacaguuucucucacuauguguuggccucauucuuuccuacuguaaaaugggccucucucauguuuggggaguggggugggaagaggaggccauggucucagacagguccagaucuaccccaucccagcccaccacccggagaaaagagauggcuuugucucuguguccauaaguacagucacaaggauggauucugaaugacccugccaggucaugugacccacuugaccagucacugugcuuggaggguggggccaucuuugccuggccugucugugugugcacaggggcuacugagaggcagggcacugugagugaaggccuggucagaacuccauggaaaagcacuuccccgaaggggugcuguuagcagagaaagugggagcggcugcugugcagaaaaccacaggagugcccucucucuugcacagggcuuggggccuguggccagagguggugagaccccucagauaagcugcaguccccucccacacacggauuacugucagcccuccguaggccaugcugugaucaguuuaggaaccagaccguggcaccuuugggcagggcacugagggcauaucuggaaucccagcuuccugcagccuucuugccucuugacccuccagggcagcggcagggcagagcaggggaaagaguuuggagauuuggucucguccaagcuuuacaucaugcaacccugaguaagucacuucaccccaccagucuuugguuuucccguuguggggcugaacuagaugaucuuuaagcccccuucccucuaaaauucggggauucugaguuugaugcugaggcugacauccugugcaccuaaccaguacgcacacacacaaacacauaccacaccacuucugcuaccaugugcaguccauggcaggcaagagccuacccuugaacaggugaacagggccacugcuggggaccaggaggccccugcuggggauguuuucccaggcagagaugcccaggcuccuuguuuauccacagaacccaugagaccugcagcaaccacacccuguggucugcccccucugacucaucccaagguggguugguuuggcccgcccaggccgaagggaaaccagggcuacagggauagggcagcuagaagaggguacagggaggucauuggggagcagcaggcugcucggguggcaucacuuuggcucuugaguggcuacugcucuguucagguggagcccagggcuccuuccacaaauuagaguaggccuuccuuauagucagagcucugccagcucacaagaggcuccugccuuccugaacuggcgggcaggaggagucggcaggaaguuugcggugcuaacacaauagcuugguccaacccacuucugaguuagagaaacagaugucucaucccaggugaaagggaguuugggaauguccugagguggcuguaccagccccugaugucaggcuuugccccagaggacaggcagguuugaccuggggugucauaggaccauggaagcccuggagaggccucugggccagucucuuaccuggagucuugcaaaagcuggcuguuuaaacacacacacacacacacacacacacacacacacacacagaugcacauucaugucagucacgcauucagaagcgcuuauucaacaagaucuugcucugagcucugggaagucgcagucuuggcccccaagaaagucccucaaauggcaggaaacuaaaacccgaacucuaaaaggucugccuuuucuaacaaacugagaggaagguaggcaauuuaucaaagggaaaggggccucgauggauaaaggagcacucgaccugagucuugaaggacaagcagaaguuuucuccaugagcaaaggugaaaagcagcugcacuugugggcagucggggacgcagcuccacagcagcggcucccaccccgccacugucacucuucaggggcccugauaaacucacaccaagacacuaacgguucaucaaaacuuccugggcuuacuccucccgggugcuuuuuuaaauuaauuuuugagauauaauuuauauaccauaaaauucacccuuuuaaaguauacaauucagugguuuuuaguauauucacaagguuauauaacuaucaccacuaauuuuaggacauuuuugucaccccaaaaagaaaccccaugcccuuuagcagccacucccauuucucccccucuccagccccggcaaccacuaauucuggacauuucauacaaauagaaucauacaauauguggccuuuugugacugucuucuuauacuuaacauaauguuuucaagguucauccguguuguagcauggaucaguacuccauuccuuuuuauggcuaaauacuauuucacuguauagacauaccacauuuuauuuauccacucauaaguuuggauucuugggucauuuggauucuugggucauuuggauuguuuccacauuuuggcuguuauuaauaaugcugcuguggacaucugggcacaaguuuuugugugagcauagguuuucaaucucuuggggauacaccuaggaguggaauuucuggagcacaucaugaccauauuuaauuuuuaaaggaacucccagacugcuuuccaaagcagcuacacuauuuuacauucccaccagcaaugcauacggcuuccaauuucuccacauccucaccaccacauguuauuauccuucuuuuugauucuggccauccuagugaaagugguaucucagagugugugcguauguguauguuuuauagagauggggucuugcuacauugcccaggcuggucuugaacuccuggucucaagugaucuuccugccuuggucucccaaaagugcuaggauuacgggggugagccagccauuggcuuggucucauuguggcuuugauuuucauuccccuaaugaccuuuuuggaauguuugcauuuaaaggagacaguccuuuaaucuaccaaaaagaugauauuaucagccaaggauaccagacuagucccugggaugguagcacagggcacuuuuuucccccaaagaauaagauauuuauuuucucauucauucauucaguaaauauuuguuaagcaccuguuaugugccaggcaccaugcuggacauugggguucaggguaaacaugucagacauggcuccugcccuaauggagcuuacauucuagugaagaaacuaagcauuaaacagcaaacaguuggcugggcacgguggcacaagccuguaauccuagcauuuugugaggcugaggcaggcagaucaugaggucaggagaucgagaccauccuggccaacauggugaaaccccaucucuacuaaaaaauacaaaaauuagcugggcaugguggcacaugccuguaaucccagcuacuugggaggcugaggcaggagaauugcuugaacccgggaggcagagguugcagugagcugagaucuuaccauugcacuccagccugggcaacagagcaagacucugucuuggggaaaaaagaaagcaaacaguugcacacuuagucauguaauuaugcuagaauagcuauaaguagaaguauaugaagcuaagcgagggaauaagggaggagccugaccagcuuaagaagucaggugaggccucccugagacacuuguuguauuuugaacauccugggcaggagacuacuuggcuuauuaaaggagcagaacuaugaccagcauagucugaaauauacugaaggagaaagaugggagaugaagugggagagguggugaagcccagauaagaccugggaagaaguugggggcuuuauucugagugcaaauggaagccacuggagagcuuugguaauagaaaagauugauacaauuuacauauuuuaaagaccacuguggcugcugcaaaguaaaggagaugaaggcaagagugaaggcagaaagaccagagaggaagcuauuguggccaucaaagaaagagacaaugguggccuggacuaggggaggagguagcaagacauggauggagucucuugaggaaguggaaauggcaacccuuggugacagauggcuauaggggaauaaaggaggaugaaaucaaagaugcccucuaggacuuugguuugugccauuuggucacggagauaggaaagacuggggaagaagguggguagggcagauggugcagagcacaguuuuggacuuguugaguuuggggugcugugagccauccucguggagguguaaagggagaguccacgucaccuucacuucuccaaacacgggcaaccauagugagagauauggauacgcugacagggguguauagacacguugccucaggagcccacgcgugcuagaacaguguaacugcgcuacagcgugagcgcagcucuuccguguggaaaucucccuggaguauggcuuugccacuggcagaguugggcugcaguaucuugggaaggcccugccauuacagaggaguggccuuucugagauggaaacacccguggucacucuuuccccacacccucugugacuggcuccccaaaugucuucccuuuuuaccuucccggggucccagccucguccccaugacaacaugauacuggcagcgcaggcucaaugcauucggcuggggaggccccaucuuuccucaggaguuguccuuagccucccaaagccucgaugagcacagacauauaugugagaagcccaagugugcaacuguggccccggccaacccagcauccucccugcuguccacugcucacucgacuggggugaaacaaugggcacagcagugggcagucugugccacccgcaacugcagaggacaccaggcugggccuggcagauccaggcugagauuucucuggcuuagccaacacccacaggagggcccaggccugcaguccucacugcgcuugcauucgucugcuuuugucaagccugggugcugauggggaggauguacagccaggggcuaggagcccugaggcucuguugcaacacacacugcacucuggccagacacuucgcugccuucucucucuccacucuccugugugauguaaaugaagggcaggacaaccucgaggguucucccagcaaggggauuuuacaaguggcaggcgugguaccucagcugcuucucuucucugucccuuucuuaguucccugggucucacugacccagaaguggggcaaagaucagcaggaggucucuaguuccagccagcacguggguuccagcugggucugggguugagccgaggagggagaccucagcagggguggggcuccgggaugccagcucagcagcaggcaugauguggaggggauggugaagccggcccugcccgcuggauuuuaucagcaugcuccucagacauauacagaagcagagcuguguauacacucccagcccccugugcuccauccgucuccccacaugucuaaacacugagggugccgacugccugcccuccuccuccuccucucacuuccaccccuauuacugaggggaguggagagacccaguaccccugaggagacagggccagcugggguagcuugggccaccucauucaggaggccacugcugggcugggugggaacgagaggcccucagaggcccugggagcugaggggagcaggaccugcuucuggcuguccaguccggauuggauggggcauuaucuaaaacugauguuuggggcgagaauguucacuugaagcuagcuuucuggaugccauucccugaugaggagcagagcuucagugauguucauuucucaaaugaguccagucaaucggacgugcagucugugcuagaagccuuaaggcccagccuugcucucccccaguuuugcaccccagcugcccccuucccuuucccuggcccugucuccuccccaacaacuugaaacccgugauuuauggcuggggcuguccgagaccuggaggcucccucuaggggcaacagcugauaaggucagggaggagggggcugucugggguggggagauauggagaagaccccagaugcuuauggagauggggcauaguagccuuugaagcauuccuggagcuagcccagaccuuggagaaugggggaagagagcagaagcuaggguuccuccuacccccaacaucucuccagaucuuagaaaaugaccguguccuaaaggugccauccccugaaggcccagcucccuuccagccacucccugguccaccaugagagcccaagccaugcaggcggguguaggugucucuuuccugcaccgccuccugcguuuguuccccacaugagacaucagcauuucaaccacuugcaggggagcccccggaaagccaggcagggaaggggagaggugggcccuuauucagcagaggaagcaguuccugcugucuucucacccugcuccccccacaaaagaaugaaaaucuuccuggccuuuggaaguuugccuagagcuugggugcaagguugcacuggguaaacgggcagagcucaugguggccucuccuuugccuuauuugugacuagaagggaccaccagaccuccccuccccagucauuccugcagccucuggucaucuuccaguuuugacguggggcaugaaggagaugauuccuggggccuagggauagucucagugcgucacuggcacaugucucucauacccucagugagcaccacccugucauccuggucggggcacgcccggaagugcaacgagacagccaaguccuauugcgucaauggaggcgucugcuacuacaucgagggcaucaaccagcucuccugcaaguaagugaccaguaggggugggcaugggagcaagaacaggguaggagaugcugggucagaaguggagggcucuaggaaaagaggguuccaagccacugacaagagguccccaagggguguagacaggaagcuuugcccuacuuccuagcccuuuccuggaauauaaggagauauaagcucuaaggggcacaggggcuugugcaguccccauuucccaggccccuacccaccccaucuccugaugucuacccuuucaccaacacccuuuagggagauggggaugcuagucuaugcccuaggcacugggcacuggguuucucuuucucucucucucugccucccucagucucucuuucccccccucuuuuccuccccaucucucagcaacucuccaaacuuuguucuuaaugaacauuucccaggcugcaucuuccccaauagcgaggagccuggcagggccaggcagagcacagguuccagagcccuuugcuccuguagucuugaggggagaagaggggucugcccagaacccaguacugaccucaggaucuggcugcccuucugcccuacaggaccccauuguacaaagaugccaucccugggugcugccugugucccuucagccccuagcccccacuccaugggaugaggggauaccagcaaggacacuacucuagguauggcccaaugggggaggucaggguggaggagaggcucaggcuggggccucucagccuccccaggggccagagccugcucaccagccaggcaggguggccccagcaggaacuccaaggagcucagaaccacccacuccccauagcaaacaaggcaggugggagagaggcugucagggagggcucguucaggcccagccagaucuucugggcagcugggccuacagugcccccuggacagauucucuggugagugugugaggaggggaggggagcuuggugagggcagcauaggcuccagacagaucuaggagaggagugggaggggggccuaguuaauaacuucaguguuucaaagcagcccaagccuagagcccuggcaaguugcuaaagcugccccauucccauggcaucugggcaaaggccaccaaaacauugauggggauucagagagagauguuugaccuucccccaggcaaggucagacucaacacuucucagcuccccugccucugaucucccgcucuagauccacagcccccuuccugggcacacccuugcccgggaaugugagccuggucugagaaggccaggacuuuucaagaccccuccaccuaacaacaugguaacgaggggcucuugccccggcuggccuccucagcuggcuuccucccuggccccacccugccccugcugccaccuccuucucccccucccugaaccuuagaggagagucccaguagcaacaacaggcccucuagggaaguucucaacccaaacucagccccucauccuuccccgccuccugccucuaggaggcugccauguuaguaugacagacccuagggaacauucuagcugugaaacuugcucagaguucuuuggaacagaucuacuagaaauucaucaggguccuggaauaccucacagggaugacccagcccugcauccccauuuccuugucuccugcacccuccuccucccugugacauacacacuagguaggucucuccucuucccuagccccuuggaccccagacuuugaagggauccagcacugucacugaagucagcccucguccgggcagggaagguucuggccccucaggacaggugccagggcugaggagggccaugggggccagggcuccagugcuagaguucggugugggcaagggaguggugagauaugugggcuccaggagggcccugccagcaagguugcaccccuaggaccucugaguccugcccagcuaaaucugagaggagcagaggcaggagccugagccauugugaagauggugcccuguucccuuucccaccagggcaccugggcugcacugcuuagaacuugguacccagagccaccacuuccccaucucagccuccccugguuccagccaagguuccuggaaccaacuuccccaacacccuuugucagcccucgggggagagggcagcccugguggagaugcggucagaacaccagguccucagagcugugcuggagaagggcagggggguggggggcagggcagagcccagaggccauucugcggguggacgagcugggagggaaggugggcaggccucuugggguuccugaugacaccugaauggaauaaaaaggaaagaacuuaggaaacggaacucacgucuuaccauuugugcuguuuguuuacuuuuuauuuugauuuuuuugcauuuccgcuuagcuuggauaaugaaacuacacuggucaguuucauuccaguuucuauaaaaaucaguuuuccuuccugguuuucuuacacuuguuguuguguauugguucagagcccugcagggaguguuggaaagcaggcacacuccgucccuccuguuuuucuggaauucagugccaaaagaaacagugucacugauacugaauuuuguuuuaaaaaaagacaacguagggggauuugaaaaugggaguccaaaucaaggugacuguccccugucugggccagacaggggccucugcacucccucuugcugcuuucuccucuucucuccguguguuuguagagcacgguuggugcgugacucuuggggacugguucaggggaugaugacagaacaagacucuuuccagcccugugcacauaccaguggcaugccuccccuucccaucagcucaucccccucaucccucugccccuaccccacccauguccaggugauuccccaucccaccuccaucugccugcucauccucgccacaucuucaccccucucaugaacucagaggcccuucacucccuccagugcccggggcacaccgccauccuucauccacccccucccccgggugagggcagcacacauggcauuauccccaggcuaccaaaaggagaaacugaggcccgggagguggggugggaaaaggggaaggcagagguccugaccucucugucaccccagaugcagcccgugggcucuccucucugccccucucucacccugcucuucuccagcccuggggacagaccuuccccagagucauaacugaugaccuggugggaaaggcugggaaggcuguuacccgcugcuccuucuaaucuguccucugugcccccugaaaaucagagggucaaucccaguuucaguggaaaccaccaaccaccacccagcccccaaugcugaguucagacucccaaccugguugauaggcuaauguaccccauacucucuuacccugguauuaggugcagguuagagaggcuauaggcccagcucacccccaaagccuucucuagggaagccccagucuccugaaugugacucauccucagcaaacaggacuaaggagagacauaggaguguccaggaggucccugaaggagcuagcaccccaaagaacagcaguagcugucagccuuccaccacccccacugugccccuccccagugccuuuuguuuuguucagccagcggggagcacauuuucucaaggaaggaagguuaggaccauaauguugugcaacucagcggccaugaaagauguaagucuguagucaggauaguccaggcugggugugagauaagggccacagggauguauggaguuaucauuguuaucauuguucuccaagggucuugggacagcagcccugcuugucagcaauggaaauaaauuuccccuugccccuccugccccuguacucccccauuuucucucucucucugucacacacacacacacacacacacacacacacacacucauacacacacacacacacacacacacacacacacacagguuucccuuccuccaagagcugggcugaucucagacauuggacacagacacaucugucucuuucuuguuccuuuguggaauccaagagucauuuggcaacuuccugggucuucauccuccacucccaaaggcacuuauguuugaaaaucacuucucccucucuaguccccaucacaaguggacaucaguuuccaagagcuaaggaagaagagcuugagcugguugggaagccuuagccacuaccuccauuuaccugagcugggaugaauagggacgagggccagggaucagagaaggauguguugacaagggggcugauggcagucuccuccuccaaaccacccuguucaguaagacgaccauguacccucuucccacccaugccacuucccugauacacuucccagcccuccaccaccccccaauuagccaggcauacccacacacacacuccuaccacuacaggacaaaccuccugccuccccugggggagaugccaucaaggcccagagaaacucuagcccucugcucaacuaccacucccauuccccacuccuccagauuugaggucacaggguguucaugaguaucugucacaaccaauggcugccacuuacuguaagccuaaguggcuuccugacaguugcuauauacugcaaugcuaagaaauagaguacacuugccucuugaggaaguuuacauugauuaauuuugaacaguagccuauuauugagggggacacuggugaugaacuuagcuaauuuccuaaggaagaagaugcagaggcaauauagacccaucucugaguagggagauguggggaaggggucuagcccucccuguaagcuucuccuuagguauccagccuugccgggguucagaagagaguacagggcugggcauguccuccagaaauuugcaagacuucugcaagaaaucugagauucgcuugaggagagggcuggcagccagagagcagaagaacguguacccuguggguagagacaaggucagggagauugaguggggggugcuuuagagcuguaagcaaggcaagaucagagaaugagauccagggcagguccaggcagugauggagaaacaggucauggggaaauggaagaguuucgcaggcuggcugccacuaggaccuugauguggaccaggcuuccagggucccccagcgagccugcuccaaucccuuuugugguccuugcuaccugaggccagauucccugcaccugguaucaggaaggcccacuuugggaugcugauaauuccagcuccucuccaacuucccauuucccuacuaagcuuuucccauguacaucacacuggggcagccuauuccaaaccauguucuaccacaaggguuccucaaaaaacaacauccauggugaaguaaauuugaaacacaaauaaauuugagaacuuacauggaaaguucagcuauuuccuccuaugaaacuuucauagucuuucauaggugaagguacacugcaacucuacaaggcacccugagaauguauuuccuacauugauuuggccacagaacccucuuugaaagaacagauaaaacaucucuuaggucacuuuugucaaagacauacacagucugggaacagcauucccgaguuaucugaguuuccugggggcuguuucuuggaugagaaaaccugcccagggcccaggagagaauccuucagucgguccugggaggaguagcucccaagaacuugguauuccuuaaggcucccagaucccugccagcugacugacugccuggcaccaagaggccacagugcuugcuucauggggcaccaggcagguaagaaggaaagucucaaugaccaguaggacaauuucccaucuucccucaccccacuuaccuaaaucauccucccccugacccaccccaccuuccccaccacccauggagccacaucuaugagacagauuuuuaaggagauuucagagcccuccacccagcccugacuccagucccuucagcuacaaguaugaccccaagugccugacuugguuuuucucauucaucacugugcacuuugauuucuaaccuuagccucgcggaugaugccaguuuguucugugauuuuuccccuuuuccuucuccagauguccaaauggauucuucggacagagauguuuggagaaacugccuuugcgauuguacaugccagauccuaagcaaaguauguuugaagauacaaacacaagucccugcuccuuagaaagcuucugggugcaguccccccaauguagggcauagggccagggguguugguuguuuugaucuuuggcuguuuuguuuuguuucucuuuucuuuuuuguauuuugguuuguuaguucuuuuuguuuuguuuuguuuugcuuuguuuucauuuuuggccuaauccuuggguuuaaaguucagggcugcagguaaggggcagaguggcaaggccaauacaaaugguaacgguggcaaggaacccagcuggcauuggcaggagcccgugccgggguguugcaaugccugugucuugcuauccuggcucucucuuucugguuuucuuucuuuugguagguguccugugggauacaccggggacaggugucagcaguucgcaauggucaacuucuccaguaugucucuuucuucuauuucuucucuucccuggugacugacagucucccccuggggagggauggggccuugcuuagcaagacuagggggagauguagaggguguccugcgcuccuuagaggagacggaaacacccccggcacccccaccuccacaugugggcuguaccuccugggcacaguaaugccaaguucucucugcagcagccagggccacacccaggccuccucccaacuucuggggucgggcagccuggccagaaugggaggaagcauuugcagagcccuccccugcuccgaaggcugccugaggguaccaaagggucuggcagugagugugugugugugugugugugugccgacguguuugagagagaaaaaaaguucucagaaagcccauuuuccagucuggccagaguuuguuuguuuugaggguuuggaaaugggguagagggaaggaaggggaauuaagggagagcaggacccagggcaaugauuuccaugaauaccagagauauuuauguggcuacaggauggugggagagggggcggggguuggugcuggagaugcuaaaaaguugaggaaaugaggaauugagggguaacuggugacucucucagcaccucuguggucugaauccucccaucuaggauuuuauucccuuccuuucuucaacuuaugagguuggagcuuucccuuuugcacaguuugcaaaaaaaaaaaaaaaagaagaagaagaaggagaagaaagaaagaaaagugagccccgaggcccaaggacccagccauaauuauggagugcuuuuauuuggggccugagagcaguuccuuccagcaccaccagguggagguggagcagaacaaaaagccucuggccggccauugauucugcuugaggaccagggguccgcuggcuugcaaggccuguccccaguuacccaucccauccugcagagcaggcuaggccccugcgugccccccgaccuccucuucuccagggaggacagcugggccccaugaggaguguggaaccaaguguccacauggcacuggauacugggagguagaacucugggaggugcuaaaggugggauccaggggaccauguagguagccuuggagaaaagggguuuggggauuuaggucucaggguggagaaaugauccuucccaguacuccucagaccacagcacaaaaguccagcaaguuacuccccaccccaaccccacaggggcauagagaccccugggggaugggagcugcuuggcccagauggucaacuaucuuaauagagugugggaggccaaggaggaagggcagagccugugggcaggacauguggcccaacagaauucucuagaacgcaggcucugcaaucauuucagagucauauccagcccugagugcaggacuguagagcaggagggaccucaagagaaggcagagccuaggcagagcugggggccaggggcaagagacaguggggcaauauuccucucggcagagagccucccgggcuugugagacuguccuggauggcgagucccagccuguccugaaucagagcagcagagccuccggaaccgggccgcuauccaaggccucucugccagcugggcugcuucagcuuucagccuagaucugcuaggaaggucagcagggccccgggagcccagaaaagagccugcaaaggcaguccaggcccuucugccuagugucuucaguagcuugacuguuaccuuuucguaaaggauuuaugcucuucaagcacuuucccagagagcacuucauguacugcucuagcagauaauuacugaaaagguaguguaaagugcuggcuuaaguguucaggcuucggauucaaagagaccucaguaaaaaugccagcugcugagcuuacuagcucuggggccucuuuaacuucucaauuuguuuucucaucuguaaaauggggaugaugacauuuaugccugugggguuacugugaggaugaaaugaagugcugcauaagaagggcuuagcagagagccugccauugugauuggagcacaauuuaguaccucucccagcuacaacugguaugcgggggcagggcagcaucagcccccuagaggcugacucccagcacauccugagcaaaguguccaaccugcccagauagcaucuagaccagguuaucuuuugcagagaucaaagaaagagccugugacugcaauagcacauugaagcuuuucuuucuuccacaaacagccccuccauuccccacgggucaaagcuuguccaucuuuauguccccauguaaaagagcacacauacuuguacacacaagcacaaacgcaugagcaugggcucauacaugcacaaacacacaaucauguucuuacauaccugcacacaugagcaaacccaugagcaugugcucacaccugcacacacaagugcaaacacaggagcucaugcucacaucuguacacaucacugccuccuuguccaggcagccuaugacuguauggcaugggacauguccaggaugaagaauuugcauauugucugguaagcacagcccuguugggaguccagcaucagguugccaugguuacuggucaacaugcaaauuucugguuaauaggaccuuccggugacucaguggugccacuccacccuggcugaguggcagccaaugaacauaaugagugggaaggucuugucuuugcuggggcggacacagccauaggccccucauguuccaacccaugcuucccagugagaaagcugccuacccagugacuggccaggcccucagugaccccaccaaucaugccagccaccacucuaaacaguacuggccuuugacucaaagaggaggccaguuaggagcccuagaagcugcagcugcuacuauucgguucccagaggagugaugcagaagaaaacgcuuaaagggcuuugggagcccugcucacuucuccagcuggucauuguccucaggaauacccagccaggccugcccagaaacucagugggcaggaaagccauggcuuagcaccaagggaccaaagggucuggccuccagucucccuucugccuccuaauuugcugugugaccuugggaaaguguccuagcaucacugggccccagcugccucaucuaauacaaccaccucgucggaaaguggggcccagaccagcucuaugaacccaauccucuuugcgucccagguguuguggucaagcugggcuguucucucagggcagcauggcuggauagccaaacaaugugagcucuccagcugccugaagggucccugggccacagcauuaacuacucagugagaggugcgccaggguucuuugagaauugucaaguuuguacugucuacucagcacgccugaccagcccugggacacccuggagaggaguggacaaacuguacuuacggcaacuuuuuccugccuccaagcagucagagugggaaugcaaagaaaccaaaacgucaaggucacuccccaaccugggauuuaauagcaguacaagaauggcuugugucuggaaaagcugggaguaaugaaugcuucauugguguggucucugcauggaacugggggguugaagccccaggaucuuccucaagccucuuuagucagagccaucacagucccuggcucggagccaugcugcucucccgcccuuuuccaaaugcagaaccuucuggaaucccuaucaggaaguagaugagagguccagggauggauaaugcgcaggacuuccugcggauugccacgugcucgccuuccuccaaggcagaugagaauaucagacacagugucacaccuucccuggaucuaguggugcugacuauacaccuggggaagccagagagugagccaauccaggcuaggaggagcggggcccugcacgcaugcugagcucaugccguccaggcuuguucacaucuuccuguagcugugugcaagcacuuuggacagacaaggaaacagggauuauggcuuacccacauccacauagugaauuagggaugaaacggagacucuaggcuuguagaccgaugcuggcugcuacauuagaaugguaggugagcuuuuuaaaaacacuguugagauuucugggcucccaccucagagccagauuuccucagucuggacaauucagaagcucagccagguuugcaaaccuccuaggauccuaugccccaggcugauccccacguaacagagaagagccugagacuuaacuagauuggaaucacucaggguggcacagcagcaggucagugcagaacugacucuugagucaggguccuuuuaucuaacccuucaaugaugugggggucuccgucacaggguccugaaaucacacauucaaaacaggaucccacuuccaagacuguaauuuguccaccaguugaggagcucagacauucuacaagugaacccacuugucucuuccugugaguugcaguuugcucuucuggguagugaaaucaggcucaggcaccauggcccagcccuguaggcuucuaggguguugcggugucaaguagagaagugaccugcuaucuggagccucauccucuuccucuucccacucccucccacagacucugaggcuccccacccgggcucccaguacguggacaggccagcuaggccuguggggcacagcagggacauggggccagucuggggaccucaugccugcacucugaacaaaaaaaaaaaaauugggcccccaaugagggagcugggcaagcugucugcaggaaggcuugagaguugagagugcugaaggccuggcacugaugcugggaggagcaggggggcuccugagacccccacccccacuuaccuuuccucccagggacauuugccaacugacucuugcgccucugccucgccaccagguacuaaccccacagcucaucucuaaagagccugcccugccugcuguuucuaacaucucucucuacccuccuuggggcucuuggggacugggugucagggaaggagcucaggaggcugggaggggacacuacuaaccugcuuucaccucgcaggauggcugcccggugucugaggaguccugaccaacguuucugucucucucucucccccuguccccacccaccugucucucucccuccaccccucccuuugugacccucgcucuucugcacugccagagcaccuuggauuugaauuaaaggguaugaaaccucugugugucacucagcaccaucugcguggccccucuccacagccuccgaugccaugugugcugaauguuugguuuccuuuccaaaaaauggaaaagggaugauuccaaaaaucucuccuggccccaucgagauguccuaucauaaacuacguugauuuagcaggagacgaaagaagcucaugaacagaagggcacucagggguucggaccguugcccucaguguaccguagcaucccucacauaggggagauuuauugcuaggagagcucagaggggagggcccccuccugagcugagugcagacccgcaggcuggcuggacaagagauaggccccaugugugaacauggccccuugaagggcugguguccaggaaccacagaagccugguuuggagaguugugcagagaggcaucccuuuccauuugacuuuagucuucuuuccauuccccauuuccauguucauugcuuuucauccugcaccaggccagcagcugauaacucucuauuuaucucugucccugcccugugucugucugccuggcuuugccaucugcuugaggcugucacucccuccaugaucugaccccacauuggcaagaccagccagggucuggguggggcuggccucuaguaccugccccuugucucccagcucagaaucuuacauauguccuccugccaccugcuacuaccacccucuggcccccggaagacuccuugggcuagaagggacuuuaugggguuaguguuucuggcucucuggcuuugcaccgggaggcuccuccauagcucaaguguccaggcauaugacaugaggagagaggcaggggcucagagggugggggcuccaguggggugggaucucagacauggugcagagccuacaguuacagaaaggcugcucucguggcugauuuggggaggccuccuagccccaccaccuauccucuaucagcuguucucaguagaagauagauugcaaaguuuguguguaagagugcaucugucuauagcuacuggcugugaugggguugugggagaggcauugaguccguguggggucugugaugguggcagggugcacaggcgugaaucugcagguacguguguguuguugagaguauacaccuugugaggucugucagggcaagaugucagcagguggaggggcugugaaugccuuuguguuaagguuugagcacugugcagguggaacugugagggcguggagaugagugugagugugcagauaugucaaugucuauaaggcuggucuguauauucacucacucaccaaugcaacaaacaucuauggaacagaauuuaccagacacacagucccugcccuccugggcucacauucacaggugacaacaagcaaacaggaaagacaucaggugguguucagugcugcacagaaaauaaaaugagguaaugggauagugccuggcuggaguggggugcuaguguagcgaaguggucagggaagauuuaucugaggaggugacaucuguuuuaagaccugaugaaaaguggccaacccugcaaacaaccaggggggaguccugcagagggcggcacagcagguauagagaucaugugguuggagugggcuugccuuauucaguggauggagagacuuccagcaucucugaagcacagugaacgcagggagaggaccacagaugagauccaaaaggaaggcugggaccaagcagccgggggccucagaggccaugguaaggcuuuggguugcauuugagucacagugugaagccauuuugaguuucuaaacaggggaguaaaaugaucugcuuuaugguuguaaauaaauguagcuuuggauggacaacagccugggcugggggcaggguggggaggaguggaagcagaaagacccgucagaaggugaccaucuccagaugagaggugacaccauccuggacuaaguuggaagcaauggaaaugguaaggcuagaucagacccaggaucuacuugggaagcagagcugcgaggacuugcggcuggauccggcauuaggguaggugggaagaaagggaguaaucaagaaugagcccaagguauggggccugagcaacaggaaaaguggugcugcauccaugagcugggaagagucgaguaggaguuugaaaagaggguaaggaagcagggauucucuuuggucguggcccuuggaugcaugagucuggugcccaacacagcccaaguaggaugcaacugauuaaaugccugcagagaaaaggacaugaauagcaagcagaaagggaucacagaugacugcaauaggaaaaaugcucaaccucacucaugaguaaaauggaaauaaaaacgacacugagacaagcacaguucacccccuggacugguaaacucaacaagucugauaacaccauggagugaggggaaccaguccucucauccaugucugaugggacagaggcugccaauaggugcagacucgauggagggccaucuggcacgaucauacuucagggagcagucagggcaggacauaaaaauuugagagucugcaaauagacgguauacaaagucugagucugaguuaaaucacuaagggagagagggcaggugcaggaaagaaagaaaccugagcccaggcccgucuaucuucccagucgguagaaaagaagaaagcauggcuaagacagagacaggucagccaaugaaguaggacagagagaagaaccauuccaaagcccagggggagugggccccagaaggaggagagcagcugggaaggaagcaagugaccucaggacuuggcggccuggagguuguuggugccuguaaccaggguagucucagaggagugauggagacacaugccuggcugaacuggaugaggcaugugaagggggcgugagagcuggagccagggcugugggcacagagccaagagauggggaccuaggguggaggucugguuguuuacaacuccauccaacugugugucagugggcaugggcgugugugugcaccuguugcuggagugugugguuaacucugugugugugcauauguugugugugcaggugugugugcgugaaugaaggggucugccugugaaucagauaggcauaguuagaaaucucugugugucuggaggguuuguagcccuggguguuuccugguguguacaccuuugccacaggauaugcugcaagcccaagagguuagggacauuucccagggcucugccaaggcauugagguccagccuccacuuuacccugagcugggaggaggggccagccagcagguguggugggcacggguggggucuccgggcuguagccuugacuacagcuagcgcugucaccuuuuacuuuuucuuccuccuggcuuucucuguuuuagaaggauggggguugccccagcagcagcagcagaggguaaagaggacagucggccuuugggagggcuuugaggcccagccuagcucagcuccucagcaacggugggggcuguuccuugcacaccagcacuuuccuagaugccagggguccauggugccacuggcgggcuucucacaagcagagauagcaggccuggagggggccagggccacucccugaccaggcugcagggguaaacaaaggcauucccaugaucacugccaggaagaacaacuccucuuggcccaccaagguucuuugcagcuaccaggccacuguggagcagggcagggucaccggccagacugagcuguccuccccugcucuacagccucgggagcuuugccuccacuccaucccuucccauuccccugcauuuuccacucaugugcucugggcaggcauggggcuuggggaggggaacucaggaggaguugugugugaccagauccaugggugggugggagcugcagggaaguggaaggcaaaacagagcauguaggagggaaggaacuggcuggagaaaagggauggaaaggagcugggcaggaccugagcuggggagagccuauggcuuugggggcaaaggggucucugcaccacuaucccuaugggguuugccuccugccccaccccucacaucuacccuaccucugcagaagccgaggagcuguaccagaagaggguccugaccaucacgggcaucugcguggcucugcuggucgugggcaucgucugugugguggccuacugcaagaccaagugagugucagucacucaagcuggggacaggccaagccaagggaugggccuccaagaaugugugugaagaagacuuuccucccccaccccacuggagcccucuauacccuccuaggccccaacuaccccucgggggccucuguagcugggugggugucgagccaaagaucuggaccaagaaguagaggcagagggucagggagacaggccccagggcacugacgaagaaugguugugagcacaggcuuuggaagaagacgaaucuggguucaaauccagcucugcuauuucccauguaaccuugagcaaauugaugguuccucaugggaaugauccugguauguaccucaaaggacacugugaggaccugagcaguagcgugcagcugaccccacaggcuccuggagcaggugccccgucaagugggcagguacuagguaguguuggggaggaacacagagaggacagcuucauucccaaagaaagacagaugccucaaagcacugccugaccccgccuugggagcaauugagacaaaaggacagagaaggcagggcuggucccccucuggacagagaagagguaggggcagaaccuuggggcaaggagaauaagugaacagagagggagccgggcagucuaagcuaaaagacagcacagaugagggucaacuguacucccggagcaugggcagcccagacuagcuggagcaaagggccagggacaggaaaaaagcgggcaugagucuaaaagaauagcugggacccagaugguaccauagggccuuggaugccgagcuagcaaguuuggguuuauccagugaaggcuauagaugugccuuuguuggauaaacccaggcucccuagcucggcauccaaggcccuaugaccuucugaugugcugaaagaugacggguuuguaacaacuguucuuaucuggaaagcaagggucuggacuggacagagccaccauucuggggacugagccccuggucuggacucaugcugccccaucuguggcaucugaaguccugcuggccuugucuugaaugaauccaggaccagaaagucuggaggagagucaggagggaguuggggcccagugagcccagaggagacugggcccaagagggaaaacuaaguccaagaauuggagaaaaagcaagccgccuguccugcccccacugcauuuacucauuucuucaacaaacauucagugccugcuggacaccagguccugccucaggcauacggccggugcucugaacaagugguccagugucacgggacaccuuuuagagucaccuaaccuuggcugaggagcaggaaggguuucccugaggaagcagcauuuaggccagggccugagaggugaacaagaguuagcaggugaagaggagagaaaguauuccaggugaauggccuggcaugcgcaaaggccgggaggccagagagggcugggcauagugggggaucagaaacaagcucaccauggaggcagcuagcuggggugcugggugggcagagagagacagggcugggagagaaacaggacacuaaggcccaauaaagggguuuuauuuucauuuuugcggguacuuaguagguguauauauuuaugggguacaugagauauuuugauacagacaugcaaugcauaauaaucauaucauguauucuauucauccccccaggcauuuauccuuugugaccuugagcaaacugauggguccucguggaccuuuguguuacaagcaauccaguuauacucuuuuaaauguauaauuaaauuauuauugacuauagucaccccauaugcuauugaauacuaggucuuuuuccuucuaacuaguuuuuguacccaugaaccauccccaccucccucccaaccccccacuuccuuucccagccucugguaaccauccuucuacucucuaucuccgugaguucacaaugaagggucuuaaacaggggagggacaugauuagauuuaauaucaaauaaaucgagcauuuaauaugugccaaucugaaguagucccacaggcccugacucccuagccacagcaccuguuuuauuuucuucauggaacuuuauugaaaguaucuaguucauugcuuuguuuauguguuuaccaucugcuuccucuacuggccugcaggcuucaggaggguggauucccuaucuaccuaucuauugucucugcuccaaaacagugucuggcacauagugauaacucaauacauaccaaauuaaugaaugagggagagagagagggagucagcacugugcuugaauguuucauauacuuuuaauccucaauagucuuuggaauggauaaaugaucacccugucuuauagaugaggaaagugaaacgugaagagcuuaaguaacuugcccgggguugcauagcuagaaagcagugaaguucuacucucugggcagagccagagcucacugccacgacgcucagguccuauuggauucaggugguagugaugcuguagggcagcuugaguacagggacgagcaguagccauggccacccugggcaggaggaaaagcuguuucccuagagagauagcuagggaaguucaucguuggcgaguggggggaaugccagccucaccuucccuucccuugugcagaaaacagcggaagcagaugcacaaccaccuccggcagaacaugugcccggcccaucagaaccggagcuuggccaaugggcccagccacccccggcuggacccagaggagauccagauggcagaugugaguggcuuuccuggggcccccuucugagcccucaguggacagccagccuucucaugcccccugcaaggaugggccagggcagcagccagccuaucccauggccagccuugccugcuaggcacugccucaccaggauggcuggccuugguuugcucacuuccaugaggaagggguggggguugauuugcuggagccaucgcugccccaacaucaagucacucucacacagugggucuccccaaccaggagcucagucagugcucaucacuucccuguccccaacaagaaagaguucauuugggccccagucacuaacucucgcccaacucugucuguuccaguauauuuccaagaacgugccagccacagaccaugucaucaggagagaaacugagaccaccuucucugggagccacuccuguucuccuucucaccacugcuccacagccacacccaccuccagccacagguaggcaccaccaaggcccauggaaacuuguagacucacauacuucaucuggcgcaaagugcccacuuacuccgacauccagagcuauucaauacccuccccugagcuugccacaggaaucacagcacaccuuagccuccucuccagaacugcagaggccaguccacacagcacaaaggcucagacaacucaaaaauaacauggcuggcucccuucuucccucgggagcaccaggaaauagucagggcccucacauacuggccccuggggcugggcuucugagauagguagcuaaggaccacggugguggaaaggucccagacagggggucuaagguaaggcuggggggaggcugguugcaggaaggaaagaaaugggucucugcacauuacagcucacccaucuaugggaccccagcccuccuucuuccaauauugggguugggcauuugcaacaauacacaucaccccagaguggagaagggcauugagcuaagggagcucgagguggaagaagagccagggagguccaugggaccacaccugcugggccgcccugccccuuccugaccccucgucucaccccaucuggccuucccagacacgagagccacacguggagccuggaacguucugagagccugacuucugacucccagucggggaucaugcuaucaucaguggguaccagcaaaugcaacagcccagcauguguggaggcccgggcaaggcgggcagcagccuacaaccuggaggagcggcgcagggccaccgcgccacccuaucacgauuccguggacucccuucgcgacuccccacacagcgagaggucaguuccuacccccugaccuauuccccgcuuagccagagggcuggcaccacuggcccaaggcugacccuuagggccccucagaaacacuccaaagagccucaucuccauuuuucauaugggaaaacaagguccuagaaaaggugaaauggccugcucagagccaucggcauguuaaugacagacugggacuagaguugggccaguggacccugguggacagugaccaucuaauuuaauuguccucccaggacacuuuucacacuagaaaaaggacauuauuaauaguuacacuggaacaucaagaacaaacaggcagccgggcgcgguggcucacaccuguaaucccagcacuugggaggccaaggcggauggaucaccugaggucaggaguuugagacuagucuggccaacauggugaaacccccaucuuuacuaaaaauacaaaaauuagccaggcaugguggcacaugccuguaaucacagcuacuugggaggcugaggcaagagcaucccuucaccugggaggcggagguugcagugagcugagauggcgccacugcacuccaaccucagcaacagagcaagacucccuuuacaaaaagaaaaaaaaaaaaagaacaaacaggggcuguucuggacaaaccaggauacaugcuagaaguuccaugucccagcaggaacagaaggagacacgaagaaggaguaaacugcagagugggaggggagguugccuuugaggacacugaccagcacaagauggacgugagccaagaaugauggcaggccuuggcaguagcagcaacaagaccccaggguucaaggccuuguuggcuuccuaagcaguggauguaguaagaaccaggaaacgcccuuucuucccugacuccaagccagaagucaagggccagcaccccugccaccuugcucagcccugaguggcccucagcaaguggggucuguaggaggugagcagggaaagaugagugguacuaaaaacuccacaccagggagcagggagaggagcagauauucccuugcucucaacucagccuacuccaugccaggcccugugcugggcaggccuggcugggaauccagaaguggccugccagguuccugcuccugaggagcuccuagccacagaaacaaaccaaggaagcuuacagcagccuauggaaggugcuaaacaugacaccacaccagggcagagagacccagucugacuguaggcucugggaaguagccagauuuucuaagcccagcuccaccaccugugugauuuggggcagacugaucaccucuguaccuuguucccucagcuguagaacagggagaacaaaagcuacuaugcaugguucaagugaaggccaccugagaucaugugcacagagcucuuugucucaucccuggcauggagcugaugcucacuagguguagcuauuuaugaaucguaaccacagcaaugagacuccuuaaugggugguaggaaggggagaggcaggagagcaggaagaaaagcauucuaggcacggggaacaacuugagcuguuccaacagaggcacuuaagaacagggcugaugagugaggugccuggaacagagugggcuguagggagcagaggagcugggccugaacaggcaagcugaggccagacagacugacccuggguggguaaacaggaagaccggcuucagcagagcugugacuuuacaagauugcucugggaacugcauagagugaaggaggagagacccugggguggacccagaugaccacaugugaacagucgggcccaggaugggguggagagugugcuuccggagaagggaauggguaggacuuggugguuaaucagaugugccggugggaaagggaagagggaggagucaggcgauucagaaaaaaugauaauggggacuccaggcugguuccagagagcagugagaugcccagcugugcaguuuggaagggaagcguggagguggguggccccuguccugaggugacaacgguggggcagaagacugaugggcuuacaagggggauguggagcacaaaaggggacagguacccgggauccagccugggagauauuagcaaggccagacuucugaaggagcuggugguguggggaugggucuguagccacaagcagagacaccucaugggaucuugguacuccccugaagcagguuuugacuucacuguaaggaggaauauuucccucacugaagccaucagggcaugggaggaauugucccuguggggcagugaggccaggucacagggguaucugaauggagacuaauggcuucuggaauugggcaguaugaguccugguuccugacuagccucaagucacaucccagcucugccacuucuuggcuguguaaauccugaauaagucacuuaaacguucugaguguuacuuuccugcguguagaauuaaacguucugaguguuacuuuccugcguguagaaugggacuggcggaagggucuuacagagcugcgguauuaaaccagauggaacauguaccccagcgugagccugacccccugacggugagcauucccacagcaagugaccauucaugaaagcuuaccagggucaggcacagggcuaacacaucccacugauacaaucuggaaucaucccaacagagcuauggaaucaacaccaugguuaugcccgcguaacagauaaggaaaccgaggcucggagagguuuaggaaauugcauaaggccacugaggguugcugccgucauucuugcaggcggggucucgggcaagguuaaggcaagucuggguccgccccucccacccuaccccacccccaacccccccucccccgcgccggcccggccuggcccuggcccaugccucugccucuccccgcagguacgugucggcccugaccacgcccgcgcgccucucgcccguggacuuccacuacucgcuggccacgcaggugccaacuuucgagaucacgucccccaacucggcgcacgccgugucgcugccgccggcggcgcccaucaguuaccgccuggccgagcagcagccguuacugcggcacccggcgccccccggcccgggacccggacccgggcccgggcccgggcccggcgcagacaugcagcgcagcuaugacagcuacuauuaccccgcggcggggcccggaccgcggcgcgggaccugcgcgcucggcggcagccugggcagccugccugccagccccuuccgcauccccgaggacgacgaguacgagaccacgcaggagugcgcgcccccgccgccgccgcggccgcgcgcgcgcggugcgucccgcaggacgucggcggggccccggcgcuggcgccgcucgcgccucaacgggcuggcggcgcagcgcgcacgggcggcgagggacucgcugucgcugagcagcggcucgggcggcggcucagccucggcgucggacgacgacgcggacgacgcggacggggcgcuggcggccgagagcacaccuuuccugggccugcguggggcgcacgacgcgcugcgcucggacucgccgccacugugcccggcggccgacagcaggacuuacuacucacuggacagccacagcacgcgggccagcagcagacacagccgcgggccgcccccgcgggccaagcaggacucggcgccacucuagggccccgccgcgcgccccuccgccccgcccgccccacuaucuuuaaggagaccagagaccgccuacuggagagaaaggaggaaaaaagaaauaaaaauauuuuuauuuucuauaaaaggaaaaaaguauaacaaaauguuuuauuuucauuuuagcaaaaauugucuuauaauacuagcuaacggcaaaggcguuuuuauagggaaacuauuuauauguaacauccugauuuacagcuucggaaaaaaaaaagaaacaacaaaaaaaa

SEQ ID NO: 18514 - RNA, 3885 nt, Homo sapiens
uuugauagagacaaaaaggcauuuuagguuaagaaaagugcaugagcaaagagagaggaacuuggcgggauacgcgcaggggccucugcggagagucgcugggguggagggcuuggccuggagagccaugggagugaggauugaugacguccaggguugcuaaaucacagagaaccuuuaaguuggggcuuagaaguuuauuuaucuugacuaaggcguugagaagccauugccacuuccucagcaggagaguggguggugggaugaauuuggccauggugugauggaugaauuggaagggagaaaacaggcaggacagccaggagagugcuggcacaauuucccucccuuccugccccuccagucauuucauucuuccuuuucaucauuguccacuauaggugcugacaugggcgaccuugggaccuggggcuagacagccgcugcaggucuccuggggccccaggcugcuccucucuggcuuggcugcugcuggcugcucagggcugugaccgugaccuggguugggcuggauuucuccuccacggucacuuuugcuaaugagaagcaguugucuugccacgaucgugcaggaggcaaggggagagaaccgccagccuggccucaugcuugcucugugucccccaccccucccugggucucuuuuuuucagcuuccagccacccccacacccugccccuugccucccagugagcaggcuaccugcccucaacucuggcccacuuuuucagguucucuucggguuuccagugcagagaaacugccagggaugggggagggguuucaugagggccuguaaauccugcguugggggacccuucacugcuuccuccugcuguauucaccucuuucuacauuuucucccuauugucagauggggggcuuggaucaccugagcucugaggugcuucugguucucaugugguuuuuugcuuucagucuugcuuacucugucuuuccuucucccucucagcaucucccgggcuggggcccuccuacgaugaacagaauauguccuuuccucuuaucaucaucuggucaaauccuucuuaucuuuugagaccccauagccuccaggaagccuguugugaccacuguaccuugucaguguuccagaaaacgcuggcugggcccuagugcagugccccagguagucagaccaccuagcccugauagccuugcguugagucuuugugggucaucuggcugguucucucaggaugagagcggugggaagggguuggaggauggagugcagugaggauaggaguggggacaagaggcguagauagauauucuagugccuucccugccagaagcauccagaaugccuggcuucaugaaggcagaggagaggggccuagaguguuucucuggcugaccuguuucuuccagcucuugccagacucaggacccccuuccccagguccguuaacccuucagccccagucacaaaggcccuuuuuggcuauguccacggcuuugagcuuucaguagcucucucugcagggcaggagacccaccucccagcucaacccccucucuucacaagcacaagggcggccacagcccaugguuaagugcuaguccauacucccuccccacgucacccccaaucccagaaagugugucagaggcccacugacaauucuugaggccuugcucuuucuucuucucucuuuauugaggccucuuuuuuauggcaauguuguugauagugcacauauuccagaguaauauguucaggauuaggccgcacaaugagguuaugacuuccuccugugcaacccccacccaggggagcuugcccuccaucuggccggcgcacaucuggcucaggcucacagcuggccagauguugccucccucugaacccaggccugcagccuccucugcuagaggcuggagcugcacacauacacacgugcgcacauacacgcaugcacacacacgcacacacacacgcaccgccccacuccauuuggagcauugaagcacugaggucaucugacucuucaagggggaggaggggagagcucggccuuagugcaauuauuccuccuccaccgugguagggcgagcaggcuguggggacacaucugcggagguauguaaauaucagguucccugcuuccagcccagacaggcuagugggaaggacccacuugaaaccagguuaugaaucuggagccuucucccaccccauccaggggccagcugcucuuagcagauuccuugugcacugguuuuggggugcucugggggucuaagccacggaagcucuccugucucaggcugaggccgcccucugcaccuuguuucugcccacccaccuguuucccacccuugccucauuuuccucuuuuccucuucccaccuucaguaguucauggauuguguaguuuaaaggacaaaagguacagaggcugggcccuggacccucaaauaauugagacgugaucugccaaauuuguuuccccauugguguuggcagaggcugggcagaggagcaggguaggaaaaggaaacugcauuuauugggugccaacuaugugucaggcacugagcaagaugcuuuaaauauauuauauugguuaaucccugcaaccauucugcaaaguagauauuauuaucuuuauuuuacacacaaggaaaguaugucucagaaagguuaaaucccuugcccauggucacauggcuaggaagaggcagagccagaauuccaaagcuucacuacaaacuaaaugcccuuaugccaugcuuucuuccuggcgauguaguugguaaaugccucuacccaucuguaaguccuccuggcuggccacugcaugaccuggaucuuccagggcuaagacccugaggcugcgagccuuguccuuccugccaggccaggccaggcugccugggugagccagggggagggcgugccauaggagggugcaaggcuuagguugcaguguuguaaccaguuggguuuucugcaugguuggucaagagccuggggacugagcucucagaaacacaauuaggaguugagaaagcugggugguguaggaugaaaggcaggcggaugggccaaggaggcaucucuggggaacuugggagcuuuccauggcugugggacagagaaaccucauuagaggagccacggagcucaggcugcuauuguuagcucaucguuccaucagacuuccaaagggcccccagcagauggaauauuccaagggccuuccaggguccccucuuccugacuacagcauguggcaccccagagaggcagcagggggugagcaggcacccuccagccuggcugugauccacuauguccccaugacagcaccagcauuugacugcccugggcuugaagagcaggaacaaugaaaggccucacuccuaccucucgauaaguagccaaagagagacauagacacccaagacacacacacaaacacugcucuguaucuuucugccucaaacaaaacugucauuuuagagaugaaacugaagcacagaaagugagggacuuggcaaggucacauauccagcaaauguguaccuucucagucugcauccagggcuuggcccacauuagggagguagcauggggcaguggaaaaagcacagacuuggggucaucuaggccuagguugaaagcccaguucugccucuucucugcagugugacaacacuuggagccaguuuccucuucauuaaacuugcagauuugcacugaggauuagagacaacauagaagaugaucaauauaugggagcuguuauuggcagcaguggccaggauacugacugggcuaguagucacgaugcagcuaggaugguggcugggagaggggcugagugguggguu

SEQ ID NO: 18515 - RNA, 9309 nt, Homo sapiens
ggggaaaagauaaauccguugauaaugagaaucuggguggguaucauggcccaagcacuuuauaucauuuuuuaagucaguuaagauuugauauauuuuaaaagauacuaugucaacuuuuuucuuccuauuuucuuauguaacuugacguuuggggggauuaucucauucauuuuuguuugugugcuuuuaacauuuuguguuuuggcccuguucaaacuuucuaaacacauuuuucuuuuaugacauuuuggguuaucugcuagaccuggugaccccaccauaugggcaugauuauuuuuaucuuccacacaugguucaccuucuugucuacaauauucccacucauuuuuucagguuauauauacacacacauuuccagauaauuuuagaauggggcuaucugaaauugauggucuaguagcuuucauagcuccacaauucauuuuauuuuacaugugaacauaauuuuaagauuuucuucaccauaaaaagugagauaccaagucuaaugacuuuuuucccuuuuuaaaaucuuuugaguaucagaaugagaccuugcuaucuauguaaaaggaugcuaaaacaagggcaucuguagcaacuuagguuuggaauaguuggugaugacucugaguauaacauuuauaguuuauuaucccuaaauuugaauaucuucauaauuuggagagagauguauacacacacauacacauauauauguauauauacauuguguguguguauauguauauagauacacacaucuccuugagaguggaauaaguaggagagauaauuuauuggaauugcuuacauagauaaauucaccaaaguuauuuguguagauuuguuaaaguguaucaauuuuuaaaucacaauauuucuguuuucuucauugcauauuaaccaaauuuuggccauucauaaguaugcuauaaaacuaaagugaucacugcuauucacgaauuauuauagaaucuucuuugcagauuuugugauauauuaagaaaagcugauuuuaauauuaauauuuaagaaguuauuugauccugaaaaccuaaauuuaagguauaggccauuugacacguccuuuuugaacagaaauuucauuacaggcuaagugaaaauaagccagaauuagcaugagucagguagaauuucaugauaaaagaacaaccagaugaaauaagaaauaaugauugguuucaagccaaugaaucugcuaagcuaacuaccaaguuuugauguugaaugguccaggcaauuuaugucuuuaggaaagcugaguguggcaaaggucacuuguuaacauuuuucuuaacaagaaugucauaacuacucauucauuuuuauuuuguccccacguuugguauuuguuuuguuuuguguuuuuccuuccugauguccuuugcuuuuguggaagauuguccuguugauaggcagaaacaugguggugauccucuauguaaaauauaguugcuucuuacacaucagaaguauuucacucauuuuggaaucacaggauuuucauguuuucauaaauacacacauuguuuugauaauuauuagcaauuagcuuauuuuguagcauuagauggaaaaauguuuaagcuaaagaguuuaauuuucuugauuuugguuccacuuuaauaauucaagaggccuccaaguucaaggaccaaguccuucuauuuuagaauugugaaaaacauggaaauacucuuguuaguguguguuuuggucuaagguagauuauuaacacagaaggauccuaggaggauuuaagaaaauauguccuuaucgugaaguggcaguuaaaguuaugggacaggugaauuaccuauucaucuugacuagcucaaacaaugauagccaucagcuaaugacuuaucagacacauguugaguuugggucaaacucccauucagcuggaguggauuggcaauuuuaaaugcagguaguugguggugguacuugaccuaccuccuuaccauguacaucuggcaucuucucucuccuauccuuuuucuuuguuucucucuccacuuuuacucuugcuguaggccuaccaguggcacucaagcuuacuucuucagagagaaguaaagaaauuucugacuccugccuuagaacauagcuaacugaugauccagaacaauuucaguauuaugagguaacugggcaguuuuuuucugauugcuauuuuccccauagucuuaagcuggcaguuugaagguaucuaaauuaauguuaagaaacuugugaacugaagagaguaagaaguauguguauuuuagguaaguuacugggaacugagacuuacugguuuggaaauuggagaguaggacgaggagagcuguuuaauguguuuguggauggggguuugagagguauauagagaaugguuuggaaauaaagugagaggaauuuuuacuagagguaggaaaagguacuaugauggaguccgaaugagaguuauuugcuaaggaaaugaaguugaucuucacuaaggaaguuucaauaaagccagagaaaaugggucccucauugauuaugagaaagcuguuaguuacuauagcuagaguuaugauaaugaucaugcauuauacaagucuguuuucauguauaggaugucugcuuuucugggacaaauuagcacaauuguggaaugacagcuuuucuggucaaggcaaguggaugcuggggaguuauuauuuugaggaaaagaaaauuucaagcuuuucaccauuauucuuuuuaaacuaucagaaauauuuaucacacauacuaucuauuuucuugggcucuuguuacaauguaguuuaccuuuacuuuucaaaugguccuuagaucaaauuauuugauuuuguacuccacaaagacacauauuauuccuugcuuuuauagaauuuugagacuuuggcccacacaaauuucuuagaagacaauaaaccagguaaaaacacuaacuugcaauuuuaggugucuuuuuuauuucuuuuacauuugcauccguagcaaccauuuaaccuuguagaccuuaugaggcccucaauaauacuguauuucuaaaauuagacaacauaccccccaaacucauguuucuguuucccuacuuucucucuuacuuuaaaauuguaguauucccaagaguucagugguggcaaauguuaauaaaauaaguuaguacauuuuggagguucuuauauccuuuguaggguaagcugauaguguuuagauuucuguucccauuauuccaguaguguuuuaaauuauuuaagauaaauaauuacuguaauguuuguuuuuaaguuacauaauucaaguauguuuggauuaacucuuuguugucaaauuuaguauggauuuauuccuggugauuuggacagauuacuuugaaguuucauuuuacucacaucucuauauauuagugauaaaaaucucuuuuaaaaauagcaaaaaagugguucugauuuuguacuuugaagguaauuuuucuuuuuuacgaaugucagguucauuaacaauagcaggauuauuuuuacuauagcuuauuuuguagaguuggcacuuuaguauaauuuucacauuuuauugugucagauuuuaaauuauaauaguuauauacuauaacucauuuaagucaaugcaaagccuucuuaaauagccccucccuuagaaauuuguuuaaaaagaagugaauucccaaaccugugucaagaacuugugauuuaaaugacugugagacaaguccuugaaaggcuuaagucuagucaguggagauaaaugauagcccauuuccaugcugcauauaguuguuaggguuuauaaaguugucaauguguaaaagugcaaaagcaggaaagacuaaaguugccuguaaaauuucuaguuuucauuauuugcacuauuuaucuuugcacuugauuuuuugaaaguuaaggcuagucacuuucacuuuuguuucuagucuuuucuaauuucuugcagaauuguguuuucaauauuccacccaaagcaaaaauuauaugcaauuaaaaauauuuuauaaggccaagaaaauauuucuuaauguuagcuguauaaaacaaaaauuuguucugauaaaauuuuuaauaugggccuuuauuugccaauaaaauccuuuguaaaugugagcuuuauuaaacuguuuaaauagacaaaguuaaagcuuaggauagggaauauauauguauguguauaugaaaugaugucuucgaguuuuaacuuccagccugagauggccuagauuugguguguuaguuuguuucacugaagucagugagauaggagucuagcuggguacaugcuuaaaaagcuggaagugaaguggguggcaaguggcagcucccucuuucauguaguuuuccauaauguucauauaguuuccuuauggucuaaguguuacaacugguuuucaaguuguuauauugaauauuccuuuuuggaauucaggguugaaucacuuugagggggaagggaagcaagggcaagagacuuuauuuuaaccagaugcggucuuaugaccucaaagaugugcucuagaaagaaaauaacaaaaaguguaccugugaacauauuuuuugucuuggugauauuaugcaacacaguguucagaauugcaaaaaaauuuaaaaauugauaguuuuaucaauggaacagagagauguguuuuuggcuaaaauuauuuuuuguaaguuauuugguuauuucauuuuauauucccuuucccauagcuuuguacacaccucauacuuaaaaccaagugagaggccucuuuucagaucugguuuauuuuuggaaugccugaguguguuuccagauuggggggggagaggugguguuuuacuuuuugacaugcucuuagcauguuuugcuagucauucuggaucuuauguuugcaaauucuguugaacauucagugauguauuugaaaugagaaaguccuuuauaacauagugugaauguuuguggccaauucaauuguggaaucuuauggcuuuguuuuuacuuuggguagaaguuuaacuuccauuguucagauuuuagguuuaucuagugaaauugugccagguaguugucuaaauauggaccaauuuugggaaaugaagauuaauaaguguauauuugauucuagauaauccuuuacucaaaaucauaaguuaaagauucacaucauuaagaguuaucuaacuuuuauguugucaaaucuuuaaauguggaugauauucagcauucuaucuaugaauuuccuuuaggaaaagagaaaaauucagucuccaaaccuuuucuuggagacaaaauuuaccacauaucgaaaaugaaaaaaauuuagaaagcgauuugauuauuuuuuaauggaguuuaaccagcuuaauuaaugauuuuuccaguuugaagcacuuauuuucccaaugugaauaaagggaaaagaucagcaauuugucccuggccuuuuucgaggccauuuuuaguuuucugcccccauuucccaguccugguauaaaaugaauuacggguaucccucuaagucccuauaacccuuuuugggggucacagauaucuuugauaaucugaugacagugugauggauccucuacccaagaaaaaaaaaaugcccaucccuggauaauuuugcauacaacuucaggggcaucacacaucuucugaaacccaaguuaaagaucucugcucuaaguaaauuguagagaauuuuagugcaaaucguugauaaaauuaggaaccaacuauuggcuuaaaaccuuucauauuggaauuauuguuagaugguggccccuacuagcaaaaugugacauugcaaccagcuucguuagacauuauaacaaccagagagaagggaaaaaagcaaaguucugaaagcuauuuauaaggagucagggcaucucuagacaugggagccuuccugguucaaggcaggggucagggugccugacaauuucuagcaggguagaguuugauaaaccacaaugcucaggaugccaagggguuagccauuaucuuaaccccuuccucaccaaaagauuuuaguuuugucuguugggaaacaagaugucacuagggaaaaaaagauuugccuuacaacuuugcuggaacacaucaguuuggugacguugggacacuaguguuauuuuugagaaggcgcauaaaaccaaaguaaauuauucucuauguagaacauuuauuuacuaguaacauuuguuugcguguauucgcuuugacaauuuuuaccaguaaauauugguuuuauuuaaaacugggaauccaguugauauauaggauaguugauacaucuguucuuucccccauguaaagcauaguuaaaagauuuaugcauacuuuuuacuuuucucucuuaaugccaugggguggggagggugggugggggaaagauuuuugagucuacaacugacaaaaugucuucuucaaauuaaaaaaaauugagaagcagcacuuuaagucuaacucuacaccauuuuauugcauguauuaguuuuauuaaugauuuuuggugcaugccuuugggcuuauucaaaaguguacaauaggaaaguauauuuccuuucuuagaaaggagauguuuucuacuuugcaacaugugauuacaaaaaucuuccucugugggaagauuaaccauguauugaacuacugaaaaguauauauuuuuagauauacagaaggaaucuacauggagcagcauucagaccuauauagaagucauagcauucuguauaggaccaaaaaggaaauaacauuaaacacuuaaacagacguuguuggguagaaauaccuuuagaucuugcauuuacuuccaaaaagaaaaaaugccacagaaguuugcugaaaacuuuugucguuugaauuuucucugucaguguauuuagcccaaauacaacagcuuuggguuagcacacacauaagaaucaaaaaaacaaagcucacuaaauaaaucagucugguuugccaauccagcuugacugaaauaaguaaaccaaucacuugcaacaugaaaaacuguccaacuccucuaagguucugacaaaauaaccuuggcugaugugggaagacucccacuuugauuacugaccugacagugaagauucaugcuugacaugauuucagacuugacaaugucuguuuaaggagcuaugguacaguuugcuaauucaaucccagauaccuguugauuaccugugagaucuagaguccaaaguagccagcagccauaucccugagugcucugugcccaucagauaucuuaaaguaagcaggguugggacaggucacagcuuggaugauugaccucaggugccguagacagccccagauucaagaauuguaucugcuuucuuggcagucgucacugaacuaaugucccauacuguguuacuuacuguagaugcucucuuuuagaggaggcccagagcacacauccuaaucgcuagcgguacucagagagggggugcuaacucugaugcccuggccaaauuccaguuuagggaugugggucuucuucuugucauucuaauuggaaaugugcaucacuucccauuuuucuuacugaucucagugcaaacuacacuagucuguuucuuugcccuggucucaagucucuaagacgcugguguguauuaugugggcuaaguucauguguuauccuaaggcacaagaguugaggaaugggugagcuuggugucagagcacugugugguuggaggguggacucuugugaugcuguggggaugaaauuggcccucuuuuagcauaaguuggggagugugcacuggcuggaggcuuccagaggcuuccagccaugaggugugagcugaaaccaauuuuuccucuuuccuuauagcauguugagaaaaucuguuggguuuucagcagucagggaaggccggaguucugcuuuaaucuggguaacugaggcuaauaugagcaagacuuugguuaauuaacuggguucucagaugccacagacuccgugagaagucaccauuauuuucaaugguugugauagaauuucccccaguagccauuauuuuaagauuauauugcagaguugcuuuauuuugagcuuuuuguguauacacaaucccaaacuggaagaaauuuuaaaaaaaggaauccugcugugaaagguauauauuacucuagauuuuucuuacuguaaauauuguaagauuguaauacugucgauauuuuauuaaccaacaaauguuaaucuaugugaaaucagacuuauuuuaaaugugcuucuuauuuacuguguguggucccuguugcugacaguauuaaguuauauucugauguaagauuaacuuuauuaaagaauguaaacauuaauguuuccuuaugggaaaacaaauaaaguauaaagaagacaauucuuuucauugaaauauacuguguauuuacacuugcuagacccagcaccacuuauaaauuuaguacacuguucagaauuuuaguuaacacagcugacaugguugugcucuguuugaaagucuaagaauagguauuguuggaauauacaguuuguauuugucugcugugaaucauaaucuugaaauuucuaaucaaguuuguaaaauuuuuauagugaaacauuuuaaugacaauuuaaaaauuuaucuucucuaaagaauggucaaaacaauauccuuucagaaauagaauuguucuuuaauaucuuuccaaaaugacuuugguuaaauggaccagauguauauuaguuaaaauuuaggacuaaguuguugauauucuuugaguuuacaaguuaauccuuauuggagaugugccaauauacaguuagaauaucauuaauuugcacuguuuggggaccccauuuaagaaugcugaauuuugccaacuaagaaguaagcaaaugcaauuuaaaaaguaaauuugagcauucuguauuaaauaugugcaguuauuaucacaugaagaaacgcagugugucgggcuguaauauuaccauauuugcugucauguucucccaucucagugcugggaaaucaccauguggaaaccaagcaaacguguugugcaucagccggcuugaguuuguucaauaucaaagcugaaaacuagcgaggucugcuguacugcuuauugaaguauugugauuauuuuaggcauugauucuuacaaaauauauacuguaacaguauacuuuguacagauuuaaauuuuauuugaaaaaaugaaauaaaguaggcaaaaaaauaaagauguuuauuuuucaugugacuguauaaucag

SEQ ID NO: 18516 - RNA, 555 nt, Homo sapiens
cagcuugaugagaugcaguuuucacagaaaaauucuguuccuuagaacccaagugagucuuucucaaaacugccagaguuggugauaaaccuguguuaaaaaaaaaaaaaaaaaauuccccuguguguccacauacuagccaguauccacuccagguaaaaguuucuaccauugaguaaaaggaaguuauguuuaggaaguuuuugaaacagccccucucuacuugucugcuaguuaaucacccacauuuuguuuugguuugguuugguuagauuuggugggguuuuuuuuauuuguuuucguuuuuugcaacuuaaagcaagaauuaaaaguuaauucugaagcuucacauaugcuuuggcuucaaauccuaacauucagcacagguuuccacauggggagugccaggucugacaucugugucaguccuuauuuugauucaggguugguuagauagaugcucaaaucauugagggagggaaguccuggaugagggcacugcacugcccaccaggguguccaugagacacuuuauaaccuaagugucuuucagac

SEQ ID NO: 18517 - RNA, 13788 nt, Homo sapiens
uggaauaaggguuaucuuuauuuggauugcaaaguauaaauaugaaccagguuuggaaauacaaguuguaacaguucagaaauggcaccagaaacuuccagaaaggaccaugacagcauaacuucaucguuuuggugaggugggugggauuauacaaagccuuccccaccuccaaccuucucgguagcaauuggcagguaaucaguuaccaagaacagucagcuccaauguucccuguuccuucucagccuuuugcuuugcuaauaccuucuccagacuguccucugcugcacugaccccugcauggaguagcaccagaagaauggcaggaguuagagaaaugucuugacacaagggaaagugaguucccacgcugugggccuggggccaugggggugagggaccaggaaagcuacaggcauggaagcccaaccucuucugagacuuggcagggagaggacacggggagacacugauaucuguuacacuuugacaucagcaccuugggcuuucaaaacacaaaugguagacaaaaucgccuaggcaagacugaaguccaacucauagaguggcucugaccaaguuaaccccuacauccugaccauacagagcucccgcaguggcacucugaccacggaagaucugcagaaauguagacagacaauaaauuacuacagaugggucacagaaccauccuagcuuuguggcaaagguggguggcacuaagccagauuguggggaugaggaguggagggccaggaaauugccaaaguaacagucuaggcacuugaaauauuauuguuagauuguuaaaaacuaaauaaauuaacauacauagaauaaaauaaauauauaauuuaagaggcauuuacaaacaacaacaacaaaaauaguuguuauuuuuccaucuggguagaagucccaaaauucaguucucaggcuugugguauuucacaguuaacucaucaaauccagcacuggagggucccaauggcagaucccuuggugguacuugaguacauggcuucucaaucuuuguugcuuucuuccaguucacaaaucuuuccuucuugcucuccuucuucuucuucuuuuuuuuuuucagucaaagauccuggagcauauggaauuuaaccggcauucuaauccagaagauaaguguuuaaacaaacuuaugaggggaagugggguuugguggaggggaaucagaagggcaugaaggucccuugcuuuugcuuucuucuuacccagauaccaucggacauacucuguuuggcacuugaaggcucugguauuuuggcaaagcaauuaugggaggcccaauccuagacggcaacuggggacgaaggagucuuugugacuagauggaagucuuuccccucugcagucugaaaucaccuugugucuucucagagguagcaguccccagccgauuccuaaagcacaaaaggaaggcauguaaagccagguccagucuaaagaagucuuaagauuuuccugguccagucuuuuuuauuuuuaaacuuuuugagacaggguuucacucugucucccaggggaggagaggggaggggaagggaggggaugagggugggagaagcuguccucucaggcaucucucuuaggugucucucuagcaacuuuuaccuuaagugaagcacugagucuuuuugaaaauaauucugcaaugggauauuaaugucacaguagccuggcccccaaccccuauaugaagaauucagcacccacugaagcacagccaggaaaggggacaaaggauaaucaugucauggggcaaaggauggagcguuaccuugagcacaagucucucucagugggaauuagucaugcccaacuucacuuucucuucauuuuccacaucauaaccuccucuccuaugguaccugaggaagauaaguuuugugaauaagcccugccugcuaugacaaagugcagguccagagcagguccuuccaaagaacucugccauggugguuuccucuacuacuuggaaaagcccaggcaguagggcagcccaaacucuggucaaaggcccaacugccccgaggaacuccugucucuaauagcaggaugcaauuuacaaauagcuuucaccucauuuacgugauccucacaacauccuuaugagguagauggacaaacauuacaaucacuacaagguuacaauccucagaaagacaguaacuuguuccaggucucaugacagaugaguuacacugcuugaaaacaggcauagagcuaggcacgguggcucaugccuguaaucccagcacuuugggaggccgaggcgggcagaucacgaggucaggagaucgagaccauccuggcuaacauggugaaaccccgucucuacuaaaaaauagaaaaaauuagcugggugugguggcgggugccuguagucccagcuacucaggaggcugaggcaggagaauggcgugaacccaggaggcggaguuugcagugagccgagaucacaccacugcacuccagccugggcgacagagcaagacucugucucaaaaaaaaaaaaaaaaaaagaaagaaagaaaacaggcauagagugcuuggugggucucccaagcuagagcauaccuggauuagaaagcagggccugagguccagacgccucagaaguggaaggauauaccacuagcaccacccacaccuugacuaccaaaccacauacuaaugccaucaaagaacagccaggagaaagaaaugugugacaaagugacuccaugaguggguagcugggucauggaggcaggaaaagaacuccugugaggagcagaaccugcuauggccucgcaaauuugacccugggcucuagacacaggacucaugucaugccagaaauaccagguuuuuggagaaucuacaccccggagcuagcccaugauuuggaaagauugagggaagugcaugugaccaucaaggagagggcccaggaggaggaagaaagggagugauuugcagaaacagccugcaggggaccccaacacucaccuaaacaugagaagccccacgaugaccagcagacagacagaugacagcaccacagccaccacggccaggaugguuguguggucauagguauauaagcgauuuuccacugggaggcucagcccaugacaccucucuccaugguaacccggguggcagcuaguucaagacagaacaagaaggagauggaguuagugcuuuggccucucuuggcaauggcccaccugcauaagccaaaccccauuccucauacccucagccugucaaucccugaccacgaucccugcccauccuccauccuucuccucuaguagaaaacucuuuaaagccccucugaaagcucuguagcauuccucucucacuugacacccuccccuuuuccauuuccucugguucucugggcugagaauccuguucuaggcauggaaaaagcaagggaggacuugaaggccucagcuagauauguuccacguguggcugauuuaugacauguguguucaggcguucuguuuaagccacuuaugagggcuugggcacaagagcugguaggcuaaauugagggaauucguaucacucccuccagugaggccccucaacauucugacccagaaauaaacccagccuuccccaucgugcuuccagcguccagucccucuccacugcuguccagccuauuaauaggcccugugccucugccaggagucguuuuucucaaguuuccuucauuuaacuccagcucccccugggugcagggcccaacuugggagcucaacucuggccuuuggccucugcacgcugagcuaccaggccucuuucaucacaggacaaaccaaacaaaucaagaaacaucuuucugcccagcugcccugccagagcauggaagacugucagaaacaaucccuuggcucuucucacucaagaaauaaaucacauggcaacugccuuuucuuuuucuuuuucuuuuuuuuuuuuuuuuuuugagacagagucuugcucugucucccaggcuggagugcaguggcgcaaucuuggcucacugcaaccccuaccuccggauucaagugauucuccugccccagccucccaaguagcugggauuacaggugcccgccaccacgcccagcuaauuuuuguaauuuuuuagaagagacggaguuucaccauguuaacuaggcuggucucaaacuccugaccucaggugauccacccgccucugccucccaaugugcaaggauuacaggcaugagccaccacaccgggcuggcaacugccuuuucuaacacaaagcauuuccuugaagcucuuagaaagacucagacgugcuuacaguugaagaagcacauucacauccuuuccuuuaucugagcaucccagagauccuuugauauaaguaggagcccuguuuuacagaaagguggagugguuuucccaaggucacacaguaagacagaaaugaagauguagauguagauugucugacucugagcucagugugcugcccacucacaccugacaacugccuaccauccagccagggggcacaguggcacugucugccugaggacuuuagaccaccagcugcugaaggaagcaccaagaaccugguggcccucuuuucugagcugugcuuucucugggaaggaggugcuuucucugguaccucagaacaaggaaucccuucuuccugcggacagagcaccagggaagcuccaagagacagacuuguccacaaccagcaguggcagaggggccaggcugggugguacugcauucuugcuuuccugcccugagccucucccugcccuaguuccuccuggguacuucgagaaaccaccucacagcaggauaaauguaggucaggcccacuauacguauagcacaguccacaguuccuugcccagccucuccauguaucugucccaucagcccauguaggccuaaaagcgaccccuauccugccaggacauagaggacacuugcacaagcaccccuggaaaaucacuugugcacagcaguuuaccauucacaagccacuagccuuaucuacuagcucaacugagccuccuaacauucugguaggcagguacaaccccauauuacagauggaaaagcuaagauuaagggucagagaaauuaagugauucaccaaaaguggcacaacuaggaagcagcagggcuaagacuaggaacaagucuuggcagauuccaaauucaucauuccuuccacuuugaacaaugcaggauagcgcagguaacuccaaggaagcauaucugauaggcuccuggggggcagucugacccuucucucugacuauguuauuauuauuuauuacucauaacuugaauaauaaagaauaauaauuagcaaucauugaaggcuuaccaugagccaaguacuuugugcuaacugcuuuacaagaauuauuucauuuaaagccagcucugugaaggagaaguuacuagccccauuuuaaagauggacugaggcuuagcuuuuguuaaacaccucgcccaagguuacaaagcuagugagucguagagccaggauucaacagcagucuggaugacuucagagacuuugcuuuccugggaggagggaagcugaaguugagucuguuuuucacuuccaguccaucauucaaacuccacagguaguuacucagaagauagaaauaaaguuuggccucagagucccgcaauucaguuacauaaucccuccacccccacccugagucaaaaggauaauaauguaaacauccuaauauuaccuaccucccccucccuuugcagacaacuccuggcuuccccagagaaggaggggggaugaguacauuccaagcaucccaggguaggggcaaaauuuugugucuuguccagagccagccacccaccagacuaggacacauucuucccacccacgucugugacccauuucagaacuuguauuacaacagaugcaagaacccucuaggguccagagacaucuuccaaacuggauuucuccaccuuuaccccaggagguggaggggacacgucuggauggaggagacugagugcaugaguuccagacugguucugcugcuauuucuagccagguaauuuugggcaagucacguuaccuuucuaaacauugguuuccucauguaaaacacagggauaagaaaugccuacuucacuagaguauugugaaaagauaaaaugagguaauacaaaugaaagggcuuuauaaaggccaagucccacauugugugaguuauuacauaaucagacuccagagguuacugcccauggccugaggaauggggcacccaagucagauggagacaagagaagcgggaucaccauuccuucuuagcaccugggcagugaggccaaguagagcccccuagccugucucuccuccagcucugaguccuccucagcccaaguguccccaguuuuccuccagccacaggaaacucugcagccaauuucuggguaggcaacuagucaggaaucccaggaaacuacucuuuuauuuauuuauuauuauuauuuuuuugagauggaguuuugcucuuguugccuaggcuggagugcaauggcacuaucucggcucacugcaaguucugccuccuggguuugagagauucuccugccucagccucucuaguagcugagauuacaggcgcccgccacaacacccagcuaauuuuuguauuuuuaguagagacggggguuucucuauguuggccaggcuggucucgaacuccugaccucaggcgacccacgugccucggccucccaaagugcugugauuacaggugugagccacugugcccagcagaaacuacucuuugagggcaacuuuuggcuggugacacaaaaaggguuuuccuguucaugguggcugcagagggcuaguuuaggaagccagcuagccucaggcucaccacagcagccuggacacacccuggcuagugguuccugggucuggagucaaacaagagccacaaagauccccagaugaacgugcacagaugucacauucccccaaaccaggauuucugucuucuugcugcuuucugcccugaguagcaagggcaggaggcaguagggggccaguccagacaugcaaucaacccccugaaaaucugcccaggaagugguggcccacgccuguaaucccagcacuuugggaguccaaggcaggcugauuacuugagguuaggaguucaagaccagccuggccaacauggugaaaccccaucuccacaaaaauuuaaaaauuagccagaugugggggcaugugccuguaauaccagcugcucaggaggcugaagcaggaaaaucacuuuaaucugggaggcggaggcugcagagagccgagauugugucacugcacuccagccugggugacagagcgagauuccaucucaaaaaaaaaaaaggcuagauaugguggcucaugccuguaaucccagcacuuugggaggcugaggcaggcggaucaccugaggucaagaguucaagaccagccuggccaacacggcaaaacuacgucucuacuaaaaauauaaaaauuauuaauucggcaugguggcaggugccuguagucccagccacuuaggaggcugaggcaggagaauugcuugaacccaggaggcagagguugcagugagcugagaucacaccacugcaccccagcaugggagacagagugagacucugucucaaaaaaaaaaaaaaaaaaaaaaagaaagaaagaaagaaaagaacaaagaaaaagaaaauucugcccaagaaguuaauguaaaguuuucaaaucagauugcugugcuguuagacuaguaaaagaauaagagaccucuaggacaacagcugcccucugcccucuauaaaaugcugcuccaacucuauaaggacagauacaggaaagaaagaugaaagccaacacccaguacagcuugagggcaugaaaagcauguuggacuaggagucagguacugagacucugucuuauuuccaacuacuuauuuagcuauugaccucaggcaaauuacuuccuauuuucuggcuccaguuucaucaccuuucaaguagagguaccaaguccugccuacucagcagagggcuuuugaaaaaucccaggaaacuauaucucuccagcuccuaaaguagugucugccaccaaauaggggcucaacauacuugggcucaacucauauuauauauaaacacugaaacucugggacaaaggagauaugacaucauuauaguuaucacuaucccuagggaccacugggaagguggccugggcacccauaucagguucucuggguuuagguggucauccgaguccagcucuccaggagggcaaccuuauaaggccucucaaccacacagugcaagccccacauccauccaccaaaaugcccaggaccaaucugguauagacagauuccugaccucaauccaccuugacuacuugagucaccuucuucacccuguacuaaugaugccauuuuacaaauuuaagaugaacauuucccacccugucccaagaccuugggaaggauaauaugggggcuuucuaugccacucuuaaacaacucccucuaauaccaagcuccugacaaggauguuauaggaaaggaugcacaagugacuguggacaugguggggagugaugggucugucugccaacugccaaauacagggcagcucugcugugugugaucagacaaaacaaggaagcuuuaaaaagcuaagggaucugcaccaaucaccaguagaagggaugccaggcacgccgccuucuugacaggcuggaggcagugugcauacaacagucucuuggcccuguccagagucucccacuaaggcccccagagccucccuccccacagggaagggaauggauguuugcagccugacgcaggguguuggccucaggcacaguggcaacauuaugccugccagagagcauggcagugcugucaucccugagggguugccaaggcagccguuugcuggguuuggcuuaggagagaggcuaaggaacccacagccccuccacccacacaccuacccagggaaggggugauguugccugaccgggggcugaugccuaaugggucagguuccauuuccugugaacccugcacaaaggaauuguucucucacaacguggccaaaggccaguacucuccaugucucccaccuccucguccuugcugggauaaggaagaagaaagagaggccucaaccugccgccaugaugaucccucucuguacaguccugccaugccucacagucaauccacauuugcacacuuacaugcacauaaacccaaauacacacauaccuauacaucaugcauccaaaugcacuuccuaccuucccacaggagcucuacucugcccuggaagcccacucugccauguuuccuacuggcuucucccucccagaguagggcaucaggcaagaauuaagggccugccuucaggugccagcuguccuagccacaugcucauuucugggcaagcaggaaauguccccaaggauuaaagcacgucacaaaaccauaccacaggaaauugcauccuauaggggggagggggcuuccgcugacuaaaaauauauuuccccuccucccaacuuccgcccagagguugagaagaaacugggugaaauuaugaauucaaggaacagugacaacgaggaacagccacguggcugacaaagugugcugaugagauucagcccuggggaaggggcacuuacaugcaggagggagcccggagcuccuucacauauuugcauucuccauggaugcagaaguccuuguauuuccgaagacaugggucccucuucuucccuagccccuugccuuucuucuuucuuuucccgugcuccuccuuguuugguguggccagugcuuguggcuuggaggauaaagugacuguaggagaaaagcacucuguuaaagucugacucuuugggaagaaaaucagaagagcauagugcuugaaaggaguauauaugcuuugauuccaccugaagucagagaucugggaaggccccuuagcucagugccuccuaagaggcagaaggaagagcaggaagauugggcagaaccaccagaaagagggaaccucgguaggaaguagaagcuagggugggucccaaggaaggcauuucacagucucuguguaagagccucauucucagaaugcuuuuguugaguaacugggcaauucuaccaaccucaccuccaccccacuguccaccuuacacccccaucuccuacucccccacacccacuucauucuauuuuggccuucaaucagccucauuuccugaugcuguacucagugaaccacuugcagaaagacagugucacacacaaaaauugcuucuagagaagguacuuggagguucugggguuggagggcuccuaauauaagaacaguguccauguguucagguggucucuucuggggcaccccuuaguacuaugagcccagggcagagccuggcucaggaacagcaagcaggccagcccuggucacggccuugcuuuuucaacuucaagcaaaauauuuaacuugcauacccuuuacagcucacccacuuucucaaagauucauucauauuuaacccccaauguccuguuuauagcucucuggauugggggguacaggguguacaagggauagaaaaauggaaaguaaggaacuguccagaaggaacuggaacaaugaugacucccuccuucuuuccaugcuucagagagacugggggaaaaacagccucacccagauauccagcugggauugaccagggacuaugccuaucagcccaaucccacccuuuuaucccccaucaggaaaaaggugcccacauccauggcuacagccaugugucuuacagaaggguaagcaugauacguuagacuagagacuuagagucucaagcuagagggacuucaaagaauaccauguggccaggcacgguggcucacgccuguaaucccaacacuuugggaggcugaggcagguggaucaccugaggucgggaguucgagaccagccuugccaacauggcaaaaaucucaucucuacaaaaaauacaaaaauuagccgggcgugguggugugugccuguuaucgcagcuacucaggaggcugaggcaggagaaucacuugaaccugggaggcagagauugcagugagcugagaucgugccauugcacuccagccugggugacagagugagacuauguuuaaaaaaaaaaaaaagaaaaaaagaaaaaacucauggcaggcagagugacuuacucaaggucaugcaggauugggauuagaacuguguucucuggacuucacuccaauguccuuccucaccacaccaagcugccucacacacucccaucuccucccucucacaagucuagagcaccugagaugcugauccaggcaugaaugggcucugaaguccauagaccugugcuccaauuucagcuauuuacugugggcagucacuuaacuccucugaaccucagguucucaguaaaauguggauagccaaaguaacuaucucaaaagguugcuauaaguguuacauuagccaggauaacauaucaagugccuagaacacaguaggaauuuaauaaaugguagcagucauuuauuuuaggugguaggauccccagaccugaaaaauaguccuugcccagcaaagccaaaagaagggaagagaaguaggugccagcagcccccacagucuuucauuuccucucauccagucccaggcccccucagagcucagaaggugauacagguggucagaggaacccagugaccagagcuucggggagagcaaggcaggggggccaagccaaucagaaaggggagggagaaggugcagggugacagccaggcuccugccauggacagggagcagugagucaggucugcagagguaagaggagcagccgugugggugggggguggggguggggugagucacagcccagcccugcccagccuaggaggagagggccaggagaauccaggcuguucaggucaugggcaaccccagagggccacugggagaggaugaaguaugggagcccaggcucaguuuuggaguaugugcuugauuuauacaaaguagagagaguauccaaggaaagcuccugggaaugagggagaagggcagcugaggagcagguggaacuagaacaggugggcaucuguccaaccaaauauagucauuccaggguacagugcugaguccuugcucuacucuggauaaucuccucagguuuggaggcaggagagcuggcaggcucuggacucugcccuguaccuguacuuggccacagccaaagaggcugguuggaggauccuacacagcccuccccauuuggagucuccucaggaaugcaaggugcucaguaagcugcagguuuccgguagcauucacagauauccagcauuuuaauacagcccccuaggggcucagugcucaccauucacagccucaucuagggcggccaagagcuccucauuccccucuguuuccccaaucuggagacagguggauggaggaggccaacacugcacacuuucuagagaugugccugggcaucuccgcauguguuaccucuauuuuauauauaauagucauuugauaugggaauuagaacuggcgcccauuuuuacauaguagcucuagggaaagcaucucaaccauuccuuguuccuaucacccagcuuaccuaagaagaacguaacaaccccagacaacacgucugauucaauuugccccggaguacccagaagggcagcaacccagcaggugaggcaaugacaagagagagagagugggaccuauauuccaggaucccccagugcccaucaggccgaucagcuuuuccccgagguucuccaugaauacccucaacccacaguauugcccaaacagcaagaaucuuggaucugcuuauucuucaacagcccaccaagguccaaggauggggggccuccacacccaccucucaaaagguccagaucugccucuugcaagucacggacuuuccggucccggccgccuccuagggguagcagcugguccguggauacagugggaggguccggguugcugguuccagcagcuagcccucuccgaagccgcuccaggcucucgccagucaccagugccgagagaacugcgggcgagaggccaggccgcaucagacacccgcccagaccccugaccaacacgcaccgaugccgacgcccguccgccagagcgcaagggccccaccaaguggcccgugccgggugcgcugcggcgaccuucccccaugcccccagcacaacgcccccauccccccgaucuccgggggcgucggcagcccucuuaccugcagccagaaagagcuucagcaccaccgacggcagcagcuucauggucccgcaccgagaggaggcggcgaggcaccagucacuuucgaagcggcggccacugggcgcuggcaccagagcugggcggcggagcucaggagauuccgccgggcaccgucugccgcccgccucugcgugcaagccuggccgggacccaggcgcagcucgcucuucuugagugucuugucuugcucacucagcccgcccgcgcggccgcccgaccccgcgcgccuaggucaggccagccagcagcguggcccgcguagcuccuucggccgaaugagcgcugcccggcucgcggccgggaaua

SEQ ID NO: 18518 - RNA, 13788 nt, Homo sapiens
uauucccggccgcgagccgggcagcgcucauucggccgaaggagcuacgcgggccacgcugcuggcuggccugaccuaggcgcgcggggucgggcggccgcgcgggcgggcugagugagcaagacaagacacucaagaagagcgagcugcgccugggucccggccaggcuugcacgcagaggcgggcggcagacggugcccggcggaaucuccugagcuccgccgcccagcucuggugccagcgcccaguggccgccgcuucgaaagugacuggugccucgccgccuccucucggugcgggaccaugaagcugcugccgucgguggugcugaagcucuuucuggcugcagguaagagggcugccgacgcccccggagaucggggggaugggggcguugugcugggggcaugggggaaggucgccgcagcgcacccggcacgggccacuugguggggcccuugcgcucuggcggacgggcgucggcaucggugcguguuggucaggggucugggcgggugucugaugcggccuggccucucgcccgcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagguggguguggaggccccccauccuuggaccuuggugggcuguugaagaauaagcagauccaagauucuugcuguuugggcaauacuguggguugaggguauucauggagaaccucggggaaaagcugaucggccugaugggcacugggggauccuggaauauaggucccacucucucucucuugucauugccucaccugcuggguugcugcccuucuggguacuccggggcaaauugaaucagacguguugucugggguuguuacguucuucuuagguaagcugggugauaggaacaaggaaugguugagaugcuuucccuagagcuacuauguaaaaaugggcgccaguucuaauucccauaucaaaugacuauuauauauaaaauagagguaacacaugcggagaugcccaggcacaucucuagaaagugugcaguguuggccuccuccauccaccugucuccagauuggggaaacagaggggaaugaggagcucuuggccgcccuagaugaggcugugaauggugagcacugagccccuagggggcuguauuaaaaugcuggauaucugugaaugcuaccggaaaccugcagcuuacugagcaccuugcauuccugaggagacuccaaauggggagggcuguguaggauccuccaaccagccucuuuggcuguggccaaguacagguacagggcagaguccagagccugccagcucuccugccuccaaaccugaggagauuauccagaguagagcaaggacucagcacuguacccuggaaugacuauauuugguuggacagaugcccaccuguucuaguuccaccugcuccucagcugcccuucucccucauucccaggagcuuuccuuggauacucucucuacuuuguauaaaucaagcacauacuccaaaacugagccugggcucccauacuucauccucucccaguggcccucugggguugcccaugaccugaacagccuggauucuccuggcccucuccuccuaggcugggcagggcugggcugugacucaccccacccccaccccccacccacacggcugcuccucuuaccucugcagaccugacucacugcucccuguccauggcaggagccuggcugucacccugcaccuucucccuccccuuucugauuggcuuggccccccugccuugcucuccccgaagcucuggucacuggguuccucugaccaccuguaucaccuucugagcucugagggggccugggacuggaugagaggaaaugaaagacugugggggcugcuggcaccuacuucucuucccuucuuuuggcuuugcugggcaaggacuauuuuucaggucuggggauccuaccaccuaaaauaaaugacugcuaccauuuauuaaauuccuacuguguucuaggcacuugauauguuauccuggcuaauguaacacuuauagcaaccuuuugagauaguuacuuuggcuauccacauuuuacugagaaccugagguucagaggaguuaagugacugcccacaguaaauagcugaaauuggagcacaggucuauggacuucagagcccauucaugccuggaucagcaucucaggugcucuagacuugugagagggaggagaugggagugugugaggcagcuugguguggugaggaaggacauuggagugaaguccagagaacacaguucuaaucccaauccugcaugaccuugaguaagucacucugccugccaugaguuuuuucuuuuuuucuuuuuuuuuuuuuuaaacauagucucacucugucacccaggcuggagugcaauggcacgaucucagcucacugcaaucucugccucccagguucaagugauucuccugccucagccuccugaguagcugcgauaacaggcacacaccaccacgcccggcuaauuuuuguauuuuuuguagagaugagauuuuugccauguuggcaaggcuggucucgaacucccgaccucaggugauccaccugccucagccucccaaaguguugggauuacaggcgugagccaccgugccuggccacaugguauucuuugaagucccucuagcuugagacucuaagucucuagucuaacguaucaugcuuacccuucuguaagacacauggcuguagccauggaugugggcaccuuuuuccugaugggggauaaaagggugggauugggcugauaggcauagucccuggucaaucccagcuggauaucugggugaggcuguuuuucccccagucucucugaagcauggaaagaaggagggagucaucauuguuccaguuccuucuggacaguuccuuacuuuccauuuuucuaucccuuguacacccuguaccccccaauccagagagcuauaaacaggacauuggggguuaaauaugaaugaaucuuugagaaagugggugagcuguaaaggguaugcaaguuaaauauuuugcuugaaguugaaaaagcaaggccgugaccagggcuggccugcuugcuguuccugagccaggcucugcccugggcucauaguacuaaggggugccccagaagagaccaccugaacacauggacacuguucuuauauuaggagcccuccaaccccagaaccuccaaguaccuucucuagaagcaauuuuugugugugacacugucuuucugcaagugguucacugaguacagcaucaggaaaugaggcugauugaaggccaaaauagaaugaagugggugugggggaguaggagauggggguguaagguggacagugggguggaggugagguugguagaauugcccaguuacucaacaaaagcauucugagaaugaggcucuuacacagagacugugaaaugccuuccuugggacccacccuagcuucuacuuccuaccgagguucccucuuucuggugguucugcccaaucuuccugcucuuccuucugccucuuaggaggcacugagcuaaggggccuucccagaucucugacuucagguggaaucaaagcauauauacuccuuucaagcacuaugcucuucugauuuucuucccaaagagucagacuuuaacagagugcuuuucuccuacagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcauguaagugccccuuccccagggcugaaucucaucagcacacuuugucagccacguggcuguuccucguugucacuguuccuugaauucauaauuucacccaguuucuucucaaccucugggcggaaguugggaggaggggaaauauauuuuuagucagcggaagcccccuccccccuauaggaugcaauuuccugugguaugguuuugugacgugcuuuaauccuuggggacauuuccugcuugcccagaaaugagcauguggcuaggacagcuggcaccugaaggcaggcccuuaauucuugccugaugcccuacucugggagggagaagccaguaggaaacauggcagagugggcuuccagggcagaguagagcuccugugggaagguaggaagugcauuuggaugcaugauguauagguauguguguauuuggguuuaugugcauguaagugugcaaauguggauugacugugaggcauggcaggacuguacagagagggaucaucauggcggcagguugaggccucucuuucuucuuccuuaucccagcaaggacgaggaggugggagacauggagaguacuggccuuuggccacguugugagagaacaauuccuuugugcaggguucacaggaaauggaaccugacccauuaggcaucagcccccggucaggcaacaucaccccuucccuggguagguguguggguggaggggcuguggguuccuuagccucucuccuaagccaaacccagcaaacggcugccuuggcaaccccucagggaugacagcacugccaugcucucuggcaggcauaauguugccacugugccugaggccaacacccugcgucaggcugcaaacauccauucccuucccuguggggagggaggcucugggggccuuagugggagacucuggacagggccaagagacuguuguaugcacacugccuccagccugucaagaaggcggcgugccuggcaucccuucuacuggugauuggugcagaucccuuagcuuuuuaaagcuuccuuguuuugucugaucacacacagcagagcugcccuguauuuggcaguuggcagacagacccaucacuccccaccauguccacagucacuugugcauccuuuccuauaacauccuugucaggagcuugguauuagagggaguuguuuaagaguggcauagaaagcccccauauuauccuucccaaggucuugggacagggugggaaauguucaucuuaaauuuguaaaauggcaucauuaguacagggugaagaaggugacucaaguagucaagguggauugaggucaggaaucugucuauaccagauugguccugggcauuuugguggauggauguggggcuugcacugugugguugagaggccuuauaagguugcccuccuggagagcuggacucggaugaccaccuaaacccagagaaccugauaugggugcccaggccaccuucccaguggucccuagggauagugauaacuauaaugaugucauaucuccuuugucccagaguuucaguguuuauauauaauaugaguugagcccaaguauguugagccccuauuugguggcagacacuacuuuaggagcuggagagauauaguuuccugggauuuuucaaaagcccucugcugaguaggcaggacuugguaccucuacuugaaaggugaugaaacuggagccagaaaauaggaaguaauuugccugaggucaauagcuaaauaaguaguuggaaauaagacagagucucaguaccugacuccuaguccaacaugcuuuucaugcccucaagcuguacuggguguuggcuuucaucuuucuuuccuguaucuguccuuauagaguuggagcagcauuuuauagagggcagagggcagcuguuguccuagaggucucuuauucuuuuacuagucuaacagcacagcaaucugauuugaaaacuuuacauuaacuucuugggcagaauuuucuuuuucuuuguucuuuucuuucuuucuuucuuuuuuuuuuuuuuuuuuuuuuugagacagagucucacucugucucccaugcuggggugcaguggugugaucucagcucacugcaaccucugccuccuggguucaagcaauucuccugccucagccuccuaaguggcugggacuacaggcaccugccaccaugccgaauuaauaauuuuuauauuuuuaguagagacguaguuuugccguguuggccaggcuggucuugaacucuugaccucaggugauccgccugccucagccucccaaagugcugggauuacaggcaugagccaccauaucuagccuuuuuuuuuuuugagauggaaucucgcucugucacccaggcuggagugcagugacacaaucucggcucucugcagccuccgccucccagauuaaagugauuuuccugcuucagccuccugagcagcugguauuacaggcacaugcccccacaucuggcuaauuuuuaaauuuuuguggagaugggguuucaccauguuggccaggcuggucuugaacuccuaaccucaaguaaucagccugccuuggacucccaaagugcugggauuacaggcgugggccaccacuuccugggcagauuuucaggggguugauugcaugucuggacuggcccccuacugccuccugcccuugcuacucagggcagaaagcagcaagaagacagaaauccugguuugggggaaugugacaucugugcacguucaucuggggaucuuuguggcucuuguuugacuccagacccaggaaccacuagccaggguguguccaggcugcuguggugagccugaggcuagcuggcuuccuaaacuagcccucugcagccaccaugaacaggaaaacccuuuuugugucaccagccaaaaguugcccucaaagaguaguuucugcugggcacaguggcucacaccuguaaucacagcacuuugggaggccgaggcacgugggucgccugaggucaggaguucgagaccagccuggccaacauagagaaacccccgucucuacuaaaaauacaaaaauuagcuggguguuguggcgggcgccuguaaucucagcuacuagagaggcugaggcaggagaaucucucaaacccaggaggcagaacuugcagugagccgagauagugccauugcacuccagccuaggcaacaagagcaaaacuccaucucaaaaaaauaauaauaauaaauaaauaaaagaguaguuuccugggauuccugacuaguugccuacccagaaauuggcugcagaguuuccuguggcuggaggaaaacuggggacacuugggcugaggaggacucagagcuggaggagagacaggcuagggggcucuacuuggccucacugcccaggugcuaagaaggaauggugaucccgcuucucuugucuccaucugacuugggugccccauuccucaggccaugggcaguaaccucuggagucugauuauguaauaacucacacaaugugggacuuggccuuuauaaagcccuuucauuuguauuaccucauuuuaucuuuucacaauacucuagugaaguaggcauuucuuaucccuguguuuuacaugaggaaaccaauguuuagaaagguaacgugacuugcccaaaauuaccuggcuagaaauagcagcagaaccagucuggaacucaugcacucagucuccuccauccagacguguccccuccaccuccugggguaaagguggagaaauccaguuuggaagaugucucuggacccuagaggguucuugcaucuguuguaauacaaguucugaaaugggucacagacgugggugggaagaauguguccuagucugguggguggcuggcucuggacaagacacaaaauuuugccccuacccugggaugcuuggaauguacucauccccccuccuucucuggggaagccaggaguugucugcaaagggagggggagguagguaauauuaggauguuuacauuauuauccuuuugacucaggguggggguggagggauuauguaacugaauugcgggacucugaggccaaacuuuauuucuaucuucugaguaacuaccuguggaguuugaaugauggacuggaagugaaaaacagacucaacuucagcuucccuccucccaggaaagcaaagucucugaagucauccagacugcuguugaauccuggcucuacgacucacuagcuuuguaaccuugggcgagguguuuaacaaaagcuaagccucaguccaucuuuaaaauggggcuaguaacuucuccuucacagagcuggcuuuaaaugaaauaauucuuguaaagcaguuagcacaaaguacuuggcucaugguaagccuucaaugauugcuaauuauuauucuuuauuauucaaguuaugaguaauaaauaauaauaacauagucagagagaagggucagacugccccccaggagccuaucagauaugcuuccuuggaguuaccugcgcuauccugcauuguucaaaguggaaggaaugaugaauuuggaaucugccaagacuuguuccuagucuuagcccugcugcuuccuaguugugccacuuuuggugaaucacuuaauuucucugacccuuaaucuuagcuuuuccaucuguaauaugggguuguaccugccuaccagaauguuaggaggcucaguugagcuaguagauaaggcuaguggcuugugaaugguaaacugcugugcacaagugauuuuccaggggugcuugugcaaguguccucuauguccuggcaggauaggggucgcuuuuaggccuacaugggcugaugggacagauacauggagaggcugggcaaggaacuguggacugugcuauacguauagugggccugaccuacauuuauccugcugugaggugguuucucgaaguacccaggaggaacuagggcagggagaggcucagggcaggaaagcaagaaugcaguaccacccagccuggccccucugccacugcugguuguggacaagucugucucuuggagcuucccuggugcucuguccgcaggaagaagggauuccuuguucugagguaccagagaaagcaccuccuucccagagaaagcacagcucagaaaagagggccaccagguucuuggugcuuccuucagcagcugguggucuaaaguccucaggcagacagugccacugugcccccuggcuggaugguaggcaguugucaggugugagugggcagcacacugagcucagagucagacaaucuacaucuacaucuucauuucugucuuacugugugaccuugggaaaaccacuccaccuuucuguaaaacagggcuccuacuuauaucaaaggaucucugggaugcucagauaaaggaaaggaugugaaugugcuucuucaacuguaagcacgucugagucuuucuaagagcuucaaggaaaugcuuuguguuagaaaaggcaguugccagcccggugugguggcucaugccuguaauccuugcacauugggaggcagaggcggguggaucaccugaggucaggaguuugagaccagccuaguuaacauggugaaacuccgucucuucuaaaaaauuacaaaaauuagcugggcgugguggcgggcaccuguaaucccagcuacuugggaggcuggggcaggagaaucacuugaauccggagguagggguugcagugagccaagauugcgccacugcacuccagccugggagacagagcaagacucugucucaaaaaaaaaaaaaaaaaaagaaaaagaaaaagaaaaggcaguugccaugugauuuauuucuugagugagaagagccaagggauuguuucugacagucuuccaugcucuggcagggcagcugggcagaaagauguuucuugauuuguuugguuuguccugugaugaaagaggccugguagcucagcgugcagaggccaaaggccagaguugagcucccaaguugggcccugcacccagggggagcuggaguuaaaugaaggaaacuugagaaaaacgacuccuggcagaggcacagggccuauuaauaggcuggacagcaguggagagggacuggacgcuggaagcacgauggggaaggcuggguuuauuucugggucagaauguugaggggccucacuggagggagugauacgaauucccucaauuuagccuaccagcucuugugcccaagcccucauaaguggcuuaaacagaacgccugaacacacaugucauaaaucagccacacguggaacauaucuagcugaggccuucaaguccucccuugcuuuuuccaugccuagaacaggauucucagcccagagaaccagaggaaauggaaaaggggagggugucaagugagagaggaaugcuacagagcuuucagaggggcuuuaaagaguuuucuacuagaggagaaggauggaggaugggcagggaucguggucagggauugacaggcugaggguaugaggaaugggguuuggcuuaugcaggugggccauugccaagagaggccaaagcacuaacuccaucuccuucuuguucugucuugaacuagcugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuaggugaguguugggguccccugcaggcuguuucugcaaaucacucccuuucuuccuccuccugggcccucuccuugauggucacaugcacuucccucaaucuuuccaaaucaugggcuagcuccgggguguagauucuccaaaaaccugguauuucuggcaugacaugaguccugugucuagagcccagggucaaauuugcgaggccauagcagguucugcuccucacaggaguucuuuuccugccuccaugacccagcuacccacucauggagucacuuugucacacauuucuuucuccuggcuguucuuugauggcauuaguaugugguuugguagucaagguguggguggugcuagugguauauccuuccacuucugaggcgucuggaccucaggcccugcuuucuaauccagguaugcucuagcuugggagacccaccaagcacucuaugccuguuuucuuucuuucuuuuuuuuuuuuuuuuuuugagacagagucuugcucugucgcccaggcuggagugcaguggugugaucucggcucacugcaaacuccgccuccuggguucacgccauucuccugccucagccuccugaguagcugggacuacaggcacccgccaccacacccagcuaauuuuuucuauuuuuuaguagagacgggguuucaccauguuagccaggauggucucgaucuccugaccucgugaucugcccgccucggccucccaaagugcugggauuacaggcaugagccaccgugccuagcucuaugccuguuuucaagcaguguaacucaucugucaugagaccuggaacaaguuacugucuuucugaggauuguaaccuuguagugauuguaauguuuguccaucuaccucauaaggauguugugaggaucacguaaaugaggugaaagcuauuuguaaauugcauccugcuauuagagacaggaguuccucggggcaguugggccuuugaccagaguuugggcugcccuacugccugggcuuuuccaaguaguagaggaaaccaccauggcagaguucuuuggaaggaccugcucuggaccugcacuuugucauagcaggcagggcuuauucacaaaacuuaucuuccucagguaccauaggagaggagguuaugauguggaaaaugaagagaaagugaaguugggcaugacuaauucccacugagagagacuugugcucaagguaacgcuccauccuuugccccaugacaugauuauccuuuguccccuuuccuggcugugcuucagugggugcugaauucuucauauagggguugggggccaggcuacugugacauuaauaucccauugcagaauuauuuucaaaaagacucagugcuucacuuaagguaaaaguugcuagagagacaccuaagagagaugccugagaggacagcuucucccacccucauccccucccuuccccuccccucuccuccccugggagacagagugaaacccugucucaaaaaguuuaaaaauaaaaaagacuggaccaggaaaaucuuaagacuucuuuagacuggaccuggcuuuacaugccuuccuuuugugcuuuaggaaucggcuggggacugcuaccucugagaagacacaaggugauuucagacugcagaggggaaagacuuccaucuagucacaaagacuccuucguccccaguugccgucuaggauugggccucccauaauugcuuugccaaaauaccagagccuucaagugccaaacagaguauguccgaugguaucuggguaagaagaaagcaaaagcaagggaccuucaugcccuucugauuccccuccaccaaaccccacuuccccucauaaguuuguuuaaacacuuaucuucuggauuagaaugccgguuaaauuccauaugcuccaggaucuuugacugaaaaaaaaaaagaagaagaagaaggagagcaagaaggaaagauuugugaacuggaagaaagcaacaaagauugagaagccauguacucaaguaccaccaagggaucugccauugggacccuccagugcuggauuugaugaguuaacugugaaauaccacaagccugagaacugaauuuugggacuucuacccagauggaaaaauaacaacuauuuuuguuguuguuguuuguaaaugccucuuaaauuauauauuuauuuuauucuauguauguuaauuuauuuaguuuuuaacaaucuaacaauaauauuucaagugccuagacuguuacuuuggcaauuuccuggcccuccacuccucauccccacaaucuggcuuagugccacccaccuuugccacaaagcuaggaugguucugugacccaucuguaguaauuuauugucugucuacauuucugcagaucuuccguggucagagugccacugcgggagcucuguauggucaggauguagggguuaacuuggucagagccacucuaugaguuggacuucagucuugccuaggcgauuuugucuaccauuuguguuuugaaagcccaaggugcugaugucaaaguguaacagauaucagugucuccccguguccucucccugccaagucucagaagagguugggcuuccaugccuguagcuuuccuggucccucacccccauggccccaggcccacagcgugggaacucacuuucccuugugucaagacauuucucuaacuccugccauucuucuggugcuacuccaugcaggggucagugcagcagaggacagucuggagaagguauuagcaaagcaaaaggcugagaaggaacagggaacauuggagcugacuguucuugguaacugauuaccugccaauugcuaccgagaagguuggagguggggaaggcuuuguauaaucccacccaccucaccaaaacgaugaaguuaugcugucaugguccuuucuggaaguuucuggugccauuucugaacuguuacaacuuguauuuccaaaccugguucauauuuauacuuugcaauccaaauaaagauaacccuuauucca

SEQ ID NO: 18519 - RNA, 7090 nt, Homo sapiens
cgccccggaaaugacgcgcugccccgcuggccaagcggaaguggagauggcggagcuguacgugaagccgggugagcgcagccggcgggcuagggcacuagguugucgccccggccuaggcugggggcgguugcggcgcuuaguauggacccucugucucccccagccccaguauaagcuaacaguggaguuccgggcucgcuucacacaucccucgccuccgcaggcaacaaggaacgcggcuggaacgacccgccgcaguucucauacgggcugcagacccaggccggcggacccaggcgcucgcugcuuaccaagagggucgccgcaccccaggauggaucccccagaggugcguggggccccugugcucggagacagacggagaauggggggggggggguguaaggcauaagccuguuuggaaggcuuuuuucucuccccgagggcuccuuaaggagagaaguuuuggggcuccaguaagggucucagagcaggugcuuuuccgagccccuucucugcugcucagguuaauaaaugguguauugauuuaaaaagacuauuuuuucauccuagaugaucuuauccagaccuguggcuuuuaauauaguuuuaauccugaaguuauuuuucuuuguuaaccuauaccucuugccagaaccguauaguggcauauucauuuguccauucugucuucacuuagguauaugauaaucgucagacuucacaguuuuucauucauuuaaucacuguuauuuacugagcacuucuauaagucaggcacuguuugagggcgaacuagacagcagugagaaaaaaaaaaaaaagaucucugcuuucaggaaguccacguugcagcacuggagaugggcugaaagaugaaauaguggugagggugcuacagaaaauaagcggugauguaauaugacuggguaacgaggugucugaggggcugacauuuaagccacacaaagaucauguacaaaagcauuccaagcaaaagaaacagcugcaaaaggaauaaguuuggccaauucagagacugaugaaauacagaguggcuggcuacagcauagugggcuuuguaaagcaggaugaggaauuuguauuuuaaucuacauaaaguuagaagccauugaaaaguuuaaaguagaggagagccaccuuuccccccgagaauuuuccaagccauuaaaugggcugugccguggcccccauaaaggggcucagguuugguucuuucaguggcccuccauucuccacacccuuuuugcuguagaagaaugauacaaggcuugguuucuuaaacucagcaguauugauagguuguggccagauaauucuuugugagggacuuuccugugucuuauguuaaucagcaacucugacuucuacccaaaagaugucaguagcauccacccaguugugauagccaaaaguguuuccagacauuugcccugugggcacuaucuuccuagcuugagaaccagggacugauuuacauuuuggaaagaucacugugucugcugugugaaaacaagauuuuagggaaguggaaagacaaauuacagcuauuaugguaauauaggcaagauuuaaugauuugcauaagggugggagucagggugguaggaguuggauggauaugagauggagaaggucaguaggaaugaguagauuaggaagaauccauauaacugaauuuuuuugcuugauauaggaagacuggggauggugguuuuggggagggggaguuuuuuuggggggccaugugaaguuuaggcuguuacuuuuggggaauguucuaggccagaauuagagaaauaagucaccauuacaaggaugguauuugaugucaugggcuugaauauggccagggacagagccguagggcacucuagcauuucaagguugagaaggaaucagcaaaggagauugggaaauggccaaagaagaaaaaaggagaggccaggcgcagugagucacggcuguaaucccagcacauggggaggccaaggugggcagaucaccugagaucagaaguucaagaccagccuggccaacauggcgaaacgcugucucuacuaaaaauacaaaaauuagcugggccuguaauaccagcuacuugggagggugagacaggagaaucgcuugaaccugggaggcggagguugcagugagccgacaucgcaccacugcacuccagccugggcgacagagugauauucugugacaaaaccaaaauaaaaaaagaaaauaggagagcguaaagacaugaaucaauaguaaugaaugcugcugagacaucaagauagagacaaggggccaggcgcaguggcucacgccuguaauuccagcacuuuggaggccaaggcggguggaucacgaggucaggaguucaagaccagccuggccaacgugguaaaacccugucucuacuaaaaauacaaaaaauagccagguguaguggcgggcaccugaaaucccagcuacucgggaggcugaggcaggagaaucauuugaaccugggagguggagccugcagugagccgagaucgcaccauugcacuccagccugggacuccaucucaauaaaaaaaaaaagagcgacaaggaaccaguagauuugacaaacauagcagucacucgugaucauaacaagagcaagucucugcaguagugagaacagaaacagcuggaaugggcugaggagagaaugugaaaaguagagagagugacuauaaagagcucacucaaaugcugcugcagagauaagaaaugggacaguaucugaaaauggaacaugaaguaagggaguguuuugauaguaauauacuagagcauguuuguacacuaacgggaugauucaguagagagggggagcugaugaugcaagagaagauaguuacaguagggaagucuagagaagacaagagaggcuaggaugcagaguacagcugguaagauggcuuuugauaggagcaggaaccuuuucaucuauuacaagaggaagaaaaguggccacagaugcagguggguuaggaggaaugguggugggaagaugagagaguucuguuuaaugaccucuacuuuucaaugaaacauuaggcagugucagaagaagauagcaaggaaaggaagagaaguucugaagaguggaaaaaaugagccaaaauguccaggcaguauuugguaccuuuuaaaaucuguggccaugaauuuaaacuaucagcauggcucuguuuucccucccaagugcaagcaaguuggguuuaaccaggaaagugggacaaugggaggagauaaaggagguaaaaauauuuauaagggggugauguuaauguacauugaaaucaaaguagcugagcuggaagggguaagggggugaucagauuuuggaggugauagugugaacaaggcagggggaugacaggcugauguagggugggaaaaaaugaucacuggaggugaagaggucaacugaaacaccaaauuauuagaugaauuaaucauccuuguggauguugguaccuaaaaguaaacuuuugacuuuugucuuccagucuucuuucuguuagugguucccauuacuaagucagaaacuacgagucaccuugacuucucucuuccucacucucaauccacuccuguugcuacuuccuccuaaguaaaucucagacuacuccauuccccucgucuacucuuuuacccuaguccaugccagcauuaucucuuuccugaacuacucaaccucucaacugguguuccugccaccacuguugaccuguuuucaucaguuuuucacagagcauacauguuuaaaaauaagucuggucacaucaccccuugcuuuuacaaaccugcaguggcuucccaguaccauugacucaagaucaaacucuuccaaagccccacagggucuggacccucugcuuaccucucuaaugauagcucauacuacuuucuucagugguaauaauuuuuagccauacaggccucauuacugucucuugaacaaaucaaaaguuuuccugcuucuugggcacugcucuaaccucgaccuaguacauguuccuucaacucuucauagcugcaucuaucucauccgguaguucucaauuuaauaaaaacagcucauuuuguacuuuuugcuacauacuagucuagcagcugucuuuuuuuuuuuuuuuuaagagggucuuaguaugcugcucaggcugcucucaaacuccugggcucaagcgauccuccugccucugccucccagugugcugggauuagaggcaugugucaccacacucagccuguaccuguauuccuaaucuucauugcaaccuugugaaauaaguggcauuauauucauccccauuuuacagaagaggaaccuaagcucuaguugaaaguaacuugcugaaagucacauagcaagugagcucagauaaacuuaaauguaccucagaaggccuuccuugaacacuuagucuagauagguucucccauuucucuuuauugcauaaaccauuuuauuucuugguagcauguaacauaauuuaguaauuuuguguuuuuuucccugccucuagaauuaagcucucugaggucaggaacuuaaucugucugguuuacuuccuccugaguagccaggacuauaggugugugccaccacacuugacuaacuuuuaaaauuuuuuuauagagaugaggucucacuauauugcguaggcugguuuugaacuccugagcucaggugaucuuccuaccuuggccucucaaaguguuaguauuacaggcauaagccacugugcccaggccugguuuacuuuucuuuucuuuuuuuuuuuuuuugagacagaguuucacucuuguugcccaggcuggagugcaauggcaccaucucagcucaccacaaccucugccucccggguucaagcgauucuccugccucagccuccugaguagcugggauuacaggcaugugccaccaugcccagcuaauuuuuguauuuuuaguagagacaggguuuugccauguuggccaggcuggucuugaacuccugaccucaggugaucugucugccucagccucccaaagugcugggauuacaggugugagccaucacacccggccaccugguuuacuuuucuaaucuuuagugccuagcauauugucuggcguagaguggggacuucauaaaugcauauuuuugaaugaauaaguugucucagagaguagcccuucuuagaaggggugaauuuagaguuaagcuucuuacccauuuaagccauguugcuugauccugcuguaccuuuucaguccccgcaucagagacuucuccugggccucccccaauggggccuccaccuccuucaaguaaggcucccagguccccaccuguggggagugguccugccucuggcguggagcccacaaguuucccagucgagucugaggcugugauggaggaugugcugagaccuuuggaacaggcauuggaagacugccguggccacacaaggguaagcucuggcacaucagagguuagagagggcucccauccacagccaaaugcaggaaugguucccagagauagacccucugacccaguggacagguucuuaauccuuugagaguuacggacuccuucagaaucugcuaaggccuucccaaagaaaugaacacaggauuucaggagcauuaauaagacuuuugaagaccaaucaguagaagaugcugugggaacaagaguugaauucagcuccuauuagugaacaaccugauuuucuguaucuccaugccauucagagcagaagcugcugauuuuauucucaggaaauuuauauugugcccaguuagggagaaagaaaccucuucuagcuauaguguuuucuuaguucuuagaaaaagagaucugaagaaugucuuaaaagaaagggaaaguagcauggucauuucaccucuuuggcgcuuaguuuucuuuuugugaaguaacgcuacaggaugagcuucugagagucugagaagccccugaaauuuuagaauucuagucauaguaggagguggguuaggaagacugguggugggaagaugagagaauuccuguuuaaugaccucuacuuuucaaugaaacaucaggcagugucagaagaagacagcagggaaaggaagguuucaucaguuucucaguggggccucuaaucuuuggguaaagaaccagaauucuaaagugugggccagagaaagcaggugcuuccuauguggugcugucuuccccucuccuccccucauugggcuggcagcacugaauuggaggggggcuucugucucuuagaagcagguaugugaugacaucagccgacgccuggcacugcugcaggaacagugggcuggaggaaaguugucaauaccuguaaagaagagaauggcucuacuggugcaagguauggguggguucuuugguauagccuaaaucccuuuccugcugugguuggcuaugcuggagcaggugcugagauuuugauugacugggaggggaggcauggaagcucuuguaccacaggcugcuugcucaacccccgucucucuucagagcuuucaagccaccggugggacgcagcagaugacauccaccgcucccucaugguugaccaugugacugaggucagucaguggaugguaggaguuaaaagauuaauugcagaaaagaggagucuguuuucagaggaggcagccaaugaagagaaaucugcagccacagcugagaagaaccauaccauaccaggcuuccagcaggcuucauaauccucgguuccccagacucaccggacaccaucuccuaugccuuggagaccuucugucacuuggcucccuucuuaccaccaccaagacugucccacugggccugacccaccuaugagggaagaagucccaccugggccagagggaguucauguguuacucauaacaugcauuucaauaaaaacaucucugcggugggccuuggguaggagagaugaacccuuccggugccaagcuaguccccucugguguccucgacugcccugcucccuguguaucugcaaaccucuguuc

SEQ ID NO: 18520 - RNA, 1970 nt, Homo sapiens
cacagaacccuagaugcccugcagaauccuuccuguuacggucccccucccugaaacauccuucauugcaauauuuccaggaaaggaagggggcuggcucggaggaagagagguggggaggugaucaggguucacagaggagggaacugaaugacaucccaggauuacauaaacugucagaggcagccgaagaguucacaagugugaagccuggaagccggcgggugccgcuguguaggaaagaagcuaaagcacuuccagagccuguccggagcucagagguucggaagacuuaucgaccauggugaguguagggucuuggggucgaacgcgugccacucgggagccacagggguuggauggggccuccuagaccucugcucucuccccaggagcgcgcguccugcuuguugcugcugcugcugccgcuggugcacgucucugcgaccacgccagaaccuugugagcuggacgaugaagauuuccgcugcgucugcaacuucuccgaaccucagcccgacugguccgaagccuuccagugugugucugcaguagagguggagauccaugccggcggucucaaccuagagccguuucuaaagcgcgucgaugcggacgccgacccgcggcaguaugcugacacggucaaggcucuccgcgugcggcggcucacagugggagccgcacagguuccugcucagcuacugguaggcgcccugcgugugcuagcguacucccgccucaaggaacugacgcucgaggaccuaaagauaaccggcaccaugccuccgcugccucuggaagccacaggacuugcacuuuccagcuugcgccuacgcaacgugucgugggcgacagggcguucuuggcucgccgagcugcagcaguggcucaagccaggccucaagguacugagcauugcccaagcacacucgccugccuuuuccugcgaacagguucgcgccuucccggcccuuaccagccuagaccugucugacaauccuggacugggcgaacgcggacugauggcggcucucuguccccacaaguucccggccauccagaaucuagcgcugcgcaacacaggaauggagacgcccacaggcgugugcgccgcacuggcggcggcaggugugcagccccacagccuagaccucagccacaacucgcugcgcgccaccguaaacccuagcgcuccgagaugcaugugguccagcgcccugaacucccucaaucugucguucgcugggcuggaacaggugccuaaaggacugccagccaagcucagagugcucgaucucagcugcaacagacugaacagggcgccgcagccugacgagcugcccgagguggauaaccugacacuggacgggaaucccuuccuggucccuggaacugcccucccccacgagggcucaaugaacuccggcguggucccagccugugcacguucgacccugucggugggggugucgggaacccuggugcugcuccaaggggcccggggcuuugccuaagauccaagacagaauaaugaauggacucaaacugccuuggcuucaggggagucccgucaggacguugaggacuuuucgaccaauucaacccuuugccccaccuuuauuaaaaucuuaaacaacggguccgugucauucauuuaacagaccuuuauuggaugucugcuaugugcugggcacagugcuggauggggaauucaucauacuuaggcuuucuucauccuaacucccuaagaaacccuaucuguccuccucaagaaaagaacugcggggauagaaggagccaggaaaggacuccuggcuagggcugcaugggagaaacaaugagugugcagucagggcuuucugagcagauuauuggcaucuggauuaaaagguauuugcaugauauuuggaagauacaaaauauuuccucuccuaugcacuucccaagagccagcugcucccuuucaa

SEQ ID NO: 18521 - RNA, 6077 nt, Homo sapiens
cuuagcaugaaucuucuuuauuguccugauuuguccucuuuguugguuuuuauuuguggggaagggcagcugagccaaaggggucagaaauucugcccuuugccuccaccacauggcauucugguuuugguuucuguauaguuuugggucuuucuaugcugguuguauuuauauuaaaccccugguuaguauauacuugugucugugcugucuugcccuagcuuagaguuuguuuacacugguagagugaauagcugcuacggggcaaguacuuccucacaucagugcuuugagugcaucuucuuguguugcacuguaggguauuauaaauucauauccaggccggguguguuggcuuuugccuguaaucccagcacuuugggaggcugaggcggguggaucaccugaggucaggaguucgagaccagccuggccagcauggagaaaccccgucucuacugaaaauacaaaaauuagccuggcaugguggcagacaccuguaaucccagcuacuugggaggcugaggcaggagaauugcuugaacccgggaggcggagguugcagugagccaagaucacgccauugcacuccagcccuggcaacaagagcgaaacccugucucaaaaaaaaaaaaaaaaaaaauuucauauccagccaggcacaguggcucaugccuguaaucccagcauuuugggaggccaaggcaggaggaucacuugagcccaggaguuccaagaccagcuuggucaacauagugaaaccccuggucucuaccaaaaaaaaaucacaaaaauuagucaagcaugguggcagaugccuguuaagucucagcuaccaggcaggcugagguggaucacuugagcccaggaagucaaggaugcagugagccaugaucaacccacuguacuccagccugggugacagagugagaccuugucucaaaaaauauaaauuuuuuuggccaggugugguggcucgugccuguaaucccagcacuuugggaagcagaggcagguggaucauuugaguccaggaguugaagaccagccugggcaaaacagacccguuucuaccaaaaaaaaaaaacaaaaauuggccuggugugguagugcacaccuguagucccagcugcuccagaggcuaagguggaaggacaaucugagccuggggacauugaggcugcagugagccaagaucaagccagcgcacuccagccuggacgauggcaaaacccugucuuuucaaaaaauaauucauauccucucuggggaugcagcccaauaagcaagacucuugccuggugaggacccgucucaagauucaauucauuccuucagucacugucauccccagucuccuccuuuucuuccugagccauggagucuucucccucuucccucaguccugcgaagaagucaucggugcuccaagucuugcugcucagagcccgcagugguccucccuuuuuuuugcgccgacgguagucauccaccaccacagcucgcagcugggccaugucccaaaacuugaggcgcuggucauggccacuacuggccaggaagcggccacagugggagagggccagcuccuccacaggcuccccagugugcuggcccacacugcccaccacucgguucgguaggauguucacagcccugggcagggaaagaacaguguugaguacuggcuagcugggucugcccuuccugugaccuaagggcuguccaggcuucccucaccugaugacuccaucaguggagccaguacacagcagacucucggugacuggaaccaugcagucgauagauucagcucucagggcaaagcggucacuuguggccccaaagccauuccaauugaagagguagaugguaccuucacuggagccacaggcuaccuucuucccccacugcagggaaauagagaaaacaauguggaagcugccucagacuaagcccccagcacacaccccuccaucccaccauaaccagcuguacuuucaugagagugacagaggucagguccccagacugagguucugagagcagcucaaaccgacgccucuuaauguugaagaugccaaggcagccauccccgcuguagagaguagagcaguaggcuuagacgcaaggucuauuugaggaagacauuucacacagggaggggaggggaggcaaggcagcuuugaaguuguaccuggcugucagcagcagcuuuuuggcuggauccagagccaugucugcgauguacucuucauguugccucauauccauuaaggggcccuccuuccgcuggucccagagacagauaccaccugugucauccccaguggccagaacauucucauccaccagcagaagacuauugaugggggcacuagagacacagauguagaacuucuuggagcaucucugucccaguggggaccuccugguccuuacccuucaccuccaugcacauacacagaauuggcugcucuccuuacccaugagccuuggaaacacgucuuuccaguuggcccugcuccacaucuagaacauggauggcuuuguccuuggagacaguaaugagcucuggggaaaaggugcccaggucauggugcugcucacugcucccuuccaccacauugcugguugucuuccccaguacucacucugcccaucuucagagaaggccacagcucggcaggccuugagauggugaccugaugaccagagcuccuugguuucucccucuuggcaagaguaggaaaagcuggggagagggcaaggaggguaaaugacuccagacccagccuggguugcauugagugcagagaccaacuagacagagcagccuucccaccuaccuaagaguuccugcuucuacaccucuaagcccaaaaaguuuaccaucucauuucuccauuuucagugaguuugaaauguuagguccugcuuuuuucaauauauguuaguucaagguauauuugcgcaagauuucuuugugaucccacccaaccccucuuuaucaucuuugaaagccccagccuggacaaagauugggucuggaccacuguggaggagauauuuguuacaucaaugacaaaagaccagccccagaaguuagaaaucuaaaaaucaguaagguagagcaggcucuugcacuucaggucugcaggagcuagagaaagccacaauuaauuacaguacauugagaguacgugcugaaaaagaggcaagaucaaaauggaggugggggagaggcaccagccuguaaacaacuuugaggugaguacuguuuauggaauacccccaagugccugccucagagcagauccucaaaaagggcagaaugaauacaugcuuaauugccagugaguuccagguaggcagaacugagccugcucauuuucucuaucccagugcugaacgugaaaaaguagcuuaauaaacauucacaaauugaaugaauacuugggaagggagaagagagcccuggaaagcuaagguggugacauguggguuggaucauacaagaguagaauuugccuggcagagagcaagggccagauacuggaggcagcagagauaaggaaugaggaggguuccuuguagcaggagaguagcaugacugaaucuagaaagaugggcuggggugggcaugagaccacaugagccaagcagaaguuugaauuuaauccucggaaaaggaaccuuuucacaauagucauggcugaggguggggaaggggagaaccaagaauuuuccuccagaaccuuuuuuaagacaagggaagcaacaaaguuguguggaaugugaagaaagguggaugucuagggcaacucccaagugccuggcaccauaaauauggauaguaguagaagggaaccuacauuuguugaagagcugcuuaggugcuguacugcaaacuuguccccucugcaaggguagguauaauucccccuuucaaagaugaaaauacagaaguuaacacgcucaaggccauuacagcuaaugagggguugagguuuaaauucauuaaguaaaucugauaagcauaacaucuucaacuuuuccacugccucuaaccuguaucuuuuguucaaaaucaaacauguguugagcaucuacccuagacuagagguuggagauaaaauagagaacaaaaccgaugacagauuacacuccagaacaguguuuuuucacauucuagucauauaacggacuaguaagcuacgaucagcauuuuguguacauguacacaauaauagaauaaaaucagcaauuguaucacagagcaucauauauaauguaaaagguauuucucugugaggcaaggucaaagacguuugaaaaacauuagugaaggagacagcauucaaauaauuacacaaauggacauaugguuaccaaccauucauuauuaagggaaagguaccauggcaccuggugccauggcagcaucuaacagguaaccaauuuuagucuggggagagaggaagagggaagagauccuggaaacucagagauaguagguaaaagugaggggaaaggaguuuuccggacagaauagcacaugcaaaugggcugagguuucgagauuuuuuuuugagauggaguuuugcucuuguugcccaggcuggagugcaauggcacgaucucggcucacugccaccuccaccucccagguucaagcgauucuccugccucagccucccgagaagcugggauuacaggugcccgccaccacacccagcuaauuuuucuauuuuuaguagagacaggauuucaccauguuggccaggcuggucuccaacuccugaccucaggugauaccccaccuuggucucccaaagugcugggauuacaggcaugagccaccacgcccggcccaagacguauuuuuaaaagguauggaugaaugagcacagauggucagggcguugaaggcaggauugagaaauuuguacuaaauccuaaaagcagaccauugaaggguuuuaaucaagggagugucucacucuauuguccaagcuggagugcaguggcacgaucuuggcucacugcaaccuccaccgcccgaauccaagugauucuucugccucagccucccguguagcugggauuacaggcccgcgccaccacaccgggcuaauuuuuguauuuuuaguagagacgggguuucaccauguugaacaggcuggucucgagcuccaaccucaggugacccgcccaccucggccucccaaagugcggguauuacaggcgugagccaagauuugugguuugaaaaaucacuuaaaggggccugcugagccugucucgggcacaauauaauaauccgguaggaguccgggcacggugguuuacgccuguaaucccagcacucugggaggaaggcagguggaucacgaggucaggaguucaagaccagccuggccaagauggugaaaccccgucucuacuacaaauacaaaaaaaauuagccgggcgugguggcgggcgcuuauaaucccagcuacucgggaggcugaggaagagaacugcuugaacccggaagggggagguugcagugagcccagaucgcgccacugcacuccagccucggcgacagagcgagacuccgucucaaaaauaaauagguaaguaaauaaauaauaaucggugggaaauaacaaggccuuaaagggcuuuuuggccuacuacgguaucugggcucugucacgacauuccaguucuuucaacagauuggugugauagaagagccgaauguuacugaauaaauuggacccaaagaaucuugcaaaauuugucucccugcaacuuucucucaucucuccuguucccagguccacccccgggaagcuuccagacccggcgccccggcccugccccgcucucacacgaacacguccccguccacguccccugcagccaguaggucacgggccggauggaacgccagcccacuagccggagcuuccagcacgaugucuuccggagugucccggauccggguuggggcuuccauggagucuggguccuccucgucgcucccauccucagcgggccucuccucacaagugcgguccaug

SEQ ID NO: 18522 - RNA, 4694 nt, Homo sapiens
uggcugccuuggcaucuucaacauuaagaggcgucgguuugagcugcucucagaaccucagucuggggaccugaccucugucacucucaugaaaguacagcugguuauggugggauggaggggugugugcugggggcuuagucugaggcagcuuccacauuguuuucucuauuucccugcagugggggaagaagguagccuguggcuccagugaagguaccaucuaccucuucaauuggaauggcuuuggggccacaagugaccgcuuugcccugagagcugaaucuaucgacugcaugguuccagucaccgagagucugcuguguacuggcuccacugauggagucaucaggugagggaagccuggacagcccuuaggucacaggaagggcagacccagcuagccaguacucaacacuguucuuucccugcccagggcugugaacauccuaccgaaccgaguggugggcagugugggccagcacacuggggagccuguggaggagcuggcccucucccacuguggccgcuuccuggccaguaguggccaugaccagcgccucaaguuuugggacauggcccagcugcgagcuguggugguggaugacuaccgucggcgcaaaaaaaagggaggaccacugcgggcucugagcagcaagacuuggagcaccgaugacuucuucgcaggacugagggaagagggagaagacuccauggcucaggaagaaaaggaggagacuggggaugacagugacugaaggaaugaauugaaucuugagacggguccucaccaggcaagagucuugcuuauugggcugcauccccagagaggauaugaauuauuuuuugaaaagacaggguuuugccaucguccaggcuggagugcgcuggcuugaucuuggcucacugcagccucaauguccccaggcucagauuguccuuccaccuuagccucuggagcagcugggacuacaggugugcacuaccacaccaggccaauuuuuguuuuuuuuuuuugguagaaacgggucuguuuugcccaggcuggucuucaacuccuggacucaaaugauccaccugccucugcuucccaaagugcugggauuacaggcacgagccaccacaccuggccaaaaaaauuuauauuuuuugagacaaggucucacucugucacccaggcuggaguacaguggguugaucauggcucacugcauccuugacuuccugggcucaagugauccaccucagccugccugguagcugagacuuaacaggcaucugccaccaugcuugacuaauuuuugugauuuuuuuuugguagagaccagggguuucacuauguugaccaagcuggucuuggaacuccugggcucaagugauccuccugccuuggccucccaaaaugcugggauuacaggcaugagccacugugccuggcuggauaugaaauuuuuuuuuuuuuuuuuuuugagacaggguuucgcucuuguugccagggcuggagugcaauggcgugaucuuggcucacugcaaccuccgccucccggguucaagcaauucuccugccucagccucccaaguagcugggauuacaggugucugccaccaugccaggcuaauuuuuguauuuucaguagagacgggguuucuccaugcuggccaggcuggucucgaacuccugaccucaggugauccacccgccucagccucccaaagugcugggauuacaggcaaaagccaacacacccggccuggauaugaauuuauaauacccuacagugcaacacaagaagaugcacucaaagcacugaugugaggaaguacuugccccguagcagcuauucacucuaccaguguaaacaaacucuaagcuagggcaagacagcacagacacaaguauauacuaaccagggguuuaauauaaauacaaccagcauagaaagacccaaaacuauacagaaaccaaaaccagaaugccaugugguggaggcaaagggcagaauuucugaccccuuuggcucagcugcccuuccccacaaauaaaaaccaacaaagaggacaaaucaggacaauaaagaagauucaugcuaagcuguggcagaggggggaagguaugaucgggugggggugggacaaggaacggccauggaagaucacugggucagguuggacccugggcugggagcgggagggcaaggccccucaccacaacuuaacccaaaccuaagcugcccccaggugccauaggucccugucccagcagggaggcugaugggccugggcccaugccccuccccaccuuugggggucagaaaguggccacccaggccugcugggauggggccugacacaggcucugcaugcccauucagggugccuguggagaaagaauggagucacuguuuaaccaugguaccugccucagccccagcagaccacaggagguuggccccagacucacugagugccugcagcagccguacagacacagcauccuuggccaccucaugcccaucccggccaucuagggucagcacaacccagaugaggccgcugaagggcaccggaugcccaggaaucaccaccugguaccagaagcggugccagccagcagguccuaugcccaaacacuuggugaggaacacagggcugcccagcuucauucguuggcacagcaacugcaggguagcccgagccccuuggaacccuaacuugucccuugccaaagccaacuggcugcccucuggcuguggggaccgcaagaagggacccacaagcugcuggcgaagucgcugcuucaggucuggcuugagccacuccacagccaccugcucuccacagaggugugacugcccuguaggaaaaaugcaaagacaagggcaggucuaaacccugggcccaagccuccagguggugagcccuuuggagcuacacaguccuguuauuuguagccuucccauuuccugguagugugaccauggguaagaaaagacaaugaagccuucagccuccauuauuugcaaagggaguauaacacacugcuaccuuacaaguuuccuuggagaaguacugguuaauugcaggcuuugucugccucauaaccaucauaauggcuaaucuuuacugggaaaacuugcuguaagucagucagugugcuaaguaccguacacccauuauguuacuuaauucucauaacagucugaggaaacagauucuauaguaguaaaaagcucaguuggauucccuugagcaaaucaauuucucuaacaguuuccucauagcuugaggguccugugccuauuuugcggugugggggugggggaagguugagaauuaagucaggagguaaugcucgggaagugucacaaauuuagguaagcgguggugguagcaccauuggaaguuuuaaaaaucugagaucaaauaguaaaagguugcaaauucuggcauguuugacucuaagaucuuguaacuuuaacagcuaugcucaguauaaagugccgggcagaacgcguuuggccccaaccagcacccccgccccagccuaccuuccaccagggccuuuuuggccauggcagcggcccggugcgagcugaauuugagcagagcgaucugcccgggcgccgguccggggcugggcagcagccgcgccuccugcaagccgggacccagcggcugcagcgcgagcagcagcgcgcugcgggucagauucggcggcaggccgucaacgcucagcucacacuucucggugcugcggcacacgagcagcgggcaggacggccgcagcggaugguugugcagcguggcgauggcggccugcgcgccgcgccucgagcuguagcgggcauaggcgaagccgcgguucaggccgcugaaggucaucaucaggcggaacucguagaggcggcccacgcgcuggaacagcgggauaagcuggugcucguacacguccugaggcagccgcccgaugaacaccucugacccagcuggcggcgggcugcccacccagccugugggaagaggguaugcaaggccaccgucaggcgacgcuuucgaauucugagcccacggacccagcgcgcgggggugggaggcgaugugaacaaaggucugugaaauggguuuacacccguacccugggugguuggcauaauuaggugacugcgcuaacaagggggcuggcacagaguagguacaccuugagauuggcccccucccucgacggggcggguggacguggagccacaguuccuccuuugcugggggguauaaauccggguaguucgcaguuucugacagugaaggcucggagcagccccucccccaaagggggcugguguagccggacaggcggaggggcugggacuaccguaccuggggguggcccgccauacuuccucugcccguucaccugcaccaggcggaugccugucucccugacccacgccuccagcgccgccuuguucucuggauucacccucucacaccacagcugagagggaaaggaagguuggaauggcggaucgccaagcgcgcccccaccucuccugugguacuggggucccuaaagccgacccccgcuccggcggggcucgccggcccccaagucgccagccgcuuaccucacaaucccgcuuggacugcauggcucuccagcuggcccccucguacccucuuuauaacuuccuccccac

SEQ ID NO: 18523 - RNA, 4694 nt, Homo sapiens
guggggaggaaguuauaaagaggguacgagggggccagcuggagagccaugcaguccaagcgggauugugagguaagcggcuggcgacuugggggccggcgagccccgccggagcgggggucggcuuuagggaccccaguaccacaggagaggugggggcgcgcuuggcgauccgccauuccaaccuuccuuucccucucagcuguggugugagagggugaauccagagaacaaggcggcgcuggaggcgugggucagggagacaggcauccgccuggugcaggugaacgggcagaggaaguauggcgggccacccccagguacgguagucccagccccuccgccuguccggcuacaccagcccccuuugggggaggggcugcuccgagccuucacugucagaaacugcgaacuacccggauuuauaccccccagcaaaggaggaacuguggcuccacguccacccgccccgucgagggagggggccaaucucaagguguaccuacucugugccagcccccuuguuagcgcagucaccuaauuaugccaaccacccaggguacggguguaaacccauuucacagaccuuuguucacaucgccucccacccccgcgcgcuggguccgugggcucagaauucgaaagcgucgccugacgguggccuugcauacccucuucccacaggcugggugggcagcccgccgccagcugggucagagguguucaucgggcggcugccucaggacguguacgagcaccagcuuaucccgcuguuccagcgcgugggccgccucuacgaguuccgccugaugaugaccuucagcggccugaaccgcggcuucgccuaugcccgcuacagcucgaggcgcggcgcgcaggccgccaucgccacgcugcacaaccauccgcugcggccguccugcccgcugcucgugugccgcagcaccgagaagugugagcugagcguugacggccugccgccgaaucugacccgcagcgcgcugcugcucgcgcugcagccgcugggucccggcuugcaggaggcgcggcugcugcccagccccggaccggcgcccgggcagaucgcucugcucaaauucagcucgcaccgggccgcugccauggccaaaaaggcccugguggaagguaggcuggggcgggggugcugguuggggccaaacgcguucugcccggcacuuuauacugagcauagcuguuaaaguuacaagaucuuagagucaaacaugccagaauuugcaaccuuuuacuauuugaucucagauuuuuaaaacuuccaauggugcuaccaccaccgcuuaccuaaauuugugacacuucccgagcauuaccuccugacuuaauucucaaccuucccccacccccacaccgcaaaauaggcacaggacccucaagcuaugaggaaacuguuagagaaauugauuugcucaagggaauccaacugagcuuuuuacuacuauagaaucuguuuccucagacuguuaugagaauuaaguaacauaauggguguacgguacuuagcacacugacugacuuacagcaaguuuucccaguaaagauuagccauuaugaugguuaugaggcagacaaagccugcaauuaaccaguacuucuccaaggaaacuuguaagguagcaguguguuauacucccuuugcaaauaauggaggcugaaggcuucauugucuuuucuuacccauggucacacuaccaggaaaugggaaggcuacaaauaacaggacuguguagcuccaaagggcucaccaccuggaggcuugggcccaggguuuagaccugcccuugucuuugcauuuuuccuacagggcagucacaccucuguggagagcagguggcuguggaguggcucaagccagaccugaagcagcgacuucgccagcagcuugugggucccuucuugcgguccccacagccagagggcagccaguuggcuuuggcaagggacaaguuaggguuccaaggggcucgggcuacccugcaguugcugugccaacgaaugaagcugggcagcccuguguuccucaccaaguguuugggcauaggaccugcuggcuggcaccgcuucugguaccagguggugauuccugggcauccggugcccuucagcggccucaucuggguugugcugacccuagauggccgggaugggcaugagguggccaaggaugcugugucuguacggcugcugcaggcacucagugagucuggggccaaccuccuguggucugcuggggcugaggcagguaccaugguuaaacagugacuccauucuuucuccacaggcacccugaaugggcaugcagagccugugucaggccccaucccagcaggccuggguggccacuuucugacccccaaagguggggaggggcaugggcccaggcccaucagccucccugcugggacagggaccuauggcaccugggggcagcuuagguuuggguuaaguuguggugaggggccuugcccucccgcucccagcccaggguccaaccugacccagugaucuuccauggccguuccuugucccacccccacccgaucauaccuuccccccucugccacagcuuagcaugaaucuucuuuauuguccugauuuguccucuuuguugguuuuuauuuguggggaagggcagcugagccaaaggggucagaaauucugcccuuugccuccaccacauggcauucugguuuugguuucuguauaguuuugggucuuucuaugcugguuguauuuauauuaaaccccugguuaguauauacuugugucugugcugucuugcccuagcuuagaguuuguuuacacugguagagugaauagcugcuacggggcaaguacuuccucacaucagugcuuugagugcaucuucuuguguugcacuguaggguauuauaaauucauauccaggccggguguguuggcuuuugccuguaaucccagcacuuugggaggcugaggcggguggaucaccugaggucaggaguucgagaccagccuggccagcauggagaaaccccgucucuacugaaaauacaaaaauuagccuggcaugguggcagacaccuguaaucccagcuacuugggaggcugaggcaggagaauugcuugaacccgggaggcggagguugcagugagccaagaucacgccauugcacuccagcccuggcaacaagagcgaaacccugucucaaaaaaaaaaaaaaaaaaaauuucauauccagccaggcacaguggcucaugccuguaaucccagcauuuugggaggccaaggcaggaggaucacuugagcccaggaguuccaagaccagcuuggucaacauagugaaaccccuggucucuaccaaaaaaaaaucacaaaaauuagucaagcaugguggcagaugccuguuaagucucagcuaccaggcaggcugagguggaucacuugagcccaggaagucaaggaugcagugagccaugaucaacccacuguacuccagccugggugacagagugagaccuugucucaaaaaauauaaauuuuuuuggccaggugugguggcucgugccuguaaucccagcacuuugggaagcagaggcagguggaucauuugaguccaggaguugaagaccagccugggcaaaacagacccguuucuaccaaaaaaaaaaaacaaaaauuggccuggugugguagugcacaccuguagucccagcugcuccagaggcuaagguggaaggacaaucugagccuggggacauugaggcugcagugagccaagaucaagccagcgcacuccagccuggacgauggcaaaacccugucuuuucaaaaaauaauucauauccucucuggggaugcagcccaauaagcaagacucuugccuggugaggacccgucucaagauucaauucauuccuucagucacugucauccccagucuccuccuuuucuuccugagccauggagucuucucccucuucccucaguccugcgaagaagucaucggugcuccaagucuugcugcucagagcccgcagugguccucccuuuuuuuugcgccgacgguagucauccaccaccacagcucgcagcugggccaugucccaaaacuugaggcgcuggucauggccacuacuggccaggaagcggccacagugggagagggccagcuccuccacaggcuccccagugugcuggcccacacugcccaccacucgguucgguaggauguucacagcccugggcagggaaagaacaguguugaguacuggcuagcugggucugcccuuccugugaccuaagggcuguccaggcuucccucaccugaugacuccaucaguggagccaguacacagcagacucucggugacuggaaccaugcagucgauagauucagcucucagggcaaagcggucacuuguggccccaaagccauuccaauugaagagguagaugguaccuucacuggagccacaggcuaccuucuucccccacugcagggaaauagagaaaacaauguggaagcugccucagacuaagcccccagcacacaccccuccaucccaccauaaccagcuguacuuucaugagagugacagaggucagguccccagacugagguucugagagcagcucaaaccgacgccucuuaauguugaagaugccaaggcagcca

SEQ ID NO: 18524 - RNA, 7305 nt, Homo sapiens
gccuuguuaacccaaacagauucauuuacagguccauuuuuucaggguauagaaccagcaaguuacaggcuucaucugcuugaaguuaaugugacuguaguucuucguguauguauggcuauuuuuuucuucugcauccccuugacuuggcauaguacuugauccaguggauaucaaaguuuugugaguuucuguuuugaguuugccagucugugccaucuaauucucaaaucagaccaagguagggaagacagcuagcuucuucuuaguggucuucaauguggguagggagggauuuugccuuucucagaggcauagacauuuuuaguugucacaauuguggaagagggugcuacuggcaucuagcagguagaguccagggaugaaguuaauccuaaaucaaaaucaaaauaauaaacauccuacaaugccagcauugguuucuacaacaaaugauaaucuggcccaaaaucucaacagugccaaaauuaaguaauucugugucuagcagacaguaagaaaaacacuaagggccaggugcaguggcucacgccuguaaucccagcacuuugggaggccgaggcagguggaucaccugaggucagggguuugagaccagccuagccaacauggugaaaccccaucucuacuaaaaauacaauauuagccacuugaagccaggaggcggagguugcagugagccaagauuacgccacugcacuccagacugggcgauagagcaagacugucucaaaaaaaagaaaaaaaaaaaagaaaaaacauuauguucaauccugagcucugcuguuccaaaaacaaaagaucaaaggagucugaaaugauaggaaucguuuugguucagacuucucuggacauagaucccuuaucagacgaaaacauaacucaugcuaaaaaaaaaccuaggcaaaaauaagauuuaaaauggaagaauaaaauacucuauauggaaauccucagcaugagaaggaaaaacaaauauucacagggaagauuauggaauguucucaccaaauguaaaacaggcccagucaaugccauuuauuauacaugucaaacagcuucuaagaccgacgggcucccauaauaagguuuuggggauuuuuuguuuuguuuuucauuuucuuuuuugcaucaaacagguucuuccaaaagccugcucacaagguagacaaaaacauaaaucuucaggaaaaugaaacaugagaagcugaaacaaucuacaccugaauguuaaaaaacucaucagacacaaaccacaccaaacacucaucccauuuaauuuccuguuacaugcucugaggaagccaagaacaucaggccccagggcagcaaugcucuaggauuccagcucggacccccucuauaugacagauucaugcacacacauccacacaccauagaaccaggcagaaauacacaugcaugcacagguggcuagagaaccauagggcaggaugggaaaaagggcugaucaaggauaugcaaucaacuggaaacugggaccuagagaaugcuucuguugcaggaugaacaugaguuaaaauuaaaacaaaggcagaacacaggauaaaggugggauguucagacaagaggugggauagaugaagagauaaagaugcagggggaguuuugggaaagcagccucagaaggggagguuuuucuuuauugggaacucaggugggcaggguccugugacuccagugauacacugaggcagaagcaauaugccacagcauuaccucugcaaucugugcccucucccaaaguagagggaaaccaugagcccccacccucuaucccuccccauugacacucuuaagaacuuucccauuacccaaaaagaaaugacccccuacuacacacacacacacgcaaaguuagguccagcauaggccaaagucaggccaagcacagaaagccucaguaacucuucuugguggaaccaaagccagagaagcccaucacagcugccaucucaucguccuccucaaaugucaaguccuccucagcccuccuuuucuucuccuucuguuucucuuucuuguacgcuuuggccuuuuccuccuggagggaaaaaucacucagaaucaguuuagacuccucagccaaauguuguuuguaacaacaacuaacauucuggggcaugcaguacaugccagaaauugcucugaguacuucauguauauuaagaucucuaauauggggauauugaggcacaaagagguuauauaacuugcccaagauucacagccaguaaguggaagaaacagaauuuugacccagucagccugauuucaugggucucuuuaggacuagguacauuuaguuaauuccucuugcaguuaaaaaaaaaaaaaaauuaugggggaggcuaugcauguugugggggacaguggguauaugggaaaucuuuauaacucccucucaauuuuguugcaaaccuaaacuccucuaaaaaaaguuuagucuuuuaaaaaaauuaaaucaaagaauacagaugagacaguccucaacuuaugaugcugacaagauuuuucaauuuuauaauggugaaaaacugacaugcauuugaaacuguacuucaaguauccauacaaccauuguuuuucacauucaguacaguauucaauaaauuaaugagaugaauacuuuauuauagaauaggcuuuguguuagauaauuugggucaauuguaggcuaauguguucugagcacauuaagguaggcuaggcuaaacuacaguagguuagguguauuauguauuuuugacuuaugauauuuuuaacuugaugauagguuuaucaguagguaaccccaucagaaguugagaaauaucuguaugaccaaaaaaaaaaaaaauuuuuuuuuaaauuacaaaaaaaaaaauaaggcccagagagucuaggagaaaaaaguaguuucagagccauuuccuucagaucaugagaauccuaaacaaaggcaacaaauguuuccgcuaauauacagaacucaggagauacaacucugggggugggaguaggagugggaugaggacagggucucccaugauucauaacauaaaacucaaaucugggggagaggggaaggauaggagacccuuaccucuucucugagcuccuucauccuuuccucaaaaucauaauccuucugcuucucuuccaucuucuucuuguugaccucaaaacguuucuucaccugauccaggguggaacguuccacacgcauagacaugcccagguuucucugaucugcauagggucaacagugaagaaggcaaguucauuacaacauccucagccccucaaaaauuauuuuccugacuucucugacaucucauaaaacacacagcaaaaauaauuauggcuaaaagaaacucccuuggccagcuggguccaggagcagcacaugguuugggugcuguugaaagccucauggccuccagaaugaggccucuuaccucacggccuccagaaauauuacauaaugaaguaaaagacggccugugcugaaacaacuggagaguucuaauaggggcaucaaaaaagagcccaguagaaacuacccuucuuacuccagccaucuuuugaugaguaaaaagaagaaaaaaaaagcuacccuuccauuccaccccaccuccaaaacccaauuccagcccuagucacaagcuaccuccaagccuuacguuucuuuccauuaaugugauccagaaaguugauggaguccuucaccacacagucacagacauugcaguaauaucuaacaggaagaaacagcaccugagucaaauaugguuuuaaggaucuuaucauuuucaaccaagaaacucaaauuuuuagguaaacuucuuuuuagaaguguuaagccuucauuucuauaaagccuuagcuuucgagagaguauagcagucaucuuccaagacagccccaggaugagccccacccucuugguauuccuacucuguguagucucuucccaauuuguaccagaguuggucuguuuggccaauagaauaugucaaaaguaguaucuuccaaaauuagguuauuuuaaaaaccaugccuucugucuuuguuuggguuacuugcucuggggaagccaguugcuuuauugugagcagucuuauagaaaggucuaugggguggccgggcaugguggcucacgccuguaaucccagcacuuugggaggccgaggcgggcggaucaccugaggucgggaguucgagacuagccugaccaacacggagaaaccccgucucuacuaaaaauacaaaaaaaucagguggugcaugccuguaaucccagcuacuugggaggcugaggcaggagaaucgcuugaacccaggaggcgaggcuguggugagccgagaucauaccauugcauuucauccugggcaagaagagugaaacucugucucagaaaaaaaaaaaaaaagaaaagaaaaaagaaaaagaaaaaagaaaggucuauggggcaaagaacuuaggcuuccaaaccacaggcaugugagagagcuuggaagcagaucuuccagccccacuuaagauucauaugaaugcagaccuaccuugccaacuccuugauugcagcuucaugaagacccugagccagaaccaccuagguaagccacucccagauuccuuacccaaagaaacugugagugguguaguuuaugcugcuaagcuuuagguuaauuuguuaauuuacauaacaauagauaacuaauacagacaggaauggacaacaguggguuuacuaagcagcucagagaagugucacucauugcuaucuguguugcucuccugccagaaaaccuaacuggacagagaagcaguggggggcaaaagggugacaagcucuuguaggacccuucuuccuauagguuauagucuuggaagaagguguacaaucaggcauccauaacaacuacagccuuugcagcuagucuggaaccucaaaccccucuucuucaccauuaacaacuccuaggcucuauucuagcuccaccuaauuucucuccuagaaaucuccucaguaguccuuuccuucauuucuucuucugacagaucaaauaaucccuuuuaaaauauuaauaguaaaucagaauugauaacaaguacaauggcaauaaaaaauuuaaaaacuauauugaguaguagcuguagugcucauaguaugauuuuuguuuguuuugguuuuuuuaauugagacagggucucacuguguuacccaggcuggucuugaauuccugggcucaagcaauccuccugccuuggccucccaaagugcugggaauacaggcgugagccacugugcccagccaaugcuaauaacaugaagaaacccacugagugaccacuccuagagacacuaucaugucaacuugagaccuugggagacacagaaaaacaaauauaaagauagaauuacaggcaagaaggacguaauccuggggccaaggaccuuccuuaacacuuccuaaaaccaaaauagguggcuuauuagaugcauucuuggcugcagaggaaaaaugauaagcaacucacccucccaucucagauugagggguugucuugguaaugacaauugucuucccaagcuuggauuccaaguccaccuuguagucccuaugccguaaaagcucucgcuugacaggcugcacugguuuuccugaaacauaauggggaaggaagucccuucaauauuauaguuccucaaccagaaaggaaaaaaaaugcaugaaauccaaaauucaggucuuacucauuucaaaaucauuccugaaaggacacaacagacacuuaaaguagcagcuggggagaaucucaacacaggaagaaaucauaagcaauccucaacucuacagcuuuucuccacuuuaaagccagcaaaucuaaaaacaguauguuuuauauucauugauuaacugaauugugggggagaauuucugaagaauuacuagaagcaacuuuuucaaaacgggagcaaggacauucaagaaugcuuucaggcagauacccuaggcauaacggaaaggaaccuucugagagcugggcaaauuuauaaaaggggaccaacaucuaggaaaugccuguuacaugucaagcacuauuuauuuuacauguuacauaaaaaaugaaagaguuagugagugcaagguggccuggagguaaagggaaagaagaauguacacguuugaaacagaugacaaaauaaaacauuucuuuaugcaaucucuuaaacaggagagaagcaccaacucccugauguacaaggcacagagaaacagcacuacuaagcucuagcugaaacaaucacagauccugcaaaguuccccggcuuuucucagacuauaugggagggucuugauugggccaggaauguucucucccuuaagaaauuucaagggaaagaggggggucacugauagcgguaaugcacagcagcaaaauacucuacuuaacuucucugucacuacuaaggaugccguuaucuucucuguacuucaggaaagcauuaaacgagccaagcaaagggugggcaaggaagcagagugaaauagagcugaagagcaucucaaaacuacuuacuucaucccaccuccucgcucucauuuuguaaaugcagaaaccuaggcccagggaagcagcacucugccagagcuuacaccgcgugggaaggcagcgcacuucaacucccacccgcucuccaucaucgcaucgccucugugauacccuuagcccuugauguaguuagcacccaccaucuuucuuuucucucucuuccgugagccucuucucggcgaguuucucauauucaucuuugucccacuuucggcgaaaguccaaguuuuuugucuguggggaggaaaaagcgucaagauccgucgccgugucugggccccuagagaagcagggaaccgcgcccucgcgguccaggugucuacaggacguuuugaaagcaaagccucuuuggacuguacgagaagacugagguagccucaagaccccaacccgagaaaccuccgcgauucuacugacccucugccaaggccuauuacuggggaguucuugaaccugaacccugggaucucgaggagauaucgggaagccagucgggugcaggaguuugucucuauucaggucugaaaaaccauuccccaccccgcaaaaccuccuccucagacacaacaccuaccccgcugcccgacgccaucuucacagcgaagugaauggcgagcugaaaaacgccguaaaaagcggcuuggagccguaaggcaaga

SEQ ID NO: 18525 - RNA, 3621 nt, Homo sapiens
gguaccaacuuccuuuaugagcaauuuugaugaaaugacauugauaaaugaccucaguucucagaauauuaauuauaggaacucaacugaagaaaauuagaaauauuaauccaaaccaauggaaugguucauuggacugcacuugauaaccacugcuuuguuuccaacauuuuaugcagguagauuuagcgcuuuuuaaaaaaggcacaaaggccuucaucuacaaaaauuaggguacuuuaagaaagcucuguaucuaauguuucccagcuuucaaguagaucaaauagaauuggaaucuuaauaugaugcaaacaugaccauucccaauuucuuuaccccugcuguguuccuuuuuuucauaaacccuacugccucuaccugcagaacgggaucaaauugcuuagucacuaaacuccaccauaaaaccaccucacaagaggaccugacucccaccaaccaugaaagaacaagauacacuauaaagugaaaaacagaugcuuuuauuuauuguauuggaaacaacuuaauaauuugcaucucuacauauagaaagcugcuuugaauaacugggaaaacaauuauugcauaggaaaacauaugcaaacuagcaucauugucucuagacuagguucuucuuauugaucucacgucaucacaaagcagcaacagcagcuucuagaaaauggagaaacaguaaaguccugcaaugaagcuauaauuaagguugaaccauacauuccgcuaauccugcaacuuuccuacaaucauuuuucugccuauacaauccugcuucuuauaggaugaacaccuagcaaaacaauauaaauuugcugaaaaacaaaauuacaaacaaaugaaagaacuuaacagaacacacagcauuaaaaggacuaggaagagcaaggucuuaauacccaguacaauaaagccaagaauuuucuaaugcugaccagucugaagacugaaauuaaauaucaguucuuuuuacuucucuaggagugauucuagcuccucuugcaaagagcugaguugcuccuuuucucggucuuccuuuuguuugagcucauccaguacagccugaaaucuguucuugagagccagauuuuccacuuucaugaugagauccucuugucguuuugcccuguccugggucucuuggagcuugccuuucauguugucaaucugcuucugaauucccauaaccagcugauugguuccuucauuuuccuggugcuguucaucugauucauuuagcuuguccuguagcugucucuccagaucuuccuccgugucaaugauguuuauaucuucuucaucuugaugcugggucucaucuucauccucacugcugcugcugaggucauugaauaucucccgaagcucaucauguucuaaugagucauggcccugccugugaccagacauuccuggagaagagauauccaggccuugauuuucugccuccuuuguuucaucuucggcaauuauuucccaccgaguacuaacagcuucagcaucuguacucagcaaucguuucacuucuuuuucaacaucuggagauucaauauauuucuucuuugcugucuuccggaaccuucucuuccugacauucuuuagaggcagaguaauuccgugguuccagauaaacuuuuucucuuuguccuuauccuuuuucuugcuugcuuuaggaucagugcuagcaacuggcuccuccacaggaggauagagaucaccaucaacuguggauacaagcaucugacagauaucagcugucuuguaaaaaguuuuuuuaucaaugguuuucaagcuuuccauaacacagggcaggucuacuaauuuugaggccaauggaacacgguccacucugacgauuccaugacgcccaucaggauguaacucaauugucagucuguccuugagguugacaugaccagacuguacugcccuucucacaguagaggcauauucuggaggcagacguaagauaaacuggcucuccaguucgugaggagcaucaucuuugcuuuuacucaucuuuauuuccuugugauucacuucuccaauaaaugcugguuacacuaaaaaguuccagcuacugcaauaguuuaaaacaccaguuugcuaugaauugaaaucuuuuaauuacaagaaguucucuguagaucagcagcuaagcgucuauuuugccuuaguuuuuauuuaagcuccaagucuuuucucuaaauaugcugugaccgaauaccagucguuaacacaaaggcuuauucacagacuuaaguucauuaaaucagaugcaaugccaagucccaaccucuaggugccgcugccggacaacgcggagagagcuagcuagcuagcuagggaacaggaaagcaaauggcggcucccccggaacgguuuucggcccagaaagcccagcagagauacuuucaacucacaaacucucccggaacaaagacacucaaaaaaucagggcucagcgagcucucuucgccucggguacuuacaauccagugacgauuauaaguucaguuucaccgggccggagcgaagggaagaggaggccgcaaggagccaagcgggagagagccgagcgucuccuugucguuuccuuaauucuuccugccgcuuggcagagugauccacuaccgauuacugaugaaagggcccgggaugggcagcgcgaaaucuugccgagaggcgcagcucgcaucaccagaccccgcaccucgccggcccuccguccgggucgccuacccagcaaaaacggaagugcuacgucgcgacgcggggcgggaggcggcugugagugacagccccuccgggcggaagggcggagccccagcuagcgcaggcgcaauagcgcaauuacgcugcccagcgugaaacucaucuuuucgcgagaacuuguuuuuccgggauggaaaugacaguguuucggaagagcuguugguuucaaacuauuuagagcuuggaaguuccaagaaagacacagauucgucccccgcuaagccagcacuuuuacgggaucgcuguggggccggauggcuucuagacuuccgggugauuccgggagaugggggacgccuugcaguaagcgucuuugcuucuggaaacaucucggauguucccuagagucuagccuaucuggugccaauacaagaauguguagcuacuauacaauggauuucaaaguacccaaaucaauggagugaggaggacaugcagcuuacuauauaagucucucucuauauauauguuuguuuguuuguuuuggagauggagucucaggcugucacccaggcuagagugcaguggcacaauauuggcugacugcaaccuccaccucugggguucaagcgauucuccugcuucagccucuuaaguaguugggauuacaggcacguuccacuaccccaccuaaguuuuguauuuuuaguagagaagggguuucaccauguuggccaggcuggucucgaacuccugaccugaggugaucugccugucuuggccucccaaaguacuaggauuauaggugugagccagcgcgcauggcccaaagucuguauuuuuaaauauaauucccuguaggggaauugugccucugguuuuacuugu

SEQ ID NO: 18526 - RNA, 12765 nt, Homo sapiens
acauuggaagauaccuauaucuuugcuugagaaugaaaaucuaaauggaacuucaaagaacuguuuuguuguuuguuuuuuagaaaaaaaagucccaaaaaagaaaagagagaagauaaucaauucgaugcccaggaagccaaauagacuuuacauagaauucuuuuuaaugcaaccaaacaaauggucaggauucuucccaauaucucagucaacaauaauauacacucuuuaaacuaugaaaugauuucaauuugauacaaugagcuuauguuagauuuuauuaaacauaucuuggcggucuaguaaagaucuuuaauauuuaauuuuaugauguucgauaacuuagaaaaugugaaugcuagagacaaugaagccauuuacuccauaggguauguaugcuuuguguucggaguagucuauaauuuaauuuaacuagcucuuauuuccuuuucuccaaagaagguaccaagacacuauaaauuaauugagacuuuuuuaaaacaguagaauaagaaacaaaugugagaugaaacuaugaauuuugaggcaucagguaaaaauggaucaagacauugagagcuauaaccuccaaacaugaaaguuuguuugaaaauaucuacaagugcuuacauuguuuaauaaucauacacuuugcuugccucaacaagaaguucaaaaguacuauuaaacaaauagaauuuaacuccaguuuacagaauucaucuauaauaccucuauuaguuccuuuaaacaaaauuuaucuacuuugugaaugcaaagauaacuauggauuauuuugauagaucaaaacagaauguccuucaaaguguucccuguauucuggagcaaugccaccagaaagcagaaauagguuacuuaggagccucccacaaaacgaaguuaagcuuucuuaguguuaguucuggauucuccuccugguuccaccaacuacucuccaggaccuagaagaauuuacaaaccaagacuguuucuugccaggucuuuauuccagagcaggucauucucuuuuauucugcaacuaugugaaaggagcuuucuuuucuuucugcuagcagaggguagccucggauccaucaauaauuuaguuuuacucuaucaacaucaguggagagacgaguaccucuaaggauccugucaggacaguccugcauuuugcucaaaugcugucuagagaucccuguuuucucaauuacacuagaauagaguaggaugaagauuugaauugcauacuaggaugaagacuugaauugaauugcauaaugaaaagaaucagccaauccauuauccaguuucuuaugaauucacagcccaguaggaucucugcagauuucugccuucuguagaaaauggguugcuucuauagcugauugcugcagccaagacaaacaacgauuucuuucuuuuuuucucacaagacugggagugagaauauuuggauuccgacauuguucuacuacuauauaaucaauaaucaggaacaaggcaaggcaauucccucuuucuuucuuucuuucuuucuucuucuuuuuuuuuuuuuuuuuuuuuuggcagaguuuugcucuuguuguccaggcuggagugcaauggugugaucucggcucaccacaaccuccaccucccggguucaagcgauuuuccugccucagccuccugaguagcugggauuacaggcgcgcgccaccacgcccggauaauuuuguauuuuuaguagagacgggguuucuccauguuggucaggcuggucucaagcucccgaccucaggugauccgcccgccucggccucacaaagugugggauuacaggcgugagcaacagcaccuggcccccccucucauuuuuuaaacgguuaaaaugaagguguuagaccgucucuaagguucuauacaaucaaaaauuuauuaaaauaggucuauauauuuuacaacaauuuugacuuucugaaucuugcaucauggugucuagaacauauguguucaauuaauacugaauuaauuaaaauuuauauacacugauguaaauauuuucuaaguaaaaucuuucauauguauuuaaauaaaauuuaccuuuuugccuucaauaacugauuuucccaugugcaauaacgugugagucagugcccaaaagagucacuugaaaguugcaaggcaaagcaguuuuuuaaaaauuaucuaagauuaucaaacaccgguccaugaacacuguugcauuaauucagugucuuaaaauggauuuuuaauuaucagggauaucuagagcaaagaaaucuaacagggaaauuuugaaagaugaaacaauuuucuaugaaaucaguguauugugugcaucaauguggugcaguaacuuaguaaggacucacagcgccgcuguucaccaaccagggaaaaauggugcgagagaucccacagaaaccaccgaguuuuacagcacagagaaacgacagauugcgauaagcccucuuccaggcugcacuaaacucaagccucuauccugcuggauucugagcuccccuuccuaagacagagggguccacccggauacacccgcauucugaagcacuucccgagaucggcgccuaagcaagagaagcaggacgacuauggcggcucagccgaggggcggggacuacagaggauucuuccugcucuccauccuccuggggacccccugggaagccugggcaggacguauucucuacuccgugucggaggagacggacaaaggguccuuugugggagacaucgccaaggaccuggggcuggagccccgggagcuggcggagcgcggaguccgcaucaucuccagagguaggacgcagcuuuucgcccugaaccagcgcagcggcagcuuggucacugcgggcaggauagaccgggaagagaucugcgcucagagugcgcggugucugguaaacuuuaacauccugauggaagauaaaaugaaucuuuacccuauagacguggaaauaauagauauuaaugacaacguuccaagauucuugacggaagaaauaaauguaaaaauaauggagaauacagcuccugggguucgguuuccguuaagcgaggcuggggauccagaugugggcacgaacucccuccagaguuaccagcucagccccaaucgccacuucucccuggcugugcaaaguggagacgaugaaacuaaguacccggaacuggugcuggagcgggugcuggaccgggaggaagagcggguucaccaccugguccucacagccucugauggcggcgacccgccccgauccagcaccgcccacauccaggugacagugguggaugugaaugaccacacgccugucuucucucugccucaguaccaaguaacuguccccgagaaugugccaguggguacaagacugcucacgguacaugcuaucgaccuggacgagggagucaauggggaagugacauauucuuuucggaaaauaacuccuaaacuuccaaagauguuucaucugaacucgcuuacaggagaaauaucaacuuuagaaggauuagauuaugaagaaacugccuucuaugaaauggagguucaggcucaagaugguccugguagucugacaaaggcaaaaguacugaucacaguuuuagauguaaaugauaaugcuccagaagugacuaugacgucuuuaaguagcucaaucccugaagacacaccucuugggacagucauugcucuuuucuaccuacaagacagagauucuggaaagaauggugaggugaccugcaccauuccagaaaaccuaccuuuuaaauuagaaaaaucaauagauaauuauuauagauuggucacaaccaaaaacuuggaccgggaaacacucucuuuguauaacaucacacugaaagccacagaugguggaacuccucccuuguccagggaaacucacauauucaugcagguggcagacaccaacgauaacccacccaccuucccccacucauccuacucagucuacaucgcugagaacaaccccagaggggccuccauuuucuuagugacugcacaggaccacgacagugaggauaaugcccagaucacuuauuccuuggccgaagacaccauccagggggcuccaguguccuccuaugucuccauaaacucugacacuggaguccuguacgcgcugcaauccuuugauuaugagcaguugagagaacuacaacuaagagugacugcacaugacagcggggacccgccucucagcagcaacaugucacugagccuguucgugcuggaccagaaugacaacccgcccgagauccuguacccggcccuccccacagaugguucuacuggcauggagcuggcaccccgcuccgcagagcccggcuaccuggugaccaaggugguggcgguggacaaagauucaggccagaacgccuggcugucauaccuccugcuuaaggccagcgagccaggacucuuugcgguugggcuguacacgggcgaggugcgcacggcucgggcccugcuggacagagaugcccucaagcagagccucgugguggccguccaggaccacggucagccuccucugucagccaccgucacacucaccguggcuguggcugacagcauccccgaagucuuggccgaccugggcagccuugagcccuccgacgguccuuacaacuaugaccucacguuguaccuggugguggcgguggccacagucuccugcgucuuccuagccuucguccucguacugcuggcgcucaggcugcggcgcuggcacaagucacgccugcugcaggcuucagaagguggcuuggcgaacgugcccaccucgcacuuugugggcauggacggggugcaggcuuuccugcagaccuauucccaugaggucucccucaccgcggacucucggaagagucaccugaucuucccccagcccaacuauguagacaugcucaucagccaggagagcugugagaaaaaugauucuuugcuaacauccguagauuuucaggaauguaaagaaaaccugccaaguauucaggugagcccagcccuuccuuuauuuccaugaggaauuuauuugcaugauauuucucuauuauuuugcaaaacaaauguuuugaaaauagggauuuaaaaaacuuuauagagguaaaaaugaguuuaccaguuuccuucaguggugacacuuuaauauagaacacauaggauauaguauuucuuuagugaaagccuauggacaagauuaugaauauguggacuaucacauuuuauaauuuccaccuacuuuccaaucuauguuccaaccuacuuucuuaacucauauauuuuauacauuggaaugaaucgagucuuucauauugcacaagguuagcaggaauaaaacacaccucagcugucuucucaggauucucuuuagcauucaaauauguaaaagguucugaaagauuucuuccaugugaagauuuuuuucuguggcugauucugccuccauguaccucagcuuggugguccuaaaaaaucuugauugcuucuugaccuauuuacaguauaaucauuuauuaauggggugguaguagaagguuggauuuaugccuaaagaaugaaauguguguguaucacacuucacuaagaucuauaucaaagacagacaucaagucuaaugccacacuaaaggccaucggacaaaaccaauaaaauaugucaaauaaaaugucauuuuaaguguuguaauuggcauuugugacauaggcaauuacauguuuuaacagagaauuccaguauguuguuuuagugguacagccagaugaagugugucugugggcuaucaaagugggagauuggggauacuggcuuuguuucaacugucucacguacucaaaccuuagaccaucuuauguacacagauccuagaccaguaguugauuuuauuuauuaggucuacugaaaaauucaguuggaaauaacccaaucugggauuaacuacuuccauauucuuuuguauaacauuuuaguaaagcucaguauaucaagugauugucauccagaagggguggaugacaagguaaucuugauuccagagaccuuugaguauuaauuaaaaacacacuuuuagccagguaugguguugcaagcuguagcccaccugcaugggaggcugaggcaagaggacagcuugaacccaagaauuggaggcccaccuagauaauauaacaagacucugucucuucaaaaaaagacucuuuuuagacuaguguuguauuugguaguauuuugcacaugauagacucuguacaauagugugggggauacauuuuuuuuuuuugacauggagucucgcucugucacccaggcuggauacauuuuacaaguucugcaguguucacauuucagauguacaaucacuugggguagaagacaauguugcugacaccaacaauguuacugagggaagauccuauggcagaacuacgguuauaagguauuuuguaaaagaaaaucuccugaccaaaauuuauuagaugcauaaaauuguuuuuaagcaauggagagacauaaucacuaaacucagugagcuauugcaaucaaacuuuccagggauuguuuccuucaauucagaggucaccaaggaauguaaaauaagugcagagguaggaagcagugcuucagugcagcagaucucagugacuuuguguuuugaggcuauguauuaucccccugauaacuuugaagaugaauguuguauuucauaaccaguaaaauaauuguguaaugaggagaggaguaggcuacugccugugaucaucgaaaugagaaucacauaauauuccuguaaugaaaucacugaaacuauugggaaggggguguauuugaagauaaguauaaauugcaccuucuaaaaggcaauuuugguauuacugauacucuccggaaaaaguugaaauaaaucaacuuggagguacuuagaaaaguggagaaaauguuaggaacaaugaaagaaagauaaaauguauccaguauauuucuaaugaguaaguauggaaaauuacuguacucugagacgguuuaggccaagucuguguuauggcuaucuuuauauagauagugcauguuugaagauuggggaaagcuuaugucaauaaauguuuauguacuuaaucuacaugauuugccuaaaaauccucaaaguugggaugaaggcauuccuaagaguacauuuuuagacgucauuaaauauacagacguauccacguaguuuuuguucuuucaguuaggcacacaauuauaauuauugcacugguuaacuugaagcagcagaggcuguaguuuccuagugcugacucugggcgccgcuguuggccaaaguggagagcuuggcgcuccagaucuccucgcgcagccgcagcgcgcuuuccagggcagccccagcucagacuccccagcgccagccuuuacaccgcuuccuccucggaaaaagaagaauuuuuucuugaacuggaacugcaacuaaaguccguucggagauccaaaaaucugcaauacagagguuauuuguaacccggcgucuccaggcuggugagcaagcugaggagagcaagagggauggggagcggcgccggggagcugggccgggcugagaggcugccagugcucuuucucuuccugcugucuuuguucugcccggcgcucugugagcagauccgcuacaggauucccgaggaaaugcccaagggcuccguaguggggaaccucgccacggaccugggguucagcguccaggaguuaccgacucgaaaacugcgcgucaguucggagaagccuuacuucaccgugagcgcagagagcggggaguugcuugugagcagcaggcuagacagggaggagauaugcgggaagaagccagcuugugcucuggaauuugaggcuguugcugaaaauccacugaacuuuuaucacgugaauguggagaucgaggacauuaaugaccacacgccaaaauucacgcaaaauuccuuugagcugcaaauaagugagucugcacagccuggcacacgauuuauauuaggaucugcccaugaugcggauauugguagcaacacacugcagaauuaccaacucagucccagugaucauuucucacugauaaauaaagagaaaucagauggcaguaaauacccugagaugguauugaagacaccuuuggacagagaaaagcagaaauccuaccacuugacuuugacugccuuggacuuuggagcuccaccccuaagcagcacugcacagauacacguucuagugacugaugccaaugauaaugcuccaguguucagucaagacguauacagggugagccuuucagaaaacguguacccggggaccacggugcuacaggugacugccacggaccaggaugagggugucaaugccgagauuacuuucucuuucagugaagcuagccagaucacccaauuugaccugaacucuaacaccggggaaauuacuguuuuaaauacauuagauuuugaagaagucaaagaauauuccauaguuuuggaagcaagggacgguggaggaaugauugcgcaaugcacaguggagguagaagucauagaugaaaaugacaacgccccagaagugauauuccagucucuacccaaccuaauuauggaggacgccgagcugggaacacauauugcuuugcucaaaguccgugacaaggauuccagacacaauggagaagugacuuguaaauuggaaggugauguuccauuuaaaauauuaacuucuucaagaaacacguauaaauuagugacagaugcuguucuagaccgcgagcagaauccagaguacaauauaaccguuacggcaacagaucggggcaagccuccccucuccuccaguuccagcaucacccugcacauuggugauguaaaugacaacgcuccgguuuucucacagucuuccuauauaguccacguggccgagaacaacccgccuggagccucuauuucacaagucagggcuucugauccggacuuggggcccaacggccaagucucuuacugcaucauggccagugaccuggagcagcgggagcugucauccuacguguccauaagcgcggagagcggggugguguucgcgcagcgcgccuucgaccacgagcagcugcgcgccuucgaacucacacugcaggcccgcgaccagggcucgccagcgcucagcgcgaacgugagccugcgcguguuaguggacgaccgcaacgacaaugcgccacgggugcuguaccccgcgcugggucccgacggcucugcgcucuucgauauggugccgcacgcugcagagccuggcuacuuggugaccaagguaguggcgguggacgcagacucaggacacaacgccuggcuguccuaccacgugcugcaggcuagcgagcccgggcucuucagccuggggcugcgcacgggcgaagugcgcacagcgcgugccuuaggcgacagggacgccguccgccagcgccuucuggucgccgugcgugacgguggacagccaccacucucggccacugccacguugcaccuggucuucgccgacagcuugcaggaggugcugccggauaucacugaccgccccgaccccucugaccuccaggcugagcugcaguuuuaccuagugguggccuuggccuugaucucagugcucuuccucguggccaugauucuggccauugccuugcgccugcgacgcuccuccagccccgccuccuggagcugcuuccagccuggucucuguguuaaauccgaauccgugguuccccccaacuacagcgaggggacuuugccuuauuccuacaaucuauguguugcacauacaggaaagacggaguuuaauuuccuaaaauguagugagcaguugaguucaggacaagacauacuuugcggugauucaucuggggccuuauuuccacuuuguaauuccagugaauugacuucccaucaggugaguuuccuuuaaguauaauuuaaugcucauugccuacccauuucuccauauucacaagaaaauauacauauuugcaggaaaauauauaauuuuuagaugucauggaucauuuuaggaaaguuguagucaguuaaaaagcugucauaucauucuacaaaggaggaguaaaguaggagcaauuguguggcccaacauuuguuuguuuuuuagccaagcuuagauuuauaaagcaaugagggugugguuuuaaccacaaagugaaaguguuagacaguuguuggcucucuccuaaaaagugaaugagauuuuuccuauacauuuuccuucuuguugacuaauauaugaugaauacuuuuuucagcuuggauauaccauaaauauaaaaauaauaaagccaaagaauuuaagcuaaaauucaacacuuuucuuaacuaauuuaacugguauggucuccauaguaguccacuguuuuguuuccuguguuaacuucccuuuuguuucaaaagcucuuagaauaaggagucaacuggauuuuuauguccauggaccccuugugauuauaugcaguguacgcugugugugcgugugugugugugugugugugagagagauccuuuuacuuagaaaaaggucuacuaugcucauuagaagaucaaaagcagauucuccuuacuuguaacauaggaguuucaggauuaaucuguauucaagcucauucuauauccuucaucaaagaaaagacaauguuuugugucuguugucccucucacacacagcccuaauauauaauguguaacugccuuaucugcagcccuaaacuaauauagcuagaggucuucuaaucauucuccuaccucuaggaaagaaauauagucuugaaaacugccaaucuggugugcauacaaaauauauacaaaauaccaaggaacauuauaugagccuuuugcuagguauaucuaagcaacugcuucaguuaauggccacuuuacaaauugcugaaagaaggaaacgucuuucgauucuuuuuuuuuucuuuuuuuuuuuuugagacagagucucugucuguuacucaggcuguagugcaguggcacaaugauagcucccuccagccucaaacuccugggcucaagcauuccuucugcaucagccuccugacuagcuggaacucaggcucaugccaccagaccuggcuaauuuuucuguuuucaguagagaaaauauuuucuuucacuaauuuaacugguaugguuuccauugucuacccaguuuuccauaugcauaagaaaauauauucacaggaaaauauaaaguuuucagauuucaugagugguuuuaagaaaguuuuagucagugaaaaaacuaucauaccagucuucaaaggaagggugaaauaaguucaucugcuacguugcccaggcuggucuugaagggaaacagacuuuuuuguagucauacuuauccuuuggcuucuuaguaaguauuauauagucauuacuuuuugcaguuuuuuagaucaaaguguuaauguagguaaaguuaauuuuagaauauauguaaaagucaagucugcuuuaaauuuaaucaucucuuuggugaaagggaugggauggagcuuugcuuuuuaucauauauucaucuguaccuuucaaguauucaaauagaaaaauauaaacaauguaaauaaaauagcaaaacaauguaauaucucauaaaacugcaaugguaaaagcauuuauccuauugaaauuccacaauuuuuauuugaaaauauuaucgacauguaauucaaguggcauuuagaagaauaauuuaaaagcaacaacucuauagaaagcuuguaaaaugauuaaguaguuuaaaccaaauaaaacaauuucugagucagucaucuccaguaggucuauuuuagucucaagauaaauucauuucuggugacaacugaaguucuuaguuauuuguuaguauauauuggagacauuuacaauaaagcuuagagcacaaugggaaaugaaaguaucauguuuuuuuuaagaccaaauguauugcagaaaugugaguaauuuaauccgaugcuacaaucugaucauucugaucuaaucugaucauuuaauaacacuaaauaaaaccuucaucucacauucuuuggcuguuucuuuuaaaauauggguuuacggauaaaucaaauaaauucaaaacaaaguaauaagcaaaugauuuuuuuuucucaguaaucuaguagaguauuacauuuagaaguaaucuguaucucagugcaguaacuauuuaggacuguaagcgccgcuguucaccuacuggaagacaaaugcaaccgaaaacacucagaucucacaccucacgaagacccgcagaugccacaaacuaacugcuggacugcagcgaaacccgaccccuguuuggaggcacuccagguuuccggaggauugucaucuccauagcugcggcaagaaacuaaauaagacccauuuaugcacagugaagauucugagaggauucugcagcaaaacaacaauggccgcuccacagagucgccccagacgcggcgagcugauccugcugugcgcgcugcugggaacgcugugggaaaucgggaggggacagauucgcuacucugugccagaagagacggacaaaggcuccuucguggguaauaucuccaaggaccuggggcuggacccccggaagcuggcgaagcacggaguccguaucgucuccagagguaggacgcagcucuuugcucu

SEQ ID NO: 18527 - RNA, 20356 nt, Homo sapiens
uaaagcuucagagugaauuaucucaugaguuuauuuaauauaaucuuuguaugaauguauacuaaauaaaauuggccuauucaaaucacaauuuuaaauuauaagacuuuucugaauuuaccuagacacuaauaugaccuaaaauaaguauuauuuaccuuuuauuaaaguguguacauuucuguugggaaaacguguugcaaauauauauuuaaccaaacauuaucuugaaauauuuacaauauuuucacuccacuuuaucacaccuccccuaagaaaccuacauauaguaaauuauuuaaagauaggaguggagaaaccaaagaaucuauguaaaauauaauaauccaacagaauaguuuacuuuccauugcauguaucacuugggugcaguaacuucuuaggacucugagcgccgcuguucaccuacuaggagagaaaacgcagccagagcucaauccggauucucagggcuucaacuacacaagccccacaaaccggcugcugggcugcagggaagcucacuccagaauuuaaagugcccaggcuacagagacacccugaagccacagaaagacaaaggaaccgguugaaacacacaacguguccagugaggacuuugcagaauucuguaaccagacuacaauggccgcucaaaggaaucgcucaaaggaaucaaaggauugcagcgggcugguccugcucugccuuuucuucgggauuccaugggaggcuggagcccggcagaucuccuacucaauuccugaggaauuagagaaaggcucuuucgugggcaacaucuccaaggacuugggucuggcgccccgggagcuggcggagcgcggaguccgcauagucuccagagguaggacgcagcuuuucucucugaacccgcgcagcggcagcuugaucaccgcgggcaggauagaccgggaggagcucugcgcucagagcgcgcggugcguggugaguuuuaauauccuuguggaagacagggugaaacuuuuugggauagaaauagaaguaacugauaucaaugacaaugcuccaaaauuccaagcagaaaaucuagacguaaaaauuaaugaaaaugucgcugcgggaaugcguuuuccucucccggaagcuauugauccggaugugggcgugaacucccugcagagcuaucagcucagccccaauaagcacuucucccuaagaguucagagccgugccaauggcgucaaguacccggagcugguacuggagcacucccuagaucgcgaggaagaggccauucaccaccugguccucaccgccuccgacgggggugacccucuccgaucuggcacuguccuugucagugugacugucuucgaugcaaaugacaacgcgccggucuucaccuugccagaauaccgagugaguguuccugagaauuugccugugggcacucagcugcugacagucacagccaccgacagggacgaaggugccaauggagaagugacauauucauuccgaaaauuaccugacacgcaauuguugaaguuccaacuaaacaaauauacuggagaaauaaaaauaucagaaaaucuagauuaugaagaaaccgguuucuaugaaauagaaauacaagcagaagauggaggagcauaucuugcaacugcaaaaguguugauuacaguagaagauguaaaugacaacaguccagagcugaccaucacgucucuauuuaguccagugacugaagauucaccucugggaacagucguagcccuuuuaaaugugcaugauuuagacucugagcagaauggacagguaaccuguuccauuuuggcguaucuaccauuuaaauuagaaaaguccauugacaguuauuacagauuggugauacacagagcccuugacagggaacagguauccucuuacaauaucacagugacagccacagaugggggaaguccuccucuaucaacggaagcucacuuuaugcuacaaguggcagauaucaaugacaacccaccuaccuucucucaagucuccuacuuuaccuauaucccagagaacaacgccaggggugccuccaucuucucagugacagcgcuggacccggacagcaaagagaaugcccagauuauuuacucccuggcugaagacaccauccaggggguaccucuguccucauacauauccaucaacucagacacuggcguccuguaugcacucagauccuucgacuaugagcaguuucaugagcuacagaugcaggugacagccagcgacagcggggauccuccacucagcagcaacgugucguugagccuguuugugcuggaccagaacgacaaugcgcccgagauccuguaccccgcccuccccacagacgguuccacaggcguggagcuggcgccccgcuccgcagagcccggcuaccuggugaccaaggugguggcgguggacagagacuccggccagaacgccuggcuguccuaccgucugcucaaggccagcgagccgggacucuucgcggugggggagcacacgggcgaggugcgcacggcgcgagcccugcuggacagagacgcgcucaagcaaagccucguaguggccguccaggaccacggccagcccccucucuccgccacugucacgcucaccguggccguggccgacagcaucccccaaguccuggcggaccucggcagcuucgagucuccagcuaacucugaaaccucagaccucacucuguaccuggugguagcgguggccgcggucuccugcgucuuccuggccuucgucaucgugcugcuggcgcacaggcugcggcgcuggcacaagucacgccugcugcaggcuucaggaggcggcuugacagguguguccggcucgcacuuugugggcguggacgggguucgggcuuuccugcagaccuauucccacgaggucucucucaccgcggacucgcgaaagagucaccugaucuucccccagcccaauuaugcggacacgcucaucagccaggagagcugugagaaaaacgauccuuugucuuuguuagaugauucgaaguuuccuauagaggauaccccauugguuccagugaguuuuauuuucauuuuuacuuuuguuaaaaaaaaaaagauugguuuuuacuuugaaguuugcggcaugaugguggaaaguguaaaugcuaaaacacugaugaguagaauuugauguuuauuaagguuuuuuuuuuuuuuuuuuuuuuuuuuuuuuuuacuuucugguaaaauucaccuagucucaaucaaggccuauauaucauaaggcuuuguuaugauuagcuuugcagaaccuuguaguuuauaguguuguugaguacaauauugacaauuccuaagacagacuuccauacagaagugccugucaauuuauauuuccuccuggguggucacauauugaaacuccagccccuuaagcaacccucuuguucugaaggcaggucugguaagaauagguaaguaucagaaagaaaucaccucuggaaacacaacccaaauccaagaauacucaaugcaguucuucccaaggagaagggcaauaggccuuuuucaaacuacauuuuauauauuuuucaaucuauacuuuguggugauaguugcaguugaauauacuaaguuuuucauuaauauugaauuaacaauuuauuuauaacaauguaugcuuagauuuuuccagcccuauuuauaacugauaacacugcaguauccuuuuugcauacaauucucuaauuucacacugcuauguggaagauauagcauuuuaauuuaacuuucauugcucaauagggauccugaggaggcuauagagggugaaauuaagaauauuugggauucugcuuuugucuuuuuuguuaaauuuucuagugacuaaggcugaaaguaaauauggguugggaagacagauaaauuuguacauguucccgagaacaggagcaagagauauaugacaaagcuauuucaguggcucuuuaauguauaaggaggcaaacaccugaaacucugaaaacucugaaauugagaggcaaaauaaacuuagagucaagaaagaaaugccauuucugcagaucagaauauaaacaccaaccacagcuguaaaaaagaaaagaauauaugcaacgaagggaaauuauauaaacaaaggaucauuggagguacugaugaguucauuuaguucaaugaaaauagugacguauuagguagaucucuuaauuuuauuacuaguauucuacuaaaugugguaguauaaagucaaaaagcauuccgaaguuucucaagacccuuauaauuccaugauuuuuuucaggucagucaacauuuguugaaugauaggucuguggaaggaaagcacacucuuuagggucauaguuauuaacuauuaaaccauugaaacuauuauuuuauauuuguguuaaugagagucaaaauuauugugcauucaucucaaauaauucuauuauuuugaaaaauacagguuuuuuuuuuaaaaaaaacugcucuugacauuguagcuauugugagaaaauauuuugauuauaauuauuuaaaagcaauacaggacacccuggaugaugguaaugacuagggcaaugguugcauuccaguacuuaaguaugaaauaaggaauuauuacuuucugggugaauauaggcuagaauugaagacaaaaaaauuuguugcuuaucuucaguacuuccagcuucauagauaauuacucuuaaaaggaacaagaaugacugccucuggauggaggaauuggauagcaaugggccgugggauaggagaccuauaaaccuucaugcuauauuauuuugugccuuuuuaaauuuugaagaaaaaauauucauuuauucaagauauauguaaauucaguaaauaaaaagauaugauaguuaugaccaaguggaaauauauuuccugauguaaaaggaaucacugaggaaaaagauuaaaauauuuuggcugucaacucguaguuuaaaaaaaauuccuugaaagagguagagaaaagucaaguugcagucccacacagagccucugggcgccgccgucggccagugcagagcaagcgcugacgccggggaucccucagccucuagccugggauucccugcgcagccaacaacagaaaagaaaaccagcucccacacagaggcucccggcugcgcagaccuugcccagcacaccagauugccagcuccgagacccgggacuccuccuguccugggccgaaugcucuuuuagcgcgguagagugcacuuucuccaacuggaaaagcggggacccagcgagaacccgagcgaacgaugggagggagcugcgcgcagaggcgccgggccggcccgcggcagguacuauuuccuuugcugcugccuuuguucuaccccacgcugugugagccgauccgcuacucgauuccggaggagcuggccaagggcucggugguggggaaccucgcuaaggaucuagggcuuaguguccuggaugugucggcucgcgagcugcgagugagcgcggagaagcugcacuucagcguagacgcgcagagcggggacuuacuugugaaggaccgaauagaccgugagcaaauaugcaaagagagaagaagaugugaguugcaauuggaagcugugguggaaaauccuuuaaauauuuuucaugucauuguggugauugaggauguuaaugaccacgccccucaauuccggaaagaugaaauaaacuuagaaaucagugaauccgucagccuggggaugggaacaauucuugagucugcagaagauccugauauuaguaugaauucgcugagcaaauaccaacuaaguccuaacgaguauuucucauugguggagaaagacaauccugaugguggcaaauauccagaauuaguauugcagaagacucuggaccgagaaacgcagagcgcucaccacuugguacugaccgccuuagaugguggggacccuccccgaagcgguacugcucagauaagaauccugguaauagaugccaaugacaaccccccaguguucagccaggacguguacaggguuagccuucgggaagacgugccuccaggcaccuccauccugagagugaaggccacugaccaggacgagggcaucaacucagagaucacuuauuccuucuuugguguggcugacaaagcucagcacguguucucucuggauuacacuacaggaaacauucuaacucagcagccuuuggauuuugaagaaguagaaagauauacgauaaacauagaagcaaaagaccgaggaucucucucaacacgguguaaaguaauuguagaaguuguagacgaaaacgacaacagcccagaaauaaucaucacgucacucucugaucagauuauggaggauuccccuccaggagugguuguugcccucuucaaaacacgggaccaagacucaggggaaaauggggaagucagguguagcuuaaguagagguguuccauuuaagauucauucuucuucuaauaauuacuacaagcuaguaacagaugaggcccuggaucgggagcagaccccagaguacaacgucaccaucgcagccacagacaggggcaagccuccguuauccuccagcaaaaccauaacccugcacauuacugacgucaaugacaacgcgccgguuuucggacagucagccuaccugguccacgugccagaaaacaaccagccgggugccuccauagcgcaagucagugccucugacccagacuucgggcucaacggccgugucuccuacucucucauugccagcgaccuggagucacgaacgcugucguccuacguguccgugagcgcgcagagcggggugguguucgcgcagcgcgccuucgaccacgagcagcugcgcaccuucgagcucacgcugcaggcccgcgaccagggcucgcccgcgcucagcgccaaugugagccugcgcguguuggugggcgaccguaacgacaacgcaccgcgggugcuguacccugcgcugggucccgacggcuccgcgcucuucgacacagugccgcgggccgcgcagccaggcuaccuggugaccaaggugguggccguggacgcggacucggggcacaaugccuggcuguccuaccacguggugcaggccagugagcccgggcucuucagccuggggcugcgaacaggcgaggugcgcauggugcgugcuuugggugacaaggacucgguccgccagcgccugcuagucgcuguaagagauggaggacagccaccccuuucagccacugccacgcugcaccugguguucgcagauagcuugcaagagguacugccggauuucagcgaccaucccacacccucugacucccaggcugagaugcaguuuuaccuggugguggccuuggccuugauuucugugcucuuucuccucgcggugauucuagcuauugcucuacgccugcgacagucuuucagcccuacugcaggagacugcuuugagucaguucucugcuccaaguccggaccuguggguccccccaacuacagugagggaacguugcccuaugccuauaauuuuugugugccuggggaucaaaugaauccagaauuuaauuuuuucacaucuguugaucauuguccagccacacaagauaaccucaacaaagauagcaugcuacuggcuagcauuuuaacucccagcguugaagcagauaagaagauucuuaaacagguaaguauuuaaaaauguauuuaauccuuuuuauauuacaauaugccaauauauuccaauauagugguauuauuuuaagauucuagauaacuucuucauagaguucgcaaaauauaggucaaauuuaugguuaucauuauuaaaacaaaaguuuaaauuaaaugccucagucuuccuacuauucaaagacauuuuaaagcaaacuacauggguaaucuccggugacauuuuuaugaaguaaaauaccuuucgguuaaaaauauaaaauacagguauauuuuuacggcaugguauuuuaauugaaacccugaugcuacucaauuuuucucaaguauuucaucuucauuuacucaauaaaggaaccuuguaagaauuauaguuaggcauccuaccugaugauuuuaucgggaccguauuauuuccacuuccagaaaugucguuccuuucagucgguuaaaaucaauuggaaccaacuacaaccuacaaguuuucagcuccaguaauauuuugaaaacuuuuuaaaaauuaagcaagcccuuuuaauaauuacuccuuucgcagguguucuugguaaaguuuuaacgucacauaauguaaguauuguguaucaucguuuuuaagcucuacaaauacgugugauucacaaaggugagcguaaucauuucuucuggaauuucuuagucguugcaauaauaagaaugggcucuaggcgccgcugcucaccaaucagggaaugggaagcugcgcgccauugagucccucccucccccgccucuaccacacaaagcggaaugagauggauacucacagauccugacacuggagacuuagaaguauuuuccuucgcuuucugauauauuuuggauguagucggccuaggacuucauagauacauaagccgauucacaaccaaccagcucgagaaaccgcggaauaucggcuuagagccugccauggcgaaucggcuacagcgcggggaccgcagucggcugcugcugcugcugugcauuuuccuggggacgcugcggggguuccgggccaggcagauccgauauucggugccagaagagaccgaaaagggcuccuucgugggcaauaucuccaaggaccuggggcuggagccccgggagcuggcgaagcgcggaguccgcaucgucuccagagggaagacacagcuuuucgcugugaauccgcgaagcggcagcuugaucacggcaggcaggauagaccgggaggagcucugugagacgguguccuccuguuuuuuaaauauggaacuucucguggaagacaccuugaagauuuacggaguggagguggaaauaauagauauuaaugauaacgcccccagcuuccaggaggacgaaguggagauaaaagucagugagcacgcaauuccuggggcgcgauuugcucuuccuaaugcuagggauccagaugugggcgugaacucccuccagagcuaccagcucagcccuaauaauuacuuuuccuugcaacugcggggcagaacggauggggccaagaauccagagcuaguacuggagggaagccuggaccgagagaaagaggcugcucaccugcuccuccucacagcuuuagauggaggcgaucccauccgaaagggcgcaguucccauucguguggugguccucgauguaaaugaucacaucccaauguuuacacaguccguauaucgcgugaguguuccagaaaacaucagcuccggaacucgggugcugaugguuaaugcaacggauccagacgagggaaucaacggggaaguaauguauucauuucggaacauggaaagcaaggcuucugaaauauuccaauuggauucacaaacuggagaaguucaaguacgggggucucuggauuuugaaaaauauagauucuaugagauggaaauucaaggccaagaugguggaggucucuuuaccaccacgacgauguugaucacuguuguggaugugaaugauaacgcuccagaaauaacuaucaccucuucuauuaauucaauucuggaaaacucuccuccagguacagugauugcucuucuaaaugugcaagaucaagauucuggagaaaauggucaagucuccuguuuuauuccuaaccaccugccuuuuaaauuagaaaagacuuauggaaauuauuacaaauugauaacaagcagagugcuggacagggaguugguccagagcuacaauauaacguugacagccacagaccagggaagcccgccuuugucugcagaaacucaugucuggcugaauguggcagaugacaacgauaacccucccguuuuuccucacuccucuuacucugccuacauucccgaaaacaaccccaggggugccuccaucuucucagugaccgcccucgacccggacagcaaacagaaugcccuggucacuuacucucugacggaugacacuguccagggggugccucuguccuccuaugucucuauuaacuccaacacugguguucucuaugcccuacaauccuucgacuaugagcaguuucgagacuuagaacugagagugauagcacgugacagcggggacccgccccucagcagcaacgugucgcugagccuguucgugcuggaccagaacgacaaugcgcccgagauccuguacccugcccuccccacagacggcuccacuggcguggagcuggcgccccgcucugcggaaccuggcuaccuggugaccaaggugguugcgguggacaaagauucaggccagaacgccuggcuguccuaucgccugcuuaaggccagcgagccgggacucuucgcggugggggagcacacgggcgaggugcguacagcgcgggcacugcuggacagagacgcgcucaagcagagccucgugguggccguccaggaccacggccagcccccucucucggccaccgucacgcucaccguggcuguggccgacagcauccccgaaguccuggcggaccucggcagccucgagucucuggcuaacucugaaaccucagaccucucgcuguacuuggugguggcgguggccgcagucuccugcaucuuccuggucuuugucaucgugcugcuggcacucaggcuguggcgcuggcauaagucacgccugcugcaggcuucugaaggcggguuggcagguaugcccacgucacauuuuguaggcguggacgggguacaggcuuuccugcaaaccuauucccacgaggucucucucauugcggacucgcagaagagucaccugauuuucccccagcccaacuauggggacacgcucaucagccaggagagcugugagaaaagcgagccacucuugauagcugaagacucagcuaucauuuuaggcaaaugugacccgacaaguaaucaggugagauuuauuucucugccuccuaauuguuggugucuuggcacaagucuuuuaaggagauguuuuuugagccuguuaugaaaacuguuugggggggggguggggcggcauauauuuaguucauauauauuuagagcaauacaugugaguuuuacuuugccuuucaugagauuacgauaaucuuucagaacguuuuugugaaagucauuuuucaaucuuggcauauuuucuuuugauuucaaaggggccauucaacuaugcugguuugguuugaaguaaguugaauuuuaguauuauuuuucuauuaucaguguaugaggcucucaauuuauuauauauagauacaaauuaaugauucacaaacacuuuuuauuuccauuucaauuuugcugugccuucacugauuuguaguuauauuccaccauuauuugcuauuacugcuaauguucaaauuuugauccuguugauuuaauagcaugcucccucuagcucuccuucucaucuaucuaucuauacacaugcacacacacuuauacacguaagcuuuucucugagcaauuuuauuuugauucuugguggcugguaauaugcuuagauccuguugacuauuucaacuuugucucauuucuucauccuaucaacacagacauauugacuggcuuuuaacuacuggauuuccuugggagauaaaauuuagaucacauuuuuucuuaagcucuagaugucuuuuccauuacuauggugaaguuacauugacuguucugaggaaauaauugaauuauugaacugguauuauuuccuuuuauucuuuuacuuuggugucuguguuuguauguauggaagguuuuuuaauguaguaaauccauauauagaaauaacuugauuuugauucagugcuucucaaaaaccuauuuucaaaugugcuaaagaugucuacagauuuauucaaauagaguaguuugugaauauauaaauagauugaagguauuuggacuuuaauuaaacugauuuagcuaguauccuucuggcuauuuuuuuguucauuuucaguguaguugggagucauagauuccuucuuucuuucuuuauaaggucauucuuauggcaaauaguacauucaguucuuuuauucagaccaacuuguuauugaagcuugauaguugccugacauacauguuaucugaagcaaugucuaggaaagccaaaugaggaaaggagacuuaucuaggguuuuugaucacaggaaucauuuccauaaucaauucagucaacacucucacaucacuucuagguauuugccccaaauuacuuggauauuuauguucccuuucaaguuuaguuuucucauuuaggaauuuaccuuaugucauuaguuguaaacugacuaucuagggcucggacaaaaauaauuucaacuguaggaaaggcaagucuuccaacagaugccuacauuuuucuugaagucaagaaaaauguucagguauuuugagcaucuagggauaggauuuauacuuguggaauuccaaacugagaaaaaugauguaaggcauuguacuuugacuggaauuaguuaaauaaaaaggauaugagguauuuggcugggaaaaggagauuguuccauauuauaaaaccucaucuaaacuaacuucccaagaucguggagaacaaaaaggaaggguuggcuuugaaaugugauauuaagaggguuauguugauucggagguagugauaaaguucuguuaagguauaacauauagucccauuaaauagaggauaaaaauaaaacaccaucacauuucauguuauuaauuccuauggcaaccuacuaggcuauaccuuuauauucucuuuaugaugaaacaugaaacaauaauccuuuucagaaaccucuuuuauaagugauaagaaggguuuggcuaacuuuauucugaauaugcccuauauagcuuucagugcuccuccaguuuucucugauaaaacuaggaggaaaauuaucugcacaucagauugaaaauaauacugcauaucauuucauaguggucaaaauuuucccauaccacuugauggggauguuuucccacaagguuuuuguucuacaacaggagagaagacuuugccuaguucuuccaauaugugcauugcuucugcuuagaaaaaaacaaacuuuuaaauucucuuugcuggguuaaugacuguucuauagauucccaucucuaaggaaucuucuuugguaguaaacacuggaaaacagucacuacgaaaacucauaaaaugucuaguuuccuauacauuaguccaacacaucagucuaauucugaaucccauugaauuagcaaaggcuuccggcugcaguuuucuaaauagacucagagcccugcuguuggccaaugugcugcaagaacuggagccugggaucuaccaggacgauauucuguucagucacagaagcaagucggagaguggccaagacuugggcuuucugcuccugcaaaucugauuccauacggauuggggugcccucaaacugggagcauugaguuuucuauguauggaaguaaauauuuuaaaagcacuuugugaaacauuuucucuuaacgucggagacugcagcaacgcaugggaaggaugggaaacagggugaagcagagaagcaggacccggcaguggcaagcacucuucccuuuccugcugccuuuguucugcggggcacccucggagcagauccgcuacucuauuccagaagaaacgguccagggcuccgugguggggaaccuugcggaggacaugcggcugcauguucaggauuuauugaccugaaaccuuagaguuagugcagagaaacaauacuuuaccgugaacacggagaaugggaacauacuugugagugacagaauagaucgagagucacugucuucaaaauccucugugucauacccuuagagauuguagcagagaauccucuaaauguuuuucacauaaaugugaugauagaagauauaaaugauaacccaccucauuuuccccaaaauagcauuguuuuacaaaucaaugaacuagcaauuccaggcauucgguuuggccuggaaucugcuauagaugcagauguagggccucacucucuccagaguuaccagcucaguucuaaugaacauuucucucugaugauggacaagacuaaaggcaagaacgcuccagaauuagugcuggagaagccccugggccaggagcaacagagcucucaucuccugguccuggaagcaauggacaugggugacccagucccaacuggcacugcugcaauucaaauugaggucacugaugccaacgauaaugccccaguuuuuagccaggauguauacaaagucagccuuagagagaaugugcccccaggcaccucuguacuaaaggugacagccacugaccaggaugagggugucaaugcggagaucaccuacucuuucaaaucccuacgagaugauauuggaaauauguuugugcuagaccaucaaaauggggaaauuaaauccaaagacuuaauagacuucgaauuucguagcaguuauaccaugagaguagaagcuaaggaugguggaggcaugaccagcgaauguaaaauuauacuagaaauccuagaugagaaugacaaugccccagacgugguuuuuacuucaguguccaguucuguaacugaggacgcagaacccuggacggugaucacucuguucaaaacacaugauaaagauucgagagaaaauggggagguuacaugccucauaaacgaaagaguuccuuuuagaaucgaaucuuccgccaauaaugacuauaagcuuguaacagaugggacccuggauugggagcggaucccggaguacaacgucaccaucacugccacugacaagggcaagccuccgcucucauccagcacaagccucacccuacgcauuggugaagucaacgacaaugcuccgguuuuccaccaagucuccuacgugguccacguggccgaaaacaaccuucccggagccuccaucccacaagucagcgccucugaccuggaccuagggcugaauggccaagucuccuacuccaucguuaccacugacuuggagcugcgggcacugucguccuacguguccgugagcgcacagagcggggugguggucgcgcagcgugccuucgaccacgagcagcugugcgccuucgagcucacgaugcaggcccacgaccagggcucgcccgcgcucagcgccaacaugagccggcgcauguuggugggcgaccucaaugacaaugugccgcgggugcuguaccccgcgcuggggcccgauggcuccgcacucuucgauauagugccacgcgccgcagaguccggcuaccuggugaccaaggugguggcgguggacgcagauucgggacacaacgcuuggcuguccuaccacgugcugcaggccaucgagcccgggcuuuucagccuggggcugcacacgggaaccugcugguugcugugcgugacggaggacagccgccgcucucugcgccgcuacgcuucaccuagucuucgcagacagccugcaggaggcacugccagacuucagugacaguccugugcccucugauucccaagcaaagcugcagauuuaccuggucguggccuuggccuugauuucuaugcucuucuuccucgcagugauuuuggcggucgccuugcaccugcgaugcucuuccagccccucugccugggguugcuuucacccuggucucuguucuaagacuagaccagggguuuuucccaacuacaaugagggaacuuugcuuuauuccugcaaucuguauguucccucggauucuagaaaaagaagauuuaauuuucucaccaugacaccagaaacaguccccccacaagaucuuucuaaugaaguuucucugguagcaagcuucacugaagagaauaacaagauaagcucuaacucuguugcuccuacucacgugaguuccaaugaaugucuuucauuuacaaauggaugagguuuaauuuucaaaccaauauuuuggcaagaaaaucuuaaacauauuauaucuacuauugcuucagguuuguuugcccacucuuaauauuuccuguuccuuucugugugggccaguaacuucauuauuagcuuucauguauuuuugaaacauuuucaccauuuuuacgggagacuuuuuuuuuuuuuggacggagucucgcucugugguccaggcuggagugcaguggcaugaucucggcucacugcaagcucugccuuccggguucuggccauucucccgccucagccucccggguagcugggacuacaggcgcccgccaccacgcccggcuaauuuuuugcauuuuuaguacagacgggguuucaccguguuagccaggauggucucgauuuccugaccucgugaucugcccgccucggccucccaaagugcugggauuauaggcgugagccacugcacccggcccggagacauuguuuauacacacacacacacacacacacacacacacacacacgugugaaaaguggguauuaugauacugcugucauugagauauuuuaauugaggaauaaauuuuuuuccugugauguuucuugggacaucaauauuugaguauauaaggcuuuuucuuuaauccauuaacuauaaauuuugaagaaaaugcaugagaaaauggagaaaauguguuuuuuuuuuaaaaaaaauugagauuaaggucucauuauguugcccaggcuggacucaaacucuugggcuacaguaauccucccaccucaaucuccagaguagcugagacuacaguugccugaaacugugccuggcagagaaaaaagcuuaaaaaaauaagaacaugguaaugauuugauaauauucaguuacauuuacuuuugauucuuguaauucaaguaaacucaauuuuaugucugauauuuucucacagcuaccuauauauuucuucccaauuuaaaauauauuauuuuauuuuaugccuagcaaauaucuuuacaguauaaauauuuacgcucaugaaaguacguagccaguuauuucuuagggagaauuuuuucccuauauuuugaugggcuuccaaaaguauuaccaguaauucucaguaauuacaauuaggucaguuacccaggaaaagguaagucuguaacauucuuuggacuaccaauuuucuuuuacuaaguuuccugaacaauaaauauuuuugaaauauaauguauuaauagaauucuggaguacuuccauuauuuccagucaaugcaaguuggaaugcuucuacuuuaugcuaaaaauauuaauguuucuuuuucacuuggguucuuguuaagugugauucugauaauguauacaaucacauaucauuuuuagguuuccauaauaucaugaaaauuugauuuuuaagcguuacaugucaacaaccugguaaaguaauccuuccauucaggaucauucaaggaaucuauuuaaaaauauuuuccccaaauuauagcugaaucagaaaguuuaaauuauuauauuauaugauuugucaaaaagagaaacuccuagggagacaucuccauaauagguguguugggggaacaguaaucucaaagcagaugcacuaacauuauaagauuaaaaucauuguuuauagaaacuuccaauucauuuaaaagcucauuggggaaaaaaaagcucauugggaaaaaaaaaaaaagcucacuaaaguuucuauuaaagcgaauacgguagauuuccauccccuuuugaagaacaguagguggagcuauuuaagauauaaaaacgaaauauccuuucugggaguucaagauugugcaguaauugguuaggacucugagcgccgcuguucaccaaucggggagagaaaagcggagauccugcucgccuugcacgcgccugaagcacaaagcagauagcuaggaaugaaccaucccugggaguauguggaaacaacggaggagcucugacuucccaacugucccauucuaugggcgaaggaacugcuccugacuucagugguuaagggcagaauugaaaauaauucuggaggaagauaagaaugauuccugcgcgacugcaccgggacuacaaagggcuuguccugcugggaauccuccuggggacucugugggagaccggaugcacccagauacgcuauucaguuccggaagagcuggagaaaggcucuagggugggcgacaucuccagggaccuggggcuggagccccgggagcucgcggagcgcggaguccgcaucauccccagagguaggacgcagcuuuucgcccugaauccgcgcagcggcagcuuggucacggcgggcaggauagaccgggaggagcucuguaugggggccaucaagugucaauuaaaucuagacauucugauggaggauaaagugaaaauauauggaguagaaguagaaguaagggacauuaacgacaaugcgccuuacuuucgugaaagugaauuagaaauaaaaauuagugaaaaugcagccacugagaugcgguucccucuaccccacgccugggauccggauaucgggaagaacucucugcagagcuacgagcucagcccgaacacucacuucucccucaucgugcaaaauggagccgacgguaguaaguaccccgaauuggugcugaaacgcgcccuggaccgcgaagaaaaggcugcucaccaccugguccuuacggccuccgacgggggcgacccggugcgcacaggcaccgcgcgcauccgcgugaugguucuggaugcgaacgacaacgcaccagcguuugcucagcccgaguaccgcgcgagcguuccggagaaucuggccuugggcacgcagcugcuuguagucaacgcuaccgacccugacgaaggagucaaugcggaagugagguauuccuuccgguauguggacgacaaggcggcccaaguuuucaaacuagauuguaauucagggacaauaucaacaauaggggaguuggaccacgaggagucaggauucuaccagauggaagugcaagcaauggauaaugcaggauauucugcgcgagccaaaguccugaucacuguucuggacgugaacgacaaugccccagaagugguccucaccucucucgccagcucgguucccgaaaacucucccagagggacauuaauugcccuuuuaaauguaaaugaccaagauucugaggaaaacggacaggugaucuguuucauccaaggaaaucugcccuuuaaauuagaaaaaucuuacggaaauuacuauaguuuagucacagacauagucuuggauagggaacagguuccuagcuacaacaucacagugaccgccacugaccggggaaccccgccccuauccacggaaacucauaucucgcugaacguggcagacaccaacgacaacccgccggucuucccucaggccuccuauuccgcuuauaucccagagaacaaucccagaggaguuucccucgucucugugaccgcccacgaccccgacugugaagagaacgcccagaucacuuauucccuggcugagaacaccauccaaggggcaagccuaucguccuacguguccaucaacuccgacacugggguacuguaugcgcugagcuccuucgacuacgagcaguuccgagacuugcaagugaaagugauggcgcgggacaacgggcacccgccccucagcagcaacgugucguugagccuguucgugcuggaccagaacgacaaugcgcccgagauccuguaccccgcccuccccacggacgguuccacuggcguggagcuggcuccccgcuccgcagagcccggcuaccuggugaccaaggugguggcgguggacagagacuccggccagaacgccuggcuguccuaccgucugcucaaggccagcgagccgggacucuucucggugggucugcacacgggcgaggugcgcacggcgcgagcccugcuggacagagacgcgcucaagcagagccucguaguggccguccaggaccacggccagcccccucucuccgccacugucacgcucaccguggccguggccgacagcaucccccaaguccuggcggaccucggcagccucgagucuccagcuaacucugaaaccucagaccucacucuguaccuggugguagcgguggccgcggucuccugcgucuuccuggccuucgucauc

SEQ ID NO: 18528 - RNA, 1843 nt, Homo sapiens
auaucuuucuaaacuuuucuuuguguaaucaaagaacaugcaugagcuucauuuuuauuuuuauuuauuuauuuauuuauuuauuuauuuauuuauuuauugauacguagccuugcucugucacccaggcuggacugcaguggcgcaaucucggcucacugcaagcuccgccucccagguucacgccaugcuccugccucagccuccagaauagcugggacuacaggcgcccacuaccacgcccggcuaauuauuuuguauuuuuaguagagacgggguuucaccguguuagccaggauggucucgaucuccugaccucgugauccgcccgccucggccucccaaagugcugggauuacaggcgugagccaccgcgccuggccgagcuucauuuuaaaaaaaucucauucaccuaaauaaguuguucacaaacuugucacacuuucaugugacacuuuauucacauauuaagaacuguuauucccagucauacgguacauuuccuacuaguuuuuuaaaaauagcaacugaggccauacuguccaacagaauuauagcuuuuuucuucuuugcaguguaucaugagaauuuccccaugucuuucaaaauucuucccaagucauuugcagaguaacuccucuuaugaauauacauauuauuuuacagaauaaguccucauaugaauauacauauuauuuuucuaaugcuaaugggcuuuugcuacauuagaaaacauacacauucauuuacaauuuuuuuuuuuugagacagucucgcucugucuccaggcuggggugcaguggcgccaucucggcucacugcaagcuccaccuccuggguucaagcaauucuccugccucagccuccugaguagcugggacuacaggcacgcgccaccacgcccagcuaauuuuuguauuuuuaguagagacgggguuucaccauguugaccaggauggucucaaucucuugaccucgugauccgccugccucagccucccuaagugcugggauuacaggugggagccaccauccccagccucauuuacauuuuaacacaauuaaauucaggguguugucagggugacuuccuagauuucucaguuuuuugagcaugauguagggaguauuuuauuauaguccagucuaugggauauucccuuauacacacacacacacacacacacacacacacacacacacacacaccccaaacucaauagggcaagaaccauauucaucaucucuuaaauccuagguccugucacaggccacugcuuggaaaauaguugacuaaauguaguccauuucuuccauuuuuacuuuucacuauuccccaaauccuggaagagucccucauaucugcugcuggggcuccaaggccuccaagcugaagcccaguacguuguugugcauaagaucauaggcccuggaaucauauuaggcuggcuuucagguugcaacucuaccaguuccagcugugugacucugguauagucucucaaccucucugagcccuguuuucaucuguuggaaaauauagauaaucacaacacuuaucugcagggugauuccgaggauaaaaaagacaaauauauuacccagucagcuuagaauaggaagcucucaguaaaugguuaaaaaagaggucucucucccucugcucaucucuuacccagcuucacauaauuggcagcccacccaccuguuuggcccucaaccuucaaccauuucccaggacgccuccuuacacuccugaucaucaugguuccaaccccacuguuccacucagcuuuguucccucaacaccacugcucccugugacaggucauccuccuaaccu

SEQ ID NO: 18529 - RNA, 1607 nt, Homo sapiens
ggggguuaauccaaauggcagaacuggggcugcaggaacuccaaauccaaaugggggagguggaggcauacccauuccggguggagguggaggaaugccagggccuccgggaaauggaggagguggagggauuccaggaccaccaggaagagggggaggaggagguggcauuccugcuucuccaggcaagggaggagguggggggggaauuccagcacucccaggcaaaggagguggugguggggggauucuagcacucccaggcaaaggaggagguggggggauggcaguaccuccaggcaaagaagagggugaagggaugccaacacccucaggcaaaggaggggguggagggaugguagcauccccagacaaaggaggggguggagagauagcaguaccuccagguaaagaagggggugaggagaugcaaacacccccaggcaaaggagguggaggaggaggaggaggaggaggaggaggaggagugguacuauccccaggagcagguggugguggaauaauagugccagagucaccagguaaaggaggggcagggggaacaggagcacgacuaggaacagaaggagguacaguaauagcugccgcagagagggaagccauuucuuucuuggcaucuuccaguuccuuugucagcuuggcaaccuacagaaauaacaucaaugugaguacuucucaccccacuucagggacuacugggacuggaaggaaccuaauaaacuacuuaauccaaacuucucauguuacaaauggaggaacugagaggagucagagagaugacaugaucaccuaaagucacacggcuuggcagcagagccaaaacuagaauucagguuuucauguucuuaguucagcaugcuuuguauuaagaagacaauuucaaccuuuauguuaaacccucccuugauuagaaaauguaaaggucaaguaaauuaaauguucuaguuauauaacuaauauaugugcuacacagaugauuauauaaccacauaaguaaucaaguuaucagacaucaaagaucauuuaaguauuuacuacugcagagagaguguguaaggauaaaucugugcagaggugacuaaaauaacaggaaauuagucaauuuuuaacaguuuaguuuuuauuccuaauuuauuaggagacuuauuacuuuuauuucugggugguaaugaaacuuacuuuauucuuaauguuuuucuguauuuuccagauuuucugucuuauguauuacuuacccccaacacaaaccaaaaaccaguauauuauuuuuaaaauaugcaccauguaacuagauuaccuauuaguagcugaacccucccuaggagcgagaugacugacuccuguuccaagccaugugcauccugagguuacaggucauucugccuucccugcucaggcauuaccucuccugugagcugggacaccucugcuuccagguccuguuucucuguggcaauuugcugcuuuucagaaugcagugcaucuuuuucucccugaagaucuugaagcuucugcucaaagucacuuuccaucuuuuucauuuccaccuguagcucaugucgggcuguuaacucugaguccaacua

SEQ ID NO: 18530 - RNA, 1607 nt, Homo sapiens
uaguuggacucagaguuaacagcccgacaugagcuacagguggaaaugaaaaagauggaaagugacuuugagcagaagcuucaagaucuucagggagaaaaagaugcacugcauucugaaaagcagcaaauugccacagagaaacaggaccuggaagcagaggugucccagcucacaggagagguaaugccugagcagggaaggcagaaugaccuguaaccucaggaugcacauggcuuggaacaggagucagucaucucgcuccuagggaggguucagcuacuaauagguaaucuaguuacauggugcauauuuuaaaaauaauauacugguuuuugguuuguguuggggguaaguaauacauaagacagaaaaucuggaaaauacagaaaaacauuaagaauaaaguaaguuucauuaccacccagaaauaaaaguaauaagucuccuaauaaauuaggaauaaaaacuaaacuguuaaaaauugacuaauuuccuguuauuuuagucaccucugcacagauuuauccuuacacacucucucugcaguaguaaauacuuaaaugaucuuugaugucugauaacuugauuacuuaugugguuauauaaucaucuguguagcacauauauuaguuauauaacuagaacauuuaauuuacuugaccuuuacauuuucuaaucaagggaggguuuaacauaaagguugaaauugucuucuuaauacaaagcaugcugaacuaagaacaugaaaaccugaauucuaguuuuggcucugcugccaagccgugugacuuuaggugaucaugucaucucucugacuccucucaguuccuccauuuguaacaugagaaguuuggauuaaguaguuuauuagguuccuuccagucccaguagucccugaaguggggugagaaguacucacauugauguuauuucuguagguugccaagcugacaaaggaacuggaagaugccaagaaagaaauggcuucccucucugcggcagcuauuacuguaccuccuucuguuccuagucgugcuccuguucccccugccccuccuuuaccuggugacucuggcacuauuauuccaccaccaccugcuccuggggauaguaccacuccuccuccuccuccuccuccuccuccuccuccaccuccuuugccuggggguguuugcaucuccucacccccuucuuuaccuggagguacugcuaucucuccacccccuccuuugucuggggaugcuaccaucccuccacccccuccuuugccugaggguguuggcaucccuucacccucuucuuugccuggagguacugccauccccccaccuccuccuuugccugggagugcuagaauccccccaccaccaccuccuuugccugggagugcuggaauuccccccccaccuccucccuugccuggagaagcaggaaugccaccuccuccucccccucuuccuggugguccuggaaucccuccaccuccuccauuucccggaggcccuggcauuccuccaccuccacccggaauggguaugccuccaccucccccauuuggauuuggaguuccugcagccccaguucugccauuuggauuaaccccc

SEQ ID NO: 18531 - RNA, 17462 nt, Homo sapiens
caagagaaugcaguuuucaaugugugcaauacccauggaacacaugaaaaaaauuauagugauagccaccauguuuugaaagcaagguagcaagaacagagcucgguccagggcaagcacuagacuaaaccagacucgcucuggaguuuaauuuccuaguucgaauuccagguuagguaccaucuaauuguuucuaaucaggacaaacuaauuauugccaacaugugccuaaacagcaauaacaguuaccacuuaaccaugcccuuugcucucugcuaggcacuaggcaaacacucuacauguauuuuucuaaguccccacagucccaugugauagauucugcuagccucaccauuuuauaaauaguaaauuuggacuuuugagaguugaagugacuugcccaagaacgcauaauugauauaaaauuuaaacccagcuuagucugauuugcugccaaacccuauguuuaaccaggauuccccacugacauaaaccaaacaugagugaaaagaaugaguauucuccaagaguauauucuuugcucuucuagcaugacuuucucccuaagcaauuucauccauucucccagcuacaucugucccuugugugacaguuacguggcuaccagucggccuucacaauauggacugaauauucuugaccacagcuagcaagauuucaagcauaaguuccugaagggcagagucagugacuuacuuacucuagagccccaguaccuagucaagggccugagauauaccagggacucugccaagcuggcuggcuccuaaauuuggcauucaucucucuugugguccagaccuucugauggugaucggauagaauguuacauagagcuguccaucccauacuucaaacuugacuuagugcugagcuuuccagacauuuugucuaaaaaguccaaaagcuacuuucuaagcuaguguugagaacagacagaaucagagaauggaggggaggaagugacccaucuaucaguccucuuucuuguaucagucuguaucugcuacaauauuuaucauacuacugacuggaauguaaacucuucuagagaaagguucauguuuguggcuacuacaguauuuagcauuguucuucacauagacagauaaugggcaacuucuucugucaggcacugugcuaagcacuuaacauguuuuaucucaguguaucuucaccaacuagcaucacuacucuaaacacccagauucaaaaaccugaagucaucuucuacuccucucaaaucugcccagguuugucuaacucuuaaccaaaauccucuauuaacuucuuauauuuacaauaauaaauguagaauacauacacagggccuaacguaggauaagugcugaaugaauguuaacuaugcuuuuauuacaugcaucaucaugcccauuucccucuccuuucauaaauaggaaacuagcaagaauuaacauuccuagaaaggcgaaagguacaaaaaauaccgacuuaguuuauuggauaaaaacagugguaaaauggacauaaagccaaaagugagaacagaacauuuucauauccuccccacacuugaaaacauacuucccaucaucugggauucagguguuagggagccagagccccuuccaaaucucucucucuucaucuucccuggaagcaaggggaggaagaagucagaacccaggggaggaggaagucagaggcaaucucaguccuugucuacccguucaucccucaaaaaucucuggguucgagggaagcagggaagaaauaaggggcaaggggggcuagggacuggccuccagggcccacugccaauaaugucccagauagcuauccuugucuguaucucaucccuaauagguaccauugucaggccuugggagagagaggaaaagcagguagaugguucgagaaccaaauguggucuccagacucuuucccagagucagcaaaagcccuggggugacccccaggacucuaggagccacuccuuuucccuccagcccaaccaagaggugaaaagaaauuccuugggacacagcaucccaagccacucuuaaaucuccacaucgcuuuccuugucauugucauggucuccaucauagaacucauugggugccucuggccugcaaagcaaggggagagaggucaggaucucacucuaaguucuaaucuucucccagcacccuuuuccaaagccauuucucaggccccguugagaaccacuccuccucuuguugguagagacugcuauucauucacccauucacguaucaaauaaacauuaaggaacuacucuauacagacacugucauaaaccuuagcaauacaguagaguaacaagcuggacaagguugucuauccucaaaaagcuuaccuaauaaaugagacuaguaacuaacaaaguaaauaaauauaauaauuucagaugauggagaguacaauuaauaaaaugaagugauaggacugaaggugaugagaggaaaagggugaaauuucagacaggacuauugggacauaagaccuaaagucugaggaggagcuaagcaggcaaagacuucaggaaggccauuccaagcugcaagaaaaccaacuacagaggucaugaaauggaaagagacugauguauuccaguaagaacaaggaggccaggacagccgggagcacugugcauggaggagaguaguuagagaugagauccuggauguagguaagggcuagcaugcaggaccuuuuuaagccacagucaaaauuuuggauuuucuucuaagugcaagguaaaggagaguuuuaauuuuaagaagagugacgugguauuauaaacccauagugaaagaauggaugugaaagcaaaacagggcccaacagguacucaauauugguuucuuucuuuuugaaaaaguauucucaaaagccgggcgugguagcucacaccuguaaucccagcacuuugggaggccaaggcagguggaucacaaggucaagagaucaagaccauccuggccaacauggugaaaccccgucucuacuaaaaauacuaaaguuagccgggugugguggcacaugccuguaaucucagcuacugaggaggcugaggcaggagaaucgcuugaaccugggaggcggagguugcagugagccgggauuagccacugcacuccagccuggcaacagagugagacuccaucucaaaaaaaaaaaagaaagaaaagaaaaaguauucucugggacacagagaauugagaaagucaucaaagagaagcugaggcacuaagccaggaaaggccuuaucugcauggugagcaaugucucaguuacuucuaagugcacaggguuaaagguguggagucagagaaucagguugaaucucagcccugaucuuuaacuagccaugugaccuucagaaaguuacuuaagucucgccgggggcgguggcucacaccuguagccuguaauccuagcacuuugggaggccgaggcaggcagaucaccugaggucaggaguucgagaccagccugacuaacauggagaaaccccaucucuucuaaaaauacaaaaaaaauuagccaggcguggaggcucaugccuguaauccagcuacuugggaggcuaaggcaggagaaucgcuugaacccgggaggcagagguuguggugagcugagaucaugccauugcacuccagccugggcaaaaagagcgaaacuccgucucaaaaaaaagaaagaaagaaaguuacuuagacucucugagccuuagauuccucccguguuaaucugaaaauaagagccaucagaguugucugauggcaacagaaugaucauauauauguuguaauagauagcacuuaguagugucuggugcuuggcaaaccuacaaaaagugguaacucuuccuauuucuacucugcaagucauaugcaagcuggagcuauaggcaucaaagaagaacagaaacucaguggguggccugacagagagguagggcuuaggaacaggaagaggccugaggcuucugcuggcugugacagggcuugguauuauuauaaugcagagacuagguccagaugccagccuggagcuauugauaaaaaacccaaaaggaagaacuuaaaaacagguuuuaccaaaccaaaccagacaaugaaaagcaauuuccaauaguccuggaagcccugaagccagacacuuccagauguucagacacuuccucacucagaagggaucgggggauauccuuggaggaagagaguugcagagauccccaagagucagagcaguaaagcccagguccagaggagagauucggaggccugaauucuaagacagaagcagauucuagaaggggcugagaagcccaucaggcucugcagcagagccggcucaaaccucuaacccugcgugggagcaagacagcgugucccacaaguguccagcugugguuaucccucagucauguaaggaaaucuguuccccauuaagugcaucuguuucugcacuucuugguucuguugucuuucccuuucauuuuucagcaaaguuuugggauuaaaaaaaaauuccauccuauccuuuuuccccccuaauucauuccaucuacaaauauuuuguauguaucucagaaagauaaagacuuuuaaaaaaaaaaaaaaaacauaaccacaaugcaauuaucccacccgaaaaaauuaacagagcaaagaaaucaaagagccuuagagaguauuacgcaggcagugaccuguccagcucaagaccuggaaagacugagaaaaaugcuggcaagacuauagggugcuacagacuuucuggacggcaauuuggcagcaaauauaaaaaauuuuaggccaggcucaguggcucacgccuauaaucccagcacuuuggaaggcuggggcaggaggacauuugagcccaggaguuugagaccagccugggcaacaaggcaagacuccgucucuaccaaaaaaaaaaaaaaaaaaaaaaaaaaaaaaaaaaauuagccaggugucguggugcacaccuaugauuccagcuacucgaggggcugaggcaggaggaucgcuugaacccaggaguucaagauugcagugagcuauaaucaugccacuguacuccagccugggugacagaaugagacccugucucaaaaaaaaaaaaaaaaaaaaaauuaaugcacacagccuuugaccuagcagcaaccauucuacuaucuaacccacucaaacaagaaugcaaagauguauaauguaaggggguucauugccacauuauuauuguaauaccaaaaaaauggaaaauaaucuauccacauaguaaauuauuauacagcugauaaaauacugaagcagaucuauauuagcuagcugaaaacagcuauaugauguaaagcagcauacguagaaugacccuauuuguauuuacgaaaaaccaaaaaccacacaaacuguaaaugaguguauauguguuuguuuauauguacauacagaauaguauauuugcaaucuauagaaaaaggucuauccaaaacaauaaaaacuauuaacagugguuacuccuguggaauaggucugggauugugugaacgccaacaccauauuuuggugcuguuuuaaaauuuugcaauaaauacguguuacuuuugucauuaaaaauaacaaagaaaagagugaggaaauuguagcagacuaaaggagguaagccagaggcaauuaaacuaauaccuucccauuuacuuuuucccuuuuaaaccuccccagcaagccuauugaaaguaggcugaagucccugcucccagaccugcuauaguucuccucaggaccccucuccucugcaucagccucaucaguccugucauaggucaggaggucugcaggcacgucaugaaucuggacacuaggugcaugguucagcaucuucagguuuucaaagauugucuggcggaucugguccagauacugguuggaaaugaggaauacagagugagcaguuuccagagauucccaggacauggaaucuccuagcugccuuuuaccccuaccauacugguuuucaucucagugguaccucuaguucaggucccccaacugauagcucucccuccccaccaaccccaacugccucuacuuuaaacuggacugccuccuagucaauaacagugacugugauggcuuagaacuuccuucucuuugguuuuuccuacuucccacaucuuugaccucuccugggcuccaccuuucaggagaaguuugugcucagcuuuucugagcugcugaccuggcgugaguucugauucucgaugcgggugcugacaucuggaugaagugugaagucuggggcaaaguacucgaaguauucuuggggaggagaggagaaaguauggcucagacugagaaaggcagcuaacaagacuucccaaucuuuuuccuucccauccagagcaccuacauaauagcugcccaaucucuucccugcucugagcccagggguuuagucugcagagcucugagaguguaaaauuucccaugugccuucaaaccaggucauucuggaaucuggugagaauggccuuccuguuauggggguguuguggggugguccuuaccacuauagggaagcuccucacuaauggccucuucuaccagcagcgaugucucauauguccugaaaccaaccagcagaggggagcaggcugaccaagugggcugaaggacccauguggccauaucugagggacacccuagcucacacuggacaacaggggaggaaaucaggagagugcucaccagcagcgggcaacauuucggacaguauaaccaccaccacccagcacgaguagagggauauugaagcucuugacauauucaacgcauucccuguuaaaaggaaccagaggaagauguggaggagguuaucaaaagacaagguaaauaccuuuagguauugccugaaaggagcacaagaaaacuauaaauguucuaaaucuuuaucuugauagugaaauucauuauguuauacccuuaagauuuggguauacuuuauaugcugugucucaauaaaaauuuuaaaauaaagcacaguccccccucuguucugcucaacacccucccuggcacccugccugcuaaucaacuauucucaucaacccaaguucugucaauucuagccuugaaaauauaacucacgcccggcgcggugcucacgccuuuguaguagucccagcuacucaggaggcugaggcaggagaaaugcuugaacccaggaggcagagcuugcacugagccaagaucgugccacugcacuccagccugggugacagagcaagacuccaucucaaaaaagaaaaaaaaaaacauauauauguguguguguguguguauauauauauauauacacacacacacacacacaccucucagaucaucuacuucucuccauugccacccccuccaccuuagucugggcaccuaaccaacaccauggcuuccuaacuggucuuucuacuuccaucuccauccccccuacccaaaccuuucucuauucagcagucagaauugucacuuucaaacacaaauuggaucaugucacuuuccugcuuaaaauccuucaaugguuucccaucaucuuuggaauauaauucaaacuccuuaccaggguuuaaaggcucugcacaaucucaccauggccagcuucucggaccucaccucaacagacugaaguccaguggcacaaucauaguucacuguaaccucaaacuccuaggcucaagugauccuccugccucagcuuccugaguagcuaggacuauaggcaugcaccaucaugcccagcugauuuuguuuuuuauuuucuguagagauggcucucacuauguugcccaggcuggccucaaacuccuagccucaggcgauucucccaccuuggccucuggaaguguugggauuauaggugugugccacugggcccagcccucagagccuuuugugggccuuuguccaugcuugggucaggcuucucucugcuccucuuaugacucacuccuucuuagucuccaggucucaacucaaauuuuacuuccucagaaaaacuuuccgaaaccaugcuaucucaaguaggucccccauuguauccugugucucagcuuucuuuuuuucuuucacagaauuuauaagaaucuauuuauuucauuugauuauuuauuuuuugucuguuuccuaaacuguaaacuccaugggagacuccuuauuccauccccaugaugugguaugaugccuggaacauaacaggugcuuaauaaaaauauaucgugaaugaaugaccaucuagggaacccuguucaagaugacauuucuaguucaaguacaauuuguagcuauuuuugauuuccaagaagaggugaggcccauuccccaacuacccccacccacguacugaaguccaaggccacuuaaaaaccuuggggagaagaaggagagcaagucucacccaugcccucggaugcugagguuaaagcagcccaaucgaucacagcccagagagucagcuccacacugcaaaaagcaaaaccccaggaaagugcagugaucagaacugaucagaacaucacagauaccccuuccaccaccaaccuaaagaaccuccucuucccuugcucucuuuccccaagcccaggcagaacacuccugaggaggaacugacaguauuaccuggagcacaaugcacguggguugguagaaguccacuaccugguugauaaccggcuggaaaaggugcuuguaaccugggagagggccaaagaugggcaccuggcaccccaaggggauggggagacagggaacaaaaggaaaaaggggguugagcgagcauguagcccaggaaaggggccacccaaaagaaucaaaucacuggucugaaacuucuggaagggaucccagacugcuaugagugacugaugaaagccaaugacuuuucccagaaaaaugcacauacacaugauauguugcauacaauuuccagagauucauggucccucugaaggccauucauccuuaaggacaacuggcccaacagcagacaauaccaggcagaagagguuauuucaaggagaaaaagaaggggccuagggaacagagggaagacuucgguacuuacucuggucaucaaugccaucccgcaggggcacguucagacaguaguagcggccacucucugccccgacuucauacaugucaccuguagggaaguggguggugguagccacacaugggaagcacccacaacccagcuguuucagccccaaucugcacucugggagccucucauuccaucuauguagcuucaccauaaacucccuagagccacuaaaucucuugcagcuugcauucauugggcaaauaguuuugggggauccacucugagccaacuguguacuaggcaguagggaugcagcaacgaauggaacuaaugaaauuuacgauaucccaccacgcuuauauucuuagggaauagccaugaggaggagggaggcaguaaacaaaacaaaacaaaaaaccacaauaaacacaaauagcagugaguguucugagggaaacaaugaggcugauguaacagaggaauggggaaggaggugauuaugauaacuggagugguaaggaaaggcuucucugaggaggggacaccugagaugagacuagaaggcugagaaggaggcacucauaguaaagagcugaagggugcaaaggggaaaguaaucccuauucccauaccugugccagggaagaaguaauuuccguauuuguggaaggacaccgucaugacccggucagugagguagaaagcuucuugaaccccgucaccaugguggaugucaaugucaauguagagcacccgagggugguaccuagagggaagccaaagccagggucugagcuagaagugaaccccccaacccacuccucucaaacaccgggucucgaauugugaagagucugcuucugcccuggucaccugaaacuuaaugucaccaguucccuaaaggcaacugggggcuccagccuagaggcuagaggcagggacaggagagggauaugcagagaaggcugaaaugugagcaggcaguagggaaucugcagcaguggaagaggcagccugaauaaagcaucaagaacuugggagaagcuaaucagggaggagggaggucaaggucaggguugagacugagagaccuccucagccaagaaucccguaacugcccccaucuccuccugggcuacuuacuugagcagcuccaggaugccaaucacaaugucguugacauagcagaagccagaggccuauggcaagacaguggucucauaaagagaagagcaauuccccucccagcugccccccaccaucauccuaaacaccuacccuaggauggccacugucuuucccaucaccuccucacucaccucaaacuucuuggcauggugcagaccaccagcccaguuaauggcaauaucacagaucugaaagacaaacaccuaagucacaguccuuccugcccaccccucaagcugggagcccaggaucaggguuaaaucccgaguccagggauccagaggaaaggaagaacaggacucgggacuaugucaccuuguuguucagcuggguugcuccuugcagagaugcgccuguguaacgcgagcagaacucaaagagcccgggaaacacugggcugcagggaagaggaacaaguuggaacccuccugccucugucugggcccuucccauaucucccuccccauccuagauuccuccaaucuccauuuuucaagaaccuucucucccucuccuacacacgugggcuaucugcaaauuuauucaacaaauauuuuggaccaaaccauguaccaagcccugugcaaggcacuggaugggaaguaaagaagcacuuaacugucagggaguuuguauccuagcugcggaaagaagcaagcagcuuccagguacucaaguacaauguaaaaaggaaaucaguugaaagaaaacaugagcucuguuuuucuuagucuucucaguguaacaaauuuuagcauaauguucaauaauauuuuucagucacauauuuuaaagaaagaacuguauaccuacauaugugaaacagugaugagauaacccacgaaaagccuguagcacaguauacaguauccgcucagccuuuaauaaaugucagcuauaauuauuaccauuguuauucuuuauaaaaaguaaaggcuugaagccagacacaaaagccuacuuacuguaugacuccauuuauguaacauucuggaaaagguaaaauacaaggacagacaucuuaucaguaguuggcuggaucuagguugcagagaaguuauuaacuacaaaagggugagugaccuuuguuggguaguggaaauuuccuguaccuugauaccuuuuuuuuuuuuuuuuuuguagagacagggucucacuauguugcccaagcuggucucaaacuccugggccuaagugauccucccgccuuggccucccaaauuguugggacuacaggugugagccaucggcgcuggcccuauaccuugauauauucuaucaaaccucucagaacucuuacaccuaaaaaagguuaauuuuacuguaugcaaguuauaccuauauaaaccugacuuuuuaaaaaggaaaggcuuaggcaaucccuaguuuuaggucucaaaaaaaaaaaauagugcagcugauacauuugaccaugugaaaaacagaacuguagggguuuuuuguuuguuuguuuuuugagauggggucuugcucugucgcccaggcuggggugcaauggugcgaucucggcucacugcagccuccgccucccggguucaagcaagaauuguaggguuuuauaguuucucaaaaggcuuggaaagaauuagugauuaauaccagaaaacuaagcaaaugaaaaaauaaugcaauugucagcuccaggaaaaacaaaaagcuuuagaagaaaauagauuaaaucacacuacacuauuuggcuugauaguaaaugaaucuuucagaguuauaauaauguaaacacagaauacugauuuauuuuuaaauuacuaugaagcugaaaggggaaaggaagccaaugugaugguguaagaagacuaaaugcucauaucccauacuaaaagcuuaacagauaaugccuaaaauugacagaugaagaaauagcaaugagagacaauacaggaggggaguaugauuacaagcaccgauucuggagcuagacuaccuagguucuuuaacaccuacuaaugauagugagguuguacaaacuguuuaaccuuucugugcuuaaguguccucaucgguaaaaggaaacaauaauagacccugcuucauagggguuguugagauuaaauaagcuaauggcuguaaagcacuuagaacaguaccuaguauauaacagguauuaccuaaggauuacagauuaguaauaacagucaauuaauauuauuauuuagaaauccaaagguaaauaccagaagacauaggggaaaggagcugaaaguggcugucacugggcagagggauuuaugggugaaaaggagaggucuggaauuuuuuuuuuuuuuuuuuuuuaagacagagucucacucuguugcccaggcuggagugcaguggugcaaucucaggucacugcaaccuccaacucccggguucaagcaauucuccugccucagccuccuggaguagcugggacuacaggcacgugccaccacacaugacuaauuuuuguauuuuuaguagagaugggguuucaccauguuggccaggcuggucuugaacuccugaccuuaggugguccacccgccucggccuccgaaagugcugggauuacaggcgugagccacugcgcccggcuugggacuacuuuuuuauuuuuuucauuuaaaggccuauaguacaauuuggcuacuuauguuagaauacuuugaaaccaaucagaaauucauuaaacagaagaaaaauuccugauucucaucggaaauacagauaagcacaacuguaacuuguuugacaggaagacugaugcagcauaaauagcccagagauaguauucuaauuagcauucccuaaucgcacaaagagcaucuacgggaccccaguguggcguaagggcugacccuguauucacagagcuagaaagugagcucagaaauaacagcaggaauacuaacaaaaaaacaagaaaccuccccaaacagcaugugacugaacaccaaaugagcagugcagugugugcaagacagagcucuaugggcugguguggucaagaaagguuucauggagauggugugaaggcugagaaggccuugaagagguugaauagagaacuaagggcauuccaggaaggcauccugugcagcugagguguagggauaaaguuggaaaggugccaaugccagccuaaugaguuggccucuauccuacagcccuggcugcuucugucauuaagaucuuucaggaaaacagauuagugguuuaaaaacccgggaucuggaucaugcccccuccaaugaccaguuaugugacuacggcuaaguuaccuagauauucccaaaccucaauuuacuuauauauaacaucagaaaaaggucuauuauaauacaucuaaggauugguaugagaauuaaguggauuuaccagcaacccuuggcauaauaccuagcagaguaagcacucaguaaaugguagcuaucauaagaaauucuacaggaucaacaaccugguuucuucaagaaauaaauucaagggggugacagaaaagcuacaaauuaaaagucuuaagagacauaucaaccaaaugcacuguauagaccuuguuuagaucuggauuuaaauuagcuacaaaauaauuaugagacaacugcagaaauuugaauauugaucccauauuugaugacauuaaggaaucacuguuaacuuuuuagguuugauaaugauacuauguuuuuuuaaaagaguaucauuuagagauacauaauaaaauauuuauggauaaaaggauauaacaucuaggaucugcuuuaaaacaaucuaacaugagggaguauagaugaaguaagaguggccacuugcucagcugggugcgauggcucacgucuguaaucccagcacuuuuggaggcugaggcugguggaucaccugaggucaggaguucaaaaccagccugaccaacauagugaaaccccaucucuacuaaacauacaaaaauuagccaggcaugguggcaggcgccuguaaucccagcuacucgggagucugaggcaugagaaucgcuugaacccaggaggcagagguugcagugagccaagacugcaccacugcacuccagccugggcuacagagugagacucugucucaaaaaaaaaaaaaaaaaaaaaaagaguggccauuugcucauaagcguugaagcuaggugauggacguaugggaggucacugcacuacuucacuuucagaaauuuuugaaauuuucccuaauaaaaaguuuaaaaacaaaaguaaguagaauugagcaacugguagcugugaugguuacuauuuuuucauggauauagaguagaguguggcuuaucuuuguuguccacucucuuccccagagggucuaacccugacucuucuauggaugauacaagcucaauguaaaccuaaugauaucaaaccacuccuucguuguuuuuuuuguuuuuuuaacugcccauagcccucuuaagaucccuugcuuuuuaaaacacuuugauagcuucccucuacucuacggguaaaaaccccaauucauaauagagcuguuugcuuuuaaaagguccuauuucuuuagccucaauucaguucaccuccucuucauacucugcacuuggccuuuuuucuguuccucaaaugagucauacucaguccuaccacagacccuuagcacuugucccuacugccugcuauacuucuccccucacccuccaaccaucuuucaucugauuacuucuacucuuuuuucagaucucagcucaaucuuuacuuccucuaggaaggccccaccgaccagccacuccaccaagcuaaacaauccuccacguauacacucucauaaucugucauacaccuccucuuuauaagacuuagcaaaaauacgauauuaaaauuuuguuuuuguucaucacugcauucccagcacuuagcacagggccugccuagaacaagugaccaauaaauauuuauugaauaaacaaauaaaaugaauuaugaugcauugacaaguaggccccccuugagaucuucccacugcugccaaaagaccucacugaagggcuuggcauuaaacuguuagacaucaaaacucccaguccucccucaccagucaucgccuacguugaaggcauuaagacucuuggugaagccuugcauauugguggggcugacucucugcaggaagucaauguaguccucggaguggaagcggcacaugucauguugggaggccugguauggcuugaagaccucgggauggagacacaagaugaacccaggcagggucagccccacuccacaggcucagaccacccauacugaacccaguccuggagacuauaugaagccaaacauagcauuccccucaucccacaauccuuaagucaguagagagacuccgauuaaccagguaaguuauuacaaaugagcccccugaagaccacuucuuuuccuuuccaccuccagcucagccuaucguaccuucucaacuuugagcccugauccaccugcccuguuccuuggaaucuccuauucccaguucucuccaugcucaucuccucccccaagcucugauucuguccucuuuccucuggauucuucuuucuggagucaaauauaugggauauaugucaacuuucuaauuaaaaucaaagauuuauuaucuuuggaaggucagggggaugugucacaccucuuugaaaacugcacaagaaagagcuuuucuucucccagaaaaugcacacagguacauacaggcaaacaaucucaagggauauagauuccugcacuaacaucaccucagucuuuucuaugaccaguccauuugucugugccuuggcacaagcaaugaacauucauucauauuguucacuaguuucccuagcaacacauaaagccuggguuuagcuguuuugucuuauuuuuucuuuugagacaagguccucccugucaacucaggcugcugaucauagaucacuguaacuuuaaacuccugggcccaagccauccucucgccucggccucccaaguaguugggacuacaggcacacccaccgcacauggcuacuuuuuuuauuuuuauuuuuuguagaugugggucccacuguggcccaagcuggucuccaacuccuggccucaagcgaucccccccauuucaaccucccaaagugcugggauuacaggcaugggccaccacgccuggcguggcuuaacuguuacuaucccauaucacagccauaaauuccaagcugggaagacagcauguguaugucugguagaugaaaaacuggauagcgauuaagcagaaccauguagagguauuccaggcugaaaaaggaauaucuaaaauaucgccucuguuccacacgcacauacacauuuacaaagacggcagcaucguuccacccuggagcccuagcuccuuggagguaaagaaaggugguaaaagaggagugggaacugaggguaaaccucacacccugauacagugauauccgcuccccuaacccuaauuccugaggccaaggcccuauccacacucuaaaaugcagaggaggaacacaccuucugucuucaaaccagccccacaucacgcuaacccuaggccaagggcuagugugccuacagucagaggguggccgaccugaggugagaaaguacuuuccauuaagcagaggacgccacccccaacacccugcacuuucaagguacuccuggugacuucuauccagcuccccgauacucuaggggcgggucgcacuucaugcacucaguccagcccaccuaucccuacggccacagcucgccccaccccccaacccccggccgaggcggcggaacucacgaucaucuucuuauagagaccguaaugcaggaccaggcuaugggucaaugccaggcgauggggcuucauaggguguccagcuccuggggguggggagaagagaguucgucagcucucaccccuggaguugcaaccccgccucaaaaccuccgugucccaacuccucaugcauaucccuguuuccucaccguaguggaaguugcccacgucggggucguagaaauaggccacggucuuggccauggugccggcgggagcaggccccgcaccuccgccgcccgccgcccgcggccgccgccagccccuccccggccgug

SEQ ID NO: 18532 - RNA, 12446 nt, Homo sapiens
cagcccggcgggcggcgcacgcggcgccgcgugacccgcagccacgugacccgcgcggggccgggccgccggcgcagucgcugcagccgccgcgggaggcguccguguaaguggguagcagggcuggcggggaccuuccucgcgggccggagcgcggagcgcugccccagcccuacggcacucggggucgggaccccggggagccgcccucacacauuuuccaggagggaucggaggggcgauggggugguaaugggggugggggacacgcuguaccccaccgacgaccgcgcgggccaccuucgccucuuuccuucacacucccacuaaccgcagugcugggggaacaaaauguccuccuucuggagcgauuaccuuuucccuuuugugcuuugggggaaacugaagacccagagggguucgcaaagcaaggugggccaguaggaagaccccuccgcuaguccagagagagcacacagcuccccaggcagagcucauugccccaccugcucuaguggcccagcaugaucccaugaccucucuacuucuggaggaagagucuugggguagacggcggggaggggguaggguaucccguuccgguaggggcagggaugagggaggcggggcugagccgagcaucuaucuggaugguaacagccaacguagaaaauacuaaguuguuuacaugcauucucucauuucauauuacccgucgugaagucugugaaguagguacuauugucccaauuuuuacauaggaggaaacggcucagagagaacuuagguccuuugaccgagguccugcaggugguaagugaaggagcugagauuagaacccagaucugcccccaguggcgccuccucguggucugugggugguggagacgacuggccuagccucuuagcuccucugugaauagaaaggccuuuuuccuggcucagacagcuugggaaggggauuguugcuggguaagagaagcuucucccaccaccuccaucucuuucucugccccuuaccauugauuccuuucugucauccccucucccccacugcaggacaagaugaagcucaucauccuggagcacuauucucaggcgagcgagugggcggcuaaauacaucaggaaccgcaucauccaguuuaacccagggccagagaaguacuucacccuggggcuccccacuggugcguucuuggauggagagggugccguggauaaggguggagagaguaggcaacaggggccagguacaccggcucacucagccaagggacuucacgggggcucugggguacuggugcugagagagcaccuuccugccccuuccacauacaaaggacccagcuucccuuauggguugguuuagucgcugccugucccugcagaauccuggagcagaagggaucuugguuggcaggaagaauuugauuuuuaggcuacauccuaagucagcccuguccaccaggguuucuuaacagaauuaaguccugauacccuaaggcauucauuuuauguaaugaauuaauuucucuucucugcaucuagagggguaccagcuaaguaccauccuugggagaauugaaaagauagucacuuagguaauuuucuguaaggcuuaauuaaacacaggaccuaaauaaaaaacaguucuaauuucuuuuggaaaaaaucaaaauguugcuuuuucagaaagauauuuugaccccagcuccucaagacaaauguccugauuauuucuuucagagauggauggguuugcccuaguggcccuaccugacccauccauuagcgugucuauguguguguguguguguuggaggggucuucaaacuuguucuuuuuccuuuuuuuuuuuuuuuuuggucuuccuugcaguccagacuuuuucuguaaauggccaguaguaaauauguuagacuucacuagccauauagucucuguugcaacaacuuaacccuucuguuguuugaaagcagcuauaauuagccuggcaugguggcgcucaccuguagucccagcuucuugggaggcugagguagguggauugcuugagccaguagauugaggcugcagugagccaugauugugucacuguacuccagucugggugacagugagacccugucucaaaaaaagaaaagacaauauauaagugaaugaguaugguuguaugccaauaaaacuguauggacacugaaguuugaacuuauauaauuuucacaugucacaaaauauuauucuucuuuaauuaaaaaaaaaacuauuuaaaaauguaaaaaccaggccaggcaugguggcucauaucuguaauuucagcacuuugggaggcugagguaggcagauugcuggagcccaggaguuugagauuagccugggcaacauggcaaaaccccaucucuacaaaaaauagaaaaauuagcuaggcaugguggcacaugccuguagucccagcuacugaggaggcuacggugugaggugugaguauugcuugggccaggaggucgaggcagugaaccaugauugugcaauugcacuccagccuaggugacagagcaagauucugucucaaaaaaaaaaaaaaaaagaaagaaaagaaaaccauucuuaacucauaagcuguauaaaaacaggccacagggccgggugugguggcucacgccuguaaucccagcacuuugggaggcugaggugggucgaucauuugaagucaggaauuugagaccagccuggccaacauggugaaacccugccucuacuaaaaauauaaaaauuagcugggcaugguggcgggcaccuauaaucccagcuacucaggaggcugaggcaggagaaucaauugaacccagcagauagagguuacagugagcugagauugugccacugcacuccagcuugggugacagcgauacucugucuaaaaaaauaaaaaauaaaggccgcaggccaaauuuggccuguggaccaaaguuugcugaguucugcacuagagguuugugggaguaguauccaccugugccugugaaacuaccaaugucucaggcccucggaggcugugcuaacauccugucuccuaacuguggagagacccaaccucuguaugggucagagucuggccuucugaaaccauucccucguucccaucauugcagagucagauccaagcucuucagaguggcauucaaggcccuccaaaaccuggccucucccugccuguccugcuugaaccaacaggacagcguuuccacacggguuccuuggaacauugcuucuguuagauguagcaccugucaggguucugaguggaaaccacagaaaccaacuccagcuaaauuaagcagaaaaggaguuuauuggcuagauacugggaaguucagagaauucaugggaaggcuagaaguuuggaaaauggcaggagagaggaagcuauguggcucaggcauagcuaaggccuugucacacggaccaacuaauuauuuugggugggcugcggggagcugccauucacucagcagguauuuauugaguacccucuguaugcaaagcuguucuagccucuaaggauacagcaaugaacaaaaaggauaugaacuucugccuucugaggcuuaaauuauaaugggagagacauaauaauuagcaaaauauagaguauguuagauggugauaagaggaaaggagaaacaugaagcaggaaaggauagggagugugucggcagggguggggcugugcaguguuggauaugguggcagggagggucucauagccaggggccagguucuguggagccuuagaauaacugguguugcugagggugaaaugagaagcuauugguggguuuugaaaagaggggugacaugacguaaucucgauggguuuuuuuucuuucauuuuuuuaguuugcaaaauuucaaauauucaaaaaagaggaaaaaaacaggucaauaccauucaccuaaauucaccaauuguuaccauuuugccacauuugcuuuuaccuuucucuggcucuuguucuuuaucuacacacacacacacuuuuuuuuucugaaccacaugaaaauaaguuccagacauccugacacuuaucucuaaauccuucagcacauaucuccugagaauaaggacauucuccuacacaaccaugauaccaucauaccuaagaaaaugaaaaaucaugccaucaucuaauaugcaaacuguguucacaauuuuuucucaauuguccacauuuaucuuuuauagguugguuuuuaaaaaauuaauucaguguccagucaggguucaugcaucuuuagucuuuuaauauacaguguccuccuaccuuuuauuguguguguguuuuuaugacauugacuuuuuuuuuuuuucaagauagagucuggcucuauuggccaggcuggagugcaguggugcaaucucggcccacugcaaccucugccucccagguucaagugauucuugugccucagccucccgaguagcugggauuacaggcacaugccaccaugcccagcuacuuuguguauuuuuaguagagacaggguuucaccauguuuuccaggcuggucuugaacuccugaccucaagugaucugcccgccuuggccucccaaaguguugggguuacaggcgugagccaccaugccuagccaugacauugacuuuuuaaugagacucaacuagggcuucgcugcuccucagggaagucuuccuugaacccugaagcacugggugagccugugcuuuacccuaucacaacugacguuccugcuuuguguucuacuccuagugaguuaucuuagaguagcuacugucccuugcuccccuguguccuuaucacauggcccugugccuugcacauauuacuuguucagggaguaucaugucaauaaugaagucugauguucacucagguacuaaucagagugauuucagucaucagugugcuggauacugggagauucagcagugaucaaggcagacacaguccugcccuccuggagcuuacagucuaguggcaaaauaggcauuaaacaagcaauuaauggauggauggcaguuaggauuggaguacuggguaggacuucagaucugacagguucucccugugagcagcccugacuuauuccugugaacccucugggcuuccagacuuggggugcaagggguguucauggguguggccacucuugcagggaguaccccacuuggcugcuacaagaagcugauugaauacuauaagaauggggaccuguccuuuaaauaugugaagaccuucaacauggaugaguacgugggugagucuuucucuuucaagguucuuuccugauucuaggagagugaugcuccuccucucauuggcccaguccuggagaggaaucggggagccagugacauuugaugauaggcucaauuaucaauacuuaccucuugguuuacucagcuauaaaauggggcuaauaaagcugaccucacagguuguaagcauuaaauucauuuaauccuuuuaugauaaaagauguggaaguuucuuauacauaacaaauacuuaauaaauauuagaguaucuccuucuccucugccugcuccucaacuccauuccauuucuuucuggaacaaaugauugcaagugggauccuggcucggguguuuccccuaggaucugugucugugcuuucucuucuguguguggccuccagcuccccuuucugccagguacacuugaaggggaccugagauugguauccuuccugcugcugaaagacuauaccuuggucuucuaucaccucucccucacccaguccuuuuguaauagcuucauuuuaaacauccuuuuuuuaaaaaaaaaauugugguaaaauacauguaacaugacauuuaccaucuuaaccaccuuucuguguauaguucaguaguguuaagugcauucacauuguugugcaaccaauuuccagaacucuuuucaucuuguaagacucaggcucuauacccgugaaacaacaacuucucauuucccacuucaccagccacggaaaccaccauuuuacugucuguuucuaugaauuugacuacucuagaaucaaacuagaguauauaacuggaaucauaaaguauuugucuuuuugacuggcuucuuacaccuagcauaaaguccacaagguucauccauuguuguagugugugucaaaauuuccuuccuuuuuaaggcugauuuuacauauucuuaaugcuuaacauuaaacauuauuuuuuuuuccuggccaaaaaaaaaaaaguugaucuggggaagcccuaagauaguucucucuaaccaccugguguucaagcugggauuuauucaggcugagugggguagaacugggaguggaugguggguugagaggcacagggugaggggugugcuugcuugcuuucuaagaugaguucagcccuaccccagguggccagaguguccccagccucuaaccuauggucauugccuuaugaaaagcagaucagaucagaauguggggauuucccaggcccuuggugugcaguuacucuggccaagcccuguggccacagauggugguacuggguggguggacacuuauggauacuggcucagccugugccgaguggcuaggggucagagggcuggugccuaaggcucccagaugggcagaccccugggagugucucuguaggucagcaugguguccuggcauccuucuuaggagaggggcuuuggcuuggccuaggcauaaccgagugucucacggccccacaggccuuccucgagaccacccggagaguuaccacuccuucauguggaacaacuucuucaagcacauugacauccacccagaaaacacccacauucuggaugggaaugcagucgaccuacaggcagaaugugaugccuuugaagagaagaucaaggcugcaggugggaucgagcuauuuguuggaggugagcuugacacucugcagcacacauguccagggccagacccgugggaaggaggacaagacacaaugccugucugcagacagcuucuucugggugugcuagugaccguagagacagaggcgggagaaaugggcccugccuggcucuguuacucaggaacuauguuaucuuggagaucucuuucugcaguuugaugccuugucuguaaacugagagguuuggguuuggacucugagauucugucuacuccccagucuuaagguuuuauggaucaguccuggaacuuaucuaaacauuuaacaucauggacucauguaguuccggaaggcuccacacagccccuguagauagccaguugaaccccagagaaguuaggugacucacucaagguucacaggugggagcaagugugugcuucuuggauuugugcucggguccucugggcugcccuucuguguauccaucuaucgccaccucuggaguuacccaugagggguaacauugaacugccuuuuauugcucuagagaucacucuucuauacuucaagguggggaggaggggggcaggaccucucauccucugagauuuuagaaccuuggcagccccuguccagguucucuggguguuuuguucacugcaccucuaucccagcagcaggacccucuaacuacaggcagaagagacagagaagguccacuuuucugacaaucuggggaggcagaagcuguuuggaguguuuccuccucagcuuuuugagggugauagcaaguuaacaaugucugugugugccucagauagacaugauggggagggucuccucugagacaguauggcaaagagaaagaaaugguagggagggggacagaucacauguuuaagguguaccugcccagggcugcaaaugagaaaggugacacagcuuucaaugauuuuucuucagacccuaguuagggaaggagagauuguccauucuugaaaucuuggaucccugggacugacagggcugcacgggcucucucccuauaggcaucggcccugauggacacauugccuucaacgagccaggcuccagucugguguccaggacccgugugaagacgcuggccauggauaccauccuggccaaugcuagguucuucgauggagaacucaccaaggugcccaccauggccuugacggugggggugggcacugucauggaugcuagagagguaagggcauaagggccccaccagcuugcgcugguggacuugucuuucucuuguuaaucuuaacuauacugguaccaccuacauucuuauuaaagaugaaggcaugguaaauaaggcuaaaaucccugcugacccuguuacucacuguuccucuugcgucuuuggaagacaucauuauucccagugugaggugaaucccuugagcacguuuuuggugccuuuggcugacugccugagacagcaggcucucuggccucaggccccuuucaugcuuuucacaggcagagaggaggccagcaucgcuaauguuggaauauuuguaccugaccagguauggagagagggguucccuuguuccuuguaguugguagaggucacuguugggacaccaaggaugcuugugcuucuagccccgugcucagagauuaauaaauguggugaaguaugauuaaaauauaaguguuuuaaacugaauuuagcuuuuccccuaaaaaauuggcuaucauuugaaugugaauuuuuugugguuccaauuuccuuauuuucauuagaacuuuagaagcauuuucucuuccuuucugacguguauagacauguuagauuuacauuucuuugcccaagccaauaaacaagcaucuaaaucagugaaaacuucccuguuuaaagugaacuuuugugaaaugagugauggcacccagauuucuguuggguaaucuucaaucaguacgugggguggggguguuuacucgcuguuuuuagcucugcagcuuggaaacagguuuagggccgucuuuaucaugagggcaucuugaucugggaaaggaccuggggcuggaaaucaggaaauuaucuuuucuaaagaguucuggguugcugagggguccggaagaaauagucacauucccucucugcuucugcauucuaaucuuuuaagaaaggaacaguaaauccuguucacaacucuguggcacaugugaauuaaaaugaaaggaaaucuacagaacugaguuuuuuucucuuuuccugcccuugaauagagcugaguucuuuaagaucacuuacauucucgauauuuuaacuguuaaguggagacugugccuuuguuuuauuauauauuaacaaaaaccaucaccccaagucacauuaguucauagguuuaaugcugugaacugaaagugaccagauaauggggcaaccuuucugggauucagccuuagaggccccacagauaacucccaccauugcuugcaaagugcccuugcugguggugcagguugggagcccucuuucacaaacugugcuuguguagagucacccagcugaugggauagcaggccugggcauggcaugucuguuuacagggcaccuucauagucaucaucaaagauaccuggaggcacugucacgugguagucaagaacaugaacuuuggggucauaaaugacccugggcaaguuauuuaacccccuggggcucuguuuucuuauaagauggagauaaugaugcugccugccucggguuauuugugugauaaagcacagggagcacugagcaaaaguauguugcaugguaaccacuuacaaugugauaugaaaaacaaucauccuuacaacuguuuagggugucuggaaugcuccccuccaucacagacuuguuuucugauccccaggugaugauccuuaucacaggugcucacaaggcauuugcucuguacaaggccaucgaggagggagugaaccacauguggaccgugucugccuuccagcagcauccccgcaccguguuugugugugacgaggaugccaccuuggagcugaaagugaagacugucaaguauuucaaaggugagggagguguggguccaggaggagguggucaagcuuagggugugcuaggaguaaggaguagauccagcuuucauccucuggucauuuuaauugacaacuguaaucuuaagaaauaucaaacccaacugcaucacacuacacagucauuucucuucugccugugacugcaaagauccauuucuggagaucuguuugcucugaggaggaggaaagaaaacgcaaugugguccaaggacuauguggugaccucacagugccauuaagccucagguuuucucuuuucaaaucuuaaacaagcgauuccuuucuuuuauuuacuuucuuucuuuuugagacagggucucacucugucgcucaggcuggagugcaguggugugaucucagcucacugcaaccuccaccucccgggcuuaagugauucuccuugccucagucucccaaguagcugggauuacaggugcccgccacuauacccaguuaauuuuuguauuuuuaguagaggcgggguuuugccauguugccuaggcuggucucaaacuccugaccucaggugauccacccaccucggccucccaaagugcuaggaucauaggugugagccacgaugcccagcccuucuuuuacuuuaaaaggaugcacacugcuuuaggcaaacaugugaaaauccucuuuuacucaaguaggucaauuaggaauuuguccuuugcugaaaagacuaaccuuuaaauagccaacucccauagugauugaauuuauaaaaguuccaugaauguaguacucacugugaauaacucuuuuuauacucuuaggguguuuaucauuuggggaucauagagaaaagagagaagugucagcucuaagacaaaauuugagagcuccuggauguuaugauugauaaucaaggaacucuugccacugccugaauuaacuacuuuuuguuuuuaauuuuuuguagguuuaaugcuuguucauaacaaguugguggaccccuuguacaguaucaaagagaaagaaacugagaaaagccaaucuucgaagaaaccauacagcgauuagccugugcugggaccuagugucaaguacccauagggaaaggcaggucuuucuggaaauugucuuuagaagaaagaauuguauuucuuuaaucuaguaugguuacuccagauaagugggugaacuuauuguucuuggccaugaggcugggagccuagucacggaguuuagcuauagggagaauguuuguaacuuaaucagaaaaaaaauaucugcaaaauguacuccaucauuuugaugucugccaaacccagguugggaguuuuaaacuuuuuguucugcuucagccaugguucacacauaugacacacucccgucaggaauuucucuccuuacacgcacugauuuucaagugggagggaauuaggggcuuauguauauuggauaccaccucuuugaagagucuugagaguccuucuugcacaggccugccccuugguugagaaccauuguuccaagugaaggcacaaacucucaauaucuaaaauaagugcaaggaagcagucucuuuggucaguaacaagugcaauggaaagaaaacgaucccuuccuucuuccacuuucacagcuuuucucugaacuaggagaaccuggggguggauuuggguggguggggccaaagaggaggcuucuauugauaaauccagagccucaaggggcccagccacgucaaacuucucucccucagggacucuccagcaccaaaaggcagaagguggaagccguuuuucccccagagcccuguguuuuugugaaagccucacuguggcuccucuguuuuacauacucauuaguaagugggagguccacuggggcaacagacacugccacaauuucaguguuguguucagccaaggggacggucugggcaggcagcuuaagugugaguuuagucacaacuccugagugucccgcucuccugcuuaccuaggaggugagugccaggaaaauacaccaaaugcuucuaguauuguuuccccacuuaaaauaguccugcuuaaauucacaugguguggucugauguucugagagcaucaggaaauacaacccuuuugcccauuuacccuucuccccggaucccaagguggucuguugcucuggcuuccuuucauugucuuaggccuucauggaguggaugcugccuccuccuggcuguuuuugugccuguuugaagcuacugcugccuccauuucugggaaagaccuuugagagccuagcccaggccuaagggcuauguuugguaccaguguuuugucuuuagcuuuucuaugugauugugccgucauucuguuuuaagcucauggaucaauggauuuguuuacaaugugauauuuucuauuaaauccaguauuuucaaauaacaugucauuuguggau

SEQ ID NO: 18533 - RNA, 1364 nt, Homo sapiens
aaagaccuugguauucacccuucgaguuacaauugggacaacugggagagggggaagaguuggagugggaugaagaacuaggaggggcucgacagcuggaggucuaguccacuuaguuuuuguacuggaagggcucaucaccaguuucauugagaagacacgugcggaugagggcuucugucaccgaaaaggggucacaguuggcagaggggugauggucuucaaaguaacccuucuucuccuggccgacaguccagggaaugcauaugcuggcgcuacgauuggcuacaccagcagaaaaguuguugauguuggagguuucauggaauccaguuaggugucgggccuuguccaggccuccuuugggaucacaggcacagaugugguacuggugucgcuugcuuaauuucuugauggccuccccaguguauuucagaccauucuccucccacauggccuuggugcuaaaguugguauggcagccugcaccauuccaguucccaggaaugggcuuaggaucaaagguugcuaucacuccaaagucuucacacacacgaugcaagaugaaacgagccacccagagaugaucucccaugcugauuccuucacaggguccaauuugaaauucucacuggggaggcaugauuggcauuaguccccacaauccugacuccagcauacaagcaggcgcuguaaugagccuccacgaugucccugccauagguucugucugcucccacacugcaguaauauggagucugaggccccgggaagccacuggaaggccaaccaaagggguggccauuuguccccaugaggguauauuccugcuccaugccaaaccaggggugcugguugcucaucacgucgauuauccguuuacaggugugccucaaauuggucucugcaggcuuucgauuguacuugaaaacuucacacaauaccagcuuguuaggauccuuacggaaaggguccuuaaacauagcagcaggaacgagauacaugucacuguuggagccuucagacuguaaaguacuauagagccaucaaaauuccccucaggcaacucuuccacacacuugggcucacuguccaggguccaggucuugcagugcaguccuuuuccaguaccaucgauccagauauacaugacccggacuuucucacccugaggcagggauauguacaccugcuugaugccuuuauuuaagugggaacaugcugagguggucaugguggaagguguucugggugccgagcagacgggccgguaaagguaggccgcgagagcgaggugaggagaggagaggagaggaggccucugugcugcucacacgcuccgcucuucacccacucuugacucu

SEQ ID NO: 18534 - RNA, 1364 nt, Homo sapiens
agagucaagagugggugaagagcggagcgugugagcagcacagaggccuccucuccucuccucuccucaccucgcucucgcggccuaccuuuaccggcccgucugcucggcacccagaacaccuuccaccaugaccaccucagcauguucccacuuaaauaaaggcaucaagcagguguacauaucccugccucagggugagaaaguccgggucauguauaucuggaucgaugguacuggaaaaggacugcacugcaagaccuggacccuggacagugagcccaaguguguggaagaguugccugaggggaauuuugauggcucuauaguacuuuacagucugaaggcuccaacagugacauguaucucguuccugcugcuauguuuaaggacccuuuccguaaggauccuaacaagcugguauugugugaaguuuucaaguacaaucgaaagccugcagagaccaauuugaggcacaccuguaaacggauaaucgacgugaugagcaaccagcaccccugguuuggcauggagcaggaauauacccucauggggacaaauggccaccccuuugguuggccuuccaguggcuucccggggccucagacuccauauuacugcagugugggagcagacagaaccuauggcagggacaucguggaggcucauuacagcgccugcuuguaugcuggagucaggauuguggggacuaaugccaaucaugccuccccagugagaauuucaaauuggacccugugaaggaaucagcaugggagaucaucucuggguggcucguuucaucuugcaucgugugugugaagacuuuggagugauagcaaccuuugauccuaagcccauuccugggaacuggaauggugcaggcugccauaccaacuuuagcaccaaggccaugugggaggagaauggucugaaauacacuggggaggccaucaagaaauuaagcaagcgacaccaguaccacaucugugccugugaucccaaaggaggccuggacaaggcccgacaccuaacuggauuccaugaaaccuccaacaucaacaacuuuucugcugguguagccaaucguagcgccagcauaugcauucccuggacugucggccaggagaagaaggguuacuuugaagaccaucaccccucugccaacugugaccccuuuucggugacagaagcccucauccgcacgugucuucucaaugaaacuggugaugagcccuuccaguacaaaaacuaaguggacuagaccuccagcugucgagccccuccuaguucuucaucccacuccaacucuucccccucucccaguugucccaauuguaacucgaagggugaauaccaaggucuuu

SEQ ID NO: 18535 - RNA, 816 nt, Homo sapiens
acccaagccaggcacucaguuugccuggcagaugugaagacaguccgcaccuccaaggguuuccagccaccaaggaucgcuaaauugcauaagcagguguccgugcaaagucugagagguuaauaaugaacaacucuauuuuaucuguggcuagggagguggacucaguguugucgacaccaggcaaacacacagcaaagcauuucccaagagagacucagauaagucaaagagaaaugcaccuguuagaaagauuacccuuuuccuaggauuuccuaccgguuucccaacaacgggucauauuugugcacacgagucacucucugccccucugccuugcuuaucugagcuaguaauacucaaaacaaagacaaaaaauggaaauuuaaucuccccugaaaccuauuaaaagacaggacaauccucaucaacggaaaggaucagauuucccaucucaagucaaaggaagagcucugagagugauaaucuuugguuucuagaaauuauacugagaggcauuauuccauuguucucauuuuggggucugaaauuugccugaaaauaaagcaacaaggagaauagauguuuuguaaugauuugcauauauuugacgugcucucuugacagucagaaccaucgcaguaucaaacuaaucauauacuucaaagugaaaaagagaaaauaggcccucucuuacaagucaaaaaauaaauauuccaggugaggcuuuugaguuuuuaucuaguuuuaaacccugugccaggaaauggagcaaaugugcucuugcauuaagaaacaucccuuuucgggguucuu

SEQ ID NO: 18536 - RNA, 12702 nt, Homo sapiens
accugcuaacacgccugcgcgagcgggcgugccccggaagccguucuuuggcccugugacacguagcaacggggcugguucagggucugaaacagaguuuggggguuguuugggauuagugaagcuacugccuuugccgccagcgcagccucagaguuuggugagugacccaggcccguggcacaguguucagcuucucuccacacccgugcaaaugggcuuguugccgucuuucggcgccgcgcccugguccuuucgcucagacccucgcucucauucaagcccuugcccugacgcgguccccugcaccucaggcgcgaccuuccagauucugcacuuuuuccuggcaggccgcaggccuuauuuugcaaggaagcagucgccuugucagcuguaaagcccaguccuaaggugaaaaaucaucuuuguuguuauugauauuuuagaccgcuuauggaaccacaacucccacgaccucgccccuaauggaaggcauaucagcucuuuaagguggaguugucuuacugggccgcaacuuaaaagaauauacauuuucuuacucucucuccgcuaccgucguucaaaugcugcguacuuuccgcccccauccccucuccgaauuacugaaaaaauauuuguuguguuucuauuugcuuaagcagacugccaggaacgaauucaguagaaccuugggcauaaggaauauuugccauuucucuuuuauuacagauuauuugcaaugucaggcuuugaaaacuuaaacacggauuucuaccagacaaguuacagcaucgaugaucagucacagcaguccuaugauuauggaggaaguggaggacccuauagcaaguaacuuuucaucuuuggcaauuaauuuagucuacauugcagugaaaacacauauuuagaauauuugguucugccuaaaacaauaugugaacauguccuuuaucaggaguaugaucuuucaugcauaaucuucuuccucuagagagauaugugacacuggcuuggcuucgaagguauuguucuauuuaagaguugagugucuucugcaaacucuucagguguaccaugaauggaaaaguagcuuguuugaagaacuguuuucuaguaacaguauuucuguauuuagaagaugaugggagcuucagguaccuaggagauaggcuguuaguucauaggaccagugaaaaauuaaaguauuuuguuaguaguuaaaucaguccaacucugagacuuuuaucagugcuaauugaaagugcuuagugacauuauuuaaugauguaagcuccuuauuacgaaucaucaggcgauuuucauacagcaguugauaaucauuuuuauuacuccuccuucucaaacccuuauggucagugccacacguguuauaaguugcauacugaggagguugacucaaagccguuagccucugaacauuuuuuuuuaaaugaucuuuuuauaguaccugguguuugugacaaaaauacaugaacugaaggcuuucuagcaaucucaccuaaaacaucaucuccuuaguuucuuaggacccuagagauaaucuuaucagcuuccugucaaauaaaggagcuuccuauacuaggauugcuuaaacuuuuuuagaugguucuggaucucuuugagaauccuauuacaacugggccucuuucccauaaauacaugcauucacucaaacacccaaauaaaugugcauauauaacuucagacaauucauguguuaaaugauguucaucauggaucccgaauuugaaaccucauaaagacuguuccacgaugagggcaggggaagguuauguaucugucaguuugugagaaacaugcaauacaggaauguguuuggauuagagugcccaagaauuuaaaaaacaaaacaaaauucaaauucacuguggcucuguaauagugucugucuugguuaggcuauccuuucuaaaacauauagucucuuugagucugcuuaauuugguauauuuuaaggcuuuguuuuccccucuaaaacuuaacacauuugaacaaugggagugagcaugucaaaauaccccgugauucauuucucuuuucuguuacuuaauuacauaccaaugaggauuuaucucuuuugauaaauuaaugggcagaguuggaaaauuuguauugagguauuuccauucauuuauuuaccuaaauauguauuuuuggugauugcucuguguauaggagagccagaguccaucuaauaaauccuugccuaaagcagcaacacagcuucggagaaccugucucucuaugcaggccuguuuuuauccgaaugguuuuuaugauuagaacucaacagagcuauuccauuuagauugcagccuacgagauuuaucugccucugcuuuucuuuucuuuucuguccuguccacguuugcaucacuuaaaaggugugacuuacagucucauucccuuuaacagucauuucaguucuccacacagcaauuuagauauucuaaacaacuuguugcugguuagcaccuguugccaacuguucucacaguuucauuccaaccaaaucauguaccaguaagcauugcuucaguacuagugaugaaguuuuauucugggugauuauauaaccauuauugcuauaaacuuggguuuauagaugaugccugggaaaacaagaagccuaauguauuaacaguaauaaauuugaguuucugagauuuauuuuguaaaaacuggacucuucugugcguaccuucaaguagaucugcaaucuaaugacauuuuaaauguccaucuccguuaaccaaauaauauuuuguuugauuugcuaauuuaguaacaaagauccgcuaauaacuuuuagcucuccauuggugaaaaucuaggugcaaauagcauauuacuugcauugucuuuauguuuuuaacuugacuuguuauuaguacacaguucugcauuugccauaaugaagucagcuuuaacauuuuuugguuuccucuauagguguuucacaaguaucauucauagauccauucaccaaaaaaacaaaaacaaaaaaguauaaaaggcccuuugaucauaaucuguugaguuauauaaauggaaaauuggacagguuccacauuguauucuagauaugcuuaugaaauauaucauaauaccaagucacauuuuuuaaauuaugaaagcuguuauuuuuuuucuucuuugacuuaccugguaguaucuuuauggaauaucugagguuuuccaugaacuuagguaaccaacccaauauguuaagaggcuuugucuuuguuacugguacagaguacuuaugagaguauugauuuaguaucugcugcuuuucauguuguuuuagccuguaaagaucgugucugccauaccauguuuuaguuuaaaaccagcaggaacaagucagaaauuuuccugaauagguccugccagaaaaggaaaauaguaaaauucuaugauauugucauucucaccuuuccucuugaagauggaaugauggugccaccuuugaaacaaucaacugcuugcaguacuuuucuuccuuacaugaaauuuauuggucuguaucagcaacucucaaaauuuaggcuguagacuacagaggguccuugagacucuucugagauucuuuaaagucaaaguuauuuucauaacaauacuaagauaucauauaccuuuuuagguauguuaacauuugcagugcuguugcaaaaguauugauugguaaaacugcugguaccugaguaugaaucaagguaguggcaucaaguuguucuaguagucaucauauuauucaucacucuauauacuuguuagagaguuggcagacagucaguuucauuuaaggauucucuugaggaagcaguaagaauuaucuuuuuauuaaacccugacccuuuaguacauauauuucuuuaauauucuuugugaagaaauuuaguguuuacugcauacuaaaguacaauuacugccucuacgaaaagcaccugugcaagcugaacuggcuguuauuucaugaagaccauuuuuauuugaaagaacaacugauaaacuaugguuauucagacuugagcauuuggcagauauuuucucaaaaacgaauagagagccucaccccaaggaaaacaacugacauuaugacuauaagaauuuaaaugggaauuagacuaaagguuuucuaaggcuucucagcucucauuuuuaagaauaucuuuuaaaauaauuauuuuacaucuguguuucuuaguauaucauuagauuagucccaucaguaaguuggauuuuuucaaaacaugauggaacagaugcguaaagauguggcuucaguauccucuucccucuugcuauugucacuaaaauagcugugauaagccuuucccucuagaugcaggguuugcuauagcacauaucaaaugagacaauaaguguauaacuacuuugaaaaauaguacuuugcuaaaguacuauucaaaugcaaaguguacuaaaaaucuuuuguuacauucagcaagugcucacaaagcaaaagcuugauuuguccacucuguuuuuaaauugaugguuuuucuuaaagagauuuguccgcuugccaaaaguaacauacuaugaagaguaaagaagaaugauaauucgauggcuauccaaauuacagugaaaaauuauauaacauguauuacaaagucugacauccuaagguuucauucagucuuagccauagauuuuauuucauaguguaucuucauauuguauauauccacuaagggagaaaaauagacacaauuuuuacauuuucauuuguugaccuccuaaccuuuaacaguuuguaaaaugcuuagugcuauguaagugaauauugguaucauuaagaauauuuucuauaaaaauuaugauuuuuuuauuguagauaauaagcuugaucuuagugaucauuucaaccaugauuuauaaaaauuggcaaaguuuguaccugaggaauuucacaacuaagguucuuuagcugucacaugaaaauuuaggaauuuaagggauauuaacuguacagaguugaaauaccucugaaaaauuuaacuuucuuucauuuauagacaguaugcuggcuaugacuauucgcagcaaggcagauuugucccuccagacaugaugcagccacaacagccauacaccgggcagauuuaccagccaacucaggcauauacuccagcuucaccucagccuuucuauggaaacaacuuugaggaugagccaccuuuauuagaagguaagauuuguugcaacacuugauaguacucaauaguauucagcugguuagugaaaauuaaucuuaauuuggagaaauugucuuuuccuuuaaaaaaaauaaucuguagaaaaaaguuuucugcuaaacaacucauuuuaaacagaguauaugcgaaaccacauugggccagaggggaccagauuuuuaauagaucuuuuaauagugauaauaaaguauguuacuaugucagcaucgacuuuuacuucagguuauugacuaaauucugcuagugggaaaagugagaagaaaaagugugcuauccauuauucuguguggaaauaaacuggcagaacuagugacaucacuaaaaaaauggugauuuucaaauuguguuccaaaaccuaggaagugguaguucugaacuuuuuuuuuaacuagauaacucuuugaaaaucuaaugaaagguaugaacacucuccucagaagaaaugcacacauaugcauagagacguaguuuuguauacaguuaaaugggcccccggguauuccugaagccccaaguaaagaaccccuuacuguuaacccuuuuuguauauucuuugcuaugcagucauaccuaagggauguaauaagugucuguuucaucagauccauacccuuuuccaacaccaauccagaaaugacauauuugugggaugagcaccacauugaagacuggcauagagagcucacugaaauaauaucauccaggccaggcacgaugucucaacgccuguaaucccagugcuuuguggggcugaggcuggaggaucucuugaggccaggagaccagccugagcaacacagcaagacccugucucuacaaaaaaaaaaaagaaagaaagaaaagaaaaaaauuagcucuguguuguggcgcacaccuguggucccagcuacucacgaggcugaggcaggaacaucacuuugaguucaggaguuugaggcuauagugagcuaugaucaugccacugcacuccagccugggugauggagacagacccuaucacaauaauuauaauaauaauaauaucauccaauauugcuagauccuuuuuugaugcuaugucauuuugucucuuguuucaggauagauuuugaugaauuaaaaauacaucacaaauccuaauuaacuuuuaaauuuucuuucucuuuagaguuagguaucaauuuugaccacaucuggcaaaaaacacuaacaguauuacauccguuaaaaguagcagauggcagcaucaugaaugaaacugauuuggcagguccaaugguuuuuugccuugcuuuuggagccacauugcuacugguaagauuuucauuucaaccuucagggugcaauuaaagaacagccuuuaaauuuuaaauguucuaccaaaagccauuuugaaacuccgcuuuacaccucaagucuuugauguguuuggaauaguacugaguugcuuguauuuauaccuauucauuaguucuccaucuauaguaaguguagcauguuuuaaaaaucauuucuuuuucuaagaaaugauuaaauuauuaggggaaaaaacaaaaaaaaaauaguaaacaacagguauagcuucagucccucauuagaauucugccuuuucagagguuacuuacaguuuuuacacuauugcuuuuuuuuuuuaaugacagcauuuuuuuaaaaaucucuaaaccuugguuaauauuuuguucuagucauacugaugauuacuuuucuauauaauuauuuucccaauuuaucaccuucccaagaauguuaaggcauauugaaaacagaaaaguuguaaagauaauuguuaauauuuauuuuaucuuaugucucugaauuaugagagauaacuaauguaauauacggaagaugggauuuuuagucauaagagcugggcuugaacugagugcuccugaucagccuuuggccacaucauuuaauccuucaguuuccucucauagaaaauaauccuauccuucuuaccuagcaagauuauuuugaaggugaaacaagacagguuaugugagaacacauugaaaaguuaaaaacacuguacaagugugaguuuuuuuauuacuacaugaauuaauucaucaaugaacucagcugagcuuuuucaaacuucugcauuuuuaaucaaguauuuacaaauaaucuaauaaaagucccaauaauuuuuuuucuuaacauaaucuguagaggcauucuccuaauuuacuuuuuaugugacaaaaauuggauaaaucaauaauuuuuggaggcuuuucuguaaacugguuuuagugauagugugaccugaauacaaaguuuguucacaaacuucacuaacaggauaauuccaauuuagcuaaucuuugcagugcuuaaacuguuuauuguugucuuuucuuaaucaaagggauguauaaaucagccaauaauuuggaaaaauaaagaaaaaaauaucuuccauuauauuccuuuugccauuucuucucuguuccucacagaacccuggcuuccuguuuauccuggcuuccuuuccccuugcuccucuagcacccauauaaagugaaucauaagauuucuucuuaaaaagauuaugacuaccuccaccaaugagaauuaaugcuuuggggcauuuuugguggaauuagguacuuucaacugauauaacaauuaucuagacauuuugaacggcuuuccaucuugucucuaguuuauuugccuaaaaucauccagaguucuuuuuagaaaucuuacuauuuugggugauucugcuaugcuuuugucucuuuauuuguucacuucuaugccaagccuacacacuaacuggaaaauggagaaccaaauaucucuguacuuuaaaguuacaaagaauguaacaagccagucugcucagucuuuuacuucucuacguaaagaauagauagauuaguagauuuugaugcucauaaauuauuugcuacauguacugauucaggugaaauaaggccagaaauaacuuauuuuuugcccuuuaaccuguaaucuucuuuacccauaggcuggcaaaauccaguuuggcuauguauacgggaucagugcaauuggaugucuaggaauguuuuguuuauuaaacuuaaugaguaugacagguguuucauuugguuguguggcaaguguccuuggauauugucuucugcccaugauccuacuuuccagcuuugcagugauauuuucuuugcaguaaguacuguucuuuauuuuggggguugauugaccaauucuauguaguaggauucaccucaucuucaguuugagauaaaucaccgauucagcaaacauaucagauagugccucuuguaguagggacagugccaaaugguuucggaugaagaacaaugguaaugagaauaaauuuaaaaaccuuuauaccaucucuauuuuacucaugaucaagaauuucacuaguuuuguguuuacuuaccauugucauagugguaacaaauugaacaggguaauuauuaaauauuacaugaaaaaggucaagucauuaguguucaaauuaugcuuacccucuuugauauuuucuagaucccaccuaauuucuucaaaccauuggacauaugccaaauguacgaauaauaaauacauacucucuauugggcagcuuucuaacuggaaaugaaauguauucuuuuuaugauaagaggcuguuaucagccugcgguguuucucagauagauguacuuguaagcagcuuuaaauaugguguaauuuuuaaaugauauuuuagguuagguuaaaaggauagguauggccaggcacgguugcucacgccuguaaucccagcacuaugggaggccuaggcgggcagaucaccugaugucaggaguuugagaccagccugaccagcaugaagaaaccccgucucuacuaaaaauacaaaauuagccgggcaugguagcacaugccuguguaaucccagcuacucgggaggcugaggcaggagaaucacuugaacccgggaggcagagguugcagugagccgagaucgcccuguugcauacuucagccugggcaacaaaagcgaaacugucucaaaaaaaaaaaaaaaaaaaaaaaaaaaaggaaggaaagguauacauuaccgccaauaagguuccuccucuuggccagugugcagauugucucaauauaaaauccuccaugugacuaguguuagacauuaccaguggucaggcuuuguuacacuuugaaagcuaaaguggagguuugggaggagaagagacaaauaugucgauuauuuauccaauacaagaaauuuggcaagaugaugcuuuacacuauuucugcuuugaauagaaauauuucauauuuucaguguagaaaucacucuuauuuauuaagaauuuauauauucauauuugaauuuuacagaaguuauuuucuacuaaaacccuuuuuucaacuaggaacaauuuugccuccaaggggacauuugacaaugucugauggggggcaagggugcuacuuauaucuuauguacagaggccagggaugcugcugaacauucugacagugcacaggacagcccccacaacaaagauagcauccagcccaaaugucaguagugccaagaaugagagaccuuauauuuuuaaaaaguaaaacauaguucuaaaaaagcuguuuaucccaugaaaugauucaccaucauugaauuuacugugagguacauuuuagcauuugaaaaaaaaaauccugauuauuuuugcauaugucuacuugcagauuuaaaauguaaauuuaaaaugcuuuagaauagguuauuguaguauucuuacauaacuaaucucaucugcuuuuuuuucuucuccccccuuuuuccuuguuguuuacagaggaaugguaggaaucauucucacugcugggauuauuggaugguguaguuuuucugcuuccaaaauauuuauuucugcauuagccauggaaggacagcaacuuuuaguagcauauccuugcgcuuuguuauauggagucuuugcccugauuuccgucuuuugaaaauuuaucugggauguggacaucagugggccagauguacaaaaaggaccuugaacucuuaaauuggaccagcaaacugcugcagcgcaacucucaugcagauuuacauuugacuguuggagcaaugaaaguaaacguguaucucuuguucauuuuuauagaacuuuugcauacuauauuggauuuaccugcggugugacuagcuuuaaauguuuguguuuauacagauaagaaaugcuauuucuuucugguuccugcagccauugaaaaaccuuuuuccuugcaaauuauaauguuuuugauagauuuuuaucaacugugggaaaccaaacacaaagcugauaaccuuucuuaaaaacgacccagucacaguaaagaagacacaagacggccgggcgugguagcucacgccuguaaucccagcacuuugggaggccgaggcgggcggaucacaagggcaggagaucgagaccauccugguuaacacggugaaaccccgacucuacuaaaacuacaaaaaaaauuagcugggcgugguggcgggcgccuguagucccagcuacucaggaggcugaggcaggagaagugugaacccaggaggcggagcuugcagugagccgagaucacaccacugcacuccauccagccugggugacagggugagacucugucucaaaaaaaaaaaaaaaaggagacacaagacuuacugcaaaaauauuuuuccaaggauuuaggaaagaaaaauugccuuguauucucaagucagguaacucaaagcaaaaaagugauccaaauguagaguaugaguuugcacuccaaaaauuugacauuacuguaaauuaucucauggaauuuuugcuaaaauucagagauacgggaaguucacaaucuaccuuauuguagacaugaaaugcgaacacuuacuuacauauuaauguuaacucaaccuuagggaccuggaaugguugcauuaaugcuauaaucguuggaucgccacauuucccaaaaauaauaaaaaaaucacuaaccuuuuuuaaggaaaauauuuaaaguuuuacaaaauucaauauugcaauuaucaauguaaaguacauuugaaugcuuauuaaaacuuucccaauuaauuuuaacuguguuauugaauuuacuuuuacuaaacuacuguucucuuugucucuuuuuuaacuaggcucugauuuugaccccuaauuuaagcuuuaagaauagaaaucagcuaauauagaaucagacaaaaaggggauuaaaugagcaguuugaguuacauuauuuuauuguauuaaauuuauuugauuuauauugucauguucucuugccagagagaaucuguaggaaaauacuguaucuuguauacugaucauuggcuuuuucuagaaaaacugucucugauucuggacaaagcucaguuauaguuacgagaaagauaugguacagggaggaaaauacugccuuuuuuuuuuuuuuaaagagauuuucagacuaaauagaaaugucaaaaugauguaucaaugguucuuuuuuagaacaaguuuucaaagcauaaaaagagguugagagaaauaacauauuuauugauucacauaaguauguuuuucuucauuaaucgucuggagaaacccacuugucauuaauuuguuuugggcuagguuuucaaacuuaccaaauugcuuuaaaaaagcaauuuggaagguaauuugauaggcuuuccaacuuaaccaaauuuuuuauuguaauucuuggauaguauuuuugucuuuuucaauucauuugucuuuuucaguauaguuuuuguuaaggcaaaugucuucccuuaauauccaaauauugcuaauaaacgguagaagaugcuuuggaaauuaaaauuaucucgcuguugguuagacuuaacacuguuaaucuucagccaaauaucacauauggaucaaauuauuuucuuuuuuguuguuuacccuauccucaacaacauuuuuaguuuaaauuauuguagagauuuuuuuuguggugguuauuuuuuauuuugcuccaaaauaauaaggugcaaagcuauuuuaugcuuaacuguugcucugucaaaacagcuaugcaguggaguugcauuugauguucuagaguuugauuacaugcagaguuguauauagccaaaacuucucuuaucaaacucuguuauguaggcauauuuauauauacauuaaagacuguuguacugugucucaaaaaguacuauguggcgcuuuuuuuuugucuaucauuggaauagauugguuucuucaguuaaguaccagguagauuaccugccuugcuuuaggcccauuuuauacuaaaagcaugcagguaucuuuaaacacuagagacaccauagcuaaaagcucauccagugauugucauu

SEQ ID NO: 18537 - RNA, 874 nt, Homo sapiens
uuuuuuuuucagcuggacaggaaaagcaauaagucuuagagcuuaccuuagugagugcuggagacccaguucuugugaaaaaaauaauaauaaccauuuguaaagcaaucaaaauccacagccaaacugagucuggaucuugucaaaucccaaacagguaaacgaccgagguaucaaugaaaagugccagagaggugugcucuuggaaaauaacuauuauauauaugcauuuauauaaaugccuauuuguauuuauguauguauguagguacauauguguucauuccguaucuuaaguuaaaacaagucgcaaaaaaaguuaagcccugaugagaggagguuggguugaagaaguaaagcagagaaaauauucaaccaaagcuuccccaggggaaaagaaaaauggaaaaagaaaucuuuggaaaggauccuuagaagagaguugcaagagguaccaggacuuagaagcuuuucagaaagcccagaagcagaaagauggagagaugugcccugcuagggucccagguagccaccccaccugccggcaagggcaaacggacucccauguucccagccaggugggagccggugcgagccagaggccaacgcagcgcagagaugccggcggggggcccggggcuccggcuucucuggcggcggagcugggugguuccacaguucccagugcaguucggaugcuguuguuucagcagugcaggcaagaaaccauccagggaaaugacuauuacaucaucuuaaaggaauauggcuuggagaaagcggaggcagcuccgagucacguccuccucggugacagguugccaggacugcacggggacgccgcgcuccggcggugggcacgcgauugccaggc

SEQ ID NO: 18538 - RNA, 746 nt, Homo sapiens
gaagcucuuggcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaau

SEQ ID NO: 18539 - RNA, 489 nt, Homo sapiens
gaugccuggaguuacuguaaaagaugugaaccagcaggaguucaucagagcucuggcagccuuccucagaaagucugggaagcugaaaguccccgaauggguggacaccgucaagcugcuggccaagcacaaagagcuugcucccuacgaugagaacugguuguacacgcgagcugcuuccacagcguggcaccuguaccucugggguggcgcugggguuggcuccaugaccaagaucuaugggggaugucagagaaguggcggcaugccuggccacuuuagccgaggcuccaagaauguggcccaccggguccuccaagcccuggaggggcuaaaaaugguggaaaaggaccaagaugggggccgcaaacugacacgucagggacagagagaucuggacagaaucgcuggacagguggcaguugccaacaagaagcauuagaacaaaccaugcuggguuaauaaauugccucauucguuaaaaaaaaa

SEQ ID NO: 18540 - RNA, 6332 nt, Homo sapiens
aaauaguacagaaaaccuaaauacagaaaaauucagaaaacuccaucuccuagaaagcagggcaaggcugggcacgguggcucacuccuguaaucccagcacuuugggaggccuagguggguggaucauuugaggucaggaguuggagaccagccuggccaacaugguggaacccgucucuacuaaaaauacaaaaauuagccaggcgugguggcacaugccuguaaucccagcuacucaggaggcugaggcaggagaacugcuugaacccgggaggcggagguugcagugagccgagaucgcaccacugcacuccauccugggcgaaagagcaagacuuuaucucaaaaaaaaaaaaaaaaaaaagaaagcaaguuaaauggacucaguuaaagaccucacugaauguaggagaaucaaugggaaacaacguaaagccuucugcuagggcauaaauaggaauccgucuauguaaucaagaaauuacuuugccuccugaucuaaaugcuugccucuagucuagggcuuagaaaaaggccugguuauuugaacugguugucaaucaagguccccuucauuuucgcuuucuuggcuuccaauucagccuagaaagaaaaaaaaagcauaugucuugauacaugacaugaaauuauuuuccuuccuuauucuaaccaacccaaacacucucccuuaauguucauuuaguguacaaacuagaaucaugguucccaaaucauuauauaccucuaacaucuacuuuccaaccuuucugauguuauagcacauacacaaaaaaugcuauuuguaggcaaaaugggcaaaaagacaaggcuguggccacaggaaaucagcgcagggauuccagcagccccagcgccccccacaggcugagggaaccaauacuguggcauaccaguaugcuauucuuggcagaacaggaagaacaucauucuacaacagugcuacuuaaaguuauauggucuaugaacuauuuguuauugguccacacaaaauauguacaaaaauggauaguaagcauuuagaagcuuuuauagcaauuugacacaauaguaauuuuuaaaaucugauaaaaauugagacaauucauuuuuauuguauuuuauaaauuacaaaucuguucauggaaauuugaaaaaaggaaagcacuggucuuucugccuuugaaagguugagaagcacuguucuaaacgacuauggcaagguaaagcagcucccaggacccaccacuucugucaccaaaaacucacuacagacacaaagagacugguauaccuuuggaugagacaccaacauagugauaucugauuuugaugaaauauuuuaaguaauugucaaaaaaaaauacauaggcaccaucauacacagauccauaugcucuaagaugagcccaugaauagugcagaaaaccaccagugcuuuaagaagcaaugaccagccccaauccugguacuaccaagguagcccuaucaugugccauuacauccugggacaacguccagaaacccugaccuuuaacuccugaucuuggaccacaagaagcagauuaaaauaucauccuggccuggcgugguggcucacgccugaaaucccaguacuuugggagcccgaggcgggcagaucaccugaggucaggaguucgagaccagccuggccaacauggugaaaccccaucucuacuaaaaauacaaaaauuagccaggugugguggcacgugccuguagucccagcuacucaggaggcugaggcaggagaaucccuugaacccgggaggcggagguugcagugagcugagaccacgccacggcacuccagccugggcgacaaagugagauuccagcuccaaaauaaauaaauaaauaaaauaaaaauaaaauacagaaaauaaaauaucauccuaguuagggcuauaacaaguaucaucauuuaaggccuagauccuggggucacuacuacagaguaggguauacugacagucacagaccaggguuauaaaacuggcagccaacuacucuaaaaccucccaacagauuuccuaaaagauuucccugccugcugaaaggucuuucagaccaagacauccaaaugauagggccccagcaccuugcuaccccuugcuacucaccagcucuugcagucgccucuugcucaugccuuugcgcuccagcuguuuuucaaucacuuuggcauucugugcauaugagucagcaacuucccucugaaggaaaaaaggagcauccuuaaaccggaagucucaccaaggaauaacaacaaagacguuaagucauaauguauacuacucaaaucaugaaaucaugacuaaaauggcaggacucuguuccuuuuccauucuccaucuuuucaguaauccaggagcacuuaggguauuuuguuugauugcuuguuuguuuguuuguuuugagacagagacugacucuguugcccaggcuggagugcaguagcacaaucuuggcucacugcaaccuccaccucccggguucaagugauucuucaguagcauuuacguuuuaaccaaaacauauguaaaacagcagaugacaucuugccaucaauaucguuauacugaagaaccauaaagguaauugcuacuacuacugaggacagacucacaaaccacgaguugggcuggaaggaaacugaaaucuuucaguccaguaguuucucaaauuaagagggaugagcacuuugcccucuaaggcaucucuaaaaauagcauggaggaaaaaaucacugaucucauucaacauccaacuccuucguuuucauuuuacagaugucccugagauucaaggaaacaggaacuggcucacugucagaguuucuuuucuuuucuuuuuuuuuuuuuuuuuuuuuuuuuuuuuugagacagagacccgcucuguccccaggcuggagugcacuggcgcaaucucgguucacugaagccuccaccucccggguucaagcgauucucaugccucagccucccgaguagcugggauuacaggcgcgcaccaacacgcccggcuaauuuuuuguauuuuuaguagaaacgggguuucaccauguuggccaggcuggucuugaucuccugaccuuaugauccgcccgucucggucucccaaacugcugggauuacaggcgugagccaccacacccagcccauaguuucuuaucagcagagcagggucuaaaagugaagucucuaauauuuccacuacuccaaggcucccgcucuagaguccccuuuccucguacccuucuccccaaauuccaguuuccuuaagaccagagacacuuacagccucaaucuccucuuccucuucaucaaugguagacacggugacagaacugaacuugcccaugucuuugguccguuuggucaucaucaccuggaguggcaggcaagaagaagucaguccgguucaccaaaacaggauccaugagccgugagugugugcgcacacgccugugugaggggcuguggguauugggggaaacacuaccucuuugggacaggaugaccuauuuaaaagugccaauguuuuuauuuacauauuuuucuaacauuugccaucaaaggcucuuauuuuuuuuuaauuuacuuuauuuuuuugaaauagcaucucacucugcugcccaggcuggaauacaguggcacaaucauagcucacugcaaccucaaacuccugggcucaagugaucuuccugccucaaccucccacguagcuaggauuacaggcauaugcccccacgccuggcuaauuuuacauuuuuguagagacugggucucgcaaaaaaaaaaaaaaaaaaaaaaaaaaaagaaggacagaagguauaaaaaagcauccuuaacgcuuaaugucucaggcuuguauccaacuccuggccucaggcaauccuccugccuuggccucccaaagugcuaggauuacaggcgagagacacuaugcaugguccaucauggguucuuaaaauuuauuuuuaauuacuuuuuuuuuuuugagauggagucucacuauuguugcccagccugaagugcaauggugcaaucuuggcuccguaaccucugccuccuggguucaagcgauucuccugccucagccuccugaguagcugggauuacaggcaugcaccaccaugcccagcuaauuuuguauuuuuaguagagacgggguuucuccauguuugucgggccggucucgaacuccugaccucaggugauccgcccaccucggccucccaaagugcugggauuacaggagugagccacugcacccggccaauuaauuuuuuuuaagagacagggucuuacugucacccaggcuggagugcaguggcacaaucauagcugacuguaaccucaaacuccugggcuaaagugauccucccgccucagucuccugaauagcuagaacuauaggugaauaccaucacacccagccaauuuacuuuuuuuuguagagauagggucucgccgugcugcccaggcuggucucaaacuccuggccucaagugauccucccacuucugccucccaaagugcugggauuacaggcaugagccaccaugcccagcuuggaauauauuuuuuaauuagccuaauucauuguuuuuaauuguucaaaaaaaaauuuguaaaauaacacaugauaucucuccauaaaaagaagaaaauuugaaggaaauuaaugugaguaaaaaccauacaauuucuaaccuuagucaugaggcaacuguaggaaagagagaacacauaacagguguuacaauuacauagcaucuguuuauacacaaaaauggcacccgauuaauaaagaaugcauccauacacaugcuugaggggaugaauaccccauuuuccaugaugugauuacacauugcauaccuguaucaaaauaucucauguaccccauaaauaugugcaucuauauaccccccaaaucguuuuuaacuuuuaaaaaauaaaaauaaaguauaagaauauauccauaaagaaaaaagaaauaaaauaagaaaaagacaaaaaaagaaaaagaaauaaaaagaauacauccauaaagagcaguuucucaucacuauaaucuuauuucaaaacaugagcuaaaucuagagcuauauuaagcagucucuccuucaaugguaauuaccuucuuaggaggcucuuguuucugaguauauauguucguuuucccaaagcccuggccaaacuugacuacugcuccauccacaaugaagguaacaggagcauucuuuggcugggauugguagaagagcggcaguccacaccugcaaugacacagugaauuucugcgaggucucauaauccaaauucccaaaacagcaauuugcaaagugugcuuagacucugggaauauuucuguuuguggcauaaacuaaugacuggcucuucucagugucucccaaaacuaccucuaccugauaagaaucacuuaggccgggcgugguggcucacgccuguaaucucagcacuuugggaggccgaggcagguggaucaccugagaucaggaguucaagaccagccuggccaacauggcaaaaccccaucucuacucaaaauacaaaaauuagccaggcaugguggcaggugccuguaaucccagcuacucgggagguugacacaggagaacugcuugaacccgggagguggagguugcagugaguggagaucaugccacugcacuccagccugggcaacaagagcaagacucugucucaaaaaaaaaaauucauuuuucuggccagcuggucaaagauacaacuuugacuagccucuuuggggaacauauugguauuugugcauaguugaagucugaaggcaguugauaaggauaaagacauaaugggggucggacgagguggcucaggccuguaaucccagcaguuuuggaggcugaggugggcggaugaacucaggucaggaguucgagaccagccugaccaacauguugaaacccugucucuacuaaaauacaaaaauuagccaggcaugguggcaugugccuguaaucccagcuacuagagaggcugaggcaggagaaucgcuuaaacccaggaggcagagguuaaggugaccugagauugcaccacugcacuccagccugggcgacagagcaagacucugucucaaaaaaaaaaaaaaagacauaauggagaguuguauccaaauaauuauuuuccuaacacauuaugccucuacuugccuaugcuuggagaaacccacauuguuaauacuuacuuugcacauuucuuccuguacugucguucaaugccuucaggucugcacagaaaa

SEQ ID NO: 18541 - RNA, 1420 nt, Homo sapiens
uucuuccucucuaccuuguuucccguccucauucugagagauaauuaaccgucauguggaugagaaaccauaaccuuacaguuccuuaaccucaacuccagacagugaccuuuaccuuuccugcacuuuagccacaaacucccauaccacagccuggaugucauccacuccaccucugaaauccaguacucugcucucugaccacaaccuauccuugcuacucucaugugcucacuuccucuaaaccuauuuuauuuuguuuuuagauuugaagggugauuauuuuauuaacaguaauaaugaaaaaauaguaguaagaauagcaacaauaauacuagcuaccuuuuauugagcacuuacuauguguuggaugccauggaaagcacuuuacagguauuaucuuaaucuaaacaacacgacauccuacgggacaggauuaacuguuaccauccuuguuuuagaaaugaguacuccgaggcucagagaguuuuaaguuucucaagauccuauagcccaguaagcaauaaagccaaaaaucugacucuaaaaccugagcucuuaacuaugcugaacucccucuaugaacuuaaaacauauauguuauucagaacagauuauaauuucauuuugaaaaauaaagugcaaagucaagacaguugcauagaggacccccuguagcaaguguaugguuaccuuucuacauauuuucugaaauacuugucuuuagauacuaauccuaaaccauuucaacaucugguugaaauuacacauguugcuucaucuauaagacuguaaaacgucauuagcaccaagcaagcauaugcuuuucauuauguuuuacucuuuuuuuuuuuuuuuuuuuuagagauggagucucgcucugucgcccagacuggagugcaguggcacgaucucggcucacugcaagcuccgccucccggguuuacgccauucuccugccucagccucccgaguagcugggacugcaggcaccugccaccaugcccggcuaauuuuuguauuuuuuuuuuuaguagagacgggguuucacuguguuagccaggauggucuccaucuccugaccuugugauccaccugccucagccucccaaagugcugggauuacaggugugagccaccacaccucauauuuaaauaguuauuaaaauaacaugauauguuaguauuuaguuucucuauuuucuuuauuaacuuguauuuuaacaggaaauacagcguuuugcuguugguaugaagagccauguugacauuuuggagagucuuaucauauuuuuguuuuuguuuuugcaaauuaucaaguaugacaaaacauuaaaauguugcaaaauguucucuauuaauuagugacauuuggaaaugucacuuuauuuuuuaagauaaauugaaaagauuuuuaaaa

SEQ ID NO: 18542 - RNA, 119598 nt, Homo sapiens
caccugggucagcuggguuuuugugcacgagggacgucagaaagcuuuguguuugugaggcaaacuagggaguuagugugggugaagcagucaagugcuggagugugaacauuucuaagacgucuaaauugcgcgaaagugugugaggcaaggcuguugcgcgagcgggcagugugcgccugugugugcgugugcgcgcgcgccaaguuugguuugugauugugaugggcaccgacgcugcgucagcccgggaggccacguuaggguugggggugcgugaggaggugcggccgggcgagagguccagcgagugagccaagcgcggcgcuacucugggccccugcuccgcgcgcuagcuggcuguguggcucgcuggcucgcuagggacaagcaggaaucggagcagcacugccgccucuggcgcgaaggcucaggcgccuccucccgccacagucacuguggcucggcgcacgcugccggcggcugcccuuuccgccucuggggaagaaaaacccgcgggccgcuuucgugcuugaaccauggccucgggccggaggggcugggacagcucccacgaagacgaucugcccguguaccuggccaggccgggcaccacggaccaggucccgcggcagaaauacggcggcauguucugcaacguggagggcgccuucgagagcaagacgcuggauuucgaugcccucagcguggggcagcggggcgcgaagacuccucggagcggccagggcagcgaccgaggaucggggagucggcccgggaucgagggggacaccccgcgcaggggccaaggccgggaagagagcagggagcccgcgcccgccucccccgcccccgccgggguagagauccggagcgccaccggcaaagagguguugcagaaccucggccccaaggacaagguaagggggccccgggucacuucccuccuugccuucguuccuuucuccagcccuggccgccauggcccgggcacaacuuucuccagcucacuuugcacggggcugggggacaaggaggaggaaagggucauccuccacugagcguagcgcgacuuccuagcccagacccuggauucgcgcgugucgccacuugcagcaucuucgugcaagcgcggaagggaugcccggguuccccugccuggagccgcguccuuugccccugccuccucgccgcacuccugggccauccggucugggugggugugucagcccgggaaggcuuagugauuuccagcucuucucucuaguagccaacagcacaauugucuugccccccucuggcccuagauuaaaucucaacccgggucaccacggcagagggcaaagugaugcugggaauaugggggucaucuccauagugcccggaugaaaguacuggaggggcggucuccccucucagucuucaaacaucagcucugucccugaaacuuuuggguguggagccucuagacuaaacacgcgaaucucucucuaugccucgcuugugucuuagcacggcauuucacaucuguguuuguaaagaguguauuuguguacauagcuuggcacaagacuggguauuacagggguccagcugccucugcaagaauagcauuauauuuuagaaaauagacgagaguauuaagagugcacauuaaacuagcaugagaugcaaauucccugcugcucuuaaaugugccaaagccaauuucuucuguauguguauuuuugagaaacuuaugucacacugaacugacugaagggauggcauugaaaucuagcuugcccugauuuaugugucuauuucacagagacucagagauguaguucagaaaaugcagggccuggcagggcuggagacuucagaguucaaacugaagcuuucaguuggggaauaauaauaaucagaugcccucacccuugucuagguaauggccgcaaaauccauccgcauguauuauucugcacuaauaugguuaggaauaacaaccugaaauggaaaugucugccucagagcaauuacaguuaaugcuuauucagguuuuaguuguuuuuccauuaaaaugcaaugagcuagugaaagaacagcaucucuguucacuguuugauuuuugaaaguuuagacaaaccaaccaaccaaccuuugacuacuaagaccaccagggaaaauaagugcugaaguuagugcuguucaaggguaccacuuggaaaacaaugucggcuuccucugaaaucauucauuuaguuugugauuuucacaucauccuuuuagugcgugauuccccuaagcccuugcuuaccaacguuuuagggaaaacuucugauauuuugcaaauguuuugguugauaucuaaacugaagaagaacccuauagaaagguuauuccuuucuucaugucugacuuguccauauugaaauguucccuuccugacuggaacgggcgggaguagugauggaaaaggucgguaacaauugcugugagucagugcuauucccuuugcugaaacaccccugauguaagccagauaauaugcuggguuugcaagauuuaagaaugguaacuagagaaagggaaaauauuccuccuuuaaaccuagcaauucucccguuuuccucccuuuugcaaacccuauacuuuuggcuacuaauugagaaauaauaauacaaccuaggcaucagcaggauuucuagugcuacauagucauuuguaaguuugggcuugccaucugcuucauccaggccauguuauuaucucuaauuugguugaaucacacuguuagaagagaccacggagguuaucaaguucugaacuuguuguuuauuuccuugaggguagagauuguguauuuggauuuaucuauguggcuagaaugcuuggcacauuggaggugcucaauaaauguuugauacacuaaaccuccuuaauuaaaccaucuguuuugccacauagcuggcaaaaugaucaucuggccucugcuuaaauacaaccauugucagggagcucacuaccucaugaagcaacuuuuuggacaacuuuacuuaaaaaaaaaaaaaaauuaagcccaaaucuaccuaccuguaguuucuacaaauuauucuuaguucugaccuuuggaaauauaaggguaaauauauuuccuuauuaugagacauuuuaaugauuuuuagguaugugcacucuuguaucugucagaaaaggcugggugaugccauaguaacaaacaacccccaacucucagcagcuuaauaaaaaacauaacaacauauuucuugcuccuauuuguccagugugagucaacagggaagcucuauucauuauugugccuaacuugauggaggcuccaucucuacacaucuguguauaguauguggcaaauuguauacacacuuaauuccuugcugaaguaaugaacaugaugugugcucacauuucauuggccgaaaaccaugucuauacucagcuucaaagcaacugguggaauacaaucuugccaugauccuguaagacuagaaauauuuggcaaauagcucuaauaucucucccagaucuagagaugaauuaauggagugaaaucugucccaaccuuuacuaguuauaugacuguaagcauguaacuuagccucuggguaccucaguuuucuccuguacaaaauaaggauaauggugacuacuuugcacaguaguauucaguacauauuaguuauuacuauuacucuucaauuuuaaugcccguuacauguaugagggcaauuaucucauucucccuaaauuucuuucuuacccuuauuauuccuagcuucuucagucuucucuuguaugagcauuuuaccauccugauuuccuuuucagguuauauuauauuacauauuuuguaaauauuuuucucaaaauacagugcccagaacugaauauguugcuucagaugggauaugaccauggcgaagugcauuauguuacuuaauuuuuuggacuuuuacggaacauaugcaucuaugacuuacuauugucuccauggcaaacacccugccauucaagcuuucagaaacuuuuuucacguaagcugcuguuaggccaggauguuccccuucuaugcugguacaauuuaauuuaaaacaaaccacccccaaaaaaaucuuaacuauaggauuuuauuuuuucuuccuucuauaauauuuaucacuaucuuagcucaucuuucuauuauaucauaauaaucuuaaaccuuaauucuauaauacagcacuccuacugccagcuuuguaccauuuguugauuugauaguaucaccuuuugaacacuuucugugugccuauacuaaauagugcucaaaaggucguuuccucacagaaaaugguuauaaccgauaaggaaauugaaccccagagacuaauuguuuagucccaaaucacauaaauaauaaguggggggagccagaauucacaaucugauuuuucugauuccagagucuguguucuuuccagguggggaggcugcuuccuuauuuuaauaugaccagccuggccgucgugucagcuccugacaugucaauauuauucagagcaaggacagauuuuccugccacaccucuagaacccuucuucuauugugccaccagcccauuacacaggaaacuuugagaccaguuguucaaccuuggagaacaguugcugcaaaauccuuauucuuucaaguugauugcagagcuaucaaaagauauuuuaagugucuugguaaaaucaaaauaugcuuuguaucuagcauaccuaauuauuaacuucuaucuuaacaaaaugaguuuauuuaauaaauuguaaugagguuaaauaacagaaguguuuacagaauaaaaauauaaaauaauaggcugggagugguggcucacgccuguaaucucagcacuuugagaagccaagcugggcagaucacuugaggucaggaguuugagaacagccuagccaacauggugaaacccccgucucuacuaaaaauacagagauuagcugggcgugguggugggcaccuguaauccuagcuacuugggaggcugaggcaggagaaucgcuugaacccgggagguggagguugcagugagccaagaucacgccauggcacuccagccugggcaacacagugagacuccgucucaaaaaaaaaaacgucucugagugucaaauuccagguuugaguuaucacuagaugcuaauauagugguuccaaaccuaucuauaaacaccuucuuaaauuguguauuuagaguuuucucauaauaggcauucauguuacuaaaauccucggcauucauguuacuaaaauccucuaugguuggcuuacacaacuuuucauuuauaauuuuugauacuaagugcauagaaaagcaauucuaagugaaaaguauuuauuuuucaucauuucucaagaugcuuuuccaugcacacugaauuuuccuagcaguaaaauaguuacuaagaggaagacaauuaugauauggccugccaagagcaaauuauaucauaaggacucugucauccagcaaaaacaaaguaaugacauuaugauuacagggguuuuuauugauaacuuucuaucaggagucuugggucauuucuaguuuccuucuucccaugugggccucuuuugugcaagauguuuccuucaugaaguuggcaagggcucugggugcagagggaacaaucuagaaacaaaugagauguggccguuaccuuuuuaccauuugucauuugucuuguuuuuccugggcuaaaaguuuucaaagugacucagagaaauugauguucuccucuuuauccugcacaaugugagacagcuggaaauagaauucuaggcuuauaaaggccucacuagcuaucagaauccaaacccugguguguaaaugaauuuuauaagucuucucugacaaaugaaaguuuguaccaaagcuaggaaaaaaugccuccugcuuaccuggccuucaggccacacuugaaucugggaguagguuuccuuccccaaacuuggaaguguuugugaccuuucagaacuuugguuuaguuugacaguaggcauuugaggaacauaaaaaauacgccuucucaauaaugcugcgauuggcagaguucccucaaaguaauggucccuggagacaggguuuugcugacagcucuuguaaguaauguuuaaggcagccagaacacugucucugaugauuucagucagugacucuuacagcugauucuccuggugauuuauuuccacugggcguuauccugacaaguaauguuucuaugagacagggaguaaagcuuacaaggaagaggaaaucugucugaggaggaugcaaucugugacugcaaauggaagaggcagaagguccauuuaggugugugagcacuuuuaaaauuaagcuucuaggaguauguaacauuaaaauauguuuguaacauagaaucacauugcauucaaaagacaguucuacuccaucaaagaacauauuaggcaaaaacaaacagaaaaucaaaguggauaaaguauuagcagucucaguuuccagaccuaaccuuuaaccugcuguacaacuugggcaaguuaccucccuucccuuugagcuauaguuuccuucuuucuaaaacaaaugggcuagaccaaauggucccuauaguaauggucuucuuguaaacuuucuugauugugcaucuuuaaacgaaaauuuuuugggcaugcuccauauuccuuguguguguauauauguuuacacauaugugcauauauauaaauuacauauggaaauaucacauuaauaucuuaugacuggcugggcauuguggcucaugccuguaaucccagcacuuugggagccaaggcagaaggauugcuugagcccaggaguuugagaccagacugggcaacguagaacacuuggucucuaaaaauaauuuaaaaauuaacuaagcaugguggugcacgacuguggucccagcuacccaggaggcugagguaagagguuugcuugagccugaaaagucgagguugcagccagccaugacuggaagaggcgacagugagacccugucuuuaaaaagaaaacaucuuaugaucaucauaaaauguaaauaaaaaaucuaaacuaaaaaagaagagauacaaaaaauccaaauauaaauuaugguuguuuuccuuuaucccaguggcuugucuuguccaacaaauugggugagugcuuggaagucuauggucccuagacuaaauagauaauagucagugguucuaacaacuuagucauuaaugaguccauugucagaguacuucagugauagaugcccuuuuauugaacaauuuuugagagacaguucaaaacuguugaaggcuugugaugaggcuacagaccaggugcugguuagugcucagcacucuuuacaaauaugcauguggaggugggccaguagcuugugaauaagaagggaguccccacgucucccuuuaccugcugauuuuugucuuuacucauuuuugcaaaaagcauuauuaaggccgggcacaguggcucacgcuuguaaucccagcacuuugggagggcaaggcgggcggaugacgaggucaugagaucgagaucauccuggcuaacacggugaaaccucgucucuacuaaaaauacaaaaaauuagcugggcaugguggcaggcgccuguagucccagcuacucgggaggcugaggcaggagaauggcgggaacccgggaggcggaaguugcagugagccgagacugcgccacugcacuccagccugggcgacagagcgagacuccgucucaaaaaaaaaaaaaaaaaaaaaaagcauuauuaagccacagcuauguaggugcacaaugaaaaacaaauguuggaaaaauuaagauguaccaaagagaucagcaguaagaaaacauaaacaucguuuccucaucaucuucuggagaaaacugccauuaaccuaggaguguauuuucuucccaucuguguguauauguguguguguguguguguguguguaucugugacaugcauuuuuuucccaaaagugaggagaugcaguauuucuguguuuaaauuauuuuuuaucauuuagcguggucugaagguuuguguacccccaauuucauagguugaaauccuaagccccaagguaaugauacugauuuggucaugagcguggugcccucaugaaugggguuggugcccuuaugaaagcggcccuagagagcugcuuugcucuuugcaccaggugagaacacagcuagaaggcagcgucugagucagaaagccggccuccaccagacacugaaucugccuuaucuugggcaucccaguguccagaauuguaagaaauacauuuauuauuuauaagccacacagauuaugguauuuuguuauagcagccugagcagacuaagauaucaccuuuuuaaaaaaacaaauaagcucguauuuuuagagcaguuuuggauucacagugaagucaaguggaaaguacagagaguacuucccauauaccccugucuccauaaacacacagccuccuucacuggcaacacuccacacgagaguagucgauuuuuuacaauugaugaaccuacaucgacacaucauuggcuggaugugguggcucacgccuguaaucccagcacuuugggaggcuaagguggguggaucaccucaggucaggaguucgagaccagccuguccaacauggcaaaaccucgucucuacuaaaaauacaaauauuagccaagugugauggcaggcaccuguaauuccaauuacuugggaggugagagaauugcuugaaccugggaggcagagguugcagugagcccagaucgugacacuauacucuagccugggcaacagagcaagacucugguaaaaaaaaaaaaaaaaaaaaaaaaaaucauuaucaccacaaauccauaguuuacauuaggcuucacucugguguugcacauuuuaugggcuuggacaaacauacaaugacaaguaucuaccauuguaauaucuuauaggaauuaguuuuacugcccuaaaaaucuucugugcucucucuguucaucauucucuucugcccucaacuccuggcaaccacugaucuuuuuacugccuccauaguuuugucuuuuucagagugucauauagugggaaucacacaguauguagacuuuucagauuggcuucuuucacuuggugacaugcacauacauuuuccccacgucucuacauggcuugauagcucauuucuuuuucuugcugaauauuuggaugugcggccguuuauuuauucacuuaccuacugaaggaugucgugguugcuuccaggauuuguugguuaugaauaaagcugcuauaaacauucgugggcacauacguuuuguaugaacauaagucuucaguucauuuagguaaauaccaaggagcacuguugcuggaucgcauggugagagcacauuuaguuuucuaagaaacugccaaauugucuuccaaaguggugcuaccaaucugcauucuuaguagcaaugaaugaguauucuuguugcuccacaucuucaccagcauuugauguugucaguguucuggauuuuggccauucuacuagguguguagugguaucucauuguuguuuuaauuugcaauuuuccaauggcauaugauauggaacaucuuuucuuauguuuaguugccaucugugucuguuaagcucuuuggcucauuuuuuaauugagucauuuauuuguuuucauugaguuuuuuuuuuuuuuuuugagauggagucucacucuguugcccaggcuggaguguaguggugccaccucggcucacugcaaucucuaucucccagguucaagugauucuccugccucagccucccggguagcugggauugcaggugugcacaaccacgcccggcuaauucuuguauuuuuaguagauaugcgauuucaccauguuggcuaggcuggucucaaacuccuaaccucaggugauccgcccaccucagccucccaaaguacugggauuacaggcgugagccaccgcaccuggccguuaucauugaguuuuaagaguucugcguguauucagauaauaguuguuuaucagauauguauuuugcaaauauuuucucccagucuguggauugccuucucauucuuuugacaauauguuuugcagcacauauguuuuuaauuuuaauauaguccagcucaccaauuauuuauuucaugaauugugcuauugauguuguaucuaaaaacgucaucacuauacccaaggucaucuguguuauuuucuaggaguuuuauaguuugcaucuuacauuuagguuuaugauccauuuggaguuauuuuuugugaauggcauagauccguguuaugauuuuuuuuugcacauagguguccaguuguuuuaauacuauuuguuggaaauauuauauuuucuccauuguauuaccuuugcuccuucauaaaaaucaguugauuacuuuuauguaggucuacuuaugugcuauuuuguuccaagcuugucuguucuuuuaccaagauuguacugucuugauugcuguggcuuucuuguaaguuuuaaaguugguacugucaguccucugauuuuguuauuuuccuucaacauuggcuauucugggucuuuugccuuuccauaugacguuuagaaucaguuuguugauaucaacaaaacaacgugcuagaaucuugauuggaacugugucgaaucuaaagaucaaguugggaggaacugacaucuagacaguauugagucuuccuguccaugagcaaggaauauacucccuuuauuuaguucuucuuugacaccuuucaucagaguuuuguagcuuuccccauauggaucucacacuuuuuuuuagauuuauaccuaaguugcacauguuucuuuagauuucuaccucaguugcacaggguuuucuagauuuauaccuaaguauuucauuuccagggugcuaauguaaaugguuauauguuuuaauuucaaauuuaacuuguucagugcuaguauauaggaaagcaagugacuuuugcauauuaacuuuguauccugcaaccuugcuauaaucacuuacuaguuccugagggcuuuucuuugcucaauucuuuuguauuuucuacauagauaaucaugucaucugcaaagaaauacaguuuguuucuucucuccacaucuguauaacuuuuauuuccuuuuccugucuaauuguauuagcuaggacuuccagaauaauguugaaaagcaguggugcaccauauaaaaaaauuaccucaagauggauuaaagagugaaauguaaaaccccaaacucuaaaaacccugggagacaaccuaggcaauaccauuuaggucauaggcacgggcaaaaauuucauaaugaagacaccaaaagcaauugcaaugaaagcaaaacuuaauaaaugggaucuaauuaaacuaaggagcuucugcacagcaaaagaaacuauuaucagaggaaacagacaaucuacagaauggaaaacaaaggucuaauauccagcaucuauaaggaacuuaaacaaauguacaagaaaaaacaaacaaccccauuaaaaaguaggcaaaggacauguguucaugucuauuacacuuucaaaagaagacauacaugcagccaacaaucauaugaaaaaaagcucaacaucacuggucauuagagaaaugcaaaucaaaaccacaaugagauaccaucucacaccagucagaaugacuauuuuuaaaaagucaaaaaauaauagacauuggugagguuguagagaaaaaggaaugcuuauacacuguuggugggaguguaaauuaguucagccauuguggaagacgguguggcaauuccucagagacuuaaugacagaaauaccauuuggcccagcaaucucauuacuggcuauacacccaaaggaauauaaauaauuguauuauaaagacacaugcacguguauguucauugcagcacuauucccaauagcaaugacauggaaucaaccuaaaugcccuucacugauagacuggauaaagaaaacgugguacauauacaccauggaauacuaugcagccauaaaaaaagaaugagaucauguccuuuggagaaauauggguagagcuggaggccauuaucuuuagcaaacuaaugcgggaauagaaaaugaaauaccacauguucucacuuauaagugggagcuaaaugaugagaacauauggguacauagagggaaacaacacacacuggggccuauuggaggguggagggugggaggagggagaggauugggaaaagauaacuaaugaguacuaggcuuaguggugaaauaaucugugcaacaaacucccgugacacaaguuuaccuauguaacagaccugcacuuguaccccugaacuuaaauuaaaaagaaagaaagaaagagaaagagagagagagagaaagagagagagagagagagaagggaaggaaggauacaaagaaaaguuguggugaaaaagugugucuuugccuuguuucuaaucuuaguaggaaagcuuugaguuucucaccauuaaauaugauguuagcuguagguuuuuuugagcguauucuuuaucaagcugaggaaguuccccaaucuuccuacuucgcuaaguuuuuuuuuuuuuaucaugaauggauauuggauuuugccaaaugcuuuuucaguaucuauugauaugaccaugugauuuuucuucuuuagccuguuuggauuauauuauguguaauguaaugugauggauucucaaauguugaagcaaccuugccuagauaaacucagccuugcugagauaaaccuucauggcuaugguguguaacuuucuguauacaugguugaauucaacuugcuaauauuuuguugaggauuuuugcaucuuuguucauuagagauacugaucuguaguuugcuuuucuuuuuuuaauuuuauuauuauuauacuuuaaguuuuaggguacgugugcaugacgugcagguuuauuacauauguauacaugugccaugcugguaugcugcacccauuaacucgucauuuagcauuagguauaucuccuaaugcuaccccuucccccuccccccaccccacaacagucccuggugugugauguuccccuuccuguguccauguguucuuauuguucaauucccaccuaugagugagaacaugcaguguuugguuuuuuguccuugugauaguuugcugagaaugaugguuuccagcuucauccaugucccuacaaaggacaugaacucaucauuuuuuauggcugcauaguauuccgugguguauaugugccacauuuucuuaauucagucuaucgcuguuggacauuuagguugguuccaagucuuugcuauugugaauagugccacuauaaacauacgugugcaugugucuuuauggcagcaugauuuauaguccuuuggguauauacccaguaaugggauggcugggucaaaugguauuucuaguucuagaucccugaggaauugccacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauugugguuuugauuugcauuuuucugauggccagugaugaugagcauuuuuucauguguuuuuuggcugcauaaaugucuucuuuugagaaaugucuguucauauccuucacccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcagugcagaagcucuuuaguuuaauuagaucccauuugucuauuuugucuuuuguugccauugcuuuugguguuuuagacaugaaguccuugcccaugcguauguccugaaugguauuguguagguuuucuucuagggcuuuuaugguuuuaggucuaacauguaagucuuuaauccaucuugaauuaauuuuuguauaagauguaaggaagggauccaguuucagcuuucuacauauggcuagccaguuuucccagcaccauuuauuaaauagggaauccuuuccccauugcuuguuuuugucagguuugucaaagaucagauaguuguagauauguggcauuauuucugagggcucuguucuguuccauuggucuauaucucuguuuugguaccaguaccaugcuauuuugguuacuguagccuuguaguauaguuugaagucagguagcaugaugccuccagcuuuguucuuuugucuucggauugacuuggcaaugcgggcucuuuuuugguuccauaugaacuugaaaguaguuuuuuccaauucugugaagaaagucauugauagcuugaugaggaugccauugaaucuauaaauuaccuugggcaguauggccauuuucacaauauugauucuuccuacacaugaacauggaauguucuucuauuuguuuguauucucuuuuauuucauugagcagugguuuguaguucuccuugaagaggcccuucacaucccuuguaaguuggauuccuagguauuuuauucucuuugaagcaauugugaaugggaguucacucaugauuuggcucucuguuugucuguuauugguguauaagagugcuugugauuuuuguacauugauuuuguauccugagacuuugcugaaguugcuuaucagcuugaggagauuuugggcugagacgaugggguuuucuagauauacaaucaugucaucugcaaacagggacaauuugacuuccucuuuuccuaauugaaugcccuuuauuuccuucuccugccuaauugcccuggccagaacuuccaacacuauguugaauaggaguggugagagagggcaucccugucuugugucaguuuucaaagggaaugcuuccaguuuuugcccauucaguaugauauuggcuguggguuugucauagauagcucugcuuuucuuuuggugucuguguuagauuuuaaugugacaguaaugcuggucucagagaaggagcugggaaguauuucuucugcuucuaucucugaaagagauuguagagaaucggcauaauuuacucccuaaauauuugguagaauucgccaggaaauccaucugagucuggcauuuucugauuuggaagguaauuauugauuugguuucuuuaauagauacaggcuuaccuauucaaauuuucaauuucuucuugugggaguuuuggcaaauuaugccuuucgaggaacuggcucuuuucaucuaguuuaucaaaucuauggguauacaguuguuuguaauauucuauuauuauuauuauuauuauuauuauuauuuugagauggagucuugcucugucacccaggcuggagugcaguggcgcgaucucggcucacugcaagcucugccucccggguucaugccauucuccugccucagccuccugaguagcugggaauacaggcgccuaucaccaugcccggcuaauuuuuuuuuuuuuuuuuuuuguauuuuucguagagacgggguuucaccauguuagccaggauggucucugucuccugaccucgugaucugcccgccucggccucccaaagugcugggauuacaggugugagccaccgggcccggccuccuuuauuauucuuuugacauccauaagcucuauagugaugucccuauuucauuucugauauuaguaauuuguaucuuuucucuuuuuuucuuuguuagccuggcuagagacauaucuauuuuauugaucuuuuugaagagccagcuuuugguuuuauugauuuucuguacugaucgauacucuaauuuuuguuuuuagaaaagaaauguauuuaucuaucauuuaaaaagaaaagaaaucuuuucuucugcuuacuuuaauuugcucuucuuuuucuaguuuucuaaaguggaaguuuagauuacugauuuuagauauuucuucuuuuuuaauacauguauucaauguaauagauuucccucuaagcacugcuuuagcuacaucuuacaaguuuuaauaauuuauauuuucauuuuuauuugguugauuuuuuuguaauuucuucuuagacaccuccgccuccuggguucaagcaauucuucugccucagccucccgaguagcugggauuacaggcgccugccaccacgccaggauaauuuuuguauuuuuagaagagaugggguuucaccauguuggccaggcuggucuugaacuccugagcucaagugauccaccugccucagccucccaaaguguugggcuuacaggcaugagccacugcgccuggccaguuauauuguuuaauauccacguauuuggggauuuuucagcauucucucuguuauuuauuucuaguuuaauuccauugugguccaagagcagcuugcaugauuuuauucuuuuaaauauguuaagauguguuuuauaccccggaauguuacuucucuuguugaacaguucaucugugccucagaaaaauguguaaucugcuuuuguuggaugaaguagucuauagauguccauuuuaacuaugucuuuauuaaucuuauuaauuuucugucugcuggaucuguccauuuuuccuucuuucuuuauuucuuucuuccuuccuuucuuucuuuuuuuuuagacagagucucgcucugucacccaggcuggagugcaguagcaugaucauggcuugcagcugugacuuccuaggcccaagugaucuucccucccaccacagccuccugaguagaugggaccacacgugugcaccagcacauccagcuaauuguuaaauuuuuuguagagaugcugucucccuauguuucucaggcuggucucaaacucucaaacucaaaugauuccccugcuuccaccucccaaauugcuggaauuacagacaugaaccaccacguccugcccaugaucuguccauuucugauagaaaagcguuaaaauuuccaacuaucauaauggauucaucucuuuccccuugaaguucuuuuagguuuuugccucauguauuuugauccucuguuguuugacacauacacauugaggguuguuaugccuucucagauaauugauuaccccuuuaucauuauguaaugucccucuuuauuucugauaacuucgcuugcuccgaggucuauucuggaugaaauuaauauaguuauuugcacuuucuuuugauuaguguuagcaugguauuucuuucuccauuccuuuucuuuuaauaucucugugccuuuguacuugaaguggguuuuuuguaguuaauauaaaguuaagccuugcuucuugauccauucugacaaucucugucuuuuaacugguguauuuggaucauugacaaguaaggugauuauuguuacagauggauuauagauggauauauaccguauuuguugauguauucuauuuguuguccuuguuuuuguuccuacuuuugucuucuauaauuuuucuguuuuuugugguuuuaacugagaauuuuauaugauuccauuuucucuucuuucuuagcauaucauuuauacuucuuuuucucaacuuuuuaaaugguuaaccuacaguuugcaacauauauuuacaaauaauccaagucuacuuucaaauagugcuguauuauuuuaugaguagugcaaguacuuuauaaugauaauauuccuaauuauuuucuccuaucucuuguaucaucacuuucauuuauuucaauuauacagaagcagauguauguacaucagcauauauaacagaauacauuguugcuauuguuauuuugaauaaacuguuaucuguuagauacauuaagaauaggaaaaacaaaguuuucauauuaccuuuacuuauuuauucucugguggucuucuuuucuuuauguagauccaaguuucugaccuauaucauuuuccuuuucucugaagaacuucuuuugacauuucuuggaaggccacucuacuggaaacaaauucccucaauuucuuuuuguagaagaauauaucuucuucauuuuugaaggaugaucucacaaaauucuagguugauguuuuuuauuucucugaauauuuaaaauauuuguauucacucuuuucugguuucugaagacaaguugaaugaaauuuucauguuugcuuugcuauagggaagguauuucccccccuauggcuucuuuuagauuuucaaaaauauuugauuuucugaaauuugaauauaugucuauguguaaggguuuuuuuugauguuuaucuugcuugcuauucucugagcuuccuggaucuguaguuuagugccugauguuaaucuggggaaaauuguuagucauuauugcuucaaauauugcuuuuauuccuuucucugucuuuuccuuuugauauuuucauuauucauuuuacaccuuugguaguugucccacaguucuuggauauucuguuuuggucuuuuuuuggucuuuuuuuuuucucccugcauuucaguuuuggcaguuucuauugucguauccucaagcucagacauuauuuucucagcucugucuaaucuacuaaugagccuaccaaaagcauucgucauuaauguugcaguauuuuuuuuaucucuagcauuucuuuuugacuguuuuuuagaauuucugucuucuuaccuuauuuaucuguucuuccauguugucuacuuuuucuacuaaagcccuuagcauguuauucauagugugucuaaaugccuucuuuugaucauuccaacauuccugccauagcugacucuuguuuugaugcuuguuuuagucucuucacacucgguuuucugccuuuuaguauaccuugcaauuuuuuguugagcgguggauccauguacugaguaaaaggaacucuaguaaauaggccauuaguaauguaguggcaagguguaggggaagagaaaggguuuuacaguccuaugauuaguucuaagucuuuuggugagccugugacccuggacugugaauguuucaagugcuucucaguauugugcuggcaccuuacaugagaaaggacagcuggagggugcuggaguugcguauuuuccuuccccuacugaaggcugagcucgcuggaguuggguauuauuuuguucuccaaguagguuaggcucugacaaaacucuagcagcuuaggcucuaauaaaauaguuucuucagagagcauaucuuguuccuaugaacagcaugcuuuaauguauuucaaaaugguuccucucuccucucccugacagaagcaggagggaauuuuucuccaguauugacuaugagguccuggcagaguucuugaagguaaaauucacaugcuccugccgcaccacccugcugcugccaugacugcaucugaaguuuuuaacucucugaguugucuguaucuagcauccagcaauuaaccaauugcaguucaaguuuuccuaucccaggcugcuuccuguggaaguuucugcuuaugggucucuguguggguauaugugauucucuguaucugucugucugucuacccaguuuugggggaaaugguuugcucugugaccucacuucucugccaggucuaagaaaagcuauugauuuuuuuuguuuguuuagcguuuuacuuguuuuuaggauggaaugaugacuucuaagcuucuuaacaugcuaagccagaaaccuuaaacuauuuuguagauuucgaucauuguggcaucuucacagagcaucagagauguucuaaagcauaacuaacaauggcuaucugguacucuauuuugauaugucacauauuuaauuauacauuucuuuuaauaggacauuuauguuuguauuuucaguugugguuuuauauguaccuucucuucuuuuguuauuauaagcaagaaggugguaaaccuucuucuagauaaccuuugugcacauucauuucauuaucaauggaaaauuccuauaaaaggcugcaugugaucauuuuugugcugcaggaacacuaaacaugggauagaugcuuucuacuucaaacuuuaggggcaggacucuggggugugcaaaaucaggagagccuuucauauaaauucucuaagaaagaggagugcagccugggauggaggcaguugaggcaucagaaguaacauuacuugggccacauuauucaguagauggggugcaggggccauaagagccauauaagugggauauuguaaaagacauggggaaaggaagaauuuuauuucauuuuauuuuuucuuauuagaauauuuuuucuuuucuuaaauuuuauuuuagauucaagagguacaugugcaguccuacuacguugugcacuaguauauuguauaaugguaagguuugcccauuacccaaauaaugaaaauuguauccaucgguaacuuuucagcccucacccuccuuucacccuuuccacuuuuggagucuccagugucuauuauuuaagagaaagaauuuuaaaucuuagcugcagagaaaaaaaaaaaacauaaaaggaaagaacgcugaagucguaaacggagaucuaacuaacagaacagaauuguucuauaccuaaguaccucccucaauaaucucuuggaauuuuacauuucucugaguuugaggcacaaauaugagguucaaggggugugugcucaugaaauauuacauuuauggaguacuuauuuuugcaagacaauaaugucucugauccucaugacaacucuacaaaauaggcauuaauauccacauaauccagaaaagaaaccgagucauggaaagauuacucaauuuccuauaaucauacaacuagaaauggacaaagucaggauuaagcccaaggacucucugauugcuuuccauacgccccugugcuguucucuucugguaugguggcagcuaagcaucagugcugaaugggauccaacaccuggagcugguguggauacuaagaggaguccaaaauaaaaugucuaacagaggaaauuucugaagacugagaacauggggcucacagaaucaaaauaggaaagcagaauccggucaaguccaaaaggugagcacaguagcuaaagcagaaaacaucagaagcuaggaggcccuagaaagacaccaggagauagagcauggaaaggaagaaguggagagggacuccaacaguuaccaugaugugccccaagugccuaaugauauauuuuuucuuuucuuuuucuuuuuuuuuuuuuagaugaagucucacucuuguugcccaggcuggaguacaguggugcgaucucagcucagugcaacgucccccuccuggguucaagcgguucuccugccucagccucccgaguagcugggauuaucggugccuaccaccacaccuggcuaauuuuuguauuuuuaguagagacaggguuuugccauguugaccaggcuggucucgaacuccugaccucaggugauccacacaccuuggccucccaaaguggugggauuacagggaugagccacugcuccuggccaauauauuuuuuucuuuugagaagggccucacucugucacccaggcugcaguacaguggcacaaucaugacucauugcagccucaacuuccugggcucaagugauccucucacuucagccucccaaguaaccaggaacaccagcaugcaccaccaugcaggcuaauuuuuaaaauuuuuguagagaugggguuucccuauguugcccaggcugguaaugauaauuuuuuauugacugcuguggcuugcuggugggccagccugauuuuaaggcacuggcuaaaaucaggguagauaauauucaaaggaugguggcagagauaggacucacauccagguccacaugacccuguagcccauucaucgcuauuuuagagggucuccuuugagggcagaauuacuugacagcaaugcaugcugucaacacgcuguccaaaucccucuucacuucuuccuucccuugaucuaccuccugguuucuuucuagagccuccuagcuucugauguuuucugcuuuagcuacuguguucaccuucuggacuaaagaggaaagauguaaagcuuauguuggguuggaagugggcuagggaggggcuguuuucucuuuggauacuauucccacauccugccacuuagauagaaauaaauaaaaccaaugaaauggaaaguugugugauaaacggauauuaagugagaaggaaaaaaacaguuagugaauaaugguuuuucacacaauugauagggagagaagacuauauccagagacacaauuuuauccuauauaccacccagggagugucaggaagccagaccaucguagugcacuaagggaacuuuuuagugagauuccagggugggauguggggaguucaaaaugggcgugagggauuugaaaugaaggcaguguaucuggaaaugcauucugucagcuaagaguuuucaaaugaaggauuagauagcucucaaugaucuagaauaggagucuguaaacuuuuucuguauagaacaagauaggaaauauuuuagguuuguaaacaauaagguaccuguucaaauuauucaacucuauacuguaaaagcagccauagacaacauguaaaugaaugguuguggcuauaugccaguaaaacuuuauuuaaaacaaacaaaaaaacaggugguggguuggauuugacccauggacaauaguuugccaacuccuggucuugaauaaaagaaaaguggcacagguguauguguguuuguaugugugcaagagggaguagcaaagucauagcaacuuuuugauaugaaaagauuccaaaauuugagguaguuacgauaacuaagcaagacaaucugaaaggcucagaaacacuuguuccccuuucaggaugccugaaauuggaggaggaaauuaaaauuaaauacauaucugacauugaaggaagaacaaugcaagauauuuagagaaugcaaauuuaugaaauggaggcaaggcuuguuaaaaacaaagacaggagaaagggggagguugaagaggauaaccuggaaaugacagugggaaagaaacaaauacaggaaauccgagugauuaggaagaaggaggucaagcuuaaaauaaagcuuuaccggagugcuagaaaaaaggagagguggcaagguagcaaacagccugaagcugcaaaaagagagguagugguggaaaagaaggccucucggaguuaauagcauguggcauuguuaagcaaagggggagaaugcuaaacucacuuacccuuaaaacaugucaacaaauucaguagaguuuggggguugagauaaugacuagcccaauaaaaauaugaucaagaauaugcaguaaaaggauauaauugggagagugaauugauuaccucuuggaagauguaugcuuaccauucaggaaaucugacuuagaggucaguaacucagccagggcuagguccacuugaaguauucacugauagucaguggcucuccauuuacucuuugacucauguauucuuucauccacuuacggacccaacagauguuuacucaguguccaccaugagucucuucaggguuaauagcagucagaaaucuauuagguacuugaagggaucauguugaagaggugauggcagcuacagaaaugagugcucagaagggcacugacuggccccuuucaguccagaggagggagaaggcacggaaucgauauucaugaaaagauuucuccaucauaaggcauucauccaacuagacuauagauagaaacucugagcuagaagcaauuucaagauuauuuuguccuacccuuuucacucuacaaauaggaaaacugaggacuugagaggugauaaggaugaaaaauaaaaauuuuugagcauuuauuauaugccaggcauugcuuuuuaaaaguuguuguaaaauacucauaacauaaacuuaccuuuuuaaccauuuuaaguacaauucagaaguauaaaguaccuuuacaauauuuuacuauuaucacaacaauguaguuccagaauuuucucaucacaccacaaccuccagccuuuggcauucacuaaucugcuuucuuuuucuacuuguuuaccuauucuggauauuuuauauaaacgaaauuauacuauauguagccuugguguuugucuucuuucacuucgcauaguuuucaaggugcauccauguuguggcaugugucaguacuucuuuccuuuuuauggcugcauaguauuccauuguauguauauaucagauuguauuuaucuucucaucagcugauagacauuggguuguuuccauuuuugguuauugugaauagugcugggccaggcacuuuuuaaagcacuuuacauuaauuaauucuguucacaaauauccuuggaagaagauacuauaauuacaucauuuuuacagaugagaaaggaaaaauuagaucuuuugcccaaguuacaguuaauagaagaggauugcggaggaggagcugagacuccaauuucuuauuucccaggucagugcuguuuccaaccuaccauccugcucagcucuguaagggcagggccuaccacuuacuucucaccacagacacuugugcucagcguauuugauguaaauuaguugaauuaaauuucucugcugcauaauacauaggaaacaaagggagagacuggagauuauuuauaagucacucuaugcauuuuaauaguaaagaauacauaaaacgacugaaauauuuaguaauagaauauuguaaauaaauaaugucauauucauaugauggaaaguacucuagagccauuaaaaaugaugcuaugggagaguauugcugugaggaaguacuccugguuuauuuagucgcuuggcccuuugaaggaaggcaugaucagcucuuuggcuuaaaaaucugagguuuagagagauuaaguaaacugcaugaacucagacagcucacaaagcaagaauuuugucuaaaucuccaaacucacgcucucagccacaaucaaaaaauuaaauggaaauuuuacaaaaucuuagcagugguaagaggaauaaauaacgugugacguguuuucuucuguuccuucagcuccauuuucuacauuuucuacgaugcuguggguugcuuuugcaaucgaauaaaagcaguacaguuucuguuacaaaaaagagaucuugccuaaaucaaccucaaaacauaguugaaaaaagagacuaaaacucucaugggcuguaggaaaauauacaaauauaaaaaguauggcccacagcaaaaguaaggaacgaugcuggugagaaacucuaaauggagggguuuugugguuacuucuuuaccaucucaaucuuuggaaacuauuaauggaugcugaccacuccuugucucuaaauaagcauuucuguuucccaauuccuugcugaguucuucuguugauguuagagagcaguuaacaaaccacgucaaaucauaugcaguuguagccuggucuugugugacaugguggagauuugaagcauucgguuaucugaguuauaugccucgauuuuuuaaccccuauccaaaauucuaauuugcucugaugucugaauauuaccagugagcacuugcuuagggccugauucugucuacacuguguagcuugcacaaagaauuugagaaauaaccuuucuuuauauugcuaauacaacaacacuauugguuuguuauuguuuguuacuguugauaggaaaagcuccaugaaaaccagucauugucucuaaggacguagguuguugauauuuaauuccaaauuuccccuuucaaguccugucuccucauucagucagcagugauguggcuccacaauagcuguaauauugucauaauuuccauagaaaccaucuguaaagcugcaaacacaggauuacacccucccugcaggcugaggcaggaaggccagaugggcuaugaaggggaaaagcccucagcgagacauaaaucauuuggugaaggggaggaggaugggggaggaaaccacuuuaggagaaaaauucuguuuggugcaaucuuugcaaacaggaugaaauucccaaaugaaguggccagcagcacgggcucccuuccaaggccagugucuggaacugguuacuugccgggaaccugguucuaaugaggccagagacaaagauuucuuauuaugugggcugcugauuucacaggucauuagccacagacagacagacagagagacagaccuaagauccuggucaacucuuguguguucaaagacagagauggaaagugacguguaauguucacuccucagugccaggcuggacuuuucacauauguagcucauugggccuucacaguaucccuugggggggagauauuauucccauuuuacagaugagauaaucgaguuauucucauuuuacagauaugauaacugagcuauucuaacuccuucuuguucagaucucaucuucaucuuaaguuuucugagaccuuucuccgggugagguccaccuauaugcuucagaaugcaccucuauuuaauacucauuauucuguguaauaaauacuuguuaaccccuuucccacucaccugagauuccuuugaaggcuguguccuuaccacugccacaggguugacucauaguaaaugcucauuaccaauuuuugaauaaauaaaugagaaagucugaguaacucauucaaaaucuaucuuuuccacaguuguguagcugggaguuagaacagugccuggcauauacagacccuuaauaaacauuggaaugaaguagugaaugaauggacgucaaucagcugauuacacaguuuaucaggaagucacaucaagcuuuucugauuucaaacacaguguuacauuagccggggccauugucaugucuggccaggcaauucaaagcaccuggcuuccuguuagugucuugcuacuguuugcuuuuaaaaguaccucuuauuauauaacagcucuaacuaaaaagcauucgcugaaagcucggaaagugagggugagacauggaucuguuacucaccauguaaauuugaucauaucccuuuaccuuucugggccuuaauuucuccauuguugaaauaauuauaguugaguuaaaugugagauuuucugugagcaccgccauaugguuuugcuuuguguccccacccagaucucaucuugaauuguaaucccaacgugucaagcgagagaucuggugggaagcgauuggaucgugggagcaguucccccaugcugcucucaugauagugaguucucacgagaucugaugguuuuauaagaguuugacaguuccuccuucacacacuuucuuuuuucugccuccuugugaagaagguaauugcuucuucuucagcuucugccacgauuauaaguuuccuuuggcuuccccagccaugcagaacugugagucaauuaagccucuuuccuuuauaaauuacccagucuaaggcaguaucuuuauaccaaugugaaaacagacuaauacaaccuccuucuuuuagaaaaaaaaaucagaaguaaucuuaugcguaagcucaauacaagugaaacugcuuugauagagacuuucucaaccuuccuuuuaugugcccagccucuaccccuugguggccucugaggaagcucaguggaaaaaacggucucuggugaacacaguugggaaaucacuagaauagauuauaaguagggccauucuggcucuaaaauucaagaguucuagaaauauuggcacugagcuccacacauuauguggccaaucugagcugauggugugugccaccuauccuuacaaauauagaucuagauggagaagaauggccaugggauuuggugucauaauuucugauuuuugaacacucagauccaccacuuccacaaaggguauuaccccugagcaaaucauuuuacuucucugagcugauuuccucaaaucuauagauugugaaaaggguucuuucaugauuggguuuuaugagauccaaacugauagcuauuguuuaucguguaauuacuaaguccuugguaaauuacauugggagaggcagggaaccauggguuuuggguauccuugcauguuguugcugguuauaacaaaaauaugaggcccugacugcucuuuaucuggaucauuucucaugguuauguuuuuagugagcaaucuugagugaugagguaauguuuccccuagacaaagaguaguuuugcuuccucuuacuguaaaaguggcaaaucuuccuacaucaguauuauucuccuguaacacaacccacuguaugugcaggcaucuggcaucuguguugaaccaugucuuaguccauuuugugcugcuauaacagaauaccugagacuggguaauuuauaaugaacauaaauuuauuuagcucaugauucuggaaccuggaaugucuaagagcauggugcuggcaucuagcaaggcccuuugugccaugucauacuaugguagaaggcagaugggcaagagaggcaaaaaugagcaagaguucaaacucacagccucaagcucuuuuauaauugccauuaauccaugcauaaggguggagcccucaugaccuaaacaucucccaugaggccccaccuucaggcacuguugcauuagggauuacguuugcaauacauacuuucuggugaacauauucaaaccacagcaagccuuuugcaucaucccugugagacuugggaggugugggcaaccaaagaaagccaacauaaaacucuagcuaaugcuuuuucaugaguaauaaagucauuugucucugacccaggaaccuccugucuucugccagcauccaugaaauaguaacaggcuaauuuguuagauuguaaguaauauaaaacuucagacccuacacaguucuugacauauuauguguaauauauuacauuguaguguauucuaucauaugauuuuaaauuauuacagcagcccuaugagguagguagauucuaguaacaguauuucauagauaacaaaaacaguuucaacaagguucagugacuugccaacugucacacagcuauuauguggcagaacugagauuaaaccaaggacuguuuaaucccaaaaguuacacccuuaucuacauuuccucucugaauuuuaugaaauaaugcguaugaaauuuuuuguaaacuuuaaagcauuauauacauauguuuuauuuuuaauaaaaauagauuuauggccaggcgugguggcucacacguguaauuccagcacuuugggaggccaagguggguggaucaccugaggucgagaauuugagaccagccugaccaacauggagaaacccugucucuacuaaaaauacaaaaugagccgggcguaguggcacaugccuguaaucccagcuacucaggagucuaaggcagaagaaucgcuuaaacccgggagguggagguugcagugagcugagaucgcgccauugcacuccagcauggguaacaagagagaaacuccuucucauaauaauaauaauaauaauaauaauaauaauaauauauauauauucaugaugugugcacuaagaaauugguucauuucaacaaaucuguauugauugugguccuagcuuccuacagcagauaaagcugcccauuuaaacuucuguggaaaaccuggguuuaguaaugguuaugcugcuuaccagcugugugacauuggacaagauaauuaacauagccauaucagucuagguucagccaccauaacagagacccuacuaggugcuucagacagaggggauuugauacagagagucgauuauacacauguuggaaguugaaagagcgaaaagagacauagacguuaauccagagaaaauaacuagaggaaguggcaaccacccaaggcugaaugaauaaggaggggugcugcccuacagguucauugcccagauuuuggaggagggaucucuaccugacugcuccuaagaggguguggcaaaacugggagugacagcgcaaaaagaagcuggaggccggagaugacugccgcuacaggagugaugcuggcaggaacaggcaaacgggaaagagauucuguuguccuuucuuucgccuuuuauucucuacgugcugccuucuguuugcagaacuuaauaggaagcuagcugguuaagaauucugagucauguaguuugcagaguaguagccaaguagaaaucaaagaguauaaaguggugaaggcugggcuuagagcugacaaacaggaggaaauaacaggaauaauugcugugccuuggucucaucacuguacaauggggauaauaccuauaucauuagauucuuuuggaggauuaaaugaaacaccacucaguugcuugcugauugcaagugcccaauaaaugcaagccuuuauauuauucuuauuaugcuaagccugauuucuguguagucugcugccugugccuguuuuacagugggacuuggguguuaugcuugcuucagggauuaucaggccaucugggaagcuggccuugcuaagcuccauguggagaacaggcuucaagacucagcauuggcccuugugagucaagaugggaacuuucuccccagagauauuuaauuagcugguugucagaaugguguugauagauaagaugccugucuuagauuggcucugugguugcucugaugugggauucucaguuuauuucauuugucacccugcuuccucuuuuucccaaaauaaaacccccauuguguuucaccuccuuuuuucauucucucuucagacaagauaaaauguccuucacugaguugacaagacuugcgcuccuaaacaguuguccugugcacuagggauuuauguugcagcaucucuuagaauauacagccaaaggcgcugagaccugaauuucagcagcauagcccggcaauuaaggauuuugauuguggaguagacacaaccaggguuuaaaucccugcucaguguuuuauuagcucuaugaccuagggcaaauaaccucucugagccucacuucccucauuucaguaauuguauguguaucauauguuguuggaaaaguaagauaaucccuguagugcucuaaauccagaaugcuucacaguuugaaaacccucaauaaguaguagcuacuauuacugccugucuacacuuuuuuuuuccuuuaauuaacucaugauguacucagguagaauuuauuaauguauacauuccacaaaaauuuauugcucaccuauuagaugccagacacugugcaaauacuugauaaagaaaaaugagcaaaaggcaagucugaucugguggaaauggaauaaaguuuuugucuucagggugcugacaguuuggggagacagugucccgaggcugacacuuucccugacacacuuacaguacaguaugauaggcaguacaguaggggucucagagaaacaaagggccccaaggucccacagacagauagagaaccaaccuugagggauaagaaagguuccccacagccucaauguacauuugagauagccuggcaaaauauauguguaugauaugguaguggaaaugcaugcugguguguguggggggcagaggauuuccacacagaggaucaauaaaggagagagcauggcaugcucaggaaccugaaacacuguagacaguggcauaaguugagcaaaagucaaaggcagagaggacagucaaggccaaauuacacagggucauacggagugcauguaaggccacaaaacuuaacaggcaucuuggacucucuuggcugccuucuucuuuccaaagguaccaucuucuuacaccauacuucuuagauguuaugaugugugucuaaccaauaaucaguugucuccuucuuucuuacugaggcaacccugauuuuuuuguugacagaggcaaugugcccagcuuaaaaaacuacauguuccagccucccuuacagauguaguuaugcagagcugaaugcaaguucuagcugauauuaauguguauaagcuggagacggaguaaaaauuaaaaugucagaguguguauuaagaagaccuaugaacucccucuaacagaccaaugaauacaaagggaaugugugaaguucugugagacugagagauaucuuauguagugcauaacuuaggauaaaucauuaauugaaaaacauuuuuaugagagcaauaaugaaaaagagagcucaaaauguaagauacaagagacaugaauucugguccuggcuguaaaaagcaaaauugugauucuggacaagcucuaagaaaggcagucuuccuuuucucucugcuugccuuuaacaucuuuucuuuaucuucgcaguuuugcaauuuuaguaaagauuuagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaaaaaaaagauuuagguguuuuuauuuuuccuucucugcacucaauguacuuucugaaucugaggauucacaucuuucaacaauucuggaaauaucacagccauaaauuaucucugugaauauugccgcucuucauuuucuuuccugucuggagcuccucuuaacuuuauuguggaucaucuuucuaauguccuggucucuuaaucucuuuguugugcuuuccauuucuuuucauucagccagggcuaucuggucauaguuauauccuggcucacaaauucucucuucauauguaaauaaucugcuguuaaaccacucauugaguguuucauuucauuggcuauuuuuuucccacuuccagacaauguauuccgugcccuauuuuaaaucugcauuuucuguuuugaucaugucuuguucuuuuccuguacuuaaauauuaucugaauugggaauuuuguccguuuaaacauacugauuuuauuuuuucuauguaauuguuuuauuucaugaaguuuugagggaacugggggguacuuauugugucuuaaaucuugcucagaguagauuuuuuaaaugugucugguaauuuuuaauugugaacucaugugaguuggugcuuuuucugaaagaaucugaugaaccugauucuaaagcaucuaaagggugucucuuucuaaugcuuuuguuuuuugccagauaccccagugguaucuuugcaaugaacauuguucauguuaauauuucacuuuaggaauuccuaaaauaaaauaaaauaaaugccuaaaauaaaauucaaacuuaccugagggucuucuauuguuacaaauucugaggagacuccucccacaauacuccaucaagaacauuggccaagaaaaauaagcuccaugucaucacuccauauacaugagaagauuucaccaguuugcauuuuucacugagagaccaaaauuuacauggaagucucuguccaaauuccucccccuuugauauggaccaaagggguucaucucuuuuccucuuugaagcguuaaaacuccaacucuugguuaccaagauggguaaauccccauaaggcagccaaagugucagcucuccugcuuauuuuugucuucauuucccuuguuuuuacuccuaaauaugcauuaacauauuuugcauuggaagaacuaaaugaucuaaucuaccauauuucucuacucaucauuacgaauaucaauuauuuuacagucauaaaaauuauccucugauuggacccuggauaacugaaauuuuauguuaauucaaacaaaauuaguuuauuucuucuuuuaacuagaugaucauggaacuaauuaguauugggacuuaauuuuucauuuuaaaauuauaaguuaauucacuuuuuaaauuuaauuuugaauuucauaaucgaguuugugaccauuuguaucuguaucaaguccagcucuagcucuaccacuuacuugcuauaugaguuugaucaaguuacauaaucauuaugccucaguuuucucauuugugaaaauggccauaauaauaguaucaaccucagcagguuguuaugagaauuaaauaaguuuguacaaguaagauauuuaauaauuuuacuucccaucauuauuacuauuguuaucugcagaaacagaaucauaauaauacauucauuuuugaggauauguuaauugaugcuacuuugugaucaugaucuuaauccaaauaaauuaacuucggguguuuuucaggauaacugucugcucaaaaaccuuuacaaauauuuucaagaguuugagucaucuucuucauuauagcauguuaagacaacccuuuaaaugagauuacuucuauaguuuguaauuacuuugaucuuugcaccuuccuagggcaucuuuuauuuauucuguaauuuaguuucuauuuauacguuaacuuugaggcucugcuuucaucuguucuuucaagguauucuuucuauuccuuugaauaauuuuccauuuugagcaauuuguuuuaggauuuuaaucuuuguuucaaaucuuuugcugugaugaaguuguuucaauucuaagaaccaucucaaaaaccauauagaugccagcauucgguucuggguauauucuucaacacuugacuuagcuuugcuuuugaagugcuauuauuuuaacguuuuauuuugaaaugauuacagacucacaagaaauaacaaaaauaguucagagaucccuugaacacuucacucaucuuuugccaauggucacaucucacauaacagcaauaugauauuaaaaccaagaaacuaacaucuguacaauacuguuagguagguggcagggccuuauucagauaucaccaauuuuugaaggauauuugggguguuuccagguuuuagcuauuaugaauagaccugcuaugaacauuccccuacagguuuuugcggggauguaaguuuucauuucucuggaauaaaugcccaggagugcaacugguagguuguaugguuacugcauguuuagucuuuugggaaacugccaaguuauuuucuugagugguuguaccauguuucauuccaaccaguaauaugugagaaaagugccauuuuucauacauacucuccuuuaagaaaaccuaaucuaugaaaauccagauuccaaaaaauaaaggauuuuuugagugaugaaaauguucuacacuuagauugugaugauaguuacacagcucuaaauauaccuuaaaaaccacggaauuguauacuuuaaauuggugaauuguaugguauuguuauaucucaacaaaguguuuuaaaaaaggcuauuacaugagaugaucuaauuauauuacaaaaaaucuuauuuauucaccaaauuucuaauuuauuaagcauuuaccauguggcaggcauuauguacagugcuuucuaugcauuacccuauguaaucuccauacaaucauuaccuccaauucauaauaaacacuguuguaaaagaagauaguauagaguggcuaacaagggugaaguucuggcacaagacugcuugagcucaaauccugacccauucacuaauuagcuugucauuuaaccauugucagcuuccaaauccuuuucuguaaaugggaaugguaaaaguacuucccuuugugaggaauaaaugaaaaaaaugcagauaaaagcacuuaggauucugccugcguaguaucauuaucauuauuauuaaauucaugaaaagacauuuuccucuuagcaguucauaauugcuugauaacaguguuaugagaaagugaacuauguguauuaauaaaagaugacagauuuugucauuauguguaugggaggacaaaggaagcagaugacauuuacuguuccccuaugaugcaccagacacuguacuuacuagccaccauuguguacaugauaucugaacaacauugugugaugaaaguauuauucauccccauuuuauagaaaaggaaacaaacucaaaaagauuaagacaguauuuccauuucauaaagcaaguauuuuauguagccaggauagaaaaccagguguuucuguguccagaauucauaauuugccuuuucaccuaugaaaauaauugauaaaaaugagacuuugccucaaacacugcauuuaaguuacaguauuaagauacuugcagcuuuucuuuccucuuuauucaggaacaaaaauuuagcauuucuaagggugucacauuuaaaauauauuuaaaaaagaaaauuggaaguccauguaguaauucagaaagguccccaagguuuaauuccaccugaauuuccaacugcuuagaaguugaaucaccauuuaacugcaaagggcaaacccauugguggaaaaguccauugccagaagagcucagcaagaagugaagaaauacauucuagaauuuagaacaagaugaggcauccugugcugagcucaaucagaaacaaaacaaaacaaaacagaacccccaaaugaauuccaaacuaagaagaagaaaagaaaauuguuugugauaacauuucauucaccauuucucaaguuuauucaccuguggauuaaucuuuauauucuuucucuuucuucuucaaacucccuucucuuuagaagcugcuaaguguuguaauggaagcaaagaugggacuuuaaugucagcuuauugagaaaaccaacaaaguuuuuucuuuuguagugagucucaaagauuauguaucucauucuucagguuuauuacugaggaacuuggcuguuggucuccacugggaaagaaacacaaggauauggaauucuacuuggaaaacucaggucuuccuguuugcuggauaaauacagagacaaaaucacaaugagcccucucacauugaugugaaaaaagaucuuuggauagaaaccuacucauuuauucucaggacuuuaagugcccugcuucauguuuuggcauguugcaacugacuuuauuuuauuuauuuuauuacaagcaagagaaacaaagucugguucccguaugauuuaaaaaagaaaacaaaagaaaaagacuuggguuggguuaggaguuucucugaaccaugaaaaugaccucaauauuggcugaaaaauuugacaagaaugaaaaauggcaugguacaagcuccaggaagauguugcagagaugagcuucagaugcauuucauuuugcguuguuauuaauggcuuggaaagaggccauaaaccuauuaugguaauuaugucugcagaugaggguaaauaggaugguguuauaaacaccaguaagcaagagacguaguacagagcaaccuagggagauuagaaauauggacaggaaaugaacaaacgagaucagccuggaaaagugaaaacaugcaucuggagaaauacauaauuugaaaaacagagagauacuuaaaggcagggucauacuuggaaagcaguaaugguaaauaggccuuugagcagauaucagcccuggauaaauuuguaacaugauggaaaaauaauacucagaccugguguucauauagccuuucaaaaugcauuuuuucccaaacagaggcauuuccauuaucucauuugaucaucaacccaaagagguuggaagcaaagaauucuccacugaagaaaugaaaagagguuaagugaauugcuuagggucaauuuguuaauaaaauagacauggcuaaaacuugggugccuugacuuuucuuuuucuucuuucacuauaacaccucaucauuaugucuugcaucucagaauaguaauuauuucugguucagcacuuagccaucucuuucugauguuaugaacaacuuuauuucauuugagacugagcauagcauuacugaacauuugaacagggcauaaccuaugccccaaaccuauuuucuaggaugaagugaggcaguguguaauggaugguggaucucuggauuagaagucggagcucuauacuaguaguaucacuaacuacaguguuggccaugggcaagccaucgcuagucucaugugcuucagcuguaagauggaggagguugauugcuauggucucacagaauugcucucuuugaagagcuaaaagaagaaugaagcucguguaaacagacaacccgagacagaaaccucgaagccugagaggagugggagaagaaagagagagcgggagagauguaaacgccuggacuaaaaacauguauuggcauauggcaggcaagcauauuuaggcuuuugaggauaacuucugcaaaauuuaucucaaucuauucucucacgcucuuguuauagaguuucuauccuaaaguugacacugucauuuuuucccccuugguaaugauguaugaguuucuauguacccuuaucugccuuuguaagaaccaaugcacuagaugucuuuuuggauucugccaacaucauaauggcuccuuuuucucugagaagugccuuuauguccaaauggguggauaccuugcaccacguuuagguuauguaauuccuccaucccuucuccauaagugauuagauuguaaucacugacccaagcagagccaaucgaauucuuuccaauuggaaauugggaccaagagaaaaucauuuuauucucucacugagauuagaaugaagaagcauggaguggccaaauguggagaggaaacuaauguaaauagaggauuagagagaaucacaauauagccucagagggucaaagacagacuguagcugacauccugauucuagccuagguggaggcuuacaucugaaucauugcucuuuuuuuuucucaauaguuuuacugagauuauuuuucacuuuuuaauaagcuguuuuuacuaauacaguggucaaucuagaugauauccuguuaauaugccagugagucuacccagaacuuuccuccuccccauuaguacuuuaggauucugccuucaacaguuugccuuugguuugaguuucuuuauguauguauguaugcaugcauguauguagcauauaugcauguuuauauguauuuauucaaggcagucacucaguguguaucccaugagugucugucuauauuccaggcacuauguugggcacuggggauacagugaugaguaaacagagacccauccucaaggaguccaagggaaguguucagcaaaacagaucauuauaacauacuuuauagguggaggaccgaggucagcaggggcucugagaagcaccaggggaaacugcauagaugucagaaaaagcuuucuggaagagauaaugccugagcugaguguuaaaggauuguuuggaguuucccaagucaaaaaggguuacagucauuucaggcagaggguaugauuugggcaagugcuugagguaggaaacagcaggaugugagaaaggaacgccuaguuccuaggguuacuggaacauaaaaugcaaguuaggagugaagagaagaugaagccacagagaugagcagaggucaaguguggagagugucaaacaucguaucaagaaucuugaguuuuagucugagaauacugaggaaugauuggagacucacuuacagguaagugggaaagugacaauuuaagaugagaccugaaagacaagaaggagauaaacugguugagguugguccagacagagggagcagacagugggaaaggaccaagcacugagacccggguuuccagugaagaugaccaggugaagggaggugucaccagcugagcuacagagcaccggaaaagguaaagagaaguuuccggaaucuauguuagauuuguuuagugcucuaggugcccuagaaaguagauuauaauaccaagaauaauaugcagaaggcuuauuagggagugcucugaaggucaacaccaaggaagggaagaaaaggaaggagauggaggcagaauuggguagagggagaaggcugccucaauggacaccucagcugacccugaagggaguuacgaagagaggaugaaccuucagcuugcuccugaguugggauaagggucaggccuuuacaacuccucaucaguaucauugcaugugggucaccccucaaggcagugacgucucagacaaaauggaugucuuuagcugaagcaauguccaaagguggcugacaacugagagccuucugccaguagcuuuugcagaagcuggagucauaagcccuuuauuccugaaggaucaagauggugcaccaaaggggccacuguauuguaacugaggcgcuuguggaucaccuagguggaaacauccuguaugcaguuagauguaugauacugaggcuaagaggagagggcuggcuagagcuaaggauugggaagcaauauuauaccagugagaaugggugaccucuuuggggucauacacccuuugagaaucugaagaaaacuagagauucuucuucccagaaaaaugugcaaaaaauauauauauccauggaauuuuuggagguucaccuuuuggcuaucuuuugauuggguucacucaauaacauucugugccuugggcaacaucaugcaauauuuuaauuaaucugauuaaauaguccaguuuauuggagcauucccagaauaucaggaccucuccaacauuuuaccuaaucuucaugcuaucuaacuuaaccauauuaucccuauuuuauagaggagaaaacugaguuuaaaagaacuuguguggggcaccacaguugcuacagcagagcuagaauuuaaacacugguuugugugacuagcagaguuggauuccauuucugagcuccaugauauaucuucucaccugggcccuaucagggcaacaaguggccucuugccaaguagagaggaaagcaaggggaccuaaagaacagucaaggagguguauugauauugcccuacagcugcuaucagugaugcggaguauuacuggagaaggggaaaauuacugacaucaagcaaacagcuccagagccagggacuggccaaggcuacaaugugcuugagggugccccaguggucauaagaauuuuggcagaggagucugccauucugucccuggugguggcugauuggcugccucggauauucuucuguuuuauugguguugucguggaaaauagcguacauuguauucgcaacuuaauuggcuaguucuuuucuauuuuacuugaaaaaaauuuaauaugaauaucauuauugcuguccauuggcucuuaucaucuuuuuauccuaaagaaaacucaacuugcaaggucauaauaaaacaaucauuauuuacauuagguaaugggugcagcacaccaacauggcacauguauacauauguaacaaaccugcacauugugcacauguaccccagaacuuaaaguauaauaaaaauauauacauauauauaagaaaaaaaauuauuaaguuaaugagucaaaucaacuuucuauggcaaaacauaguuucuaccuuuacagaguagguucuuuacaacaaacuuucugauaaucuaguuucuugcgauagucuuuuacagucacagagaguuaaguggggagagcuuggaccuguuaaaauaggccuucaauauuacaagaaguucucugcagguuuuuagucaggggacauaaagagaaguuuaacuuuguggugacaaaauaaagacuaacuauagauuuaaauuaaauucuguaguagauguauaaacauccacugagcuuuccucuuaucuuucuaaacaaaggcaaauugcaaauccagugcauuguaguugugaaaucauuuguaauagugguuucuuaaagcuagcucuacaagugauuuccaggacuccugcuuggaaaaagaaaguagugccugcuuuuaacuuuaauuuuaauuaaggcugagugagucaaagauauguggguguuaaaaaucauuguuuuccauaguggcauuagcuuaaaacccucauuacaauagagccauuguucuauuaacuagcaccuuuuuaugcauuauaaaggaucacugcuaugguccaaauguugguguuggaaauuuauauguuggaacuuaauuuguauuuuggagccuaaaauucaaugugacaguuuuaagaaguaggccuuuugggaagugauuaaucaauaaggcucugcccucacgaaugcaguuagugcccuuauaaaagaaguucaagggagcugucuugcccauucagccaggugaggaccuagaaggcaccauccaggaggaauaggccacucaccagacacagaaucugcugaugccuuaaucucagacuuuucagccuccagaacugugagaaauaaauuucuguuguuuguacauuacgcagucuaagauauuuuguuauagcagcaggaauggacuaagacaauccccaugaaagguauaaucuaaugaagugucaauaacacaaaauuauucaucucuuuugccagcaauaccuugauguuuuuggagguccguguaaauuguuuguagcugugagguacugaaaagaagacuugguuacuuguuaaaauaugcauuaauuguguaugccuuuuuggaaggcguucuguauauguacucuauuaauaaauucaguccagaagguccuuaucuaauuugguguacgauuacagcagggaggcaagauuaguauuugacuaggggccagguugggcagguuuccuucauuuuccauccacucacuucuauggggacuucaaaaucuauucuuuuaauuauccuguacuauaaugauauacaccagcaacuccuuucaaaugaaucaacccauuuuucuguuucauaagaccuguuuccccuuuuuugugucagcauauccacucagcuauucuaccagcuacuuuaacaggugaggcaaguaaggcuaagguuuuucagguuguuaauuccaaagucaaauaauuugaaacaaauuuggaaaaucuaacagcuuucucuauuucuguuuuuugccucuuauguuuaugucuccagugaaaaaauaagugccuggcccuuuaaacuaucuaaguacuccacuugaggccaggugagcucaggucacuggacccccugagcucagaaaucuagggucuuauuugggaucaguguguagagguggccaaaucaauaaaaaguacucauuuguugacacuccauuugcuagaggugccuguuucucaucccagggcuccuuggauaaguugcucggugcaaucugugucuagacucucaggcaugugucucugccaucccuacuuucccccgcaaaacggagccagaacuaaugaggccaauggcccuggaacauuugcuauagcugaguacaggaaacaggagggaaaaacacaaacaacacagccaaagucccuuccugaagauggaggggaagccugcaaaauacaaagugggauugcagccucacacuuugggguuggcuugcuguucugaguccccauccaggagugaguuucacauccuucugggagugaacuguugugcuauucaggaagggaucugaacucaaucacaugugcuuccauucacccaagggugaaauugacugcacuuaacugaagauucagcagcuccggcgcauguucucagacaggcuuuuaacagacagggugcagguaguuccgggauucagucuugugauuuagggcucagugcugguggagugagggugggcuggaaaggagguaguucccuggagauaacucacugccaucuuaauucugaacagauaucaaacacuccuucagaauacaacacccuucacauuugagacacagacucccuauucuccaauuccuaaauaacucaacagucucuaaauuucugaugccagaaauucagaugaccauaaaccaggcaggggcauaaauaaauggcagcaaaccccauguaaaggaagaggaagcaacagacauuauggcuaauuggagaauacauauucugucaacaggcagccaauauuuuacucuagcuaaugggcacugaugugugucuaugagcccagaauugccaggucucuuaauuuuuaaagaaauauaaaugugagugugaaaucuauaaaauuuaaaaugcuggcuaaauaaaaaaugucuguccauguacauauuuauuuaauaucaaucucacuguuguuggcugaguauccugggaagcagaucugagaagaauaauaggaugaaggaaguuuauucgggaguguuccuggaucgacaucuguggaagggaagagaaaaagaaggaucagggagagggacaaguuaagccguguuguggucuuaacaaaggcuucagcagaccuuauaugaccuuauaggcaggcaugauacugggauaacccuuuagaauucuuccccuuuuuugacuagaaggccaggccucugggugcucacauuaaccaacuaucgggucauaugcccugggucggcggggcuuuagacaggggcaauuuucagaaaaggguugagagcacccgggguaauaaaucccuuagucuuaagggaccaggggccgggaacaguggcucaccccuguaaucucagcacuuugggaggccaaggcggguggaucaccugaggucaggggcuugagaccacccuggccaacacagugaaacccagucucuacuaaaaauacaaaaauuagccaggcguggcggcaggcaccuguauucccagcuacuugggaggcugaggcaggagaaucgcuugaauccgggagguggaauuugcaaugagccaagauugugccacugcacuccagccugggcaacagugcgaggcuccgucaaaaaaaaagagagaccuggguagaauaccaagugucuacuacagaccacucuucauauagcucagauucacuuccucguuauuguuguuguuuuguuuuuuguuuauuuuauuuuauuuuugagagagacaggaucucacuuucuuguccaggcuggagugcaguagugugaucacagcucacugcagccuugaccuccugggcucaacuaauccuccuauuuuagccucccaaguagcuggaauuacaggcaugugccaccacguucagcuaauuuuuaaaacuuuuguagagaaaaagcuauguuggcuaggcuaguccugaacuccugggcucaagcaauucucucccuuugcccucccaaagagcuaggauuacaaacaugagccaccacagcugaccucagauuuacuucucuguguacguucagggagcaaaaacuucaggauuuagggucucuucucuugggaggucucagggccucuuuuuccacagcuggucuuaagaccacaguaagacccauuauuguccucuacugaccauucuagaugcuccucacucucagcuaguaccuucacugguccagaugguuugccugguguuaggacauggaaggggcagagucccuggucaccauggcuuucucaggcucaaguacauuauggcugauguacuugucuauaccauuaaugcugggcaaguuaguacauauaagaacccauguaguucacaaagguacuauacauacucuuccuuucuuuuaucguguaacagcagccuuaccuucuccugauaaucaggguccuacaaggaugcugacucuccuugcuuguuuacagacucugggcccaugagcccgaaguacacagguagcagcugcaacuuagaguucaguaggauucuugcuaugcccccugguggaaacauuucuccuuggugaaaaggcacuaaauaacccagaaccgcagaaguggaaagcguguauuucgaguugggucccugggagugaagguaaaagggaucacuccugcuucuuccccuugguucuugcauucauguauucuuccuuuugggacacagcaccauauaaagggcauugauguaaaauguccagugcacccuggaggauggcucccuauccuugcacagacuccucucugaauuggcacuucaguugucccuucaauaggccauuccuucacacucaggaugguagcuucugguuaaaaugguauuugauauaacuguggauccuguggucauguggccuuucuuguaucucauuuguuauugagugggcccauuggucucaugugauguuuugugggauccugugccaguuaaugagacacuccuuaagcccucaaauagugguguugacuaaggcccuagcagcagcaaaggcaaaucugugccuagaauguguucauuucuguaaaaauuaaucccugugccuucuaguaugaaaggggcccaguguauucaacuugucaccaaguggcugcuuguaucuuuaagggauggugccagauuggaaaguaggguugcucucucuugcuggcaugacggacauuugacagcaccaguagcugaaucagcauuggucgguucccugcauugccucuagcccugucacugugccuacucuaaucauaugcccauugugccacauuggggcugcugauggcagagccuggcagaugucaacuaacagggucacuuuauguaccucaugguuuagugccucuucugugauggaugcccucuggggggcauuaacaaugcaauacauguaucuugacucuucaugcccauucccuuagguccacccaucugcuucuacccacgacuuucuuuuccucgaucuuuuaaucuuuccccuuccggguccaagucaacgcugccuagggucuauauauaaucuuaagccacguuuuuguuuucuuuccauauaagguagauggcuaggugcacugucugaagccauaggaaaguaucuccucauuguugucuuucagcaccacuccugaauggggcugucauguggccauggucuauuuucagcuugcucuacucaccaagauggccuaccuguaaaccaggcucagauuuuuuucuucucuaucagcuggucauaagggccacaggugugugcuaacagaaaggugcuggagcaaaaguaguggaugacaugggagacuagaccaccugcucagguagccuacuuaugcccuucagcauuucucauggccaauccuggauguaccacuuccaucugcagugaauugcugcuagguccaccuguucuuauaacauguugaaccugacagaaccuugugcugggcauuuguggcugcguggucacuugaugacccugauaagggcuucugucuuuaccaggguccaaaaggaacucuuuuucagauaguguguaauuuucugguuccagaguccuaggaaucuaaauaugauucuccuauuggcauuugugugaccuccacguggcuuuuuuuucccacaaauaccuccaauaacauaggagucauugaaucauagggccaaagugguugggcuguuuacacugcaggcaaaucuguuacagaacacuuuccuauuccaggugucacucaaaacugacagccuucucuguauguggguuguaacacauuuuggaauauggaauauguugucucuaaaaccugaagagaccuaccaggcuuugugcuuccuucauugcaggaguucccuagugcaauaauuuguucuuuacucugaaagaaguuguggcaugcccaaucugagauaucaggccccugaaucuuuguagauuuaucuuuaucuuccauuuuguagauaagaguucaugugcguuaccaaagccuucaauguacuugucauuucuugcucaucuagucauauuuucaugauguuaucaauaaaguauacuacugggauguucuuuaagauguccagacaaucuagaucuuucagacuauauuaugguggaggaaaggauaauuaacauagccuuaagucaagauuguucauguguacaguuuuucuguuccaagugugugcaaucugcuuuugaucuucuuuugugaugaaacagcacucauuugcuaggucaguggcuauguacaauguacuugaggccauuugcucuagaaaaauaucauagcagcuuagguuuaggcucuugauugagucaugcucugguauuugucaggcuuuuguggcauccagacuagugaaucaaauggugauaugauggagacuggcagcccugcauccuucaggucuuuaacugugcugcuaaccucugccauucccuuaggauaaaacaaauuuuuugauuuacucucuaucuuuggugggguagggguucgguuuuggagcuuucugcuuggucuucccuacuugauggcuguuaccccagagacuaagaaaccaacguggaaguugugcuaauugccauauuugucuauuccaauuaauaaaugguagucugugaaaaugacugcuagguggaucagugaaccccaaaggccaaauguaagccaaacguagaccaagaguccacucaguaccuggccucuacaugucucuacucuaacagagaagcuauguugauauuucagcucuggguaucaaugucaauugggaacuuguaucugccagucucccuucccacuuuacaguggcauuaguagguggccguagugaagcagcaucguugucuggggugauaccugaaauucuuugucucacagccauggaaaacuaagacauggacacacaaagaguaagguugagaguggaaguuuaauaggcaaaagaaagagaauagcucucucugcugcagagagaggggucccaaauggguuuucugggucuauggugaaaugcagggguuuuacagugagccugaggaggcggugucugauuuacauagggcacaaaagauugguuggaccaggugugccauuugcauaaggcaugaaaaccugguuaggacuagguaugccauugcagaaggcaugagaaacuggccuccccaacccuaaucuuuuuuuaugcagaugguucucugccuugcuagugccauguugcuuauuccuuuacuguacacaugguaacaaaagggaaaauggugccuccauguugaccaugccuggcucccuuguagcccuuuucuguugggacagcucccagcauucacccgugcaagcuuccaggcugcuuaucuauguuugcaacuugauuuuccaggcugcuuuucuugggcugcuuuuuauuagaagggaagccuugaugaggacucuuuuacucuaucugccuaaauaauuucuuucuaucuccuguaucaauaggaccucuuguaggaggacuagacgucuaaauuaugauucuccuauugguacuugugugggagucaagauuaccuuguaccuuaggcauggcguugcaggguccuuccuacugaugaacuggcuuuuccuucaauuaauggauugcaagccugaaaacuagcucagauccagaauuugggcaacggauuauuacuaaauugugucuauggggcuaaauucgaaguguuaucagagcugccuacauuccuuggcucauggcugcaucugacacccuugguugucuaaacacagacagauacuggugucuagacacagugacucuugcuuuaacacaacucccucucuuuuugagucuccugccucccuccucccuuuaucaggacccuagugauuacacugggacugccugaauaaucuaggauaaucuccccuugucaagauccuuaacuuaaucacaaaaucccuuugucauguaaggugacaucuucauaggucugggauuaggacauggaccuuuuggggaaugguacacacuagacugccuuuuuucccaaacccaugaacauauauagcugaaaaaccugggauuccuugcugaaagguaauucacagcagcaacuuuggggaaauaaaguauuuucuaaaauuucugaaguucagauaaguucaucagacuauaguaucucuccccaugaugccuaaggcagagcugucaagaguuuuuccccucguaugaauguaacuucacuugugugucuaacaugcugggccagagaugaagaucagcauacaauaauuuguccucaucucacaaccucaucuuuuuuuuuuuucugagacggagucucguucugucgcccaggcuggagugcaguggcucgauccuggcucacuguaagcucugccuccuggguucacaccauucuccugccucagccucccaacguagcugggauaacaggcgcccaccaccacaccuggcuaauuuuuuguauuuugaguagagacuggguuucaccauguuagccaggauggucuugaucugcugaccucaugacccgcccaccucugccucccaaagugcuggcauuacaggcgugagccacagcacccggccucucgcaaccugaucuucuaacucuagccuuuggcuuugauaugaguugccaucagagcuggauggagcaggucagaauccuucaaacucaaugacuacugaagaaaagaaugagaaacucugucuagagagacguaggauugcauaccuuugcuuaagcuaguguaagcuugauuuuggaaucagccagugggaauacuuuucuguggcuguaauuuuuuuuuuuuugguuuauguguauccgagguuaguuuguuuaccaguuuauuucuguauucaauguguagacaucuaauaauagcaggugaaucaucucuuugguuuucauucuguaacacuggaguuacaugacugagauuuccuuuguuugguuguagguaaaaauuaauggacccaaaugcuuaauuaaggcagcucuaagauuaaauguuuauuuauguaauauaagaacagccuauauauuucacauaggccuaguauauacauuuuccccuucaaaacucuucuauauuuauuuuagaacuuuuuuuucugaauuuuucaaaucaggaccaaggggcaaauguuuucucauauuaagacagcaacauauaaauguauuuuuagaaaguaaaaaauauuuuuaauggucaaaacuagguaaauggcuagguccuuauuuuaaauguuuuggagauuaaaggacagagaauauucuggacuuucuccccugccuguucagucaaucucccccuuuucccauugaugcgacuccacuccaagcacuguaaaagagcugggggcuauaaagauaaauaagacauaguuccuggcauaaauaaguuuagcaaaaaaaaaaaaaaaaucaaaauauuaaaaauaguguuaggaguagcugccauuuaauuaacuugacuuaagagcuuuaugagaauaaucuuauuuaaucuucaguauguucacuguccuuuauuccccuauacacuguguucucccugcucucuuaaggagcuuagaucccuugcuucauccucaguucccuugaguuuuucucucccuucucagcacucaucuuaaagagcccacauucaauuccacacccuaccugcuccuugccugcacauaugcuacuguaaguggcuggaggaacauccacaaccaggcuuacuggucucucuuuaaauuuauggucaccguuugaagggaaucuuuacugcugcuauuaccggaaaggggucucgauccagacccuaagagaggguucuuggaucuugugcaagaaagaauucagggugaguccauagaguaaugaaagcaaguguauuaagaaaguaaaggaacaaaagaauggcugcuccauaaacagagcagccccgaggaucugcugguugccuguuuuuaugauucuuucuugaugauaugcuaaacaagggguggauuauucaugccuccccuuuuuagaccaucuaggguaacuuccgacguugccaugguauuuguaaacugucauggcgcuggugggaguguagcagugaggacgaccaaaggucacucuugucgccaucuugguuuuggugggauuuagccagcuucuuuagugcaaccuguuuuaucaggaaggucuuuaugaccuguaucuugugccgaccuccucucucauccugugacuuagaaugccuuaaccaucugggaaugcagcccaguaggucucaggucucggccucauuuuacacagcuccuauucaagauggaguugcucugguuaacacgccucugacacugccagauaaucauaccauauuuuccuaguuccuuuacuguccuggaaaaugauuuucauaugaacuccuccucccucucccaauaccuucuuuccuagauggucuuagcugauggcagaaaaaauagauggagucagaagacaaauuccaugaaguccuucccggaaauauacccagcuacuggacucugugcaaagauauucuccucuucagugacuguggaggaaccagucuuguuucuagcuaagggcaagcccuccacucaaacaauaaaugucaccugaguugccuauucuggaacuuucauagagccauugaccuacuucucuccugccucauaaaguuuccucuccugacugaaucagccucauuggcauaaaacuaaucagugcccagguaccaauucuacucuacugagccuuucuuuggcccauauguugcucugaaauuuuuggacuguaucauauuagcaaagugauucuucgccaucuuaauucaucugcucugaaaucuagaaucaggaaacucuaaaaaugcauagagaagcaaauauagauacuguaaaaucuacauucuaacuacaugcccuuuaguuccagaaaaguucuucuucaccuauuuaaucuuucuccagaugcaauuuuaaaaaauucuuacauucacuccccuaauaauuauugagcaauuucuauggacaaggcucuauuucaggcauucaguaaauaaacagacacaucacauacccucaaauagcuuauauucuggugauggggagaauauucaauaauaaauuaauaugucaugugguaaaaaguauuaugaagauaaagcaggaaagggggcuagcaagugacaggugguguaauaaggauaugcguuauuauuauauaauaagaagaauacgaaguaaacuccaugauauuugggacuuauuauucaccuccauugcacuaacacugauaaaaauaauggcacauaguaagcacaagguaaauauugugugaauauuuugagaaugaaugaaugaaugaaugaaugaaugagugauggugaggaagagaacccaguuaggagguuacaauaauucaggugauagccaaaugauggcuaaacacaggaagaaacuuugcaaaucaugagaggagaccauagucuggauacauuuaaaagauagaacuggcugggugcggugguucaugccuguaaucccagcacuuugggaggcugaggcaagcagaucacaugaggucaggaguucgagaccagcauggccaacauggugaaacccccucucuacuaaaaguacaaaaauuagccaggugugguggcagacaccuguaaugccagcuacucaggaggaugaggcgggagaauugcuuaaaccugggaggcggagguugcugugagccgagaucaccccacugcacuccagccugggcaacaagagcgagacucugucucaaaaaaaaaaaaaaaaaaaaaaaaaauagaaucaguagcauuugcugaaagauugucuguggagaguaggggcaugauugaaggagagaaaucaaggauggugccaaaccuuucgccugagcaacuggaauggaguacccauugauuuaaguguggaaaucugugguguggcaggugugguagccaaaauuaaguuucuuugggacuguaaaucaagucuauuucuacaucuuccucucccucuuucaguuuacugagauaccuaaagccaagcacugcuguguauccaaggaaaaccauucagagucauucuacuguggaaaacauccauacugguuccauucuucucucucuuggccagacacagaggcauccuguguugauggcugccuuucuuauggccaaggaaggcuuuuuccuucaaauucaucuuagaggcuuuauuuugguucaagaaagugaaagauaauugaaggggaugaaacaaggaaaauaguguuuguuguacauuucugaugauggcaacagcuugaaucaauuugcuguguuucugugucuggcuggucacagcagccggauccagaagaacacauugcaauugccauucagcauggccucuugcaugcaaaccugaccucaaaaaagcuuaaccaagucuuguuauuugaaacaacacacacacacacacacacacacaaucaagugaucaaaaauaugguauaaaucuauuuaguaaagaguguucuggauuauaaugaugguaacagaggagauaacucagauguaagaaaggcaaagaaacuuguaaaauuaaaaaaaaaggcagcagcagcgguauuuuuuuuuuaggauuguaaauguccccuacauauuuuugcuuuucuugagaaaaaugugcaagauccuuuccagcaaguuuggggcaguaaaaucuacaggaaagaugcagagagagagagcucugcugguuuccauaguauguaguuaauucuccuuuuacucuguucuaaauauaauccugcucauuugcaugccaauccccagaaugcuuuguaauuucacaacucuuggcuaguggucucagcacuuacgcuuuaagaacaaagcaaaauguuuagggcgugccuuuggcccagucuuuuuauucccccuuguguuuugcaagaguauagggaggugaucuuugcuuggcauucauccuccuuugcagaguaucacagaaauaaaguggagacugcuguggacuuuucuugcgaagacugcauucaguccaauuaaccauaaauaaccagaagcuuggauuaacucacuugagagggaguguuuaaggggggcuuuguguguccuuggauuaugugaccagucugguucguuucggguuuauggaaagcccaagccggaguauucuguauucucuuucuguggaugccuuauauaguuucuuuaucgcaagcacgucuucacuuuaaugacaagaugucuagaauugccaucagugggcugccuuauggaaacgugaauucaagauucaacacagcuuuagucaugcuuagugacauacaggauuucuauuuaauagaacauuaagauugacaauuggggagcggugggaaaauugucuucaaaggguuuuauaauuuuuuuugcauagcaagucuuuuuuugguuccuuaaauuuuauguuuggaauuauuugucgugagaguugaggagcucccucacccccagccaccacucagaccccacccacaguggccucuccaaauaugucucccuuuggccguuugauuuuagcagguagcuaaaggacaauguauuccaucgccgaagggccaugguuuugcuuguaauaacauauaaaccuucgucugucagcccugccuaaaguaaacucgggauugugagcagugcacgugguucauuacugauggggagcaauagcaguucuacuccaaauccauggcugcgcaccaggaacgugucugggcuacugccuucccacuccacagguguuuucuacuuuuuacucacagagcagcauucauguucuuucuuugauucugagacucagucaggcaguggaguuucuuuaacaagauacuacuuggauauuuuuuaaauacagggaaugguugaguccacugcuaccgugccccuugcagccucugagagcgagucacggcuuuccauuuucuaauguguauguuccgggucuggggaccccagcaggcccgccagguugcagagucggaccagucuccggcgucugaaggggcugcgccgcuguuuaccaccccgcgagcagcagaggcggcgcccagcccuccucucgaacaaaggcgcggccgccgcauucgacccgcgccauggcagaggagagcgggugccgggagggaagccgggaaccgucuccauucugaaacuagggcggggaagguaggagauccgacgaggagcuggcugggggcggcggcgcccgcaacucggccccgcggccgggagggcguagcugaugcucccacccccgggacucagccuccgcucccgaaaagccccucgcgcccccugguggcuguggagcagccugacuccgcagcacucgcgaaucagaaaaaaaaaaaaaagaaagaaaaagaaaaagugggugaggcagaugcaaagaggaaaaucaauagggauaagagagaagagggaggagucgcagaucagccauucuugucuuauggggucccagcuggcgcagcaaaagaaaaaaaaaaacaaaacccgggcgugaacgcggguggaggagggugugcgugggggggcgggggugaaagggggaccggggagauuuacuauugucucuggcagccgccgcgggagcccgggaggggggcggaggcgggcggaggcggcggcgcggccagcgcaccauucacuccaccugaucucggggcgcugugcgcugaggaaggcgcgggcgagccggagcagaagaaggagggagggagccagccgcugcagccaccaccgccaccauguccuaccaaggcaagaagaacaucccgcggaucacggugaguccgggcgccgcugcucccucccuccucgcucgcucccuguccgcugcgcugcgggcggggucggcucggaucccgccggcuucucuggccugguccccggggagggacggagacccgggguccggguggcggagcgcggcggucaguccagccggcgccacacagacugagcgacccugggguuuggggaaaacaaaacaaagaggaaacccaaacaguggcacggagaacuuuggauuauuuauccucccuucccaccgccgguaguuccccaggagcgcggggcucgcggcucucccaggaccacugcuccgccuggagugucgguuuuugccgccccagguugaggugugcuuuuugucuaaggauccuuuuggccgugcuggguuuggagagaugacaccuuuccccagggguacuuggcagcccgaccgcgccccucucccagcuccagccccacggcucugaccccugcgccgcgaggguggcagggugucuggaccaccuguccucgccguguccccuucuugccugcguucaguccgacucauguuucaauguaucguuuaugggacuggacagcuaacguggcugcagugggaaugaucaacuuuaugugugugugugugugugugugugugugugugugugugugugugugccuucgaugcacuuuacauuuuucauuucuuuucucccucacaucaaagaaaaggccgaguuuuuagagcagauuuuaguuuacugucgcgggcgcacgcuguaugcaugcaguguucaacccauugugugcaagacggagacaccgcgacuggcgggugucagaugcgcuagggugugccuagggcgggguggagaggggacgugccauuaucagguacagaagccgcgucuucaccggcgcccagcaaggcugggauuccguggugaugcgcuguaaugaugcccccaaauaguaggcacauauggcaggcugggauggucauuuacaaaaauagaauaaauaaaaacuaacguuuuuuaguuuagcacgaagcagugcgguugugcuuugucuauagugaauuggaugguguguguguguguguguguguguguguguguagugggggaauggguggcuacuccaucuuugcaagcugaacaaaggaagugaucagcuggccccugggaggcucugcagccgcccuagggcagagcuuuaccugccacaguaguugauuugcaggguccgccagguuuuguugugggcaugagucuguuugcacuuguucccuuaggcuuggaacauccugugcguuugcgauugagaugcagaaccuuccccucugcaggcaggaagaagccucccuugcgccuacuauguuuuauugucaaaugguuuauuucuuuugccgcaccauaccuuuuucaugcaacugagcuucacuucacacaaaugcaccccaccccuaccagcuucccagcuggugcuggggaagaaacacuccccagggagaagaguugaggccagcagggauccuuuugccugguagaggcuuuggguuuuaacugauccuccuuuaccacuaccugauggcauucacuuuccauuauugaagaaacaucgugggucuuuuacaaugcacaguauugucuagugcugacugucuugucuuuccaaagagcuguggaaauuaucauccaaaaaaagaaagaaagaaagaaaaaagaaaaaaagaaagagaaaaagcugauugggacaaaagcucaauuuuuacuuaucuccccaacucaggagauugaaccacagcucucaugcuauucuaugcuggagguaugccacauguaucugccacuugcuuuaacauccaguauauauuugcuaguuuuccuguuugggauaggcagagaaccgauauuuuuuuucccuccuagacugcagugguucuucuucuggacucagccugugacaugacauugagagccacacccauucuucuagguaucauuuaagccaccuuuaaggaaagauaaggaaauucagcauugauaacuugccuuaggagcuccaguaaaugugguugugccccaaucccaggaccagauuugcaguggauucccuuuugucucugguugaaugaucuucccugggguacauccuucauuuucagugcggcuuccauccuuucucucuguguguggggcguggugcugcauagcagccucugccuugaagcuggggcuguaucuccagcagcuguuaacaggaguagacagugguugugaauuucuucaaaccaggcugccuugaauucauugguuuuaacaaccaaggggaugaaaaggaagggcauggcaggaggcggauguuggucuuuggggauaaggaauccauuuguaaauuuucucaugcuucguuuuugcauuuccaugaacaaggaaucuauuuuagaauaaaauauuuauguauguuugcaugucuauagaagauuauaguugucuauauacugugaagguugagguaccuuuucuagauauaguuguaaauauaacaauguagacauagauauucaugugcagcaaauaugauuaaagaucuaaguauaacauauacccccuaccaucaauucuaguacauuuuaaaaaugguaacauggaauuugaauugaauuuucuaugccaccucuauuccuuucugugaaggcagccccacccaguagcugaagugucacuacaaucugaggacuagugggggcagucuuucuuggccugguacccuuugccuuccugggaacuacuuucuaccacuguuuuggguccaagauaggauugguuguuuuuguuuuguuuuguuuuuuccuccuuccaccuauuuuuauugcccuccugagauuaaggcauucuuacuauccuuguuuuauugguuuccugugguagggcuggaaaugagggggagauuucugugucccuguuggaguuggcucggaguagcuaccuuucucccgaguagcucccaagacuucagaucuucauuguccccucucagggcagcuauguggauuaucuguucuaccucaacacaagccuugcuucuaauuaucagagacuggcaguuuuggggguucgacagaucacagcaagggaucuucacugucucgcgaugggccugguuuacagauacauaaugauuaucacuuaaauggauuaauugauuuaaaauuguuccuaauaauagcccauaccuguugaguguuuauuuugucagguauuauguuuuuuuaugccuuacaugccuuguuucguugaauccuugacucagucaauacugucugagagggacuauaguuaccccuauuuuacaaguuaaaaaaaucuuagaaaauaaaaaauaauuugcucagggucagagauuuaguaaguguuggaggccagacuuaaaccuacauacccaacugaaauuaaaaugcaugucccucaccaucacacucuuuuuggugucuccgccucugccucucuaccauugcuguuacuugacauugguagggcaaaugguuuccagaccaucugcacugcugggaggcauauuuuucuugucacugucaacaaaucccacaacauggucuuuccuaccuuuuauauuaaguacauauaagaacacguuuuugaaauaguagucaccaucaauucuacagguaggaacuuuugauaaguuacaguuauuguuuuccucugacauacguuacaacuugaagcugaccacaggaaugggccagguccuaauacuuaggcacuuagguuccaguguuuuauauguauuuucauauuagaaccuccacagauaaucauuucccaguuaaggaaggacauugaaauaugguuaggugaagucaguuauuuagaguugccuggugagaauauuggggcaaagcuagcaaucaaagcuaggccuuguccagcuucaaagcugaggcugccauggugcagcagcugccucuuggaggcacgugcagcugagauguugaaaguuguggaaacagcuccagaauucccucuaggagacaaauuauagagaacuggucuuuuccaaccacugauuggauuucuguaaacauugucuugcagauaaugcauuuguuuugcauugaaaguuugguugugugugugguauuugggaauugcuggaagacguauccccaguuaggaauacaacuugcaaaguucggucuagggcguguagucagagcucugugaucucccuugaaagggugugauugugaguguaguaggugccacuggaauuuauuuucuuuuucggagaagugaagggaccuuaugaacuggaguaacacccagaucucugcagcaguuaagcugggggccuagaacuagacuagagcuagaagaagggacaaaugcaauccgaccuuuggaucuacacauuccucuugcuucaaugggugucauuuaagaauuagaggaaaauauuaggagauggagaacuagaguugaggaaaccaaaagaagaggagucacagaaaaccagcucucucugugcaaggcaucuugaaaggggaauuccagagucaaagacagaagaaaaauagcaaacacuuaagaauggaaagcaucuuagauaucugaucauggaagucucagcccagucucagcccugccuaaaguguucauuuguuauuuuaaauuuugagcagguaugugcugauucuuagccagguuauuccuuuuccucaaauacuaggagaaggccucagguauagaaagagcccugaacauuaguagcugugaccaagccagcugggcauugggaggaauucugaagaaauagauuuccugagagaauucaagucuauguggcaagacccucaguuuguaaauaaaaaaccuuccugcuuauugcacugagcuacuaagaggcucaaauaguggccaugaaaguggucugugaacucuggauguguucaagagagcagaugcugauuuauauuuauaaaaucucaacuacuuuggaauguggaaauuaauaaaagaagacuugacaauggucugguuuagaaagagacuacuuaggaaaugauuuuguaaaaauaagaguuuuccaaaacaaaaauaaacagcguuauauaaaaacuuuuuuguuguuguuuaguuacguuacaguguuccuaagaauuuuaugcuugucaucucugacaguccgacacaggccauuagaccgccuuugaacuuuugauacagagacucucccuuaaccugaauagagggcauuuuccuaaauuaauugaacucuguaucauuuuuuaguccugaucaccuucuagccuagagugacacauguuaugaagauccuuucagcuguuucuucauaacucguuuuuuaguggcuugacugcucuuuuuucuucaguuggaaaaaaauaaaacuaaauuugaaaagaacaacaaccaaaagaaaaaaaaaccccuccuguccuaaugggcccucuguucuuuaccuauugacauauuuuauagggccauuuguguuugcuuauuacauuugaaaaacggcaaaauguuuacaguaguaggaaugagucucuaagguguaaauguuuucauccuuugaugaaaucagugcaucuaaucagaaggagacaggaaauuugaauaugucauuaccucuugugauggauauauguguuuguuuguuugucuuuuguuuuuugagacggagguuugcucuuguugcccaggcuggagugcaguggcgcgaucucagcucacggcaaccuccgccuccugaguagcugggauuacagacaugugccaccaugcccagcugauuuuguauuuuuaguagagacaggguuucuccauguuggucaggcuggucucgaacucccgaccucaggugauccaccugccucagccucccaaagugcugggauuacaggcgugagccaccgcaccuggccugugauggauguuaauaggagaggcgaacugcucccugguuacucccuccucaaaucaaugcucaacuuugccuuuucucccacuuucucuaggcaaaugagaaacaaauaagaaagaccuuggaaaacccagagaaaucgacuccuguauuuucagacuccuuuugcugugaagucccucuuucaucaacauaugccuauuucaauauacgaaacacagguauccucccaucccucaaaaaaagccaaagcuaguuugguggaauagaaugaaccucucaauuuggccucuucuuuugguuccagucccuacaugaagcccaguauaaaaacuacuuuucuugaggaacuuucuucuguuaauuagauuguagggaacacagugguaagaaauaugggacuaagcaugguggagcuauuauuguuaacugucuuaguaaaagcuacauggauuaucucauuuaacucacagcaacucuuauagcuacaguuauuaaccaucauuuugcauucuggagagaggcucagagaaacuaaguaauuuggcuaaagucacagagcugaaaaagcaagauccugggauugaucccugcaaaggugaauucguuucauaggcaagaaagcaguaguuccauaggcacaggugacuaccuccucccgccauuagccauuaucuccagcuguccacaccuguuagcuccuaaaugugggucaguauucacaggguggaaggauuggggauggucuggccaacccugucacaucacuauuggaacaacaagugaguuguguguccucuugacagugguucaugcauugcuucugccagcugucugaguuagcuucuggcuuuugcccaggagcauguaugaguacaggguggaaaagcagaugcuguuuuucugccuugcuucagagcagaucugggucuaaggcccuuucucacucucuaucccugucuucuucccagacauagccaggcugucuguuucccuucagucacgcggagaaacauuaacaggacacacccagcacuuuaagcuagauggggaagcuccacaguagaaugguccaggaacccauuuggaacaucuggaauucaaggacaacauuucucauggccuaauuacuauuucuuuucucuggaagugcuggacaaugagauuuuaaggguaaaacgagauuuuauuuuuuaagagaagaguuccucggacuagaagagcaaaagaaccaucuuguucuuggaugcggaauaaggaagcgaacccuggagggaguaucagcacacugugcuucaggccugccuuugccucuaauuuacuugucacuuugggcaaacccuuauuaucccucucagauucugcaucaguaaaaugagggcauugaaccagaugauccuugaggucccugccagugcaaaugacccugugagccagccccuccucacuuuguuccaaauucacagagaggaguucuaaggccuuccugugagggaaaagagaguagggagaaaguggaugagagcgaccauuguuggcugaaacucagagggaccagccaacaucuguguuggauauaagcggcuuugguugcuuuuuacacuuaaaaucccagucuuuuucucauucagggaguagacuuaauuaauagauuuugugcagaggagaaauggaauaaugaugacugagauccucugccuaguagagcguuaguauuaauucagaugaacauuauuaaagugauaucaugauucauuugcugucacauacagucuuucuuuaggauaaggcuacuauugauaagggcaugaaggcgauaauugcccaaaaucuagacuggccaaacaaacaagaaaacaaaccaaaaacaacucggagucuguaucugcucaccaggcucuuuuuucagcugcucuugcuaauauuuuaaauaugauggcugccauccaauggaaauaaucuacccccaaaggcccaaucaugccauguacaugccaugaggauagggaugguuuuuguuuuguuaccacugaaucuccagcacuuaaucuuugguugucacauauuaggcccucuguauuugcugaaugaguggauauauuuaacacuuaccuacaggaaugauuucaagagagaagaucaccugaaaguguaccaauuuguucuuguacauaagcuucccuuugacaucuuucuagaauauuaacuucuaaauaaggccagacucuuaaggcauaggaucacugggccaagagaaacaugacagcucuuuagcagaacaagcaagucauuguaaugcagggccugaccugggcacaugugccagaaaguccauccaucacuuggacuucuuucuugucuggccuccaguccucuuuuucuuccagcuucugcaucugggcucauucugagcuuguuucaggggccuaccuggauacuuauugccugcaacaaagacaucauuucucuuacugcaaaugauuugaaagaauuaaugcagaccuuuaugucgucuuucauauagaggaaacugucaccaugacucuuugaaccagaauacaacauagaucuuaauugaggucucuuucugccuuugcacguaaacuacaaagucauuagaguuauuagcagcaacuagauagaccaaucugcauuuguaaagcaaacuugguauuuuggaaguauugguuaagaagcagcucauaguucuuuuuguuucccuauuagggcuggacauuuacauggaaugguuuugugucuguguguuucaaaagauuuuuagucucuuaccccacugcaccugucagcuuucucugagcuacauuuggagcuauucuuauuacucguuuuuauucuaaauguaauucuuugguuugagggguggggccaguuaacacagauuuuaccaggcuuaucucuggguacaaaccagagaguuuaugguuucaauagguuuauguguaaugguaaucacuagagccuuuuaaagggaggacaaaaugggagaaucaaaguauauucauggaaccaaaaaccuuugauuagaaaguguuugaagaacuauguguguuauaagagugucauauauaauauaaucagguaugauaaaagcauuuugcuauuuuuuauugcauaaaagauauuuauugaccauaagcucuggcaaaaguuaguuuaauaauaagaauaauucacauuuauuguacccuguguaaagugcuuuuuauucauuaucucacuuaauuaucaaaacaacuuaauuagguagauagauuuuucaccaggucuuucuuuccauuuuauugaugaggaaauuuagagagauuaaguaauuugccuaauaucacacaaggcuuaaaugauggaaccaaaauucaaacuuaaguuuaugugacuuagagcccccauucuuaaccccacgguauggugcuaccuuaaauuaucccuccggagggauaauaacuuaucccucucccaccucuggagucacaagacuuugauuccaauuggaguucacuuacuucaaguccagggguaaguccuucucugcaccuguuuccuauaagguaugagugguguagguuaugggggacauggaaaacaguuggugccccucuucugcaagggggauggacuccuuagcacugcuuggcaucaggaagcccucuagcccuccuguuaagagcggcuuuguuucuggcauguccaaagcugcuccacacuguuauacuuacacaaacaacuugccagggagauucccaccacucucagcaucuuugcauugaauuagcaaaacuaccaauuagggauucuuccuaacgugaauuuaaaugccaccuucucauuucauacuccacacugcaugccccauucucuuaaauauaucuuaaguaagauucuuuugagguuugacuuacuauggcucuguaaaauucauacuuucagagucuccauggagauaacuuuuuucuuuaucucuccuuaaaaaaaaaaaaacgggauacaugugcagaacgugcagguuuguuacauagguauacaugugccguggugguuggcugcaccuauugacccauccucugaguucccucccaucacccccccaacccccaacaggcccugguguguguuguucuccucucuguguccauguguucucaauguucaacucucacuuauaagugagaacaugcggugucugguuuucuguuccuguguuagcuugcugagaacgauggcuucuagcuucauccaugucccugcaaaggacaugaucucauuccuuuuuauggcugcauaguauuccaugguguauauguaccacauauucuuuauccagucuaucauugguucuaugucuuugcuauuguaaauagugcugcaauaaacauacgugugcaugugucuuuauaguaggaugauuuauauuucuuuggguauauacccaguaaugggauugcugggucaauauuuuuuuuaagucuaaugccccaucuuaugaauaauaaaaccaacacccaagugguacccaccuaauuaguguuuuugcuacuaucuguuuuacugugggacacaaggauuuuaaaauuaacuaaggcuuuuuuuccauuacaaaauaaguaugcugguuguagaaaaauuuaccaaaaucacaaacaauaaggacaauaaaaauaagcuacaaugaaauuacucagagagaaccacuguaaacuuucaguauacccaucuagauuuuuuuuuuugacuauauuugccauuuauuaaaaugauuccacauauuguuuacgcuguuuuaugccuuacuuuucauugcacaauauauuacgacaucuuuccauguuuuaaauauccuuccauaauuuaauuuuuaauagcuauauauuauuacauuccuuggaaaaucuaguuaaaugaaucucauuuuuuuugcauuguuuugauuuuuuccgagaucuuugcauuaacaacaaaaaugaaaugacagauuuauugucgguuguuuuuuaguugaagccaaacuaaaaacugccucaggaugagagguugaguaaucuucccgaagucacucagcucacgaguaucagacuacagauugaaaucccagugucuuuacucuuagccuuauauucuugucaccacucauuccuucauuaguugugccauuuuacauggaaaacucugcuuucucucauuuccucccgcucuugaaugagcacauuuguuuucucaccgccaccuuugccuuccucccugucuugcugaggcuguugacauuuguagagguacacugugucuugggaccugaagcuacgcagcuggagaggaaacauggccaguucuuccccacuccuuacuggcucaaccuauaagcuuggaagcugguuuuaauuuuacauuuucuguguguauguguguuuguuuuuaaaacuuuuuuccacuuaauucuuucaaggagaccuuuauuugaaaucaugcacuuuuucccgcaaagcgaaucugugccucaaaucuugaugagauuacuuuguuuggggauauugauaaauucauagugggguuuuugguuuauccaauuaaauugguuuaaauuauggccuuauagagagaaagggccucagaaaacuuagaggguuuuaaggcaauugaauauaaucugcuucuagggacuucauccuggguuuauuccacaaagaagguauguucuguuuguuuccuuuucauuucacuuacuucauugcaugcucuaucucagaacccuuuuugcuaugagaaauugugggaaaaaacagccuugcuuggcuaggggcaggaagagaaaagggaccuguuauuccaaccccuucauuugaaugauugagaaaauguggaucaaaaagggaaaauaauuugccaaggucauacgguaaaauagguuuaaaaaaguaugaggcauaggacucauuuuuccuugcucuucugauaacuuuuguuaugagaaguuauagugcuuuucucguaauuuuguugaggaaggcagagagugagggggagagugaauuauguccccuacccaguaauuaaagucuuaacccucaguaccuuacaacaugacuguauuggaggcagggucuucagagagguaauuaaguuaaaugaggucauuaggaugggcccuaauccacucugacuggggaguuuuauaagaagaauagauuaggacacagacacgcacagagggaagaccaugugaggacacaaggauuaggggaguuugaucuauauaccaaggagagaggauucagaagaaaccaagccugcugacacccugaucucagacuucuagcauucauaacuuugggaagauaaguuucuguuguuaaaaccaucagccugugguacuuuguuauggcagcccuagcagagucauaaagggagaaagugaagaacaaagaaugaaaaaauuaaaaacuuaaaacuugagaaguucucagagagcagaaaagggagccccaaauaaaauuuauaagaaauuauggcaggccagagcccaugcuaacugauuuucaaccauaauuguguauauggcauuucauucaauucuauuaccaugccgagaucauaguuauuauuaacccacuuuacaaauggggaaauugaagcucagaaaguuaauuuaccucaaguuacaucauuauuaacuaacuggcagaacuaaguccaaauucaccucuugucagccuugaaaacccucacuuacuguacuguucuaucuccuuuuaagaagguuaauguaagcugcuuaggaaacauuacuuaucaaguuauuuaauguuaggagaaauaaaaaaauguacuccaaagucucagugaccuggaauccacuuaauugauuagacaggaaauauuuggccccugauuuuaggauaaaaagagagauuggggaaauuuaaaaagauagcauaauuagauuucaguacagucuuccccauggcugcacuuucacaugucuaaaugaacagcuacacauaaugaagaauuaauguucauagugaugugccgugggccgugaagacaucugauccaucagagagaaucaacaacugucacuagguugcauuugcuaaagcaggaaaccagauccauaaaucuauaacaugaggagacuuggaagcugucuaugucagaguuuuacaaagacauaauuucagugauuagauagauaaauaugcaaucaauccaaaagaauaaucaaaauaaccugagcugcugguaaacccagauguuauguuuuuuguuuuuauuuuugagguggagucucacucugucacccaggcuggaguguaguggcgugaucuaggcucacugcaagcuccgccucccagguucaugccauucuccugccucagccucccgaguagcugggacuacaggcgccugucaccaugccuggcuaauuuuuuuguauuuuuaguagagacgggguuucacaguguuagccaggaugggcucgaucuccugaccucgugaucugccugccucggccucccaaagugcugggauuacaggcgugagccgcugugccuggcccacccagauguuauaauaugggaacuaugaagcacuuucaauauugaaugcagauggcucugucgaagcugccuucucacuguuuuaaaguugugaagucuaucaauccugaaauauauagauuaaauuuacuuggauauuuaguaaugacacagucaagguaagagguggacaggcauuguuuucaacagauacugggaucgagucccagcuaacuguauauuagcugugcauauuuguugguucuaccuuuagaguagaauauuaagccaaccacuucucaccauuuuucaucacugucaucacccucacucaagccucugucaucuuacuccaagaacucuucuaacuuuucucugugguuucacuuugccuaccccuaaauucguucucuauucaugauaaccaggugguccucuaaaaauguaaaucaaaccaagucacuccccugcucaaauaucuccuauuacaccucaacuaaaacccagaccauggcucuugaggucccauguggaguggcccugccuacuucucuggucuccaguccugccacugacugucagugacucagcaucagccauccucccauuaugacacuuucauguccagcucaaagcuucuguacuuguuguuuuuuuuuuucucccuaggacucagauuauucacaucuguucaggagacagcuccuuagacaugcccucuuugaaaauguaaccaaaugucccagacucucuucccagccuccaccguccccuuauccuuuuucuaaauuucacuuaucacuguugaaauuacgcuauuuauuuaguaacuuacuuauucuuugcacuuucagccacugcagugccuuauuuuauuuuguucacuauuguaucaauaguacugugaacaggaggcauuuacaaauauuagaugaaggaaugaaugaauuaauuuagacuaauguuucuuucccuggguuaagugguuuggcgagaacaguugucaaggaaacaggguuaucaaaaggcuguuagucugucugcuccaugauccuagggacucugugucauaccccacuguaucaccaaaaccuagcucagucuaccccugaaugaauggaaugauaaaugaaagaugaagacuuggggcaacaggggaagagugauaacacauaggugaaaacuggcugugucugagaugacugacaaagaugauaacuuguuugcuauuuuuuggacaaaauuuaauacauguuacaacauacaucuugcuuugauagacauaaaacauguaacuguaaacuucagucugaaacauuucugagcagagacacaucacaaaagaguagacuauuccaaaagaagauuauucaccuguuguuagacucauagaauguuaaauagugaucauugggaagagaagugggcagcuuuauggcuuugcagguaagggaugaagucuuggagguucuaagcacagagaauguauucccauaauguuaacauggucuuugccgauaguaagcggucuugaauacauuccaggaggugccuaguaugaguaaagccuuagaucuuuauugaaggcgaagaaaccuuuuguucuaggauuaacuacccacuugucucugauuuuugaguucugauaauuuuuaaguggugucucguuuguauuuaguucaaguguuuguuucauucaaggucugccugaccucuugaaguccuuguucucagagcaucugcaguuuuaucuaucaauacaacuugaagaaguucagggccaaagaaucaaaaauagccucugcuuugauaaccaccucucuauccaaugaaagcagaguugcggguguauagguuuuuagacagacagauggaagccuguaaccaagaaaaucagucaucaccauugucugcuuugucaagaaggaaccagaaaaaaagagcgaacucuucccuuucuuuccuuacccauauucuuuuauagaagguguguuuggguuguuguagaaagguaguuaagauaugugguaugaaucaaaccaaccuaaaaagaaaugaaaagucaaguuacuuuucagggauaaaggagagggaagguaggcacuagguggaaggcuuugaccugagaagauuuagggagauucuagcuucuaaaggaacucacauuuauugagaaucugggcuucauccucacagcauuccuuugaaaaagauauuauuuuccucgcuuuacagucaggacuccaaagcccuucucuuucccaccauuccaucaggcuaacuggcacugauucaucacuugaauucuuggacugcuuuaacaaugaggacccucuuugcacuccuguaugauagaccuaaucuuugaggucuggacuacaaggcagagcaaacuggaagacaucuguggucuuugagacaauuccuuccuuccacacucuccauggggcccucuucauggccgccuggugugacuggagcaccacagcugaguguucuguuagacuugcacaccacggacaguuuuaggaaguuacauaagccagugguugugugcuuaugaccacaauccccaagaagcucccacaagcuuuaaaaauacaaugucagacuugaagaagaaucccuguggccuccacaaauagauggggagcuauugccugucauuugaaggugcuucucacacauuccaaggccugagcccgcauuccuccucugggaguugcauuuuggcgggcuuucagauuuggugaaaagguuucuuguuucugagaagcaauagggugggaauucacucgacgucuuugucauuguaaaggcccugucaaagccagcugucagucagaaaagaugaaaagagagagcugcuucuuaagagggagcuggguaccauuaacggcacagccucuuggaaaggcgaaggggaucacagaacuuugaccggaauccuuggcucccgacucccauucuagggaucuuuccacccuucuuuucugccuuucaguuggcacagccauuuucagcguggcauuaacucaagcccguccacuaacaccugaccuuucucuuaaaucccaggccaccauuucagugaccugcuacauugcuguaugguugaccaguaccucaaaauuauucuuagucuuacacuucaauuuuguuaguccuuuuucuguuuccugugucuauuaauggguccucuguagacaugcugcuuuaaaacucagucugguuuggcacgucugcaucugcgucacuuucccuuccucuucaguuacuuaguugauugacacuuucuucugcaguaugccauugcauuuucuaauccauauucuuccugucacacuggaccacagcaauuaccacauucuuuuacuuuuuuauaauuuucuuuauuaaguuccuuuuaaaaguuauaaaguacauuacgcauaugcaacuagagaaauaauguaaauaaauagaagagagagaagaaaaaguuuaaaaggaccccuacaaccucucucugcauccuuuccuucuacaacauccaauguuaauaauaugaugugcauccuucuggaacuuucuuccagaucagcucacacaaaaauauaauaaacauauuuacauacagcauuuuuuguuugcuuugacaagaacuacaucauauuuugcauauugcuccagaacuuacuuauuuuagauauuucuucaguucaugauauagauuuaaagguggccauaauaaucauaauccauauuuguggugauaucauaguuuauuaaaucacaucccauuguuggcuauucagggccugggcuggguauuuccugcuugcauccccagauauccucuccaccuuugucuacccugcuccauacuccguguauggugugccuuaguugguuucuuugcccuugggcuucugguugcauuuagcucuuagggcaccaauaggagauuagagggagagugaacaaugaagucgggguauuuuccccugauuccuuccuaucacuaggucauuguggggcagcugcaugucucugcugaagguuacggcuccugccaggcagcccucuccauacagcuacagucuccacuuccaauaaccacucccuccccuuucccucuucuggccuuggcaauggcucccugaugcugguaggcccuggaugcugcauauccauuuauuugcccuaaacacugcccacacuuuguuaaguaauuucuuuguuaaauucuccuuaauaacuucuuaauaauuuuaucuguuuccugcuggcacccagcaugcuaaaggucuuuucuuauuuuguuuuguuuuuuuucccccugccacuugcuguuucuaaguuuuuccuuccuuuaucuccagcaugggccucugucagcuugauuuuuugacccuaugauugacuauuuuacuuauuuuuugaagauccuucuagggcuacuacauaguaaaggucaaacuuccuaguuggcagccguuugcaucccuuauuccaguaucuuaagcuuuggaagaaggagggugccuaacuccacaaucucuuauagagaugcauuucuugcaucgauaccauugguucucccaaugauugguuguguaauauuggaccaugagcuaaccucccuaagcuuccaugucuucaucaaugcaauaggaaugacaguagcauauaauucauagcacuugaagauugauugaacaacauguacuuaaagcuucuaccuguuuucagcaaauaagaaguuuucaguaaaugguaauuaugaauuauuguaacacgcugugaucauaauugccguuggccauacccacguguacaaaucagcuauuuaccuuagauucacuuaggcaaggccucuguggauccuuuaaucucugccagacaaaagauuuuucugccugccucucuccucucucucucucuuccccccaccuuucuuaauuaauagacuuuguuuuuuagagaaguuuuaggcuuacagaaaaauugugcacaaaguacagagagcucccauagacucuuucucacucccuccucacccccaaguuuccucucuuauuaacaccuuacauuggugugguaugcuuguuacaauagaugaaccaauauugauacauugaagagaguccaguuuacauuagaacucacucauuguugaguaguucuacgggucuuaacaaaugaaaaaugucaugugucuaucauugcaguaucgucuaggacaguuucacugcucugagccacuucagugcuccgcuuacucaccaguucauccccucccuguuccccuaccccccgccccaacugguaaccacugaucauuuuacugucuuucuauaguuuuacucuucgucauuuuaggucacauuacuauuugcgauccuggcuuacuuuucuaacuguuuuaucuuuacuucucuauucaccuucuguauucaacuucauggcuaguaguuacacuagcauauguuucaggaaugaauuauuaaacucguuuacccuuagaauaaagacuuagguugaauuuaggcacuucuuccugauggaauaggcauuuggcuuuugcacaggcccaggggcucaagggacaagagauccuguuugauugaagcuggaugucacuucucuaguccgcauauguaagagagcuuccacccauggcacguguauuugaggccuaaaaaggaacaaugcaaagcaaaacaaacaaguaauaaaacacaaaacuaucauauaaauccagaccaaagagggacaugaauuagcucucuaaagcacugacuuggcuuuaaucuguacuggacuuuauacucugguccugagcuacagauuucucaagcagcuuguauaaaaugguaauagcugccuuguauuuguacuguaauuuggauuugauuuuaacaguacaucgauauuacaagagcaguagaauagaaguuguagcaaggugguaggagcaguaguaauauguguaauaccuaccacuuaggagucuuuuuuuuuuuuuugagacggaguuuugcucugucaccaggcuggagugcaguggugcaaucucagcucacugcaaccucugacucccugguucaagcgauucuccugccucagccuccugaguagcugggauuacagggaugccaccacgcccaguuaauuuuuguauuuuuaguagagacgggguuucaccauguuggccaggauggucucgaucuccugaccucgugauccgcccgccuuggccgcccagagugcugggauuacaggcgugagccacugcgccuggccaggagucuuuugugaguaccaacccugcaucaugucuuuaacucucacaguagcccugugagguaagcauuauuaucuauacuuuacagauauauaaauguaccuuuuuagaaagauuuaccuucacucagcugaagaagcugaggcacaaagaagcaucaaguuaguugccuaaaaaucacagaauaacuuaauggcagagaugcuaauguagcccuggcuucuggacucccucaguugcuaccuacaguucuggggguagcuucaaaaacugcuauuaggcugguuuucuucccaggcaggaaccuuucuauuuuuuccaaccaaaagcccaguuaaagauuugccauaugucuucacuuacccauaucugguuuccuguuuucugauaaggcaucuuuguuccuacaccugacccuaccccacccugccucuuuccccauccacccaagcuucggacccagagcaugguccccaguaaucucauccuucuacuguacugccugaugugggugguccccgucacucuacuuugaguccuacucuugcuucucacaggcccauguggacacauauggaccuauacuucaauagcagagaugguuccagcuguuucauaagaucauuuuaggggguuguggaagaaggcauuaaauaacauggaaucacauaaugacaaauuuugucccuuuucuaguucuuuuucaaaucuucugaguagaucaaggaaaaagucuccguuuacuacuaguuucucauuaacaucucccugauccgugauaaucuuccuuuuuaacaaaauaacagauccaagaucauccuuuagagcccucucgaaggcagcagaauguagacaaaauuuagugauguuuuuauuguauucauuccuagguucacuguuuaguuuuggcaaguaauacuaguuuagaauuuaugagacuaagauaguguuuucuuuuaaaauacauuuauauaaggauaauauuaagcaaauaacagcacaguuuauugcaggcugugucagauaucaugcagguagugcacaaaugacugagguuugagcuacacagacccagcugaccuuucucguugagaauggaaucucucuagggcuccucuuguccagugcugucccucuccuccacauucucuugcuucuggcguguuaucuauuuguacuuaucugugucuggaacgcuguugaagauuaacagaccauuaucgggagcuaggauuagggugcuccccacaguccauucccccauccacugugacccagggcaggccacaucacuugucaggcccuuugauaaugacaucuuuaaaaugguuaacaugaaguucuggggagggaagaaugcacauagcuggcuuugauucuccaguucagacaacagagcagccacucugcccugauuaaugcugcccugggcuacugcugccuccacauugcuguuuuuccuaccuugugucuguccgucuagggcuaaaccaaagauaauaaagaaagugaagacagugcuuuccauguguuauguauucugcuucguggguugcauuuugaagggagugccccagguugaccuacuuccagcacaccucaguggucauuaaguauguuuaggugaugaggaaagggaggaguguuugagacucucaucuguagcaguucagagguuuggaauagccaacccugguaaacuaugcccaauuucaaugaagacucggagccaagaaacugcauugcuccucaagaugucuaucuucucccaggccuuucuguuugucucaauggcaugcuugucaucgaggguccuagaaacacacccauguacuggagggagcgugggugggaggcagcuuuaagaccuuacugcccucucuacaguccugcuggaagaguguagauuguuaucuccucacaagggcuuauuuccagaggaaaaaugaccuggaggggccaugggaacuugcccugugggguuggguuuaaaaggggaagucuuggcugaccuuggcugcugguggcaggagcugagaacaguugcugaggcuuagcuggggacuggcgucucuggaauucccuuuauggcaaggucuguuauauuuugauuaacaaaguguuaguucaguccuucuugaguauuugugagagaggaguuuuacaauggcugguuauaauuguaagaaauaauaaugaugaugguagcucacacauauugagcauuuauagugugccaagcagaguucaacccuuuauauauaguaugccccacaauccuuguuugcacccucagaaaaagguaucauuguccccauuguucacugaugagguaacugaagcccacccagagaggugaagucauuuauccaaacacggguaguguuggugcuagaagucaagcucaugucugcaugucucacccaaggcaacauauuuaauaacagagccaggaugagaacuugagucuccugagagcauauuuaguaccuuuuccuaaauaccaccuugagucaacuggacuaucuuagaaugucugguuuuuccucucuucuugaacugaugcugcuuuggggaagaaaaacaagauuucauccaugcagucuauccauccugauguuuucuuaagagugaaaguguuuuaggaaaucaaaucuaauugcccaaaugggaauuuauuuuaaauaaccaccugcaccuucaucuggauuuuaaaaggaucuugaauccccacugagaaggucacagucugugcuuuguuaaugcagguaacaaaauauuugauuuugggagucucauccuucauuuuauauccucuuuauaggauuauaguuuuuacucugagcugcuggaaugucugcggaguguggaacagaugugucuuaagcgcuguucucagucugacuuuauugacugggaagaaguccauggagggcuuugguuucucugagaggcauguucucauuaccucagauagacaaaggugguaauuuauguucucuaaguugaagacuaggggaggaaaacuaaaauggagaccaacaucucuaguaggcuuuuagcucaagauucugucuuuucauucccuauuuuacuuugcaucugucauucuuaacauuccuuauagcauuuauuacaucuuccaguucucucuccccgcccuuuccucucuuucuccuuuucucccuccuuuccuuccuuucuuuuuucuuuuuccuuuuuuuucuuuuuuuuuuuuuuugagaccgagucucacucuguugccuaggccggagugcaauggugcgaucuuggcucacugcaaucucugccucccagguucaagugauucuccugccucaaccucccaaguagcugggauuacagacgccugccaugaugccuggcuauuuuuuuucuuuuucuuuuuguauuuuuaguagauacaggguuucaccauguuggccaggcugcucucgaacuccugaccucaggugacccacccgccucggccucccaaaaugcugggauuacaggcgugagccgccacaccuggcccccauccuucuuuuuucuucccuccuuuccucccucccuuccucccuaccuuuuucccucccucucuuuugcuuucucucucucuuuuuacuuccuuccuuuauucauuucuuuguuccucucucuuucauucuccuucucccgcacugaguuuuuuaugguuaguuuuccuaaucaguaucauacccuagugaaggaaaagauguuagacuuauaucacacuuuaaaguccugugccaagcuggauugcaaaguagaucccuuuauaaacuacauuaacacauucaggccauuaaggggcagguguauugcacugauuuuaucaguaguggcuugaaaguuacugaauuccuaaagcuaccuaccugagagaacuggacgcaguuuggacacuggaacgaauucaguaucaaauagagaagagagcccugucagaaagagcugcuugucauaagguuuaaagacacuugguacgguguccuaggagaaaucagugaugugccaggagaugggagacauggguuuacuucaaauuggaacuaaucuacucugucauuuggagaaggucacucaccucucuguauauaucuccccauuuggaaaauagaaauagucucucaccaacauacuuaaggcuuaaaaacauucaaaguauuauaaauaauauuaauggaauaaauguaauauuuauuagcuauuuacuugugugcuagauuauacacgcacacacacacgcacacuggcagccacccugugaugugagcuaaguauuacuauccacucugggcugaugaaaaaaaacgaugcucugagagguuaagucccaacucaagaucacacacguaguuaaguggugugucugauucucccagcaguggcaaaaccuagcuggacccaaacuugccagcugguaugccuagaacccugcugggcugcaagacagugacacacguagcucuugguagcugugcagggccuaaggcaggucaguggcggguugcuucaggcucugaauacguucauuuuggguuccagaaacccuucagauuaccacagcaugcccuagugguaucaucauucuuuauauauauacauaauuacauuagaaagauugcuaacuuuguagacaagaccauuuaaccuccucagacaucagcucauggacgcuuggcagucuuggcugccaggaacagaaggugaagaggcccacugagccauauucaucacugagggaacuuuuauuuuauuuuauuuuaaguucugggauacauguacgggaugcacagguuuguuacauagguaaacaugugccauggugguuugcugcaucuaucaacccaucaccuagguauuaagcccagcaugcauuagcuauuuauccugaugcucucccuccuccccgcaccccacccaccgugacgggccccaguguguguuguuuuccucccuguguccauguguucucauuguauguaguguuugauuuucuauuccuguguuaguuugcuaaggauaauggcuuccagcuccauccaugucccugccaaggagagagcaacuuuuaaucagagauguuggguuuguucauuuuguuggcuuuugaucuuagcauguguuaaucuaucaggcucauccaugaauucauagacaaacacuuuuuuguguccagugggguuugauuuuaugugaccuggggguggucagugguuaugucauaccccacgcucacauuccccagugccaagccuaagaauugccuuucagauuccucuuuguugaugacugauuugccuaggccgccauuuauaguggaucccccuuccauggaaagaguuaaaauuggggaggauagcagggcaagcugaagacccauagaggaagcauuuauuugagcucuuuaaguucagguuuugauauuuuugcucugcauggugaaaacaaauuaauaauguuaauauuuguagcccauggagaaaacucuucuuaaucucuucucugaaaccuacaccaggccuaugauucaucuuugggcucuguuuagauuccugauuauugagccagaaagauuuuauuuaauuacuauuugaaaaguuuccaaugacaccaucucaaugguguuaauuccacuuggaucagugcuuacuaucccccugauguucacaggucuggauauagcauuugccccuuugcugacauuucaugcuuguugaagggagugaugaucacaccaguggcucagggcugcguguccuuaggcuggucauauuucauaacuggucucaguucagacagaaacuggccccuuuccaaaacccaguuuaguucaguucuuugcugggaagaugaagaaaaucaggaaagcauugaguuaugagagggaggguacucuuacaguuaccaagauuguuauuauuaugaaguuccuguugaagauguucugucaccuuccuggacacacauagaacuguggggugggguugggggcaggcaggagggcagugguuccuugugcuggucugugacuugguacugggcugccugauggcugcauaaggagcuuauaaaaugcagauuuggugauguagagcacagccugggaauauguauuuuucuaauguguacacacuaguuuggaagcacagaccuaggacugccucauauaauuuugcaguacuguuaaaauaguauaucacaaagccaucauuuauuuucucaaaacucuaauuuuuggccgcuucccacaauauucugacccagacaccuuuacaucauguggauauaauacaaccuccugugucccacccuucaccuauucauucaaccaauauggaauagcugucuaggaugagcuccaggaacuaagguagaaauaucaaaagauacauuguuccaggacuaaaggagucuuugguuuagucaggagauagcuugaguaauaaauaaaucagcuacaguagaacauuguuauuuuuccaacuaacuugcagugggagcaggugaaauuugcuggaaggucaggucacacaucguggaggaaaagcccuuuggagccuugacaaaggagaugacugcuagaugccaggugauuauaugagaaggcagagagaacauuuuuguaaaugccuaguggacagagagccugauaaugugacaagaacugcauguucugucauuuuaaaauauaggccacacaugauagaaaugaggguggacauauuaacagaccagaucaugaggggcuuguauaucaugugugguggaccuuuguauuugaccucauaggcauaucuuccuugccacauauguaguuuguuuuggaacacuucauugaucuguaucuuuaaaaaaauaauuuccccugacaauaugauaugaugaaauuucuucuuaugcaauaccuuagaagagcagaggaagcuaggugguaauuuucuguaucccagauggggccuaccuucaaaucucauucucuggcccuuucauuucugaagccagaagucagcugguuuuggggcuccguccuccauaaacuuuauauccucuuugaaagcugacguucucaaacaggggcuacagaaucagcaucaagggaaugaugaccaugguuggcccugcauaugaugucucccugcccuugaccccuuaaucagugacucuuaauccucauagucaaauagccauggagaacauuggcccugagcagugcauucuagagcugacuucucaacacaggucuucaccccucugcuugcaauccugacauaugucucaguguauuuucauucaaacucaaacucuuaccaaacccagcaugaguagccugccuaccuccccaaccugauuuaaugccacuuucuuccuugaacccuaagcuccuuccacauugagcuuuuucagguuuucagagaaacaaaacuuaguccuaccuccaggcuugugcacaugcuauuccuucuaccuagagaaguucuucaccuccaccuccaucuaaauugcucuucccugaaaagacauuuuccagccucuaaacaagcccacuccccuguauuuugugacacguaauauaauuuuagauugcuugauuuguuuuguuuacuuuauuucucuauugccagacuuucccuuuaagcuccauaaaaucaaugaccugggaaugaauggauggaugaauggauggauggauggauggauggauggauggauggauggaugguuggaguugaaauaucuuugugaagcugaauucuucacaaaguccacccucucauucuuuauucaugcuguagcuacacucagccagacuccugggaauuguuuucuccuccaugaacccaacaaagcuuaauccaucccucauacuccagccuaagcuccauucauuuaaugaaacuugugaucugucagguugacacugauuugucccucuccugacuuauauauaaaguauauauuuacuuuguuaauaacuucauuaacuuuguuaauaacuugcauuguuuccugucggguaacucaaauuucaucuaaguuauaguuuuuaaaaaggcuuuauuuuucucauaauuaaagcaauaaagaaaugcacucagaaaaugugaggaauauugaguauaaugagauaaauauaaauccugcauaauuucuccacuguaaguuaaauacuauagauacuuugccuuuuccccuucuagcgguuuuauuacacauuuuacaacauuguguguacuugugcauacauuuguaaguauccugaauuuuagacauaaccaugaucugagcaugcccucguguaauugcaaauacuucuaaaagcuucuuuccuuguacgccuaaccauaaguucuauuuuugagaaucaccauugagugucaacagaguacuagagagugcacuagccacugaggcauauguuaucccacuuuaaauauuuagugccuacugaaucagaaaauauaauauaaaggaugucucccuuacuugaguagauauguuuccagguggcuauaauauuaauacauugcagaagcaagaggugaaacccuagaauaauuugaauuaagggcaaacaagaaagaccggauccccaacaaauacaccuacuuuaaauguugagugcauugagcacacauaugucuuugguaaauguguuucuacuagacaucuagaacaaugaauugggaaaaccuuggcagaucacucuucucugaaaucauaccugugauaacaacucauguuuuccuucuuuucuagagugaccgucuccuuaucaagggaggcagaaucgucaaugaugaucaguccuuuuaugcugauauuuacauggaagauggcuuaauaaaguauguauauggaauucuucucuuuauuguuuugcacuuccuccuucauuaauggcucauaaaggagguuggauuacaugaauguagugaaaaaaaucuuaauuuaaucaacagaaugaagugagauacugagggcaaauuugggcagaaaguauugaugagcauucuacgggucauggaaaaguggaagauguggccaucauccuuaaggauacuggaaaaugugcacaaauuacagcacccuaaaaauauaaggcuuugugcaauagguaucaaaggaguugaagucgggauaagugauuuagaaguacaaagaagaagaaauuuauuuagaaguaaugcuuugggguagagagaguauuuaaucugaaccuugacuuaaggauaggacuuagaugggcagagcacagauaggacauagauuucaugcaagauuugcaaauaaauucauuagggauguauaauuacauucuaaaauguauacuauuggaugccuguaaguggcacagccagguaaguuuuauguguagguuuccuacauagugaacuuuaaaagaagauuugauuuacauaguguuucaucacaaaaaacaaaguacacuacccugcaaagauguuguaaaagacuggguguauccaacccauucuauuagcccugucuggccucuuuuaguuuuauuuuuauaugacuuaacuucauugacuaguuaaagauuuugguuacaagagaucucuugcuucucuuugaaaaauuggcuuacauauaguuuucugcaggcaaacuuuuuuuaccagcccccaagucuaggcuagcuuucccuucugugugcuuucaaaacagcuugcggucggccgggcauggcggcuguaauuaagugccuguaaucccagcacuuugggaggccgaggcggacagaucacuugagcucaggaguaugagaucagccugggcaacauggugaaacccugucuuuacuaauacaaaaauuacccgggugugcugguguaugccugcagucccagcuacucagggaccugaggcaagggaaucacuugaacccaggagguagagguugcagugagccaagauggcgccacugcacuccagcacuccacccugggugacagagcuaggcucugucucaaaaacaaacaaacaaacaaacaaacaaacaaaaccagcuugugcuuucaucaaucauagcaauucugacacuguuagucuccuuugagaguaaggagacuuacuuacucucauaucuuacauaucuuguuuauuccacaucccaauucuuaacccaggacuuagcacaaaaaauuuugauaagagcuacuuuuuauugaguguguaguaugugccaggcacaauguuaaauguuuugcaugcuuucucucaaucagccagcagcccucugaaguaaguacuguacuauuauuauucuguuuccugagaugaggagaaagcagcacauagaguguaaauaacuugcuaaaaguuaauguauuagucaaauaacauugaaugaaugagugagugaaugaaugaaugaaugaacaaauccaagaaccaaaaauauuuguucauaguuaccuugccaauuuacauuauuacuuucuuauauuggaaguaagaaaaauggaaacaaugggaaaaccaaaauauaugacaauaauuucuucaaaauauaagccacaauugauuuuauguuuuucuauuaacuaaaaaauuauuauauauaguuggcucuauucagagguagcaagcucucucauuuggagagaaugggaaaaauuuguuaccaaaugcuuccucauuucagagcucaucauaggcagcacuaauuguucacagaacuuuuuuauuauuauuauuauuauacuuuaaguucugggauacaugugcagaacgugcagguuuguuacauagguauacaugugccauggugguuugcugcacccaucagccugucaucuacauuagguauuucuccuaaugcuaucccuccccuuucccccacccccaacaggcccugguguuugauguucgccuccccgugcccauauguucucauuguucaagucccacuuauaagugugaacaugcgguguuugguuuccuguuccuguguuaguuuacuaagaaugaugguuuccagcuucauccaugucccugcaaaggacaugaacucauucuuuuuuuuuauggcugcauaguauuucaugauguauaugugccacauuuuccuuauccagucugucaucaaugggcauuuggguugguucuaagucuuugcuguugugaauaguggugcaauaaacauacgugugcaugugucuuuauaguagaaugauuuauauuccucuggguauauacccaguaaugggauugcugggccaaaugcuauuucugguucuagaucccugaggaauugccacacugucuuccacaaugguugaacuaguuuacacucccaccaacaguguaaaagcauuccuauuucuccaaauccuuuccagcaucuguuguuuccugacuucuuaaugaucgccauucuaacuggcgugagaugguaucucauuaugguuuugauuugcauuucucuagugaccaguaaugaugagcuuuuuuucauauguuuuuuggccacaugaaugucuucuuuuaagaagugucuguucauauccuuugcccauuuuuuugaugggguuguuuguuuuuuucuuguaaaguuguuuaaguuccuuguagauucuggguauuaccccuuugucagauggauagauugcaaaaauuuucucccaugccuguucacucugaugauaguuucuuuugcugugcagaagcucuuuaguuuaauuagauccuguuugucuauuuuggcuuuuguugccauugcuuuugguguuuuagucaugaagucuuugcccaugccuaugcccugagugguauugccuagguuuucuucuaggguuuuuaugguuuuacgucuuacauuuaagucuuuaauccaucuugaguuaauuuuguacaagguguaaggaagggguccaguuccuguuuucugcauauggcuagccaguuuucccaacaccguuuauucaauaggaaauccuuuucccguugcuuacuuuugucggguuugucaaggaucaaauaguuguagaugugugguguuauuucuguggccucugcucuguuccauuggucuauguaucuguuuugcuaccaguaccaugcuguuuugguuacugugaaauuauaguguaguuugaagucagguaguaugaugccuccagcuuuguucuuuuuacuuaggauugucuuggauauacaagcuguuuuucaguuccauaugaaauuuaaaguaguuuuuucuaauucugugaagaaaaucaaugguagcuugaugggaauagcauugaaucuauaaauuacuuggggcaauauggccauuuucauuauauugauucuuccuaucugugagcauggauuuuuuucccauuuguuugugucuuauuuccuugagcaguggauuauaguucuccuugaagagguccuucacaucccuuguaaguuguauuccuagguauuuuauucucuuuguaguaauugugaaugggaguuugcucaugauuuggcucucuauuuguccauuacugguguauaggaaugcuugugauuuuugcacauugauuuuuauccugagacuuugcugaaguugcuuaucagcuuaaggaguuuuugggcugagaugaugggguuuucuaaauauacaauuaugucaucugcaaacagagacuauuugacuuccucucuuccuauuugaauacgcuuuauuucuuucucuugucugauuucccuggccagaacuuccaauacgauguugaauaggaguggcgcuacggccauaccacccugaacaugccugaucuugucugaucacagaacuuuuuacaauugagccuuaaauacagguuuagaauccaucuucacauggugcuucagggaucuacaaccaggguugaagguguaagaugauuccuuuucgccauuucuauuagaaagacugaaaggccacuugccaaggauguuguaggaggaauuuaaccaucagauguguguguuggugguggagagaagguugaguuaaaugaucauaauucaauccugaaauuuuguaugucuccaacaacauucuuaacucacagagcauaagaacagaaauaaccuccucuaacuaucacauaguuguuugucugucugugaauauuuguggaauacuuguuaugugccaggcaauuuuuugagauauuggacucaugcuaugucacacgguaugguacucauuaucaaggcccaaaucaucaugcugucuucccccgggaccuuuuagucuuuuaggggaacugagauaucuguauauaugcaaaggaccuagcauuaccaaggaguggcauaucaaguauuauauucauagaacaggugagauucagagaagggaguggacugauuauuaauuauaguagcugacauuuauugaauucuuaguuaccuaacaguguuuuaugggcuuaacauauauucacauuuaaucugcagcacaacccuauggaggaggcaucuuuauuacauuuuacagaggaaagaauugaagcaugguaagguaauuuggccaagguuauacagcuaguagcuagcagagccaggauugugaauccagauagcccacauccagucucacucauuauuagacuuggauuuugcuagaaacuugaugaaggagggaagauggaagcugagccuugagggauuaaugcggccuucguugguggagcagugacgaagggggaagccauuucuauuucaggcuugguauuaaacuaguugucaaaauggaugaaaacacacacacaagccaggcaacucuucaugcccuugguucucaauuuuccuuaaaggagaaccugugagagagaaaaaugagaacagaauuggccaguaucugaacuagaauggacuuaggaucagaggcugcauuuuaccaguauauuuugaauuaugguggcucuggaauggcccaguggugaugugguaaaguugaacucuuagagaugucaggaauacuuuauuuuagucgcagaacuuggaguuugagaggccagugguagacuucuuacugccccaagagagugucuuucuuggcuguccguggauaaaaggggaaaauauucaugcaauggacagugagguacagauaucccaagguaggagauuuuuaauggucauauagaggcuuaugaaucauaggucucccuguuauccauaguggacauguuuaaccagcuauuuuaaucaaaaaugugauaccacguauaagccaagcaauacuggcugaucuauaagcagcauuguguggggacuaguuguauuugucacuuuccuuggaggcuugccuuugagauacucauuggcuuccuucugccugagucuccccccuauuccucccuaagaugcucugaagcuuccugggcgaagccgugucuaguggcgguucucauaaucacucagcucggcuaaaagcuucuacugggacacugaccaugucauaaaggcagcuggugcuggaggcaucugcaucuuugacuuccuccuggugaaucugccaucagcugugauuggcugauaaauggucaggaaaggguggaauugggagugaagacuuaggugggaaauaacccagacagaaucuuuuguuaggagcaaagaugaccccacuuaaaagauagcugaguucccauaccuguucuuuaaaugauuuacuauuaucuucuucagucucuucuaacagugcacuauuuuauacucuuuagauucuucuccaaauguuauuucucaccuuaacuuaaagaacaaaaugaaaggaauaauaaaaauauuuauaugaaaaaaguauuacacacacuauauucuagacacuaucagaccccugggguuauaguacuaaaccaggacacguggucccaccgaauggcauaucagaucauucugugacuauaaacauuguuuucuguguauaucuaucuuuguuuauagauugcuaagcuugugagucacuugcaaaguuuaauuugauaaauacaaguaacacuguuuaaaauccuuauaccacuauauuugucuuggaaauugcacuuuuaaaugaccaaguguuugaucauuuuuuuguuuguuuguuucaccagacaaauuggagacaaucugauuguuccuggaggagugaagaccauugaagccaaugggaagauggugaucccuggaggcaucgauguccauacucacuuccagaugccauauaagggaaugaccacaguagaugacuucuuccaagggacaaaggcggccuuagcagguggcaccaccaugaucaguaagucuucauauuuuacacacuccuguuucucagaaguguguguuuaaugaauguguuaucuccagaacucucuuacuauaacuuguauacuugucccaguucaguuuauagauguguugccugaugggaccugagaaaagcagauugagcugaggaaaugggcagcucccuguaacuaaagaggagauucaugaggcucuuggucauggcagcaccugcccucuugucuaccuuagcagcaggcgcuggcuccugcaaugaguggagaauaggaaauagcaucucugggcuaguaagaggugaaaguagacuuaaaaaguuauggauagaagaugaaacauuauuucaaaacugcccacuugggucugagaaaggagggcagagcagcgugaauggagcuaaggaguaucacggagagagggauuauggagaauuacauuucucggaaauuuuguaaacuucaguggguaaagcugugucugguggagguuuucaaaaucgcugagcuugguuuaaagcuucuacugggacgcuggucaugucauaaaagcaacuggcgcuggaggcaucugcaucuuugacuuccacuugcauuuagugcuuauggucugcgcuguauuuugaccaauucauaucuuuaacauuuggcaagcuguaggagugguuucucuuguuuuuaaauuuuguuuuguuuuguuuuuucuauugcaauuccaaaaaaaaucuagggaguugcaugccauuggauuacugaaccaauagcauuccagggcaguccuuccugucccaaaggaauccugaugaauugggccccaucccagugcuggccccaaacuuggucaggcagagagcacuguuuauuuuaacaccauauacauccccugagaacacaggacagccugagcuguagaauuauucacugucuuuuacuuccuuuugacaggagcauaagcaggguucagcuucagcuaguuggguguggaagcccagaaaaauugcaccaaagccauaaaaggugcaauucagggugcaauucuccagcugaaggguggaagccugcugacuucucagcagcugccugcugaugaaaguccugguguugccccagacauuaguaauguagcuccacgcauuugcuuuccgauaagugcacucaggcugcuuuugauagaagacuacgggaaugagugaucuuggcuuggcuuucugccaucugggcaaggaguuggaccuguuuggcauccuugagauuuguauuaugcuuggccaucugcauuagggaagucagauuccccgugacgagaguaaaacuuacaaagaaccacaaaagcaauuguguccuucauagauaaauuaggaaaccuagagaugcaaaaagaaaauaaaccuccuaaucccacaucgcuguuagaguuuggcuguauauuguacacauuuuuaaaauccuauuuggccaaacuaggaucacaguauauguauuauauuuuaaccuuccauuuuugcuaaauaauaugucauggguaucuuugcauucauuuuuguucuaccccaacauuuaaaguggauuccuagucauccauuuuauaaagcauuuauguauuuaaccuaacuucucuauuguuaacaauuucaauuguuuccaauuuuucacuuagauaaauaaguagcaaacauccuuggaaccaaaauuuuguauacagccucauuuauuucccuaggaauaauucguaggugugggaauaaauguuggguuaagguuugaaaaauguccggguuuuuuauguauauuucagagcugcucucuggaaaguuguccuuagcuguacuuuguccuuacuuguacuuugccucagcuguucaggggaacuaugaaaguguaacuuuugccuuuucuucaucaacuguagaugccauuguuuaaaaaaaauguauccaugguugugggugaaagaguagauuugggccucaaagaaaccagauucuugacaagaaguuuccauggaaauaagaucugcgggcccaguaucagguuuauguaacugacaccagcuuuguccuauagcagagagccucaaugucuuaugcccuaacuuagcuuuaaaccucgcuuucgcccuuggaagagagucugaccuuuuucacuagcagugaccuccccacaguacuaguaauaaugacacauaguaggcacucauugauggcuaacauuuauugagcacuuaccaugagccaggcauuagaugaaguacuuuacaugcauuuucccauuuaaucuuauaaauucagaagaaaggcacuaguaacacccugacucccaccccacuuggcaccaacuuaaaggaaagaaaacugagauuuagggaagcuaguaauuugccccaaaucacauagcuuugugacauuuaagugaucagcauucuugaaacuaucagggaaccccuucaaaaguuaauuccaugcucaggaaauagagauucugcagucacagcuaagcaagcaggagcaggccugggcagaggggagcaaaggcugugucugagagugacucaucuggggucucugucauucaguugaccauguggugccugagccugaguccagccugacugaggccuaugagaaauggagagagugggcugaugggaagaguugcugugacuaugcccugcauguggacaucacccacuggaaugacagcgucaagcaggaagugcagaaccucaucaaggacaaaggugagcccggacaugccguccucccuccucucuuagcuucuucuugccaguccuuccaacaccauccacucauuucagucacugucuuuuacuuggagccuggaaccuugagugugagcacuggauguagggauaacacaauguuccaggcacuuuauuuacuucuuacaggauccccaugagauagugauuguuuuccccacuuugcagauggagaaacugaggcucagaauaagcagcccaagaucauagcauuaguaagcaguagguguauccaaauucuaugcucuucaccuccaugcaauauugcccauucugaagaggaagaaacugagguuaggagaggcuaacuaaucuuacauaagguuguauggcuaguaugaccuaugagauuagggauuuuuaaccuguaucauuuuugcuguagagaucaaacccuuacuaucauauaacaauggcauccuuagacaaggcuaaggcauuucuaggagcaaggauguauugguacucaggcugggagcuuagggugugaaaacauguucauguauauguauauauguuucuguguguuugccagcguguguccucucagugaguacaugauuuagguuccacugucuucuuagauuccuccauucucugcuucuuuuugaucaacagauauugcaaaccccucccccccacauacaggcacacauaugcacaaugugcucagcauuguaaggcggccugggggucuuagagaaguguaaguaauggccuuugcugaacacccaaggcaaaagaaaacaggcucaugaagaacaacagaauaaaugucauagugugcaagaaccauuaccaaaggaguagucuagacacaaaugcuaggaguccacuggaagagugugcccugggauggcagggaaaggaugacccccucagaggaugauauuuucuuuccauccccuccuuaccccacaagcccugcaaaaucuuuggugacacagaaugugagauuaacuccuucuuucuguauuugcguuuauacugggcaucucaaccggcguagaaaaucgaacggcuuuaacacucacuucuuuaucaaagagccuggaucauuccauggauaauguagaggcuuuugggaaggguaguguuugggaagacugcccugaguugaaccacucuggguagggaaguucucaaauuacaacccaguuuuggcccagaauacugugggcugagaaggcucuaaugguuagagaccaaaauuaucccccuuuccucaaaaugauucucaguuccccagucccaccuauuucuguaaaucacuguauuaguaguuuauuuggggagagaucuaaauagaucuuuacauauaaaccuuacaacuuaagauauuuaagcacaagguaaaaccugcccauuaguucccuaaggguaggaucuguaucuuaguucuccuuucugauccaacacccugcacaguaaaaugaacugaucccaggagauccauuaauuggaaaccaaauaugugccaagccuggugcuaagagcucuguauguauucucuccuuuaauauucacaaccacuuuaugaaguaggguauuguuauuuuuccauuuaacaggugaggaaaccgaggucuggagagguuaaguaucccaagcucacugaacuaguaugugguggauuucaguggugcagcccccaggguaugaacacaacuggugugcuagagugauucuuaaugccaccuacuacugccuugagcaauaacaaaguuuauugaccuucugggcuaggggaugcuggacaggggaguuuagaaagaggcacagaagaagagaccauucugcuaugacaucuguuaggaauuguugauuuuauggggcaagggugggcagagcaaaaugcucuugaagaauauaaauaucugcuuuauguuggacaggagcccggguaaugcagcugggugcuauggucgauggaagugggagcaaaggauggaggacagucaugauaauguugucuuucucuuguuuuuccuccugucccucuuuugcagggguuaacuccuucaugguuuauauggcuuauaaggauuuguaucaaguaucuaacacagagguaacaacccauuugcuaugugguuugggguaucuggauggguuuccuauuguuguugaugaccuuggcccuuguaacaugaaucacuguggucacugugggagaccacugggccagaaugcuucuugaagccuuugcaguccacgcuacauuuuaaauaagguaacaggcagggugcccauggcaagacagacagggagcuagaguuuccacuggcagcagcuuucuuaaacggcaagaggaggaacaugccuaaauuuccaucuaccaaacaagcuccaaaccccucauaagcccagugaaagugugaggcucuucgccugcaggaccaggagggccuucugcugauuggaauaauccuacugccuugccucugacucucccccuaagaaauucaugacaugcguuugcuuuagacagaggcuauguuuucagaggaaauacaagaaaugaauucccaugccuccugcuuagaggugaagguaugucugccuucacagguuaagagauaaggguuucaguuuuuguguuuguuucuggccuggcuguagugguuuucuagagcauuuguugagaagaauucugagacugucucucagcucaaugggaaaauaauuccauuaaaaaugugugcuagaggcagaggagaggaguuggugguacuuuauuauauauuugcucugccagccuagggaacaugguagguucuuuauauagucagaguuuccugggauuucuuuggacuagcacuccucuuuggucaugccuauguaauauauauuucugcccuagugacuuauuuccucugcuuuaucccaucuguuuuagcuugggcucugguaauuggcccuucuguggggcugcuaaaagugcuugcaagagugacaaagacucauuucuauuucagcucuaugagaucuucaccugccugggagagcugggggccauugcucaaguucaugcugagaauggggauaucauugcccagguaacaccgugcagcucccuggagcgugcuuugggucugcauuccauuuucuucuucauuucuucagugcugcuugagcucucaauaugugcaaggcaccaucauaaguaccuugcuaaagacagaaccugcuccaagguaccucacaauuuagguggaagaaacagaggggaauguagacaagcaaugaaacuagaagaugagguaaaacagaaagagggcuggccauuguuggagaaucagaaaaggcauccuggaagaggaggauuucaaauuggaacauuuaaugggagagcauuugcugauucucuucugaaaaugugucaaagcuacaagacauucucugucauaaagaaagaccguaaggcagcauuucucagaagccagagauuggauccaagucuguggaacucauagccuuagauaauagagaauuuaggucucaugaggagcaaaggucucacuggauuccuagaaaucauauugagaaacuugaggaaagagugacgaaagugagggccccaaggcccaaauugaucauuuguaaggaagaaggaagcaguuaucucuccaucuccugggcugcuuaauggaauagauggacagaugugucuuaggaaggguuuuguuucucagaaacaucucaagauuggccuuugcuaggaggagacagcccgaaaaaaaaagagugagcuuucuucauccauuugauaauguuggcaacaagaaaccguuauucauuccuucaaagaguauuuccugagcacuuugugccaggcaguagcuauugaagugagccaaaacagaugcauuccauagcucacuaauacuugggcugugcuuuuauuuuagaaguugaccagaacuuggugaauguggucagcagggguguaggaacaaugucuaggccuccccucaucucggaccauuaguuuccugauagcaggugccguuuggugagcacugacuacugugugccaggaacuaguaaauuuucugguguauucucauuuaauuuucacccaacccuuuaaagaugcuaucauccucccuauuuuauacaugagaccauccaggcucagaaagauuacgucacuggcccaaggaucacagcaaauaacuaggaaaacgaaaucuuugccccuaaggugauauaccucaguggguaucuuuacucagagauggcauaucugggaucccuugccucccaagcccagcugcaggcuugugggcaggcaguaccccagccaugcagggcuccagcuguugugauuucagacucuccauguugucuugcuggugggggaggugagguaaguguacaguuuccucucaccaugaccaaggaggcuaauuagucaggacccugacagcacuuucgcccacuuccaccacacacccaaagauaaugaaaucauuuucuuuagagagcccaaaugccuuggucccgugggaggcaacccagugauauuagaacuguacuccucccuuuauccaaguuuucagggcagcagccagaggucccagcccugcuuucagcuucccuggaaaccaaacucucuggcaguuaauucuagccccugaggaggcagauggacuucaauccaaagucugcguucucaguuuauuuccucuugugaauccuuagaguggaaguuucucugguuuccccucccgcugcuauuucccuaccuugggaagaucuguucucagucaggaaaagaguaggggcauuuuuccauuuggaugaguuuauuguguguguuuauuaaauucagcuugagcagaaagauuuuuaucacauuguuuaaaugaaggcagcugcuauacucagaauuucuugcugcacuuauucaaaagugaguauaugagagaggaaucuuugccuuuggguacaaacaaggaugauuuucaagaauuucaaguuggcaaaacagucuaagacgacagcaucuuuagccauucguucaacaaauauuuguugagcaucuacuauacgccaagccuuggacggggaagauguaaaagacaggguuccuuuccucauggaccaagcuacaguugugucaugacccaaacugugauguaacuguagcugugaugaaugccacaacaggcccacugcuauccccauguaagguagcaucaguggggcuuuacugcuguucuuaaucucucagcuauagggacaucauggcuucagaauaggacuuccuagccugaacagugcauuagaaucaccaaauuuuucuaauuccagguauucuggaauuaggaaaagucaguagcagaguucaggcaaguguauuuugaaaauaauccccuggugauuuaaaugugcuuggaagccaccucuugagcuuagcuuuguccugugcauuauccuggugcacucaaacaagacagaagcacaagugucaccuaagacagagauucuuuaguuggagaccuuaacccuugugugacuggaggcaauuuagaguagaaacucacuagacuuuagaagaaauuuaauucaguucaaguuucaauaagugagaaugguaagaaugaaaaguggaggugcuuuucuggaaaaauaagccuguaaccuuucuuuguuuucuguagagcuggagauagugaccauuucacuucucaugguugcuuuuaguaugugcauuuuccuuucuacuccucuuuuagagauuucuauuacuaaaaacaaaaaacagaacguucuuuuccaggugguaagaauccuuaccuuucuaaaugccucacaguuucaaagugagacuaggcuuguugcauucaccauuuuuccuaugugucucacacauuaccagaguacucccaggucacuaggccaggacugcuggugcagagguucauagggaccagucuuaauaauuucagagugaaugccaguaacgcugaagaaaugguggcuugggauuucugccaguuccaaucaguucaugugugugugcucacugcccagcuaccugcuucuuccauaaagaggcuagaagucugaggaauuuugccaucaaccacaagggacaugcacuucuucugccauguccacaacuugguuaaacagaauuucaccaagacacuaacuuagguaaugcuguuuggaggcacuauuuuguuucguuaaauuuugaauccauucauuuaagccauagauuuaaaacaucaaaacuccugaguggcuuauuaaaauaugcauuucuaggauucaaccugacaucuucugauauguuaggcuaggaugggugagaaaucugcauuucuacaaaaacaauucaggcaauucugauguaagugaugaguggcccacacuucgggaaacauagcacuaaauuauaagccccgugaggucaggggcuaacauugcuuuaaugcagguacuuacccagagccuaggaggaagcaguugcucaauacauuuuguugagugaaauggcuuaaagagcaugagugaauaaacaaaugagauaagcaaguauaguuucagaggcagcugagacugagagagaugaacaauaagugaccugguaugauucuugaagggcaguauagacaaaaaauagucuaacagacaacuaucuuucuucuaauaaaaacaaaucacccuugaauguuuuuucuuuuuauccuuuuaguugagucuacccuauauugcaacuccaaauauaggauuaauacaucuguucaacauacgcauauuuauucuuuagaucuuuagaucagaacauaccagcguaauuuuuccaaaucucacuugagcuuauugaagaacuauuuucuuuuuucauuucaggagcaaacccgcauguuggaaauggggauaacuggcccagaaggccauguacugagcaggccagaagagguaaguuacaggggaugaaggugcacacacaacgcaugaauaaacauuguuaaaaggcgacgagaaugugaguaccagguugcaguauuggaacauuucuuccaaagaccacuucugauugacucuaacucaggagcccgugagaaaauuagaaaggaauguaagagacaugcuuauuucugaccccuaaucucccuacagauaacacaaguuggaguguccuucacagcuauucaggaguguuaaauuucuaaucccuuucuuaaggaaaucucagugugaaucucauagacauuuccacuuauucccuuauuucgaguccugcaaaauauuggcauauagauaagauguugaauggguuuuuuauauacauuauacucaucaauuuguauaaggugaugauuauguccagguauggaaguuucucauauauaaaaugaaugcuuauuuaugucuguacuuagcagccaaacaacaaaucaaaggugacuagaggcugguuccaugucuccgagaugucagcagcuucaccuacuggcacggagcacagagcugggaauuggcugcccauguaccugaaagcacauuggcuuuggaagggcagccugggucuagcaccuagagcaaagucaaggcccuccauaucagugaagcgaguccuguuucuguccugucauuccaaacccuacaacagggagaagaaggaaucauaaccagaaaugauucccauauccugucucuuuuagagucuuauuuaaaauauaaauagaacacauauagaaaaaaauguuucuauccuaaggaggcaaugaauuuucacaaaccagauacacuuagcuaguguuacacuaguuauacuaguauaacuagcacccauagaaggaaacagauuaucagcaccucagaaacuccuuuguaucuagugauauuuuuauugccauuuaaauaauuuauaauuuugugauuaggguuccagucacauacagcaucccugaagucugucuccuuaauaauacuaggucacuucuauggaaugcauucaucugguaugugcugauugcauacguuaucucaguucucgcugccgcugcucugugugguuggcauuguugcgcagguaaagaagcugaagcucagagagguuaagccccuggcugaucacacuugaaggacuggaaaaugguuuacucaucgugaagagaccaggguaaucagcauuguuuuugaaguuuuucuuaaaugcuggucacuguggagaugugcuggcaagacggauuuccagcagcagccaggggauuucagagcaaagucuauuuuuguuccuugguuuguuuuuucaaccuccccuuagccuuaccaccccacccuccuccuuauuccugucuccuuuuuaguaaaaaagccucucagccgcaaaccucuauagccguggaaggccauuugggugaaguuggagggugauguaaccuuccaaagauagucauguugucaaagugcugaaaaaccuguagugcuugggaggaaugagaucaaagggaccaggacagagguccugggggagcugaaguggucagcaugggugugaagugggaggagugaucauaggaggagccagccccuguucaauucaagcauacccagacaccaccucaagugaugcuguucagagagcugggaccccaggcauagagacagccgcuccagaguacaaaauucugggugcuucaggaagguguccauauucacauaugaccaggggccuccaaggucccauccacaugcaauaaagugcagcuugggggaggccagcucagccagccaaguucuuaggucugucugcugagcuacacccacaauggacagugacugguuugcauuauacagccauugggcaucugcaagcuauuuuugguauuuuuuuuaaguguugggcuccacaggcuaaccagaaugucauauccauaaaaaaaugaaguguugccaauugaauggaagaaugucaaagucucugcucugugcugaauuggacuaacuuacacaaguugagaguagaccacuugagaguaacacagacccucaacugguuagaaaauauuaucaacaauaauaucaguagccaacccucaaggggcacuuaccuuguuuccccauuaggaaugagcuaacugcuuuauaaggaugaacucauuuaauccucaccacagcccaacaugucagauccuauuauccucaauuuacagacaaggaaacugaggcuuugggagguugugcaauguacccgaggucaccuagcuuauaagugucagaaccaggacucagaaccaggccaucugagagagccucagcucucagacccugcuuuguuaauaaaauaagggaaaacuucuaauuucuuaauaaaugccacuggguugguuagcauauuugaaaacaugaauucuacauuaggguaagaugggagagaucaauuauaaaacaagucuuuguguugagaaaccugggaauuauuuucguaagaaaugccuccuaaaauuaacccuuugcugaccacuuacugcugcaggaaaggauuugaggaaccaugaugccuaacugccuuggcugguuauuuuagacauaaugguuugcuauuguguuugcccagagauucuguccugagaagauugaggagcaaaggcuuucauucagaugucaccuuugugauaaccacagaggcuaaggaaaaaguacuuacccucugccagacauugcucucagaugacaaugcugugcuauacuauuuuacuagugagggauagaggcacugggaagcugaguaaagugacacaguuaggaagugguagaucugagauguggauauaggcuaucuaauuccagauccugccaaaauuauccauaaccuuugugcagcacugcauccucacaguucguggaggugggagccaccaguuugagagguucauguuucuauugacuccuggagacuuuuucuugcagcuggaagcugaggcuguguuccgugccaucaccauugccagccaaaccaauugcccucucuacgucacaaaggucaugagcaagagugcagcugaccucaucucacaagccaggaaaaaaggugauuuguguuuccaagaucucggagccccugauggcacuguguggcuccuucccucucugguuguccuguguaauauaaauggugccuacuuugcucauugccuugcucccuaggaagccgcucuccacauccuguguggaugggaggauccugggauuucucccacuuggcauuuaaguaaacugaggcucaggaagguuagaugaguuguccaagaugacacagcuugaaccaguucuucugagacuuugugcaucuuacuucuccccuugaucuuugauuuucaguucaccuugucugaguuuuauaaacggacauaucagucaggauuaaauugggugcaaaauucaaagauccugcucaaacuggcuuaaacaaacacaagugaauaaccgauuguagguguuucagguauggcuagauugaggggccucaacaaugguauuagguguuugucacgcuuacuccuuucuuggcucucuuuccucuguuugguuuauguucaguaugaacaguuacagaauagaugcugagaggccccuguuguccucaauuuuuggcagagagcaugaugggaaaguaaaauacaccuuuuccagcaggucaagcaaaagucccuaggagcacugugacuggucuggcuugggucaugugcucaucccuggaccaguaaacaccccggggaugauauaaucuggccaggauugaggccacagugcagaugcaggucacaccuccugagccacugagacuaacacaaguuauuuuagagaagggguugagugggucuccaaagcauauuggccaccauggccuucaugacccuggcugugucccugcucccuguugacuucugcuucuuuucuccacugguguuaacuugggcuuccuuugcuugccuugugcuuagcuaaaguuuucagagcuuucuuuucuguuucugguucucauccucagugucagacucgugggcucaguugugaggcuggguaagggacgagugcaggugagaagcugcagauguguggcucuguguuggguugugagaggauuuaccaggcccagugaugugguugcuacugcugcgugccaguggccauucugguaguagagaggcccaacaugggugauucaucuaccaaacuggccugugaaacuccacgugugagugauugcaguagcuaaaaauagucucagcugacgcugauggcugaguguucagaugccuggccuucuggcacagggugacccuauuuuucuuacaagaggggaggcuuucacauugucuagacacucuuccuagcugacagauucuggggcaccuccuuccuuccucuguucuucguaggccugcuguuuucuccuuagcuuuuagaaguuucaacugacauggagugguugcuccacuggguaugagucauugggcgagaaccaggaaagcagcccagugcuccucacucauucuuggagaaaagcaaagaaaagaaaaagaagaaguguguaggaacuccuugugcccucacccagugccgcacacacacaccccugccaacugugaccacccaccgcccucaugcccucugcugaggcugcauucugcccgggacccauucuuagggugaccuagggccgcucgggacaggguguuuuaguuauaugcuggucuuauuuuaaacuucauggacaaaaauuccuaacccugagccuuuuggcacauaauucucuggcgagcagaacuaguacagcugugucuccgggguggaauggggguauuauuucagggaugaaaaacuggcugcugagauugaagucaguaaacaacucauggaccgucauucucagggaaacacccaagagcauucuuugcaagacaaaguguagcaggguuugcacuucccuccugagcaggauaugguugaagucucaguguguuuagucaccaaucaucagggcucuuuaacuauauggcugcucagaauuaauauuagaaagcuacaauuuaaugaggaacagcuaugugcccugcacugacauaaauacuuuaauuuuuuuauuguguagaauucucaaagaacucugagaaauaggcauuucucagaaaugccuuuuuucagaugaaauugcagcacaacuuguccaggaucucccagcugggagagcugguauucaaaucuagguguaauuacuaucuuagcuucuuuuacucuuccaugcuaaacauaguccagagggagauuucuuccacuuuuaagauucuauuucuuucaauaguaguugagugcuugcugugacuuucauuucuucauaucuuuaugguccuguauccuuuaguguguaaguauuuuuggagagcccuugaauucucaucacuuggauuuuuuuuuacucucacccccaaaagcagggcuguccaaugugaaucauugccaucgcuuccuucuuuugccuauggcagacauuacuaauuaaucaugagucuuuucuacugagaccccgcgcauuauuagaauuuuucccuucauggaauucuaggcaacuauuaccaguugaauggaguugaaacaaggcaaaaucuauuugugauccuggccauagagugcaaacuuguggagaauuuaacuguggaaguuggaggaccaaaguuaaagaagugcagggcuguauaggguagcuuuggccccagauuuuggcauagagaaacuugguaccaaccaccuagcuaugagcuagcauuugcuuucuauaucacuauuccuucuucuuaaagaagcuaaacagcuuagaucaguguauauuccaauagccuuuauccccucuccaugguuuggguaguuaggccucuaauuuuugaggcagaauccaagaagcuagucucauauuugauguguccuagguuauugggugacuuuuaccaagucaucauguuaggaguaacaaacaugauaaaaaaaaaagucauaggccgggcgcgguggcucacgccuguaaucccagcacuuugggaggccgaggcgggcggaucacgaggucaggagaucaagaccauccuggcuaacacggugaaaccccgucucuacuaaaaauacaaaaaauuagccgggcgugguggcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaagaaaaaaaaaaaagucaugagagucucuaauccacaggaauggauuuuacuuuguggaaccaaagcauaucauuauaaugggagcaucuagcaauucccaguggugggugcacauuugggacuuugggccccuacugugggaaggcauaacagguaaagaaagcgauauuuaccaaacauccucuaggugccagaugcuucacguaugccauaucuuuucauuuucacaagccuaagaaguagacaucaucuuguuucaucaauuucagaauauaucuauuucagccuugguauacauggaacccauuacuagagcaagaacuggagcauuuuaguauuucugaaaugaggaugaaucuugaaaucaauauguauauuuuauuuucuuuugccucaaauuuuaauuugccucaaaauuugagaauuaacacugcaucuaacaaccaauggcuucuuuuaaucuagagaauacaaacuuggucacauuuagcagauaggaaagcaggggcuuuaaaaaggugggaacauggacuugaacccaggucagucugacucugagacacaguccuggguaggcuuaggagcuaaauuaaauaggcuuggcccagugcagcauauacuuuaugcuaaccccuugucuguuuccugccccuucuaggaaauguagucuuuggugagcccaucacugccagccucggcauagauggaacccauuauuggagcaagaacugggccaaggcggcugcauuugugacauccccaccccugagcccugacccaacuacuccggacuacaucaacuccuugcuggccagguuggugcaggaaugcccagcagcaggcguuuugugaaaacaucucuugaguccagcuggggguugaggacaggagcagucccaucuauaaacuugaccagagucugcagugugaacaguguauugggaauucuuuuacagucuugagcguagaaagcaggcucuuccccauccuguuuuaaacauuaauacagucauaauauuaauaaugguaauaguaguuaaaaccuauuauguaccaagcucuaugguaagacuacacucacaaucucauuuauuucuccuaacaacuuuaugagugaggcacucuuaucagcauuuacauauuaagcaacugaaggucagagaagcuaaaucauuugccuaaguucaaauaguuggucaugaugacaaucaaaauuauagggagacuccuuuguugcugcccucugcagacauauaggaucaugacauugcucauuugaguacauuuuauuuugcuacaaaagagaugagcuaaucccacccccucacuuucuagaugggguaacugagcccagggaggggaagaaacucauccaagcucauauaucuaguaagagguagaggaggcauuccaaacccaaauagucagagugcaaacccucacaguaaacacaagacucuaagcucccagugugccuccagccaucuccccuguucauguggagcuuuucuccuuugccagcggggaucugcagcuaucugggagugcccacugcaccuucagcacugcccagaaagcaauugggaaggacaacuucacagccauuccugagggcaccaaugguguggaggagcggaugucugucaucugggacaaggcugugguaaggcauggaggucaugggaggguggccagagccaaaacauccaugggccagaucagaaccuccugccaccaguugggcuggugacacugcgagugcagaugggaucucguacuugcugagaugucucuggaaccauguggcucuggcaguguggaaaauuuccuucuagugugaugaauccuaaggccuagcauucugaaggaggcuuccuuaucuagacuguuaggacuaggaaccagacaugcaacuccuucaucugaguguacgaauagccuguacuuaaaauaauagugaguuaauucuuuuuguuuggauaguuuuaugacuucuuuugaaagaacuggauauaauccuuugaaaugauaagcaaugagucugugucuagaccaaagucaucuugcuuaucaaggacgcccuguacugagggcauguggucauucaggcgauacaagugauugucucuaaaugucuucuggcaaguggccuguuuuauuuuccuuguucacaucacaaggacugacgaaagaaauagccauucaaauuaagacucuuucaaagauuuuaguaaaaucaauaauuaucucauuauuaaguugauuacugcucuauguuucauuucaaaaauccuaaaaacauucuuaucaaaguuauguauacuaaagccucauuaaucuacacaguguaauuucacugaguuuucuuuuucuucuuugcucccaggaagcucagagcuagguuuuaaacucaauucuuuccguaaagaggcuuuuugguuugaaaagagggaaaauauaaauauuguugucuguucucucacauaguguuuccuuuuucauauacugcagagcaguacguauguauuuauccuggcacuauuuggaauaguuccaagauaauauauauuuuuaaauuaccaacaugacacaugcucaguaaagaauauuuggaaacuacagacaagcacacacuugaaagaaaacaaaaauaucucaauuccacaacccagggaacccauuguuaucauuuggguaagguucuuuuguauuuauucuaugcauacaacauaugcaaacacaaauacauaucuaaaggaugggauuauaaucacauuuguuuuuacugugaacucuccauaauccuuuuugaaauuagaagaagaaaaugaguaaguaaauguaagaacauauagaaaaaaaugcauacuucaggggcaguaacuucuaucuuaaaccauguguuugaccauuuuaccugaguagucacgacagcccagcuaauucgagcuugcugagugagguucuguagcucaccagcuuuucagguggcuccuuuuuguauuucuaugccuuuguggguugucuuucucugaguucagaagcccugaauugauauauauguagcuauagauauagauauaauuucuuauauuucaauaggccacagggaaaauggacgaaaaccaguucguggcugugacaagcacaaacgcugccaagaucuucaaccuguauccccgcaagggaagaauaucuguggguucugacagcgaccucgucaucugggauccagaugcugugaagaucgucucugccaagaaccaccagucuguaaggcccgcucuggugggaguggaguagaauggagaaugcaugcaaggaacuuggucaggagaaauguguuuauguggugugccaggguaguuagacuaggacggguugcaauaauaauccauccccuaaaucucaguggcucaaaaccucaacuguguuucuccugcuuuccaaagcagaugggcucugcccauuccagucacucagggacagaggccaauagaggcuuccucucuacauauguuuucaugauugcugagacaggggaacaugaccuggugaauggucuacuggcucugaaagcuuccccuagaugugguguacgucacugccucucacauggcacuggucuuagccaguccuguggcuauaccuaacuuccggaagucagggcgugcaaugauccuuugugccuggaaagggaaagaauaggaaauaacugguaaacagcagugaugacuucuucacgaugaguuucacauggaggaugauaauuaaagugcaguaccuaacagaaacgggcucgacacuguuguuaaaaauaguuaauauuuuuaagcacuuauguuucaggcacugugcuuugaauucacuggauuuccauaguagucuucuacagguagggacuauuauccuccguuuuauagauuaaaaauuggagguacagaaaaauuaaauaauuugugcagcaagcgaauggugaagcuagcauugaaacccagacaagcugacucuaaacugauguucuuaauuauuggcaguacaguaaugccucuugcugauugaguaaaugaaggagguagggagaaaucccauuuuugguggcaauggccuuugcuuaaauauugugucaucucauguuauuuaauuuggagcuagagggaccuaaaggccacauaaccucucugcccaccugcucaauacaagacagugauguacagcauccuggauaguuauccagcuucucuuugaacacuacccaagacaaaaguugacuuccacuugaggaccuuauuaaagaccggacacuucuuuuugcuaggaaguuuagucuugucuuaguaaaucugucuccggugccuucuacccacuggaugcuugcagaugcauggugagcuuuuccuggcuuaccuggugaaucagcagcaaaugacacugaaggucucaaggagagaagguacguuccucuuucucuacccuuacuguggcuuugcuucucaccccugccucuaggcggcagaguacaacaucuuugaagggauggagcugcgcggggcuccucugguugucaucugccagggcaagaucaugcuggaagauggcaaccugcacgugacccagggggcuggccgcuucauacccugcagcccguucuccgacuaugucuacaagcgcauuaaagcacggaggaagguaaaaagcauuggagcucugagguggugcaggagcuuuguguuccacucacgcucagagauaguaaccaugaacacagggcacugugaucucuagacucucacagagaaauucagugacagucuuguccccaagaacaacuacacagacuuaauguacuauuaaagaggguguugaaaauuuuuguucaaagagagcuuuuuuucccaaaugacuuuucccacauuuuuauaguacuuuauuaaaaauaauuuaaauucgaauaauucaaaauaaggccaguguauuuuuuuaaaaaauaaaugacucuucaagucugaaggugagaaccgagaauccacaccgacacaucccugugucauucuguccagugcugcuccacaggggcaaacacuuauaacauuuuagcuacuguauuuucaauaaaacuuuauuucucugauuuuauauauaaacacacacagagauauguguguauauauauauauauaggucuauagauacauacaugugugcaaauguaugcaugcguauaaaaaauggaggugcagagaaauuaaauauauauuuacaauauauguauuauauuuauauauacuuaauauauaaauauagaauaauauauaaauauauaaauaaacauuuauauauuuauauuguauuguguauuguauuauaacaauacaauaaauauaauuaaaaacaaaaaugcguauaaauaaauauauucacauauuuauauuuauuguauuuauuguauuauacuuucuauacacacacuauauauauauauauauauacacacauauacagauauacguauauauauguguuuguauauauauguguauuagcccuacccuaggauuguggaauuugagcuccacacuccaguuugggccuaauagagaaggagacuuccccaauauugacccuuuauuucuaugagugugauuuagauucugaaaccagggaaguguugaugauguagaguucuugguuuuggggaguacagauacagucaucacaucacuagaaucauuagcaucugcacauuugaugggcucggcuucugugcuggcauuugagucacuaacagggaaggaggcucugacaggacuucuugugaugauccauccugcacggucaggcuccucuggcagcgcguccucauugccuccccucuggccaaaguuaagaaauggguggagguugugugccgcugccauggguggucuugcaguguuuguccaguugacuguaagccccuuugcaggagguaccguguuucccauggccaaaggcccuagugccuggcacaaggccuagcagagcaugugcuggguggaaguugcuggcuggcuccacagucccagggcaaguucacagccacagacagaggucagugggucagaccacagacacucacuucaaggccugcccacccuggugugugcugaagagugugaggguggagcucccaugugaucccauccuggccaggaccugcgaccucgugucaugaccuacccuuccuaucccucugcuccagcuguacugcuguucuucuauuucauaaucacucccacuucagcugucugcccuugcucuucucuuugcuggcuucucugucauccacaccacuccccgguaucccuccaaccuccucccucuggcaaccccaaccccauagcaacguccuuugauccuucugaucgaagcucaucuauuuagaagggccuucacugaccacauccauugucacucuaucaucacauccuccuuuauuuauuuuauacuacuucucccuuccucaaauuaucuuuauuauuguuaauuccuagcucccaccacacacuguauucacuaauauauuuaugauaccuagaacagacccuaaaaugcugaaugaaugaauggugacaugcucuucucuggcugcagauggcagaccugcaugccgucccaaggggcauguacgaugggccuguguuugaccugaccaccacccccaaagguggcacccccgcaggcucugcucggggcucuccuacucggccgaacccaccugugaggaaucuucaucagucgggauuuagccugucaggugagugggacaggcucaucaaaagauaagagaagggggaaggggaagaucaauguucugaggccacaggguguuccucagaacucaaccugaaggaguuuuccagccuagcacuggugucaacuuuagggagaagguuacuggggcaagcaggaagggucccugaauugacaagggguccugguaagaaaguaagacaaggcagucaggccgaagaccagguuuaagugguaacugauucugccuagagaucagcccugguugggggcagggucggggagcugguccccucuaugaauugauagugauuuccagcauuagccuaugagcgcuaugcaacauaguauguuuucuuuauuuguccagauuaaaagauagcuuaaauuauuuuuaugcucaaauugcaguagcgucuucuaaccuaggauuuuuauuauauucucccauuccuaguaauuauaauaaugcuaacacuagcuaccacugauugaacaucuacuauguguuagccaugugauuagucuuaccuauucuuuacgaacucucugauauaauuagaaaauaaucauucaguugcuccauaaccaguagucuuaaaauggagaaaaauaaauguagauucgcauuccuauaaugaauaauuuaaaugugaaggaaguaagauaacaagaaaagaaagacauuuaaagguaaaauuacagcauaugaggaaaggguauggaaugggagaaacagaaacaugggagaaagagguaagggagaccuaggggaagaaagacaaaggaaaagaguuuaaaguuuggagguaacuuugccagaggucacauucugcuagucauaagcaauuuuuuucaaaguuuuugccuuuuuuuuuuuguuguuguuguucucuggcuaccuuaauucuuaagcuuuuagaggcuccuuucugaauagacccaagcacacauugaaauuucuuuuugugcuguugucacaaagaccugaccaucacugcuuugcacugugggaucuugggcaagugaccuaaccuuucagaaccucaguuaucuccucuguaaaacagauaagggcaccucucucaaaccaugguggugaggauuaaaggagauaaugguuaagcacggaaaacauugccugccacaaugagugucacgucuuugucauuguucuucuucccaguauuauuaucaugcucugggucagaugaaaucuagauaagaacuuggcuuuuccuaccagaggcuaguuuucggggccauaagaaaagucuagaagaccugauagacuggaauggaaguuucuugggaggugaggccagcaaggcacuucauaucuugcacucuuaaaauuaacccaguuucucucuugcccacaucccccuacccgccacucuguuuuuuuuuucccccugggaauuuauuuccaacuguaggcacccaaguggaugaggggguucgcucagccagcaagcgcaucguggcgcccccaggcggccguucuaauaucacaucucugaguuaagcaagccuuccucaaagagaggggcagaagcaagaagagauuguuuugaagccaaaaugguacaccgauauuuaagaaggaaagcgaauccaaacgguugugaucuaaagaaucaauaagccucaagccuuauguuucuccaauguuacgcucgcuugccuagcuuuacgaauauugcuuuguuuucuguuuaugcauagccuugauuuguuugacuccccuccccccauuuacaugcaugcaaucagacaggccacuaagguaaaagagucugcucuaucauaguguugagagcguguguagugcugcaucuuaugacaaggggacagacaagcugggacgucagggaaaugaacaaaagggacgcagguuauuuggggugaguggguggugggagccuggagcaagguggagggugcagaggggcugggguagggcauguaggagggaggugggugggucaggugaguggaagggguguuguauauuguguugaugacguacguuauuuccauggaagauagccgcuguggcagcugucacaucaccacagcucccuagggucugccgagaaggcaggcagucuuuggguucuguucuuugucacguccccuacaaguaaauuuuguuucuuugaacguuuauuaaaaugccaagacccaaccauuucuuccaccugcuugauugugccaguguuugcucaggccucuuucuuaguguugcuuucaaauccuucucuuuccuggguugggaaggccaggcagggacagagcaaaugacacuucucuuccucuugcccucccugccucuuuggugcucuuaaaagccagcagcugagaacauagcacaggcccacguggugagggcacccacagcuuaaagacgcuuccuucuaaacacggcgaggucaccucucacucuucugucuuugcaaaccgagaagaguggcaugcuucuggcaucccaagucaggauuuuagcucagaugaggcagaaugaagggccucucuuacaggcaguuuguguuugauucucucgauccuggcacauccaugauaaauaggaguuuuugaaaguugguuuuauuagguguucccuaauuuuuaccguaauaggucaucucagcuuauaugaaagucaaguggggaacugggaaagccaaagucagucuugagcagagggagcacauuuuguggaccugguuccaccuuuccauuccaaaccaccuguuuccccuuccauuagcagaaacucugggggaacuuugugucucaguccuagaaucuccccaagugaguggaagugacaugaugcagucuuccucauggggcaccugaaagaaauuagugugggugcuucgaucuaccuugucugucagaguugaauaucucuuucccuaucaugcugcuucugaaaauucaguuuuggagcaaguccugugagcaagauaagaaucuauagaaccaagaugcucauuuucagaagaaauauguucaaccugggaucagacuuccaugcucuggggaauccaagugguagcaccuguaacccuguguacuaagugcuuugaagagaagagcaggccucagacaccuuuuaauugcuuaggagaaaccauugucucugacugcagguuugaauaaguugaagaccagagaaaaguacacacugggcuacaaaggaauuuggagauagccaaggaacaggauuuccccuagcaagcuaccuucuguucaaaucaugaaaaaagacuauuuccccuuagaauagggaagcuugcuauuuuaaagcucuuguagugcuuuucuuuuaagggagauguaguaaaagggaaaauguagcucuuaguuuacacuucaaagaugugggggucuuucagagaacuaagaauaacaguuuuaugugcagagagaguuugccagaucugaagcauauaccucauugacuaggcuguuacuuugggauagguugcaguaccagccacagccagcagauagaggaaaagacacacauaaacucgcuucugagcguccacuucugcacucucugcucugcuguuacucagccccugagucugacucaucucugcacaaccucucugugccaugaagauaagucuuccauggccaaaucggucauccgcacugcccuugggacuuccgaagugaaccauuccaccagaaccuuugauucugcacaagauuuccuugcucugggaacaacccccaaaugcccuugggaggaacaacaugagcucaggaagccucucuuucuucacuuaccauuacuaacucuccaagcauagaaaucccugggaauugcgagaauaacucccacuauuuuaaaauuuauauucagauuuguuucguuucauaagacacaucaaacaggccuauacaaaagguuuaggaaaagaaaacaauggugagucccggcccucuucgaauucacuggcaccucaugcaaguguaggaaggcacgcuggaucgucuaucugauuccaaagcuguccuuugccaucucaucccuuggccugccccccaacccugaggaugccccugccauccccccaaccuccucauauugccucugaacccagauggcaauccaucccgguucucucugagggccacgggcuuggguaguggaaaggguguuugggaaauuguuaaaucaguuacccguaguagagcuauuucuuguacuucuaaguuuucuagaaguggaaggauuguagucauccugaaaauggguuuacuucaaaaucccucagccuuguucuucacgacugucuauacugagagugucauguuuccacaaagggcugacaccugagccuggauuuucacucaucccugagaagcccuuuccaguagggugggcaauucccaacuuccuugccacaagcuucccaggcuuucuccccuggaaaacuccagcuugagucccagauacacucaugggcugcccugggcagccagcauucauuguaaguucccucuuugaaaacugguguguggguguucaguucugugucugguggguauggacagacaguaaucuccugugaucugugcuagcugugaggcagcucuggaacgugaagagcuguuugguuugaaccgugaacaaaacuguguuuugaguuuagcugacauuaaagaaaaaaguucaucacgugacuguuaauguaaaccugguuauuaaaauaacuaugaaauuaccaacauuguuc

SEQ ID NO: 18543 - RNA, 13203 nt, Homo sapiens
uuuccucauacuugggacagcauaaaacuuguauuuauucucauuuuugcuccucuucuucuugggaguuuuuaaggaaugcagaacaaggugacucagcuaguccugucugccuugcagucccugacugacaccuugcuuuuucccuuuuauucugggcagagugguacccugaaaacagcccugcuggacuacaucaaacgcugccguccuggagacagugaaaagcacaauaugauugcccugugcuucagcaugugccgggagauuggcgagaaccacgaggcagcugcccgcauccaacugaaauugauugagucucagcccuggggugagugaggucacagccacacuaccagaacagugcugcuagcuagguaaaauuccuuuuuuuuuuuuuuuuuugagacagagucucgcucuguccccaggcuggagugcaguggcacgaucucagcucccugcaaccuccgccucccagguucaagugauucucccgccucagccucccaaguagcugggauuacaagcaccugccaccacacccggcuaauuuuuuguauuuuuaauagagaugggguuugacuauguuggccaggcuggucuugaacuccugaccuggugaacugcccacguuggccucccaaagugcugggauuacaggugugagccaccaugcccggcccucgauaaaauucuuacagcaaaggacaagagcccaugagaugggcuauuagaaucuugagguagguggcccggcacaguggcucaugccuguaauccuagcacuuugggaggccaagguagguggauugccugagcucaggaguucaacaccagccugggcaacauggugcaauccugucucuacuaaaauacaaaaaaaaaauagccagguguggcggcaugcaccuguaaucccaacuacuugggaggcugaagcagguggaucacuugaacccgggaggcggagguugcagugagccaagaucgcgcccauugcacuccagcguaggugacagagugugacuccaucucaaaaaaagaauguugagguggguaugucgcucagcaggacccccacuugggcagacagauggaauggagacuuugaaggcaugugcaauuuaggauuguacucuuggaucuauagccuauauauccaggguaucauccaccaggaaccaacaugcacguugauaccauguaagccuuccuugauguuuuggagaaaugaggcauuagaaggggcacugaauccuacugcggagugaaguuacaauaagcguaugcauuucuggcccaauaaccuuuaucugagugagguguuccugccugccugugaacauggcugggauguuucuauucuagccacgaucacaaugagugggaugagaacagugagcuuugggagucagacucggcaaaucuucuuuauuuccccuacagaggacagccucaaggaugggcaccagcugaaacaacugcugcugaaggcccugacucugauguuggaugcagcagagaguuaugccaagguaacccaaaggcuuuuuucagacuggccuugggacuugcugucugcaguaaaauuauuuucuuuuguccuugggcucuuuccaggugaagcgggagggcaucauaggccaaccaggaacagaaggggugaauaccguugugaggguucacacaggaggugacaacuaggucuuucucuacugugccucuccacccuuguuccucaggacuccugugugcgacaggcccagcacugucagcggcucaccaaguugauaacucugcagauucacuuucugaacacuggccagaacacaaugcucaucaacuugggccgccacaagcugauggacuguauucuggcccuaccucgguucuaccaggugagcaagaaagcaaacuguagccagcacugcuagcauccucucuccuucugucccacucauggaacccagagguaaggucucagggcuagugacagaaccaggacaguacaguucugauuuaacucucugauaccaacauagaacggcaauuugauguauuucucucuaguauauuguugggcagagguuagagaaugguaagacagugcugucucccuuuccugugcuguuaggccagcagagaggcagacaccuuuggcccuuuaaccccaggcugcagacugguacuggcccauggccugcuaggaaccaggccgcacagcaagugagcacugggcaagcaagcauuacugccugcacaccaucuccugucagaucagugacaggacuauauuuuuauaggagcaugaacccuguugugaacugcacaugcaagggcuucuuaugaaaaucuaaugccugaugaucugagguggaacauuuucaucccgaaaccauccccucccagucuguggaaaaauuguccuccagggaaccugucacugaugccaaaaagguuggggaccacugccuuaagacaguugagguucagaguaauacucuugcuggugguccugcaagaaccuccuagccccagcaguuacagaauggcacacucagguuaguacagcaagucagggagauugguucuagcccuuuaaagaaguggauuaucagggaaucagcccuuucacuguuccucauacugcuaaugggaauaauauauucuuagcaguuucaauucauugugaggaagauuaaaaacacugaaagaagcuaggcaugguggcauauaccuguagucccagauaugcaggaggcugaggcgggaggaucuugagcccaggaauuucugguccagccugggcaacauagugagacccugucuuuuuuaaaaaaggguuuaagauaauuuggggauuuaugagagggaaaaugccaaacacacaccugacuuuucaccaccucugauacauagagccuuuuaacauaauugguaaugaucauauucacuacaugagugaguauacaguauuguuuucuacaacaguuuguuuuugauuuuacaucagaugggcucugaugguguccuucuucaccucuccuuuuaaggcuucuauuguggcugaggccuacgauuuuguuccagauugggcugaaauuuuauaccagcaagugauucuuaaaggagacuuuaauuacuuggaagaauuuaagcagcaaagguuauuaaaguccaguauauuugaagagauuuccaaaaaguaaguauuaaaaguugacuguaaacauugcuccuugccucugcuuugaggugagacaaguguaagaauuuuauggcuaaguacaccaugccuuuagauuaccucuacuuaaaauggcaaagcaguaucaagaauccuuagaaggaagucuuuuaacagauuuaugcaaagagaucaacaagaacaguuugcucauagugcuuuguacuuuaaaaugggaggauagcuacucagugccaaaaaccuaaaacacuggccaggcccaguggcucaugccuguaaucccagcacuaugggaggccgaggcgggaggaucacuugaggucaggaguuugagaccagccuugccaacauggugaaacccugucucuacuaaaaauacaaaaauuagcugggugugguagcuggcaccuguagucccagcuacucgggaggcugaggcaggagaaucacuugaaccuggggacagaggcugcaguaagcugagaucgugccacuauacuccagccuggcaacagagugugacucuugucucaaaaaaagaaacgaaaaacacuaaaacaucagaggugccuuuuggaguacuaaacuuacucuauaagguaagcauuaacauacucauuuuuaaagaaauauuuuaucaagcaccccuaauacuagucugagauaacccagacuccagcacccucuccucuauagguaauaguaagugguacuucagagcugacagcccucacucaaaauacaguauccuaaggugggcacaguggugcacacuuguaguccuaguuacucgggaggcugcaagagaagcagcugagcccaggaguucacacucugaaaaaccacuguacuccagccugggcaacacagugagaccuccaucuuuuauuuaagagagaaaaaaaagggcagccacagugacucacgccuguaaucccagcacuuugggaggccaaggcaggcagguaacuugaggcccggaguucaacaccagccuagccaacauagcagaacgcugucucuacuaaaauuagaaaaauuagccaggguggugacacacucauguaaucccaccuacucgggaggcugaggcacaagaaucacuugaacccagcagguggagguugcagugagccaagacugcuccucugcacuccagccugggcaacagaguaagacugucucaaacaaaacaaaacaaaaaacaguaucuuaaccuguacauuauguuucuuuaucuagauauaaacaacaucagccuacugacauggucauggaaaaccugaagaaauuacucacauauugugaagauguuuaccuguauuacaaguuggcauacgaacacaaguuuuaugaaauuguaaaugugcuucugaaggacccucagacagguugcugucuaaaggacaugcuagcagguuagaugauuucauaggugucuguuuucuuguacuguuagcagauucugacagaugugaugagaagaagaaugcauuggagaucuuugcuaaaguugaacaaucccgguacuguaccauaucaguccuuuguggguaguagguagcaaguaagaaacuuuucaggaggaaauuccuauuuaaaauagauugauuuuagaugauuguucauccacaccauuuuauauagauacuaguauuaagaucaaaagcuuccucuuccucaggacagcuucuacuuuagaugauccaauaaugauuaaagaauaccuguaccugcagauuccaguuucaaagaaauuuaauuauuauuuacacaguuaaggaacaggugauacauuuucauuuguuagaaacugaucuuucuguaauaaaauagauuuucaauucaguguaugucauuauuacugcuaaggaaaucuuagcccuugucugccuuaaaggaaucuuuauuuaauuuacuguaauuauugcuguguagucacuacuuuuguuaauuucucaaaucacuuagaugauggucuuguuuuccacuuaguagguauacagagcuuugacguuccuauuauuuccuauauaagagaaauuuaaaacauuuuuuguucuuucugucuuaggggaauaaaaaaacacuaaccacacauuugguuaaacugcuuaggagaagacauaauaaagauuccccaaucuauacuuaacagccauaaaccugaguuacaggcucaguuacuccaaauaaauaguucuuauagguacuuaauuaauuaggccuugguaucuaaauaacaaaauaauguccccaaauaaauaagaggaaggcagcccuauaccuuuguugcucuauggugacaacauaaggaccuggcaaaucacucauguuuuaaagcuguaacuaugucaagcauuuauuaagauuuaguagagaacguagagaacuguacucccaagagcuguguucuauacucucaaaaaguaucucuugggagguaacacaaaauuuaaguccucacaacagugauuuuauuaaauuaguugcuuuauaaaacauugcagaugucauaauuguuaacauaacaauuuaccaaacuguaguuaacuggugcaguuugcugagcauguuuuauaaaggaaaggaaaggaaaugccaaaacccugguaaaguuguuccauugcagccuaagagaacaaagauuuguuucucagacacuuaaaucaggcaaauaaaaauaaguuucccucccccaccugaagcaguucaucaguagaaauagccugauaaauaacuagacagucuuugcacucgagagauuccacaacauguaaugcaauaauggaaagguuuaccuucuuuagcuucaaaguuggaggguuuuggucauuuuaauuuuauaucaaacuagugcuuuucagccgcaguaucuucacucugagauaagcagucuucuucacaauguauuuuuaauauccucauguucaauuuuaagacaaagcaauuuuaauacuaggugcacaccacaugcccuugcugcaaacugcuuuucuugacaaguuaugaaguaguucaaggagguaugguuaaggcuguauuacugaauggugcugguaaauacuacacaauuuuuuuugucacguugcaaccuuuuguuuccaauuuagugacugcugcuaugaaaucagauagcaacaacgacaacauuauuagguuuugaacuaugauuuaguagcaacuuagguucccaauuuuaaccccuuggcagcaagauccaaguucccucauuugcacauuagcaccuaagugucaagggguuaaauaaccagcacaaaagauacugcacuucugauuguagcauuuggcagaacugaaaggaaaggaaguugugcuacauguucaagggauugugggcaacauaaagaugacaccaagaaaagauaaaaugucacaugaagucuucauagucuuguacauauccuccaucauaaccaccauaaucugccagaucaucuuucaugguggcuuuuaaucccccuccaggaaccacaccuuucuucuucuuuuuggcuuugcuuugcuaaagaugaaagagaguuaauucaugaaccuuagugugcuaugggcaucuuaucugguacagcaacccucauaaacaaacacacaaaaaccuuuggucccagaaacacuaguucuguaagggacauccgagccuacauguuuuggaccugaacaggucucccagagucagucucuccaaaacuugaucuggguccuugguccugcucuggauaccuagcccaccagcagggguuauaaguuauugguagacagccuuaacuucacugaagcaaauuuagaaaaguguggauaaguaccccccaauuuaaaaucacaaagcucuaaccuuuacuugacauacuucucuuacuuuacucuuauaaauacucugcaaagugaguauuauuguuccuauuuuagaagggagaagacugaagcuuagaaaagcugauuuaccuauaccuauuaaguagcagugcuaguauuugaacccagucugugauuucagcaauuucuauuaacucagaaaaggggaacaugucuggaaacaaaaggacaguaauagcacccauacuccucuucuagucuaacuuaaaugguauuagugaguugcuugacuuuuaauuaggacaggcuccuauuauauuuguugacuguuagaccuauaaccccacucuaauuuaauacccauuucccuacacagcuugcucuuaccuuuucuugcuucuguuuuucacugcaaagcacagucagugaauugguaauuuuuuucaagucaucaauuuccacuuaaaaaaaaaagggcauaccauuaaacuugaauuuuuaagcauuuugaaaaguuaaagcuaaauauguacauuccauauauaucuauauaucccaaaauguacauuccaaaaguguuaugagaaauccaauuuguucauuguuaaacuucaguaacuuugaaaggaccaugaauuucuccucuuuaaacguaagguggccgggcacaguggcacaugccuguaaucccagcauuuugggaggccuagguggguggaucacuuaagcccaggaauucgagaccagcuugggcaacacagcuagacccugucucuugaaaacaaaauucauuuuauuuauaaugacgaccuguaaucaccaacacaccauugcucaaccaaagagaaacugucuuuauagcucacaaugcucccuacuauccuuccucagucuaaacaaaugggggaggauaacaugcccuuccauuaacacacccccaguaaucagggagaacagacaaauaaacaugaaaugacaauuacuauuauuuuuuuuuuuuuuugagauggagucucacucugucacccagguuggagugcagugacgcgaucucggcucacugcaaccugcgccucccggguucacaccauuuuccugccucagccucccgaguagcugggacuacaggcgcccgccaccaugcccagcuaauuuuuuguauuuuuaguagagacgggguuucacuguguuagccaggaugcucuugaucuccugacgugauccgccugccucggccucccaaagugcugggguuacaggugugagccaccgcacccggccuauuuuauuuuuuuuuuugagacagagucucgcuuugucaccaggcugggguacaguggcgugaucucggcucaccacagccuccaccucccagauucaagugauuguccugccucagccucccgaguagcugggauuacaggugcgugccaccaugcccagcugauuuuuguguuuuuuuuuuuuuuuuuuaauagagaugagguuuuaccauguuggcaagguuagucucaaacuccugaccucaggugaucuaccagccucagccucccaaagugcugggauuacaggcaugagccaccacgcccggccagaaugacaauucuuaaaccuacaaugacaacacccuaucccaugaugucuccauuuucuugcacgggaacuacaaugagaacagugaccaucucuauguccuaccaagaaauaguccuguucaguggacagcauuaucagccuuauaaaaauaugaagcuggaaagagacaccaguuuuuagcuaccagaaaguguucaguuuugguuagagaacaccuccaaaaaccagaaaaaaauuaguacaugcagaauaaaauaucaacucugggcacauuaccaaucaaauguagaacccucagcuuagugauaauuuaucaaagaaaacccaauucauuguguaggauuccuuuuucuccaucuuaaaaacugcaaauaggcugggcgugguggcucacaccuauaaucccaguacuuugggaggccaaggcagggagaucaccugagaucaggaguuccagagcagccuggccaacauggugaaaccccgucucuacuaaaaauacaaaaaauuagccgggcgugguggcaggcgccuguaaucccagcuacucaggagucugagcaggagaauugcuuuuuuuuuuuugagacggagucucacuuggucacccaggcuggagugcgguggcacgaucucagcucacugcaagcuuugccucccagguucaugccauucuccugccucagcuucaccuuguuagccaggauggucuacaaucuccugaccucgugauccgccuguuuuggccucccaaagugcugggauuacaggcaugagccacugcgccagaccaggagaauugcuuuaacccaggaggcagaaguugcagugagcugagaucgugccucugcaaugcaagacuccaucacaaaaacaacaacaacaaaaaaacugcaaauacuagcaaaaccagucccuuccauacauuccugcuucaccacccauggcugucacucccauucacccugcccugaaauguaugacuccuaucaagguguggcaccacaaccacggacccagagaauaggugccagcccugucacucaacuugcacccugucuaauucugauuuguaaaagacaguggcugaagucucacccaacccaaauccuacagugccagagaccuuuucccucaaaagauacuucccagccccucucaagugauaaucagauaaaaagaauaggccaguguuuuauuagcugcuuugcugacaagcccagguaucucuuagggaagccauuguaaaacaagaaguccucuuaccccuacaaacaaacaaaaagauccagcacucaaauucacuguaucugcagaacaacauucacaagguaauugcuaaaaacagcaaaucaugagucuguauuauaguauccuugaaaauaaaaaauaaccuucaaccuccugaagagaacauccuacuaaaaaucuacccagaggggcuagaaauuagaauuacuuacaugaaauacacacaucucgaacuaagacuuccaaaaaacuggcauaauauagugacuuuucauauuguguaauuuuaucuuuuaguaacuuuccaaacucuguaaagucaucucuugaagauggguucauagcaucuauuccauaaacugcauuauuaacaccuguaggagaaaagaagcacugaaaaguaucaggagguuaggauuuuuaaaaaugaaaccuuacaaagccaauagcuaucugaauaacccugucguuucauucuaaagcaggggcucugaaccuggagccacuggagucacuggauagaauggcugggugaggggggagggggguuacaaacuuaaaucagaaaaaaaguuacaucuuuauuaaccucuaauucagcauuuccuucaguuucaauugacuggcaacaaaucacagugguauuagcaaaacuugacuuaccaggagagaucacacucuccugccauuacagauaucuuacaauauuaauauuguucagucauaauuacucucaaaugacauuauuugacgugccacuacaccugauuuaaugcaucgauaaggaagcauauaauucuguaucacaaauuugucauuuuaguauuuugacaucuauuuauauauaacagguuuucuuuauaaauaaguauuuuauucauuuaaaaacaauauaucaaggccagacacaguggcucacaccuguaaucccaguguuuuguuugggaggccuaagaggaaggaucgcuugaggccaggaguuugagaccagccugggcaacacagcaagaccucaucucuacaaaaaaaauuuuuuuaauuagccagguguggccagacgcaguggcuaacacccguaaucccaacacuuugggaggccuaggcaggccgaucaccugaggucaggaguccgagagacaagccuggccaacauggugaaacccugucucuaccaaaaauacaaaaauuagccaggcauggugguggcauguaucuguaaucccagcuacuugggaggcugaggcacgagaaucacuucaacccaggaggcggagguuacaaugagccgagacugcaccacugcacuccagccugggugacagagugagacucugucucaaaaaaauaaauaaaauuagccagguguggugauauucaccuguagcccucgcuacccgggaggcugaggugggaggauugcuugagcccaggaguuugaggcugcagugagcuauggucaugccacugcauuccagacuggaugacugagcaagaaccuuucucuaaaaacaaaacacaacauauuacauuacaaaagggauacucuguucuuguccaagaacacccccacaguaaaguggggagagagggaacaaaaagaauaagaaacaaagauggauccugugaaaguauuugucuaacuccagaagcuaagcggggguaaacauguuaaaucccaauagaagaaaucuggccuaggcugugcaugguggcucaugccuguaaucccagcacuuuaggaggccaaggcggcagaucacuugagcucaggacuucaacaacagccugggcagcauggugaaaccuuguaucuacaaaaaaagccccaaaaaacaaaaauuacccaggcgugguggcaugcgccuguagucccagcuacuugggaggcuaaggugggaggauggcuugagcccagaggcagagguugcagugagccgaucucagccacuguccucuagccuggaugacagagccagacccuguuagaaaaaaaaaaaucuggccuagaugaguuuuacacuaagauaaguaugcuucuguauccuccaugucaaguagauuaguuauuaacaauauuacaugugguauuuuaguaugagaaacacaacaguaaaauccuauuaacaaugacuauaugaaugcauguuuuuaccuuuuagucuauaacaggugucccaugcuaggcuuuaugcacacuucauaaaccugccucuuuaauaaacacaugggcagcuuuuaccauccuaggaagacacauauuaacagccaagagcucucuauaauuagaugagugcaguuaagaccugccaagcauacaauggugcacaggagcauucacaucaacuccugguauuuguacagauccacugacagauaaggucauacuuccucaugaaaaggaaaacaaucacuacagucagccuguugaucuguuucagaguagagaaaguaugaaagugggggagggguaucagaauaacuagagcuuuccuucuugguuauaaauuucagugauuuaacuguuucaacaugaucuucuacucugaaaaguacucaacagguaacgauaacuugguuaaaugaagcgagggcuuugacuauuucucuagccaugucucuuacucuggaacacucugaauuuaucuauuuauaggauccugcacuuuuaucucacgcacuaaccacagcugcagacaccgcacaaagaaauggaggcccucuaaagauagggcaugguaagggcaaagaaggguugcagaaggaaaugacacugagcacaagaaggcacagcaaaagcugcaugccucucaccuggagcaacauccuacugucuaagucuuaagacaacaggacagcccuacaguccauuucaaagcuacagaccucacauuucaugcaaauuucauccagcugauaaaaauauucuaugcaguaguguacuucaucugagucuacuccuuuuugcccuucuugcauugcuauaaaugacuuaucuuaauaaucuuuuacucaaaacaauuauucaaaaaucugaacauguaaugaaaucucaaauauacacagagauuaaaaacugcuuucuaauaucuacauuagccaguauguuucuuuuaagaaaaggagauguuuucugaacuuucugggucuucaccuguaacaguuuaauacuguauugcaaucauaaucccgucuuaccaaaaguuuccuuugcuaauucgaggucugacucuuccuguaauuucuuuagccgcaguuuaucugcuaauuguucuucugguguuagcacuuuagguucuucggguucuucuaac

SEQ ID NO: 18544 - RNA, 892 nt, Homo sapiens
cauggccgacgaaaaacccaaggaaggagucaagacugagaacaacgaucauauuaauuugaagguggcggggcaggaugguucuguggugcaguuuaagauuaagaggcauacaccacuuaguaaacuaaugaaagccuauugugaacgacagggauugucagugaggcagaucagauuccgauucgacgggcaaccaaucaaugaaacagacacaccugcacaguuggaaauggaggaugaagauacaauugauguguuccaacagcagacgggaggugucuacugaaaagggaaccugcuucuuuacuccagaacucuguucuuuaaagaccaagauuacauucucaauuagaaaacugcaauuugguuccaccacauccugacuacuaccguauaguuuucucuauucuuucauuucccccuucccuauuccuuuauuguacauaaaguaacugguauauguacacaagcauauugcauuuuuuuuaacuaaacagccaaugauauguuuugauugacaucaaguggagaugggauggggaaaaauacugauucugugaaaauacccccuuucuccauuaguggcaugcucauucagcucuuaucuuuauauuccaguaaguuauuuugcucucacuguuuuaacaaaaacaacaacaacaacaacauaaaaauccuugcauaccuuuuucaauuggagaauuuuaaugauuuucauuuaucauuguaaaaccaaggacaauuuuauaacuuuuucguacauagcugcuacauguagggcaaucugucuuuaaguagggauaaauuacucuaaaacaaaaaagaauccuagauacuuuucccuucaagucaagcgucuuguuuaaauaaacugcuuguuuaaaaugaa

SEQ ID NO: 18545 - RNA, 1227 nt, Homo sapiens
uuugugagacaccaaaugcaauuuuuguuaguuuauuagagaguaaauaaauaaauaaugauaccgaacuccaacaaaacuccagcacuguccgugggcagcgacuauucagcccaagcuaucauucuuaauuucccugccaggcugcgacuaccggggugaaucagcccgcgccaggccccuuucccacccgccgcugcaguuaggacuuggcaaagaugcucgauauuugcguauuugugaccggucuuugcuuugugucugcgcugcaggugaggaggaggaagagaagcagaagagcagcuggaggccggcgguggcugagcagcccccacaccuuugagcgagccgccugccucuccaccggcaaggaagcccugggaccuccggauucgggcugccggagggccugagcgccagagcccaggacccggcggccgggggcgccauccccucauguucuggagaaggcgcaaaugugagcuggcgguagcggggaaagcccuccgcccccgccaggggggacccgggaagcccggccggcucugucggcagacugcggggauccccuccuccggccccgcccccacccacccccggccggggugccgaggcgguuaacccuacccgcgccgcagcgcacuugggcuagagcgccgcgcacccaauccagauuccagagccugccggcugggaaagauccggucucggggucggcuaugaucccgcagcggccaaggcagggcucaggccccgggauucuccccacacgcugcugcacuggcgcagccggucgccaaacuuuuucuccccaaagccagugcccccgcaguuacuuggcgggcagccggcagcccacucucggcgggaugaucugggagaagcgggcgugggacgagggggcugcuguuuugcagcccugcgaggcgugcagucggagaaguggucgggguuccacaccgucccugagccugcccccggccaagguggcccgacgugcugcaguggcuggcgcaggugauccgggcagcgcguccggcacuagucaagggggcagcggcacgggagggaggggcgccuuucucuuuucuccucccccugcagcccagcugcacugcgugggggcucuccaucuccacgcaaucagcaggcggaaucccugcccuggagcgcccuggcucuggacugcaccccccuaggguuuguccugcagauuccccuccccau

SEQ ID NO: 18546 - RNA, 2845 nt, Homo sapiens
uauuuugcauguucagguaauucauauguaauaugguaccacuaacauucuauaggaaauuacuaagcauucaucuucuacccuagaauacaaaaccuguccauugaacugcccugcuuaaauagauaucacugaaaauguagaauauguaauucuggacagauucauucuuccauagaaauuaaaacucaaguauccugagauuuauaguagaggcaggcucugcacguaugguagaguaucuggccuucauugcuacucauggucuuuccccagcuuuacuaacacacuuuccuaagauagugaugcuauuuccucuguagcucagugacuugacacaucacuaugcuuuuucucccuuuguaaggaaaacacaagguuagaguuuucaaauaauacucuuaaaauaaggaaaaacacagaaaggaacauuauauuccaucuggcucacaagagggaacuugcucccuagacuuacaguuacccuuauaacccagaaccaccauccaggagcccuugccuagaaaucuugauuccuugaaguuuagauugaagagaaugagaacccucccuuucucccaacccagagaugcugagcuuucgccucuguguuccuuaaccuauuuuccuguggaacaggcaucuuccucaaggcacucaccucacacaacucuccuauuagaguggucuuccccugcuaaaaccauacuacacaguaaccccaacacauucauacaggagguccagaggccauaccaugcauggcaaaaucauuuuuucuaccuuuaauauuuugguauuaaccuauauuuaguauguuaaaaagaaaccuuaccuuggugcaugugagaagguauguauguccaggguggaaggguaugagaugacacggcagugagcaaguguggucggucuguguugagcagccacacaucccauugccuccaggaucuuaucuggguccuuuccugucagucagaccuaucaaauggguaauuacaugugauuuaccuuuaaucaauuuucauauaauaacaaauccaagaaaaugcugugauaguuuuuauaguacgguucuguagccaugugcaguggggauuuguauuacaucuuguaauauaagacucuucuggacuauuauguucagaauacauucacauucaaaagccugggggagaauuuagggguuuuuaccguaaaaugcuuucaacuuugccguuagguuauuacguuuuuacauuaaaacauuagaaaaaaaguauuuggggaaguuuaaaaacugucccuaagcaaguugcaaaugcacccuacaaggcaugucggcccuuucuuaaggguggguacuguggagucgcuugcacggggucucuuagcauauuguguuuggauagagugacagaggaagcuacuugugauuuuucugcuucugucagauauuucuuauucuguuucuucuguagcaauguguacuucuaaaguagauaagcuucaggcaacucagaaaugcucugaauugcuuuauaaauucaucuagggguuaccggguuuccauuacagugggggacauuuauacuucuaaaaguguaacugaguacguuuauucaugcaagcuuuguuuggcuagaucauucuaaucaugcauacuuaccuuucauuuuagcuuaguguuggaaguuagggagugaagucauaggggaagcacacagggcucgauuccuaagggcaaggcuuccauugcccacugugcagauccagugagacccucggccuuaucugucggcacuggguacaaucagaccuuacuagcugaagaaaaauguuaaaauucauucgauagaucacuccuggccucuccuacucucugauuuauccugagcacuuuuucagcagcucucugcuucuaccaguccaugcuaucucaacucuguuucucuuuuccaaacuucauagccucucuacucuguuggaugcugaacuguccaggccugugcccucuuuucaguaauugucuuuuuagauugucacuuagugucgugaaguguucucuuucucuaacuuuuaacgcuuuuucugguagcaacuuucccuuuaaaguuuaucauucuuuuaucucaacuauggaccaacaugaauuuguuucagaaccaagaaauccaaucuacuugauuuguauaucaugagaguuggauuaccugccuuucagaaaccccaggcuucugaguuguccuaauuuggaaaagauguacccccccaaaaaaauuacaaugccuuuguuucaaauauuguucuuuuaaccauaucacauucauauuaggcaaaaauauuucuuguuguuuacuugaacaucaaauaucaagaggccaugaugacuuuaugcaugcucuuccuucugaacucuuauucaggaggaagcugagugcuuacagaugggaaaguauaguagcaaugaagaaggauaauuggauaguguuucucuuuggccaauauuucaaaauccugcagaaccauaacaggaucuuccagcuaaugaaucgagccccuugugcacaacugaacaccacauuguguuauuuuguuccagaauauuuuacaguuucuuuucuuuuguuuugucuuuuuauuucaacaaaaugaaaauagagcucggaaguaaguugugugagccgcuccuuucaacauuugcagaauuuucuacuggcugcaugcacccagcagauccuuuauuugugaauuuuaguagucugauugcugcuauggaaaugugauccaaaaucaugauauuuuccugugauaagugaaguucacaaggaagaaaucaacauauguuucuuuuucuuuuuugggg

SEQ ID NO: 18547 - RNA, 817 nt, Homo sapiens
gggcucugaggaacggaagugagggcagcggggagcggugggcgggugccgagggcggcgccggggcggggaggcuccgcugcagcagagcagccggcugcagcccuggccccuggccccuggcccugcgcugccauuccgcccuucaguuugcucucacugcgcuuucuucacucgcgguucgaagccccgcuuccaggcucggcacaggacggugcgggcgagggcgagccuaagccaccuucccugaauggccgcggcgagcacggcagagcugcgcgaggcgaccagagugagaccccgcccgcccucuccgcggucccuagccaggcgcggccugggguucccuggccccgcccggcuugucccaguucucuucuggcuucacuugcugggugaacuuaauagucccugacugggcaccgagcagucauaucccgcuuucugcuucuauacccccaagucgcgaugucaccgcacguucuugcccaguagcgcggggaccgccugcaggguggagauuccucucccggaugcuggccagggacugaaguuaaaaggccgcggcaagggagagaccccccgccacccgggccuacgcuuuccuuccugagggccaggacagaggguccugagcggcuccggcacccccgcacccccgcggggagugcugcugaacguuaaggcgcgcgccagcucaaggacuggcggcgcacauuucaccugccacggcccaaguguguuucugguguuguuuucaggacacacggagaacaaauuaauuuaggauuauuagaucacgcacugccuuucuggc

SEQ ID NO: 18548 - RNA, 24914 nt, Homo sapiens
uaggcuguugcuggccgcggccgccgcccucccccggcccaauggcguggcggcacagucagugaugugacgcucaggcuuguccggcccccggcucgcagcccauuacaccauccgucgcagcagucgcugcagccgcugcaguccgagccgacuaagggcgggaggcagcucggguggcggggcguggcgaacagcgcggccggauucauuccuuuggggcgcggagcauggaggagcugugcggccgcaggcggagcagggcggcccgggcggcgguggggacaacgguuucccuuugaaggggacggacaaagcccgagugaccagcggcggcggggaggacuaguccccgggcagguaguggcggcggcagcggccugccagggcucgggccggggccugaggugcccgcggaaggccugggcgggaaggagggcgccgggggagccgaaggcgggcagcgggcuggaggccacagcuuggcccaucgggaggggguuguggucgauggaggagauugggagggggcugccguugucuggaacagggagaggggaagguuguguuggggcgacugugguuugaggaaccugcggaucaucccuuggcgggggguggggggugaucgaaauggggcgggcgaaguuaaugacuaaaaggcaggcggauuuccugagagccgugaguaguuuuaaaggaaagagaaucuuucggggcacaguuuuggccuuagccgggguuugguguguccgaccuuuuuguucuuucucgaaacccggccucaggccuuccagccuggcgcccuuggccagcucuccugcaguugcaagaaagagaaacauuucugaacccgagucuccugccucuuucgguuguacucucccugggcgugugcaaagcaaaacuagaacaaagcuuggcugguuagagcuggaggcgagaaaacgggcugccuguaguguuuaaauuuuccgcacauggaggagacugccugcgaccagaacauuugggucucuguguauccuucuguauuuuucuuuaccaccuuuucuuuggggguggggggggugugugggauggaguagugccugaaguauagcuuuuauuccuuucuucccacagaaguggaaauuaagaaguguuuugccuucuucuauagaaaauuaaaugcugcuacuuuuuuuuucuuucucuaguuuggugcccugguugucagauguuggaaagcaguaggacggaacauacucuucgugguuguguauccguucuggggugcagcaauuaacauuggacuuugguuccugugacucuugccugugucgauagaguuaaacuggagcucugcuuugaaagauaaauaaagcacagccucucaacuggacauaaauggaucuaaagacagcaguauuuaacgcagcucgggauggcaaacuccggcuucucaccaaauuguuggcaagcaaauccaaagaggagguuuccuccuugaucucugaaaaaacaaauggggccacgccacucuugauggccgccagguaugggcaccuugacaugguggaauuccuccuagagcaaugcagugccuccauagaaguugggggcuccgucaauuuugauggcgaaaccauugagggggcucccccuuuaugggccgcuucugcagcaggacaucugaaggugguccaguccuuguuaaaucauggagcaucugucaacaacacgacuuuaaccaauucaacuccucuucgagcugcguguuucgauggccauuuggaaauagugaaguaccuuguagaacacaaagcugauuuggaagugucaaaccgacaugggcauacgugcuugaugauuucauguuacaaaggacauaaagagauugcucaguauuuacuugaaaagggggcagauguuaauagaaaaagugucaaaggugaguucagcuucuuuguuuuucuaaaugucuaccacuuauuuucaggaaguuugauacaucauuauaagcacugguguugaguaaaccagcauugacagaccuguuuugauuagguaagucuuccaguaugacuuuguugaguguuucuaugauguuugguaauagauugaaaaagugugauaaaagacuucuguuacucuguuaagcaguauuuucucucuuauuuggaguaacuuaaaauucuugggaaauggguuccccagaguuacagagcauguuagugguagcugaucugagccuuuaggcuuaugcuuaaucuacuugggaauaugguuaaauguaauacauuuuucuuagcuuuuuguuuuguuuuuuuuuuuuuuagaacaaccuuggaguagaaauuacuauauuuauugagucauggucuuguuuguucuaggcagucauuucacuuuuucugucagagaaggcuaggcuaaacugaccuggaaggauuaauaucaguggaaaggagcaaaucuguucccuuauucuauauuuguuuguggucaauagauaauccuuuuauaagaacaugcauuaaauauagcaagagagaaaacacauuuuuaaaacugcuucaauacugagagugaagaacaaggacuagauuaaacagauguggauuuguuggcuagcaacaguguaaacaccuuuguccagaagaagggcuccgguuuuugauuguguauaauuuuuguugauuguaauaaacuaaaagcagcaaaaaguaguuuagaauuuuuuuaacccuuaaaagcaacugccuugauagcauaauuuugauacuugaaaaccuuaacuucccuuacacgaaucuauuuauacgacagcaaaauaauucacuaccuaauuuuuaaaagccauuaaaauuuaaaaguagcauauagacauguuaaaaaaaaucaaacaguguaaauugguuuacauuguugguuuacauuugaauaaaaagucuuauuccugauuucuagaucucuaaugcgcugacaaccacuauuuacaguuuuuuauguguccuuuuagaguuggucuaugcaaauacaagcauacuugucuauguacaagcaugcuuguuuguguagcccuccgucuagugguugauuacauacuuuuuuaucuuuauuuauuuuucuaaccuuggaugucauucaacuccaacacacauagcuaccucauucuguuuuguggcuauacaguauuucauuguaugaauguacauaauuuaucuagucucuauugguugauauuuaggucacauccaguacuuugcuaauauaaacaaugcugcugugaacauucuugaacaaaaaugugucuuuucacgcuugugugagaauaacuguaguauaaauaccuguguucagaauugcuaaaucaaagugaauguacauuugcaguugugauagugucugccuuucagaaagguuaaaccacacaauuauggggcacuauauaguuacugagcauauuugcuguagauugugugaucuuuuauaaaaaugauacaagugugaucuuuuauaaaaaugauacaagaucauugugauuuuucugaauuuuuuuuuccagaggaaguguaaaaaucccacaaaaucccaguacucagggauaauacuuccaaagauauuucugaauuuugcauacugauauauguaugcaguuuuauaugcuguucuauaaccuguuuuuuagcuuaauaaauguuaucuuuaauauuaccaauuauagcucuuuaauuucaauagcugcauacucuucuacugauggaguuuuauguugcuuccaguuuuucaguaugauaaaaaauguuucuguaaacauucuuucuaauaaguguuuucauuuguuccugauuaucuuuagagguggcuugguagaucaaaugacagcauggcuuuucuuuuuucuccaaacaauuaucauucuuuugaagaaugcuuguuuuaagacaacaaauuacugcugaacuaaccauguuaauauugggaaugguuugaaaucauggcugcuuguuuagguuuguugaauuuuuuguuucuuuguuuugggcuuuuuauucaucagcuugauguagauauuauugauaaacucauauuuaagucaaauugggauauguuuuaaaagccuauguuauuggagagaugagaacugguauuacuuccguuauauuuuccaaagcuucuuuauguacuuguggagauauaguauaugagagaacucuaauauaaauagcucagauuuuuucagcauuuucuccugagaagcugugaacaguauuuaacuugauuaccuuugagcucuuucaaaacaauguucccuuuaucaccacuaucaucuuuuagccuuauaugugaggguaugucuguucucucuuuuggccaaacuuauucuaagucauuuuuuuccccaguaucaguaucuaauauguaugucuuuaaaaaaacuacauauaacaugagaaaacaauuucaugccaaaaauuguuuucucguaaccucaacuuuauacccauacacaugcauauagauauugucacuucaugugcagaauuuuuaccuuuucaugguaucuguuaauuuccauagugauucuucaugaauguugggggcagauuaaaguacauguucauccuccuccacucugauccugaagcuucacugcucauucucucauugguucuggauuuuuuucuauggguuaaugguaacaaaagcaggaaccaauugaaacuaaggcagggacacuggagaaggaugugauuuagcagcaagagaggauuuuuccccacuuuuuuagccccauucaaaaaguagaaaagauuaauaagacuagaguuaaauuagaauaauuccuuaggacauuuugugugucauucacuggaaaugguucugaggaaagaaaaugucaguacauugugcuuggucugcuuaaagauaaaaugcaugugacuucuacauuccauuacuuuuaaacaggcgguugauauuugaacauguuauuuaaccucuuuucauuacuuuuuaacaggcuauuggcauuuugaacauguuuuaaccuaagguggaauucacuaauugagagagcaguuguugagucccgcagugugccaggcuguuagacuuaggauauacaaagagcaauaagacaagauagccaguccuugauucccugcucuugaggagcucaugguuugauuggagagacagguucauaagcagauacuuaaaccacaguaugguaagugcaacaguaguacuuucuucuauuagauauuuggaaaugcuuuauccccaacaacuuauaaccugaggggacaaugguuuucuucuuuucccauggcauuccaaaaggggagaaaaucuuugauauauuuaggaauaccucuucaguuuaacagucauagcaauugaguuuugagacgggaguugguuccuauuuaagaaucuagacuguaaaucuguagugauuaggugaguccuucucagagcuaucacagugaucucagcgcuucaugguuauagucaucuuuggccuccuuugguucuuuuguuuguguuuugggguuguuuuuguuuggacuuagaacuuugcagauccaaaguuaaguccucuucaauuccacuuuuacacccuaauucuaacagaaauugagcagcuaaaaguucuugauucaguacuacagaccaauagaaaacgcuguaggcucagauuuggagacuggcucuagaagacauucuguccucauucaucagucaguuuagauacccaaaguaauuaaauaaauugguaauaagguaauuaacaugcacuuucuguaggcaaggcauucugugggacauuuuggagguuaugagaagauacgaggugucacauuuuuaacuucugaaggaauaguauaagcaauccaugcuauaggauuuuagagcggguguacugacuaggaaugcuucauggagaaaguagaaguuaaacagggcuuugaauuuugggguuuagaucuauggacagguugggguuuagaucugcagaaaguuuauugggauguggaucuguggaaggguuuuggcaguuuugaagguuuaggaaauggcauaaggaaaggcacuuugaagaauaugcuuggaggguccaggaauuggaaaguaggcauauuagaacuaaaaggcacucagggcugaauuuuaaaggacauuuaaucuagguacaggaguuggauuuuauuuuucaugccaguaaaaguuuuucagcaggggacuaacuggagugguuuguuuguuugcuuguuuguuuucagagaaacuuaucuaacugcauucuacuacaacacugugacaucuaaccgcauucuacuacauagucuuugaggcuaaagaccuaguguuuuuaccccaugcauuaggaagaguaucuggcccuaaaugagcuuguugaguggacauguuggauuuaagagaggaaagauuauaagcuccuugauggcaagcacuauguuuuauaggccuuucuguagggaaauaaauacaugcaugaagacuugaaguaacaaaguaagacaguaguuggacaaaaaugaguagcacagguagaauauagggguucagaaaagggagaaauucauguaggcauguggcaaggauugcuagcauuaaaaggguuugagagaacuaguucagacagauuauuugccuuuucauuauggaaauuuucuaacuuacacagagagaauacauugaaccacuauguauucaucaucuuacuucaacaauuacccauuugcuaaaguuuaaaaaaaaguuucuacuuuccuuuuguuuucuauaguaguuuaaagcaaauccaaggcuuuauauuauuucucucucauagaaugggcauuuagaauauagauguauuuuagucaaggaaaugcuaaagaaaaaucuuauuuaauuccccacuguaaaugcacaagaaucucaaaugagaaaaucucucuuguaaacuaaaaacuguugguauucagauagacuaagauaaugauugaugucauucuagguuauuuuaguauacuuuaguacuaucugaguguugaaagcugaaguucucuuuuccuucuugacuuugaaaacucuucucagcuguugguuaccucagcacaccuacuuacagagaaaaauaaaagggggaagggagggacuuauucuaauauaucuauauuuauuuugauugaguaauguuuaaauaacuuacuaguugaagucauuaacacuuuaaucccaaauuaugaaguuacuccuguaaguugcucuguguucauucuuuucccucuuguauccccuggcacacuuuucuguguccuugggaagaauuaguaucuuaguuggauaaacuaagcuguagauggugugcaaauugaguccaguagggaaauauccaugugguccuuugucccuggagauuggauuuugaacugugaauccucacagaauugagcaguuuggugagaaugaguagauccugagcacuacugcuguucauauuguucguggcaguaacaugagcuuaagauagaaguuacguuucacuuacuggccuucggguacaauguaguuccuucacugguucauuuuuuaucagauuuucauugauugguugauaaaauauguuuguuugaaauaaaauucaggaaacccagggcauuacauagauuuaugcuguugaggcagcaggaauguaugugauggaagauagaaguggaagagauagggagagacccagaugaaaaagucaguuggaugcaaaucugaucagaacaugucuuccuucuuuuuuuccucccuuugggaagagcugugauugaacagggagucugugaacuagaggacagggaauuauaauguugaaguuuucugucauuagaugaguuuuuuacacauaauuaguugcuuuuaguccucaucccuuagcuccagugcucuuagccuugaaaauucuacuuaacaucgagacucauuucaaaugcaauucuucaucucccucagguuauaagaaugcaucuuaccucuuuggaugcagauauuuuuuagcguuuaacuuuguuguaagcucaaggaccuuuauuguuaaauuucuguuuguucuuugcucagugccuuauacaaagaauuaaugaagggagggcacauaguaaguagucuuggcacaauuuaucuucuuuuuuuuaauuuccuuuuuuuugaacuucuguucuugaguaucucucaugauagacuacacauggggaagggaaacauucuaagcagagaauccuucuucuagugcuccuuugauacccuaaguuguuuuuuucccuuuaucccuucuuaccuccuccaucaaccuacaccuguuaguuauucagggaauaaaauacuuggaaucagcauuauugugcaauugaaccacacacccuauccucaucuuacaaguggaccaccucuguacucagcccaaccccagcuacaaaguugaggaaggaauggguuggugccaagcauaguaggcugaagaaagagagaugaggacuguuuuugugucuuuccaaauaaauguauuauaauaaaagacccucuaauugcugcuucuaucagucaacacuuauacuuucaccaaaaauauaauauuuuuauuuuaauuggauuuuuaaaacagccuuauugagauaaaauucacaaaaccacuuaaaguguauacaauucaauggcuuuucaguauguucacgggguuauacaaccaucacaacuaucagcuuuucaucacccccggaaaaaaucucauauccauuaagagucacucccuccuaucccuccucauuccccugaaacugcacuagucuuaggcaaccaguaaucucuuuucugucuuaaguuugccuguucuggacauuuaauuuaaauggaaucacauaauauguagucuuuugugaguugucuuguuacuuaguguaauguuuucaagguucauccauuuuguagcauguaugagugcuuuucuuuuuauugcagaauaauauuccauugaaauagauauaucacuuuuauucauucagcaguugaugggcauuuggguuguuuauacuuuuuagcuauucauggauaaauucuucuguggauauauguuuucauuucucucaggcacauaccuaggaguggcauuauuggguuguaugguaacucuuuuaacaggaaccguuaaacuguuuuucaaagcaguuguaccaguuuacauuccugucagcaauguaagaagaguuccaguuucuccacacccucuccaacacuuguucuucuucuucuucuuuuuuaauauagccauuuuaggaaguguguagugauaucucauugugauuuugauuuauauuucuccaaucgcuaaugacguugagcauuuuuucauguacuuaauucgugugguuauuggcucucucugucucuauuuucuuuggaggaguuucuucauuaaccuuugcauguuuuauaacuggguuaucuuuguauuacugaacuguaagaguuguuuauauauucuuauguaugucuuuuaucagauauaucauuugcaaauauuuucucucauucuguguuuguuuuuuuuuuuuuuaacuuuuuugauggugguguuuauaccaauuuggauuuuuauuuuacaaacggauuuuuaaggaaauuuaugugucacuuauauaaugucuuacuuaaacaagaaaauuguuaggaauagacugcagaauuuacugauacuaugccauuuacuaugcaggaacuuuuccauggaugaaacuuuguaaucuaauuguaaaacacaaccccuuccugcuuuggcauaugguuaaacuuagaguaaagaggaaugauacaauuuuauuucuauaugguguaaaacagggcugugaccuagcccuccuuuuaaauuuauguucauaugacuugauauugcuauuagauauauuagcuauguggcaaguaucuauauagcaaacaagaaaauaagaauccuucucuauuuucuugcuacucaaggaccagcagcguagguaucacuuggauccagccuagaugaucugaaucaaaaucugcauuuuauuaugauucucuggugauuuuauacaugaaaguuugagaagcacagcuuuauuugacuuaugcuaaacacacacacaaagcuugaaauacaugaggaauuuacaaacggcagaaucuacuguguuuguuaaauauuuugcaguccuuaggaggacauuuuuguuuuuuuauaaagagcaguaaauucugucuacuccgugagggugguuuagaaacugacuugauccuggugaaucuugguaauuuuaucuaaauugagauauuuauauguuauguugaagcucuuuuaugauuuagaugguugguugguaacaaucacuugcccuuaucaaacucaaaacguuugguuuggacccagauaauucuuaggccucuaacuaguucuuccucaaaauacagcuauguuuuuggguuaccuaauuugaaaaaaauguugauucuauuccuaggcaccuaagcuucacaguugaacaugaauuuuuaaugucuuacucaccugcuauuaaaagauuacaggugucuuuaaaauuaacagcagugaagauuggcacuucagaugcuucuugaggaauacuaccacccuuuaaugcacgagcacuuaccauaguuuccugaccuuaauauucaucccagaagcaucccagugaaaauggcacuuuucauucuuccagauuuucuuugcauuguuuuuguguuaaauuaugaauuugaaaauuaauguauucguaucauacuguuuuagcuuucuagagaaaugcuuuaacagaauuaauacuuaauguugugccacuaaccggauuucuaagaaaugcccauuuaacaaacaugucuuuugagaaaucaugaaauuuuuuuuuuuuaugaauucagugccagaauauuuuuuuucuccaaaugaacuuuuucuuaaucaggcauugagaauuguuuaauauaauauguuuuucuuuuucucuuccuuuuuuuucuuuagccaaagguaaauucauuaaauuucauugcugcauauccuuaauuucaucucagauuccugguaauauuuauuuuugaacuuuguguuguuuuauuguucauugucuuucucauucugagaaugcgaaaagaagacaugauguggagauggaaaaucuuugggaaguacgaucgcuguauuaugggaauguuuuuaaagggccuguguaacccagagaaaauucuugagcuaaaucuauaguacuuggcauauaucguuaugcaccaaaacuuuaaaucaauuauguuaacuagcaaaaaagaaaauaugauuuuaaugaucuuuggcauguaacaguacauacuagucacaagacccugguaacucacuuuuuaaauuuggcuuguuauacuuuuucacaaaaaauuacauuuaauacuuauagcauaucuagcacuugaaaaaacugacauagcaaaauauuuacgguaaauuuaacaaacugguuaucauuuuauaaagugcuuauacauagaaagccagauuaaucucagaaacugaaacauagacauggcauaaaagaaaauaaaguuuauaaacagauaugagaaaauauucuauuuaccaaggaauagagguaauauaaauuaaaaaguuaauuuuaguaguagaaagaauacuauaaaguggaacuuuaaacaauuuuuauaaucccauugguagugaauugaagaugucuauuaagccaucacacauuugugauucuauuuuagguaggcguuaauuuuuuugucauuuguuuauugacuuauuuacaugcaauaaaauucauacuuuuuaguguacaguacuguaauuuuugacaaacauauacuacgcauuuauuaaagguaagaacaaaaauguccuucaugcuccuuugcauuaaaccccucuccuagcccccagcccuugccaaucacugcucuguuaucuguccuuauaguuuuuuaagcauuaauuuuaauaguaaaaauucugaagcagugcagauguccaucaacggggaaauguuuauguaauguaugacuugcucccuugcuugaacuuucaccauaaaaccauuaagaaggauuauguagaaucuguguaguuacagaaacuaugcagacgauguaauaacacaugacagaaugcccaagauguaggugaaaagcaggaaacaguuauauauauacugauuauaacuuugucaaagcauacuauauaaaaagacuuggagaaaugacacaaaaguuauaauugcuuuaagaucaugccuuuuuuuuuuccccucuguuuucuaagcuguaaguaauaaugcucuaggcuauaauuaaaaaacuuaccuuuagggccuuccagggcagaaaaguguggugguuauacacuuaaccuguuagaguaauuaaaaagaucuccuucuaggauauuacuuuuugaacuuauuuugucugcaaaagcuaagauugaauuacuuuuugugauaucaaauauuaaaaauuuagaaucuaccuuagcuuuagcagguugcuaguugcuucugggauauaagaaauauaggaucuguauacuuuaagaauagacuguuuagguaagaacuuauuugugaagcaguagcauuauacuaguguaagguauuauaauaguagauguuaugugaauaauuauuaggaugacucauauauuuauucaccaggcauucucacaaugauaaaauugauaugauaaaaccaggaaaaccucuuuaagcaguugaaauuucuagugagauuugaaggacaagaaguuaaaaugguaaagaaggaagugcuuuauaggaaaaucaagaacagaggcauagagguggaagugaacagggcuguuuguucuuggugcugggagaaguacuuaggauggaauaaugugaagcauaagcagaauuucucccuugugugugggagaugcagaccaugucuccggguuagagcagguuuggcaaacuauggcccaggguucaaauccagcccaccccauuucaguacugccugagagcuaagaaagguuuuuacauuuuuguaaugguugagaaagaaaucaaaugaaaaauauuuuaugacacaugaaaaucaaauuuuagaguacaaaaguaaaaguuuuguugggaaacagccauauccauuaauuuaacauacuaccauagcauauuucaugguacuuggcggaguuuagugguuacaacagagaccuuauagucuagaaaccuaaaaugcuaccuggccuuuuaccggaaaaguuugccagucccugaguuagaugcacagugaaucauucauuccagagauaaugagaaaugaagcuaaagagauaggguagggaaauauuuguuagucuuuuaaaauacguauccuugaauauccaauauuaaacuuuacugcacauaauguuuucugaaacuauagauuucuuccucauugcucucuccacacagauagugcuuugagaaucaaugauguagaauuuugaaggccaucucaaagauugucugcuuuuccuuagagaaauugugaaaguuuuuugaguuggaaagugaugugauugguugaaguucuauuaugagguuugguuuuauauuagauauaauuuauucauugagguuuaauaugacuggcauuuaaaauaugaccuuagaaaugaguaguacacugaauuggcaguugggagacaggaguuuauguuuucccacuaaauucucuuuucuauuuguauguagaaugaguuuaucaucucuaccuugcaaaguuauuaauauaagauuaaaagggggcaacaguuaaauaaaaugugggaauauaaaaaaaugcuguauucgcauacguaucccuuuuuucauuaauuuuuuuuuuuuacuguuugcuucuacuuucucuaauuuaauuuacuguuuuuucuuguaacuucuuuagauggaaacuuagcuauuuaaaaaauaagccuuucuuuuuaucuaauuuauuauuuagugcuuuuuaugaucacccaguuaaaaaaauuuucugauuuucauugggcuugcuucuuugaccgacgaagcaagugaguauuaaaaauucaaauagacagguuuuucuaguuaucuuuuuguuuuggauaucugacuucauucauaaguggacuuagaacauacucagugacuucagucccuugacauuuguugagacuugccuuacggccaagaauauggucaguauuuggauaugcucccuguaucccugggggcaaaauuguuuucuaugguuguugagugccauguucuuuuauuuaugccaguuaaaucaaguuuguaauguucaaaucuucauccuuacugguuuuggucuucuaaacugagaaagauauguuuagauguacuaauguuugcagauuuguuugcuuuccuaguaguucugucgauuuuuacuuuacguaacuuaauucuauguuauuaggugaaaacaaguuuaaaauuauuauaucuguauauuuugaauuuuuuaacauuauaaaauauuuccuuuuuucacuaauuauguauuuugcauuaaagucuacuuucauauuuuaauaucagacagcuucuuaauauuuaguuuuugcaaagggcauuuuuuucccaaacuuucacuucuaaagaucauuuucuacccauauauuuaaggugugucuuguaggcagugugucuugaguuuucuuuguaucuucagucugacaguuuuugucuuuuaaguuuuugucuuuucuuuguaucuucagucugacaguuucugucuuuuaaauguuuaaauuaaacauuuaguuuacuuacauuuaauguaauuacugauauuuuuggauuuucaucuccuggguacuuuucugauuuuuauuuguccugccuguuuuguguuccuuggucuucuuuuuugccacuuuuggauuauuauuucauuuuuuucuauauguuagagaaaauguaguuaugugcauacccucuauuauuuuaguaguuauucuagauagcauuacuuugacuuaucaaaggcuaacauaaauuucuaauuuuaugucuuuacaagaaagagaucuuagaacacguuaacaccaauuacccuccauaauuucgugguauugcugucaaguguuuuauuucuauguauguauuucaagcccuacaagauauuauuuuuaaaaucaguauuuauuuagauguacucacaaauuuacccuuuuuguugauguuuuugccuauaucuccaggcuuccacguggcucaucuuccuucugccuaaagaacaccauauaguauuuagaucugcugguaauaaauaucuuaauuuuuuccuuuucauuucuuuauuccugaaaggguucuuuauuugacauuuauucuugauauggguauagaauuuuuucuaaguuggcaguuacuuuucuuucgugcuuuuaaauaucauuuacugucuccuaguuucuguuguuccugaugaaaacuuugcugucagauuguugcucuuuuauagguaacuuccauucauucucuuguuuuaagauuuuucucuuuguccuuaguuuucagcaguuugcuguguuguaugucaauguguuuuucuuuuuauuuguccuucuuggaguuuguaaaaccuacugcauuugcaguuuaagcuuucaucagcuucugaaaauucuuggacuuuaucuuuucuuaaauauugcuuugggacccauuuuuuugcucuagaauucugguuuugaguauguuaacaauauucugacguuguucccucuuucucuuauagucuccaucuuuucuguucuuuuaccacucccugcuucuuucuguauauuuucaucguauuuaccuuccaguuacuaauucucuauucagcuguguguaaauccacuuuuaaagccacucaccgaguuuuucaguucuagaaugucuacuugauuaguuuccaguuuucuguugaauucucaauuuuaaaaaacuccucgaauaugcuaagcauaguuauuauuugaaaaucuguguugauaaacugcauuaucugggucuccuguugggcuuuucugucagcucuuuauuuccauuguuuuuuguguuaugguuccucauuuucuuuucauuauuuuugauuggauaccaagcauuacauaugaaaaauauaaauaauuugaacccuaauaugauaauaucuuccucuaaauaguauuuauauuugcuucuggcuuuuaauucuguauacuagucauccuggauuauuucaaaucaauaaugagaugaucuuaaauucgauuuaaguuuuugcgauagcuagucuauuugcaguuaacuuuaacucccuaggguuaaaguuggagguuuaacccaaaguguggggaauuuucuaaguuccuuucuuaguaggcuguaggcuccacuuuuccccucuaucccugcaaggcugucacuaguucugcucaguguuucagcuagcucuuccagaauugguggaggccacugugggaaagcugccucaaauucuggacuugaccucucuaguuuuuucuucuccugcauauuguccccuuguuaugucuuaaauccugucaagcagauuuuuaaaaauaaauuuuucaguuuuuuuaguuguuagugggagggugaucauguuacagguaucucugccauuacuggaugugaaagucuuccuuauuguuuguuuuuuuaaagcuacuuuuuuucuccugguauguggguguauucaaaauaaauauauuuuguauuuuuucgauaaauacagaaauagaguucauuuaauuggcuuuugcuaccuuuuuuuuuuuuuuuuuuucugagacgaagucucacuuugucaccaggcuggagugcaguggcaugaucucugcuuacugcaaccuccaccucccagguucaagugauucuccugccucagccucccaaguagcugggacuacaggcgcgugccaccaugcccagcuaauuuuuguguuuuuaguagagacaagguuuuaccauguuggccaagauggucuugaucucuugacuucauaaucugcccaccucagccucccaaagugcugggauuacaggcgugagcuaccgcgccuggccagcuuuugcuacauuuuauucuugauuuugugcuacucugaauagagaaaagugccaucuaagccauuucuuuauauucagauuucucuuauauugccuauuucuuagaaaaacauggggaauaguagagguccuuaauacaaaagaguguuuaaaauauacuugguguaguagucauguuuaauugaaauuauuuuaaacaaaugaacaucgauagucagaaguucugggcucuuucagugcuugguuagcuuacucauuguuaaaacauuuuaucaaacacuauuucauuguagaccauugaaaucuugggucagaauaauuauauaguccuuguagauaucauagaagacgaaacaggauaaacuuguggaaagauucaauauuucuuauaauaacuuguuuuuuucuaacuuuaguuacaaaguagauuuauuugaaguauucagguuuaaaauacuuucugguacacaugcuauguugagcauccccaaagccacccccaaauuuggaaguaacucaccauauaacuguacucauagguaagauuuauuacuguaaugucauaaggacaugcagcugaauuaugagggguaaagccgcaggugaaguguagagaaaucuuuguguagauguuuuuaugcuuuguuccucuugugaggggucacauagagcauauucuuccccaguaauguaaauacauaugugucauguuucuaccaaggaaaacccaugacagacccagugcucaagguuuuuacugggggcuggucauguagguacccugugccuagcucauacccaaaauucuagacucccagaaggaaaccagacauucagcauaaacugcauuguuucuacauacaguuuagguacagugagauacccuuaucauuuagggaaaguuuuagaucaguauagagaacuauuuaccagccaaguucccagcuaccagccaaagguccaaccuugcaagaaggucuuucuaaggauagcagucucagccugccaugcuaccucuuuucuacagacaugccuaaaaugacugacuguugaaauuuuauguaaacauuguauguaaauaccagaggucggcaugauaauuccuauuuugacgauuaguaaaauguuuaucauuaaacuuagcuaaaauaccugguguuuccgaugucuuaauguguuucauacaggcuuuuacuaaugugccagugccuguugucaguuuuaaucugugugugggaagaaaaggacaguguuagaacauuuaguacagcuauaaagaauguuuaaaaaguuaaauuauaauaggaaauaauccauuaugaaaggacacuucagauaucuccuuuuaaaguucauauugaaccacccgcauauuuuucagauuccauggauuuguuuuucuuacgagagcuuuuuggggaaaguccuuuguuaccaagaauuuuggcuaagacaguugaaauucaacuuggcaaucagaaauaaauauugaaaaaauaauuucugacuacuauuagagucaaaaugaagaaucuuagauauauuaaagagcagucuggccaggcauuguggcucacaccugcaaucccagcacuuugggagacuaaggcaggagcauugcuugagcccaggaguuuaaaaccagccugggcaacauagcaagaccuggucucuaaagaaaaaaaaaaagaccaauuccuuguuuauaaauguggaaacugaccuggaaguuaagugacuugucaguaaaauggugaauagcugguuauuuguauucuaccgauuuuuagauaauaaaauaugcacuuuaaaacauuaaugaaaaauacgaagagaccauggauuaguuugaauuucuucuggugacuuuggaugucuuuuuacaccuaauuuggucaugucauuuauucaauaaguuuaauaucagauacuaguuuuagguacugggggaauuuuuuuuucucguuuguaaaccaaguauguccuacuuaggaacuuaaagcuuccugcuuuucuuuagguucuaaagugcauauauauauuacauuauauuuuggucccucaauguauguuauuucuuuuuuucucucucucuuuaagguaauacugcauugcaugauugugcagaaucuggaaguuuggacaucaugaagaugcuucuuauguauugugccaagauggaaaaggaugguuauggaaugacuccccuucucucagcaagugugacuggucacacaaauauuguggauuuucugacacaccaugcacagaccagcaagacagaacguauuaaugcucuagagcuucugggagcuacauuuguagacaaaaaaagagaucugcuuggggcuuugaaauacuggaaaaaggcaaugaacaugagguacagugauaggacuaauauuauuaguaaaccagugccacagacacuaauaauggcuuaugauuaugccaaggaagugaacagugcagaagagcuagaaggucuuauugcugauccugaugagaugagaaugcaggcacuauuaaucagagaacguauucuugguccuucucauccugauaccucuuacuauauuagauauagaggcgcugucuaugcagacucuggaaauuucaaacgaugcaucaaccuauggaaguaugcuuuggauaugcagcagagcaauuuggauccuuuaagcccaaugaccgccagcagcuuauuaucuuuugcagaacuauucuccuuuaugcuacaggauagggcuaaaggccugcuggguacuacuguuacauuugaugaucuuaugggcauacuuugcaaaagcguccuugaaauagagcgagcuaucaaacaaacucaguguccagcugacccauuacaguuaaauaaggcccuuucuauuauuuugcacuuaauuugcuuguuagagaaaguuccuuguacucuagaacaagaccauuucaaaaagcagacuauauacagguuucuuaagcugcauccaaggggaaagaauaacuucagcccucuucaucuggcuguggacaagaauacuacauguguagggcgguacccuguuuguaaauuuccaucucuacaaguuacugcaauacugauagaauguggugcugaugugaacgucagagacucggaugacaacaguccccugcauaucgcugcucuuaacaaccauccagacaucaugaaucuccuuauuaaaucaggugcacauuuugaugccacaaacuugcacaaacaaacugcuagugacuugcuggaugagaaggaaauagcuaaaaauuuaauccagccuauaaaucauaccacauugcagugucuugcugcucgugucauagugaaucauagaauauauuauaaagggcauaucccagaaaagcuagagacuuuuguuucccuucauagaugauaacuugacuguauuuuagcacuguuaaagcacgaauugguaacaguuguuucauaaaugagcacuguugugauaacaccagcauucauuuagcuugauugauaucauugugcucucauuggcuaaagcauuauaagcaucaaauuuacaacauugguuucccaauauuuaauauaaauauaccauauaauauauuguuugugaauuauugagaaauguaacauucaaauuucuaaaauugucugccaaaggcuuauucauucugguuuuguuugcuguuggguguuuggggcagaguuaaccauuucuccauggugucuuuauacuuuacugguuugugaauuuuauacaauugaaagucuuuuuuucuugcuucuuucuucucuucucaaguuuccccccuguuucuacuuuauuguuuguccuaaccauuucuacuacaguuuuuuccuuauggacccauacuagguuguacaaaccuuaaggacucguuaccauuugcaguuaccauaagugcuuuaucuucucuaugcacaggcuuaaacuugacuguuguauguuagcauauuuucuaugcagcaguuggucaacuucaacucaaaacacuguuuucuuauguuuguuacaaacuuaauuuuuugaaaguacucuguagcaugacaauuuuuagagcugcagguuagcuauuauagcucaagcuuuuuuguuuguuuuuuucuucacuuucuucacaucugagguuucuuucucuaauccacugaaauuauugugugcuaaauuugggaaacagaucuauucuaacucauuaacccaguugaaauuuaggucugucaucuuaauauaucaugcaguaaaaggaagaaucuuuuuaaagugacccaccuuucaugcugcuccagcauuguccugcuugugcugauggugugauuagguguagagaauuugcuuaaauuuaacuucaaaguucaucacacagcuuaaugagucacauugaaauacucaguaauugaacugcaaaucacuuuuaguuacaaaaagagcuaaagcaugucaguggcaugaugcuugccaagccagaucuaggcaucuaggauaauuaagguauuuuaguaugcaauuuacugccauaauaucaaaggucaguaacaguguucuuucuuucuucaagcuuauguauaccuuuaaagauaacuugcaugaauuacuuugauuacuuuggucucaauuauuugucaccccaguuaaacaugaaagguugcagugcuuccuguucccuuacuggaaguuagcuuuuucuuuucucuuucuuccuuucuuucucucacucuuucuuucucuuucucuuucucucucucucucucucucacucacucacucacagauuugcuaaugccacagaaagggcucuuuuaacuuaagauaagugaaaaguacuaaaaaagauucagguaauuaucauucagcacuuuauuguaauucagaauaaaauuuaugauggcauauuugcccugcaaaugucuuaaugaaguuguucucaauaaaaagcuccuuauugauuugagaaaaacucaguuuaccugugaguucaaugagcuggaucacucacuuggauuuuuguguugacauuuuauucugaggguugauguuacacuauuuaaggagucaucaaugcaaacagucacauuagguaugucaucaucuuuagucaguaaaaaccuuguaaugaggaguaguaaauaaacaagagaacauuagacuuuuugguuaaauaauugagauuuaauuuuuaaaagauauucuuacucauuugcuagguuguaaauuugauuucaccauuaagaaaagguaaauuggauauaaaugaacgaucuccaacuuuuugaugaagagguuuuacuaucucucacugugggaaaauuugaugaaauauuugaacugucacauauauuaagaauacuuuaugauuuagaccaauauucuagaaauaucaaaugucaguaucuugaaaucaucugccucuaacuuugugguauaagaauuauauaugaauaagcuauuauuuuuauaaaggaaaacuuugccauuauaguaaauuacauuaguugaucucgauaauuugaggauaacagaugacaauugaauuuuuaauugauuuaguauuuccuccuccucuuugggggcugggugggagggcuuacaugcucuuauagugaggcacaucucacuguuuugcagcagaauuugaauugugcaacuccuguguaaaguaaggauuucuuuaaauagcauuuuugcaccaguaaaaauagauaacuuagaacucagucuugauaacugaaaugacuuauuucacuuagaauacauuucucccuucucugccaucuccacaaaugccauugggagguuuugaaaaaccaguuaauuuaauagcucaaaauugucccugauuuuauuuucuuuuagggaaaauuguuucauaaaugugacacugauaaagccuuugucagaaaguauucucacaauuaugagauggauuauaauaaaauacuuaaauuuguguuauuuuuugaaccacagaugaguaaauuuaauaaugaaccaauuacacucuugagucuaacuaaacuguacacuguagcacgguguuauugacuggaguuaauguguaaguuauuaacauuucuaugaaaaugcccuuuuggggccuccugaauuuuagauguuccacuguuuugaucauuucuauaaaagaaauggucauuuuacuuagaugccagucuacuuuauaaagacaaauggauuauagacuuaaaaauagucauuuuucuuauucauaaaucugacaggcauaaacccaaaucaaagauaauuuggugcccauuaugaauuugaaguuaagugauagcucacuuguaaagugacuaccuuaauguguauagagaccccagucuacuauuauuugggaaaauuguuuagguuauaugggaaaaguagcucuuuaaaaaucauauugcccaacagaaaccuuaggcugaauuuacagguaugauaauuuuuguaauuaauuuucuuagaauugugcaggcuggaugagauaaugacauacucuuuuacacuguaacagcagcauuauugccuagaacuuuaaccauuuuagaguuagauacuaaggaaacaaacuaauuggucaucaucauuuucuuuuuuucuuuuucuuuuuuuuuuuuuugcccuuaugugucacuaaacaacuaguuucucucccuuuugucaguucccauuguguauuuuuucaaaagaaguacuguauucggaugccagcuaauaaauugucacacaauggaaaaucauaugccacaacauucauuguaagguuuaauaaaauuaaauuugcaccaaauuuaaguguauucuuauuaacucaauacuugauugguauuauccuaaugcaaaugauaguaaacuccuguuucagaaaaaccuaauugauaauuuguggccaguuaaaacuuaaaagauagcauuuauuguuaauacuucuauguaaguaugauuuauguacaguuuauucuaaauuuuuuuucuaguagagaucacagaagcuaaagauauggggagacuuuuguugucaacugcaugagagaagggaugccuuuaauuuuuguuuuuuaauugguuugcugugaucagaaguauaucauaaauauauuauuaugaaugcaaauuuuauacguuuguuuuccaucacuuuucauuuguaaaaucuaaguaguccuuguuuuuuuuauguuuaacuugccuaauacaaaaagcucuaguugagucagaaaaugaauuggcuguaauuucuaaacuccaagcauaaauugaaaucuccaguuuuauggguuuuucccuuuugaauuguuaauaucccuuuuucaugacaaguauaggcuuugucuuccuuugaccgggcccuuuuaaacauuagucuucuuuacccuuggucuugugguucuaugguugucugcacuaccaccaccaauauuuaggaggacucuuaccaaauuuaucaguaaaagaauauuguauguuuaaggcucuaaauaagaaaaagucuuaguauguccucaagauacucuauuucuucaagauacuuuauuucauuuuuuuaaucucuguacuaguggguagaacguucuuuguugagaaguuuggggcugugggaguuaagugaagucacugauuccuggguuccguguuacuuuauugcauguuuuuuuguaaagcucuuaaauaagauuuuaucucauaaaauuacagcuuuauauaauuaugucaauuuaauugauuuuuc

SEQ ID NO: 18549 - RNA, 13572 nt, Homo sapiens
cuaaggaaagcggaaacauuucuagguccgagccagcggccuaacuggagugugcgcauucgaccgagcacagacacguugcccaccgcuccucucccgaggucuguagucgcggagaaacacauguugcguuacuaacguucagaggucugcgacagcuucgauuugaaugacuagccgggaacaccaaguuucacuguguaauugcgucccccuacuccggcgccuccuuugcgacgcucccuggagaaaagcacgcccacugcacgcgcucagucgcuacuuccgcucucgagugucuccaagcaagauggcggaggagccgcagucuguguugcagcuuccuacuucaauugcugcuggaggggaaggacuuacggaugucuccccagaaacaaccaccccggagcccccgucuuccgcugcaguuuccccgggaacagaggaaccugcuggcgacaccaagaaaaaaaguaacugaauuuauuuccgggcagagaggcgggagguucagauugcauccgaguagggguggcggccaguaaagaagcaaaauuuagaggagcgccuguccuagaccugcauuuugaccagucaucagaagaaaagaaguguacuuuuugauuuuuaaggccuuuaaguugaguguuaaaauaccaucucugucuaucgguguagggccugauacuuggcugccacacuuauuuuuauacuguauuuuuuugaguuggccagacugcgagcucuuugaaggagggagggagcugaguggggcggggggaggggggucucgguaauuccagguacuuaacacaggagcuaauuauuugaguaauguuuuauggugguagggguggucauuggcaaagccuggauuagaauucaugccuuccaacuuaacucgcuuuugcuuuuuucccccucccaguugguugugaauucacuccuuaaaccaaaaaccaaauucuuaugcagaaugaagacugcuaagggaaagcuaaaggcauagauguuaccuuuuuaagaaacacauuuuggaaccuuugugaguuauuucauugcuugagucagcuauccucaacccuuuauugcuugagaauguuucccuuuguaaaagagauugcuaaaauuacguguucuaaagcacucuguuuagaguuagaguugccuaugggaaaagcagcauauaagcauccucgauucagagaggcugauuucguccuuagacguuuuccccguucugucuuaagaugacaguggucucuggccgggcgcgguggcucacuccuguaaucccagcacuuugguaggcugaggcggguggaucaccugaggucaagaguucgagaccagccuggccaacaugguaagacuccaucucuacuaaaaauauaaaaguuagaugggugugguggcgcgcgccuguaaucccagcuacucgggaggcugaggcaggagaaucgcuugaacccgcgaggcggagguggcagugggcggaggucucgccauugcacuccagccuggacaacaagagcgaaacuccgccucaaaaaaaaaaaaaaaaaagacauuggucucauugcuuuuucuucaacuucugcuacuguggaggauaauucucucccaagacugccccccuucccacuuuaaaucagacucccauuuccaccugaugcacuauaaguauuuccauggauagccacuggaaucuuucuucaaaagaauuccgcagguuuuacaguguuuuguugcauuuuuucuuccaauuuacuauaggcaagagcggacguucggagauucguuuuaaggucuaacagucuuagucaaaacuuguuacuugacucugaugauagcugugcaaaacaaaagcuaaaaaaaauggcuuacaaucuaaauauugcccgagggcauauuuucuuggucuggacaguauuuuuuugcaaauugaacugucauuuaaggaugagauuuuuauuuucuggcucuuguuagcauuugaguuugccucuccaauauaaaacuuaguuucuaacuauuccuaccuugugcuugucauuauuuguugaggauaauaugaugaaagcagcuuaacuguuuuguauccucagccuuuguuaaucuacagaagaaagauuguugaaacagaccaagguuuuggcacuggagguauguuagguuuccuggggaguaaguguuucccuaguugauucuaauguguauccggguucagaacuacaagcaaaucaccuuuaaaauuaaaaagagagggcagcuauaauuaaauuauuuuccuucucugguuucucacugucuuacacuucauccuugguagcauaacucaugauauuuccugcuucacuuucuggaaauguuuaauugaauuaaucgauuuauugauagccccaggggauuugagggagcagugaaaggagguaugaaagauaggcuaacuaaaaucccacguuaucuccaaauucauuccuauuccuaagauaacuggaccuaggauaauuaaguaguucuuuaguaggaagauaaagaucauguguucuagaugcguucauuccaggaguaaacuugaauaaaaugaccucugaucuuuuggccccaauauuuaauaccuaaagaauggagcaagaaggguguaauagaauagaguuaacuuuagggggcagcaauacacuguuuugcuuucaaugugucuugcuuuuugacuguagauuuuuuuuuuuuuuuuuuugagaggaugucucagucugucacccaggcuggagugcaguggcuuaaucucgguucacugcaaccuccgcgucccggguucaagcuauuccccugucucagccucccaaguagcugagauuacgggcaugcaccaccacgccuggcuaaguuuuuguauuuuuaguagagaugggguuucaccauguuggccaggcuggucgugaacaagaaguuggaaggggacugggcccucuugaacuccugaccucaagugauccuccugccucagccucccaaaguguggagauuacuggcgugagccaccgcgcccagccagauguauguuuguuuuguuuuagcaaauaacuuuaugucugagagacagauucauaggguuuggguuugcauaucuguguuuuggaucguugaaaccuuaagauuucucuuucugcaacuucuuuuuggcuuugguuguucuauuguuaauaacuuauugcuuuccuuuauuaaaaaguuuauuacagaaaauuugguaguuacaaacagcauaaguaaauccaaguaaucauugccuacaaugucacuacugagaaauaucauuuuguugcauauucuuccauauuuaugugaauguguuugugaugguuuuuaaugaauuuaagauauuauacaugcuguuggagagauuaaauauccacauauauacccagcaaguggcagagccaggauucgaaccccaggcaguuaaaaguguaugcgguuuacuacauucuauuuaaucagucaccuccaaauauccuuuuuggguauuuagguuuaccaguguuucauauaaaaauaaaugcuuaaauggaggugaaaucuuuuuaagugaauuuucacacaucucauauuuucuuacacuggauuccuagaaguauuauugaaucaaaguauaccuuuauuaggaucuguauuaccauacugcauuccacaaaggguauaccauuuuacauucucaaaaguaguaucaucuacacugguaauuacucuaauuuuaacuaguuuggugggugaaaagggacaugacauuauuuuacuuugcuuuuugugaacuuaaauauuguuuguguauugaucauuuguauuuccucucuuuggaacugccuguuaagauaaaaggcauuuuaaaaauuaguccuguugggagaacuuuguaggaucaagaaaaaaaugauggaaaagaaucuaacauuuuuacaucucucacauaucuucaguaucauaaauacguaagauggauguagauuaaauauuucugauuucuaagucuuuuauauuccauucucuuuagauguuucaguguaauugucaguaaauuuuauucuucuuuuacaguugacauuuugcuaaaggcugugggagacacuccuauuaugaaaacaaagaagugggcaguagagcgaacacgaaccauccaaggacucauugacuucaucaaaaaguuucuuaaacuuguggccucagaacaguugguaugaaaccaauggugauguuuuccuacaaaaauuugcaguaguuccuaggcaacagugaauuaacuguuguuuauagaaaugcauauggagccacauaugucgcuuuuguuaugcccuuuuaucccuuuauuuuuauuuauucauuuuuuuuuuuugagacagucucgcucuguugcccaggcuggagugcagugacacacugcaaccuucuccuccugguucaagcgauucuccugccucagccacccuaguagccaggauuauuacaggagugcaccaccaagccuggcuaauuuuuguguuuuuaguagagacggggccgccucagaagugcuagaauuacaugagugugccacugugcccugccuuaucucuuguuaguggaguuuauguacuuuaucaaaggauucucuggggaauucugaaaugaaauguuuuagauuuguuuuacaaugugaaccaguuuauguauuuauuuuuugccuccuguauuguuuuccucagaaagucacaugaaaguaugcaugaauacccaugcauaaaaaucuaucauagagcauugcaauaucuguacauuacuacagaaguuuuggauuuuuucaguuuguuuugauagcaguuacuuuuuuccuauuuuucuugagguaagcaauguaucuuugccauauauugugaaagaacuaggaaauacuucauguuaacaguacacguuaagcacuucacaguggcaguuguaguaaagguuaauucuuuaaaugccacugcauuuuaauuuggcauuugacuacagaaauuuaaaugucuacauguauuuggcacauuaaguguuuuuuauauauacauaauuauauguaugagacaccuuuaucugcaaauagaucacaaucuuggauaguauuaacucagauagcaugaguggauagguaauugaagaauugcuaaguauuuuuuaaauaaaaucaggaauuuuugggggcacugggggaaauauuugcuucugaacacaggcgugugcauggguaaaacaagugaacuaucauuaaagcaggacauguuggaauuucuuuuugucagggaggagcaaaaaacugacucugaucuaagaguuuggcugcaagugcucucacaaaagugaagcuaaauggaaaagucaggggaaugaggacauacacuugagagaaaugagcagaggcugcaucuuugcuaaagaugcaacaugaagaguugguaaaauaagaguacugaguaauuuaaugcauuaguuuagaaauacauggagauuuaagaaaaaugaaaugauacuguguucuguguuaagagucuugaaauuuuguauugccuguauucauucaguaaccugaaaggacuugauugauaccaauacauaguagguugaaccauauaaaauugccaucauucagccauuuuacccuaugaaaacaauuucauaaggguuaaauuaaauccucuguagugaauaugauuauccuuucccauuuaagcaauaggaaacauaagaauuauuuugucauuuuccuagauuaaacuaaaacugauaccuccugaauuuuaucuagcaaaauggauguuaaaggaaaaaaaguaaugcuaggaauucugggaagaugguggaaucagaagguacacgugaaucucucugaaauucucacaaaacuuagucaacuagauagcaaaaccaaaaaccccugauuaguauuuguaacaaaacuaggugauaagguauccccaugagccccaaaacacauguugguggggacaaaccaccagcaaccacaggaccugcaugguaucagcaucugugcugaaagaagcaguaagaaacaggguuggcaucugacggcacugagaaaaguagaaccucaaaaacgcuaauagauccugaccgggaaguaaagugagccaauuuaagaauagaagcugacuaaggaguuuugcccucuucuguagcacgugaugacaauacauuugcacuaaggacuugaagggcucaaacaaucucaaaauggacccaggagggcucugggaccccauacugaggagaaauuucaggaagugaaaugaaaauugaaaaggguagggacaugagaaaggaaggaaagagaaagaccagaucaaaaugguggggaacagagccuggaaagcucaaagcaggccuccaucguuuugaauaguauacaaaaaacaacaaggggagcucugugaaguuagaaaaacuacccuaauucaccucauucuaaaaguugaggaaaacuaauuucacauaaaaacaauaacaggaauaacaaggucaaaucccguacaguguuacaagaaaaacgagaugcggaaaagaacagcaucccuagagacgaugaaaucaagccagaaauauacaccuauaagacaagucgaaaauuguaaccuuguauuucaaaaugagcuaaaaacaauaagaugguauaagacaugaaagaaaaacgaucagcauuaguaaaacuaagaaaugaagcucaggaaaagaauuagaaauaaaagaaaauuauuucagaaauggagacuaaaguaggaggaacauaaacaacggauaauauguuaagaaaaauagaagaugaaaaaaauuuaaaaagugagucaaccuuuggacaagagucugugaagaaaaccagagcaagggaacagaaaaaauacuguaaaaaugucauuuaagguaagagauuugaaacuacauauugaaaaaacaucugaaguaccugagaguaucaacccagaauaaugaacaucaggaugcauucuguuaaaauuacuggacuugaaaucauuuggaaauguaggggacgggaaagagggcaugacuuagaaaguuaggcugucgucaaacuuugacagcaaagaugcuuaaggaaaaagugugaaauaaggcuuucauauccugcauaacugacuuaaucggggcacagacuauuagcagaaaaugcuauuccagugaaccaugaggaauccacuagacagagagcuuuauaaccagaauaacuagagacaucaauuuaaagacugcugauuuaaaagcagaaagaaaaaaaagcugauuuaaaggcaaaguaauuaauaaaacuaacuaauuuugucugcccaaguucuugcaguuuggaaauaauacuuccauggaauuuuacuuucacaaaccuggaguaacuacauguacuuuaaaguaacaaauuauacgccacuuagcgauucugcaguggaauugaugauguuaaccuguuacuuauauagagcuuuauaguaugcaaacagauuuaugucuuucugucuuuugaacuaacugaauugcuuuuuuaaaauuuccaguuaacaccuguuacaaaaucacauugaaugccuuugguugguucucugcuccaucgagucugcuguuuucugugaacacaacaccaucuuacucuuugucuccuuugccugugaaguccugauuacugcuuucuucaccugguuaaauccugcuuauuucuuauuucccacaaagccaucacugacccuuuugcuaggcuagaguaguguacauuucuguacgcuacauacuucauuagauguacuuuucucacccguauuuauucaugugugucucugccucuccuacagauuauaagcucauugagggaagagaucacauuaaucuucauaguuccauguacaauucucagcacaucauagacacugauaaacuaagcuguuauugagagcccuuccccucauuuauaauguacaagaguaaaaucuggauuugcucauaaauugucaggcacugaacacaaauuauaucuguauuacaaaaaauucacauuauaaugcacauuguuuucuguuacaguucugaaauuuuugugccagaacucuacucagccauaaccacaaauugauauuucagcaugaacuauuuaaagauaauuuaacaauaacgucuauugaguacauauaccaggcacugaaaguuaguguauuaucucauuuugucuuuccuaacagacccaagagguauagguccuauuauuuuccauaucuuacaaauaaagaggaugagagauuauuuguaaagccaggauucaaacccaggugugucucagagccuauacacuuaaucaccacacuauauuggcuaagagagaugcaagcaauauugaugguucaugguuggugaucaaaauaguaucugucaaccaacuauucugauacuuuuuuuuuuaaauacuaaguuuaauccaggacauuuuagucccaaauuuggauauuaaaggaaaacuaaauauguuaccugcaaauaaaguuuuguuuuccaaaaagaaaauuauuaaagggcacuucaacacugugacuuuaaguacuagaaauauuuuaguaaaaacagacuaaacugaaacauugagcagugaauccuuuaaagagcaagguuauaagguuuuaauuguuacuuuuuuuccugcuucauuugccuguaagugacuuuauuaaaaaaccuaaguauauaugucauacauuuacccaaggaaaguguacaaacuaccuugaauauuagacauauugauuuuuggcugugugccuguguaauuaucuuaggagaaauucuuuguggguaaguggggacauuuuuacgauaauguaauuucuugaauagccagcucuucaaaagcuauuuguaaaaaauauuuaaaaguuucuuaguuauacaaaguuaggaaccacuguucuaggaacuggaauuguguuauuuuuauuccucuggaggaaaaaugagaucuucguaaugaucucuuuaaauugacuauuuagaaaaguuaggaguucagagaagcuuucuucaauugugaaaacaauacaaaauagcuagcugauuggaaugcagaaaaaugcagauuaaucaggauaccauuaaacaucucuguuuuuccuuccuuucuuguaguuuauuuaugugaaucaguccuuugcuccuuccccagaccaagaaguuggaacucucuaugagguaaaaaaaaaaaaaaaaaaaaaaaaaaaagaaagaaauuacugcuuuuuuuucuuaaucgaguaugcacaucuguauaauauguauauuguguaguauuguuaauucacauuuuuauuucaagagauggcaugccauucuuaauuuucugggguagaaaagaugacuuucuuguucuguuaucuaacaucuugaucauagaaagauauuaauaaauuauacaaugauugaagaaccaaggaauaaauuacauuucaaagucaucuucaugauucucauaaaguaaggcuuuuucuuuaucuacauuugauuucuucuacauuguucuuauaaucuguuauccaaaucugccuacaagaaauugagaaaacagcauaagaaugacuguuuaacaucuuacagagucauuguaauaguuauuagaguacacauacuagcaccacuacuagaaaacagcuaaaauuacauauauugugguuggacauguagagaaaggacaagauuaaaauacauaagcucauucaugccuaagaugcuuaaaggacagauuuuauuaaacacuuaggauuauuaauaugugucugauagaaacaggcauccuuugaaagagauagccuguaacauagguaacuuaauauacguguguggauauuuaugauacauguggcauuuaucuucuuaguuucaucuaagaauaauaaaagauugaguuugauuuauugccuuuuuuuuuuguaguguuuuggcagugaugguaaacugguuuuacauuacugcaagucucaggcguggggaugaaccacaaagaaaaucaacuugcuacuacaugaaauggauuuucacggaagagacagcucugaaaaguuuugaugcuuguggcaagagacuuaacagaugugaucuauuuaguaugugucuacucuauguuuaugcauaagaaaacauccauagcaugaauggacucagaaaaaugugauuuguauuaaugcaccagucaucauaaaagauggucaugauaguacacccauugcuccuacuuguuacuauuauugcugcagaucugccuccaagguugaaaaggagacuaagacuguauaaacaucuucauugucaguucucaaaaugacugaaauuguuuucaugguaaaaguuaauauacuaaaggguuccuuuuuuuuuaauguuuacauuuaucucuauguuuaccuuuuuagucacauugaccugcuggcugaauaccucaaauaguccaguagagggcaguccaccaggcagaaaagguuaggcguuuugguuucacaucuuugcuggggaauaauaggggaaauggcuguuuuugcuaauuuuuagcuaauaucuagccaggagagcaagcacauaggacagacugaaagacuguaauuuuacacaauacacauggcuuaauuauuuuauugggauacagaaaaauauaaauucuggacaaauaagucauauaccuguuuucaguccuaacauuuaaggauucuugagucccaaucacauaacugugguguuacucugucauuuauauggugucaaaagcacuugaugaguaaacccaguagcaucuuuuugaguguuucauaaugcauuuuccaacuugaaaacaauaauugaaaaauagccuuauuguauauuuuaugccaugacuaaaagugccauuuuuacugaugcuauuagacugauaauuucuugaagugaaauuuaaccuuuuuuucucuuuaguauuauguuuauaaugccauauuuuuagaaagcauuccagaucaggcaugguggcuuacaccuguaaucccagcacuuuggaaggcugagguguggggauugcgugaagccacaaguuugagaccagccugguuagcaaggcaagauccccaacucuacaaaaaaauaaaaauuaaaaaaaaauuauuaggcugcagaggcaagaggauccccugagcccagaaguucaaggguauagugagucgugauuguaccacugcauuccugcugagcaacagagugagaccccaucucaaaaaagaaaaaaaaaggcauucuaguaaaucgaauguaaugugaauggaauuucaaaacaggaucuaagaugguauguaguagaauucaaaguaauaucauuuuaaaguuaaaugaguauggaaaaggucuguucucuaguuuuguccaguucaguuuacugaaggaauauauuuaauuauauucauauauuuaacaaauaaaaauauguugaauuuucguauuguuugccacugaggguucagaugauagaccucaaaaaaucgaaaauacugguugaaauuuguagcauccauuuaguuauucuuuuugaccuaaauaacuuaauaguuuauuaaaucuaagguuagcuaaauauguagcuaaccuuauuuguuuucuuuccuaacaacucugaagaauacauaggacuuugcacuuuuuuuuuuuuuuuuuuuuuuuaaagagacagcguuucggucuuguugcccaggcuggacuguaauggcacaaucuuggcucauugcaaccucuaccucccggguucaagugauucuccugccucagccuccugaguagcugggauuacaggcaccugccaccacacccgccuaauuuuuuguuauuuuuaguggagacaggguuuuaccauuuuggccaggcuggucucaaacuccugacugaccucaggugauccacccgccuuggccucccaaagugcugggauuauaggugugagccaccgugccgggccuggacuuuguacuuuuucaaaucauauuuaauuauuucuugaucuuuacucaaagaauuauucugcgcuaaauuugcaacauuaaacaauaauuaagccuggauccgauaaguuauugggugacuagaaccuacaacacaauuuauuuuuaauuuaaacucucaagucugauuaaacuugggggaaaaacugaacauucaggugauauuuuaaauuuucuuugugacuaaauagaugucauuaauaucaugcuucaucuuacugugcauagaugacccauggcacacaaaguauauguauaauauugcaauauuguacuuccaucuuuaaaaguaugccaaagacuucauaaugaauucaccauauuuaaggaauaaggcaaauuaauguuuauccgaaaucaaaaugagauuggauaauuccuggaaucugauuucuguaaguuucaguccuaaagggaccuuaaauaucuacuagaacgaaguacaguguauuucucagauuacaugacauuagucaaccaauuuaguuguaacacaaagugagaaagccuuagguguugaaggagugugaaaauaaaaaucucuuuucaugcaguuucugcuucauuuuccaaggauuauaauaugcugaguaaacuuuuggcacuaaggaagccagcuacaggccacguaaugaaaacuauucagaaaacaguucagcaaauacuacuauuugaauacaguucaaaucguauuuauauaaauacucugccuacauuauuuaacccaaacuggauuauucaccauucuuugaagaugccuuguguuuucuguuaucuacuucugcucgugcaguuuacuuacaccuucacccuuucaaauccuaacucuucuucaaggccugauucagauuuuaacuuuuuaaaggcuaucugaaucauucaaggagaagauacccuuucucucauaaaaacacuuagagcaaacuaccacuauuaaaucacuuauugcauacugccucagagccauguguccaguuauucugguuuuuaucugguacccacacacacauaauacuuaguacauuuccuuauauguaaauaauuaguaauguaacacaucgagugaaugaaauugugauuagcaaaguaugacagcuaaaaacaaaggaaauuuuguauaguuuaaguuuuuguacagcagaagguaauggaaaauauuugcaacauaugacaguguuuuuaaugucuuaaguauaugaagaauuuguuucaauugguaagaaaagaccaacugaaaaauaggcaaaacauaccaaauuucgauucacaaaaagauacaaauggccaacaaaacaugaaacaccuugaaccccauugguuacaaaaaauacaaauaaaaacaaugcugacugacaauaaaaauaauguacaucuugcuauuagcagaguuguggggaaauccugucauauuuuggugaauagaauaugaguugguauaucacuuuuagggggccauuuggcaauaucaaaaaccuugaaacguaaguauaaacuu

SEQ ID NO: 18550 - RNA, 324472 nt, Homo sapiens
ggacuguggggguggcgggcaccggagccgggaagggacaggucaggcggggagugcgagcgcguacugcuugcgccacucgggcugggucaggagcggcugcccgagguccagaggaaguguguggacagcgcggccuuccuggccggugagucggccccgggucguggccggugaggggacccugagcuucaccugggcuagcgcggggagugacaggugcgcgaaggagcgcggcgcuccgcccucucgccgacccgcccccuccgggccucgcccuccggggcucgggaugagucgcgggccccagcugagcggcuccggcuccaggcgccugucgcugcuucugccgucgccaccgaagagcggccgccgccccugagggaaggagggagggaagcagccgcugacccguggcaugagcuggaugcgguguccguugcaggacuagggcgccgacaugaaccugcaccaggugcugaccggggcugugaacccuggcgaccacugcuucuccgugggcagcauuggcgaccagcgcuucacggugagugagggaggcccucgcgucgcccguggcccggccuuugcccgucauucugggccgagcuuggcccagaacgacgggcagaggcgcgaggucuugucuccccagggggguccuuaccacccagaacccagcagaccuggcccuugagaacuaaggaagcaaaaccaugucggucagugagguacuguauggagccugaacucaaguuagaauauuuuguaggauuuuuaaaguuuuuggucugucugccuugggccagggugcuuugccaaagucguuuguucaaaaaucuuuguugaguaacgaguugggggcuuuuuuauaccauucuauagguucaaauugucaaauuuaggaauaguggagauugguuucauuuuguauucuaaguuaaggucaaguaucuuuguaguuaaaaagugggugucucaaaacaauuaccaauuguuugccaucaacaacuagccuugagaacaguguuuuucauuuauuuucuuuucuaauucccugagaaauaacuucggaaagaaaaaaaagccuuuucauuuuuaaaaauauuucuuggauauuuuacaauaaccugguaaucccagguuaagguugcuuaacuugcuuuucauuggucacauauugacaagaagagggcaccaaauuucgggcuacuugucaguauaguggcauuuuucuaccuuaacuauagguuuuuuuuuaauaacaauuucaaaauauaagucaguaauugcacaugauacuuuuaucuacauaaauuuauaaugcuaaugauuuuugcuacaauuuguguagauaccucuuuaguugugauuaaaaguaaaacuugucacugccugggaauacuaagugcuguaggcuuuuuucuuuaaaaaaaauaaaaguaaaacuuaauuuuguauaagugacacaaaguaaacaacguaaccaaugccccagguuuaggaguguuaaauuucuaaucuuuuucucugcuuuuaauuuuucuguggucuuuguuggucagaauaaauaauacucagcauuuaaaaugguggaggcauuuaaugccugaauuguacuuuuagaauugugccaagaagcauuuuguuuucaaauagagacuguaccuccccuuuagauugacucauacacaucuuaauuaucgggauuccaauucuaaauguuugcccagccugaauacuugggaaaagagugagcucugagggucccagugagcaacuauaguuuccuuacaccugggcauugcucucugcucuugcugcuugagaggaaaguaaacaucauccuuagaagguuuuccuagugggaaauuauaggauaauauuguugcauucucugucauuuccuaaauuuauaugagugcuuucuccaguguaaauucuaagaacuuuugcuuuuuaaaaacuuuugaaaugaggucucccucugucaccuaggcuggagugcaguggcgggaucacagcucacugcagccucgaccuccccggcacaagccguccuuccaccuuaggcuccugaggagcuaggacuacagauucuaaucaccacggcuggcuaaguuuucuauuuuuuguagagaggggucuccuuauguugcccaggcuggucuugacuuccugggcucaagugauccucccacuucagccucccaaaaugcuaggauuagaggcgugagccaccaugcccagcccuaagaauuuuuucuaagaaggcauucacaaucuauguaagcaguggugugaacuucaaagcauaugcaguaugauggccuauuuauauaccuggaugcauuccucuauaaaaccuuggugaaugucuguguauuguuuuuaaggagagaucaguuaaugugccgaggaggauuagauagauggucauccuguaccaucauguagcuuguugcucaguucugcugaauuuuaaaguucauuuccauugaguaggauuuaaucucccaccaagccuacugcagauuucuuccaggucucuggaagcauucaguaaauaaacuaaaaauaaauuuuuaaguauaaagagaguucagcucucuuuaguuuugauggaauuuuaaggauuuaacagucaugguuuuccuuugcagccuguucauccuugacucuuuaaguugcuuacgcucauuauccuggacacuuauauacaccuuaaauuuuucucucuugaaaucgcccuuuuuucuucucucauguuaaaaggcagaaucuauuguuuacuucuugaguuguuuuguguuguuuuuuuuuuuugagacggaguuucgcugucguugcccaggcuggagugcaauggcgcgaucuuagcucacugcaacuuccgccuccuguguucaagagauucuccugccucagccuccugagaagcugggauuacaggcaugugccaccaugcccugcuaauuuuguauuuuuuaguagaggugggguuucaccauguuggucaggcuggucuggagcuccugaccucaggugauccaccagucuuggccucccaaagugcugggauuacaggcgggagccacugcacccagccuugaguguuguuuuuaaccuuuuuugauuuugacuuuucuuugauaggaaaauaguaaacauuaaugguagaugguaugugaagacuaaaauaucccucaguugcauuuuacuugaaguggagcaugacaucuuccucuugcaguuccccuugaaaaauucuuuuauuccuuuugguacuuuguguuuucuuuuaggacaguccugcuuuuguaauuccucccuuugcauguuugcagauaacuuacguguucuugguuugaaagauuacaagaugugagaucuuguuuuacucauaaagccugacagguuuuaaauggaaaugaaacugaaugccacuucuccuauuuucuagauuugaaaauaugaaauuaccaacgcagauuagucuauuuaaguauuagauacuuuuuuacuaccucaucaggcaucaagcuguuuugacuuugcucuuaguaagaaaaccucuugugggcaaugaccaucucuccugugcuuucagagcacuuucuuugcaucuuuauucuaucauuaaccagucuugccuuguggauuguauguguaugacuucccacgcuucauugugagcaccuagaacagugauugaaagaguguuuaaaccuaacaguaaggucauuacuuggaguugauuuccaauguggucccuuuuaauuagcuguuuauccauuagcaaguuauacucuuggaauuucuuuuuuucucuucuguaaaaugggacuaaaagaguauuauucauagaguugcuacaugaaaaagugcuaagcuguaaguccaugguuuagcacauguaaaacucucaaaaaugucaguuuucauaaaauuaagguuauauuuauuguaaugccuaacaauagaaaguacuucauaaaucgugguugaauuaaugaaaaauggauagagaaaccuuauaguaauauaaauauuaauugcuacauuuaaaaauagcuuuaaucauuuagauuugaguccaaauaaaauauuccuguuaguuucuuuuuuuuucuuuuuuuuuuuuuuuggagacugaguaucacucuaucacccaggcuagagugcaguggugugaucucagcucacugcaaccuccgccucccggguucaagcuguucucgugccucugccucccaagcagcugggauuacaggcgcacaccaccacgcccagcuaauuuuuguguuuuuaguagagacggguuucaucauguuggccaggcuggucuugaacuccucaccucaaaugauccgcccaccucggccuccccacguacugggauuacaggcgugagccaccgcgcccugccuguuaguuucuuuuucaaagucaguuguuaggcauuuuaucaucaacaagugagcaacuaggggagacuuuagguaugcuaagcaaaaauuauuuauuuuuuccuuauuuacuggaaugcuuccuucaugccuuuuuccuuguuaauuuccuacugaucuuaguaugugagaaaucuggucuuuuuuaaaaaaaaaacaaaaaaaaauggaggcuggggucuccuuauguugcccaggcugaugucuaacuccugggcucaagugauccucccgccuuggccucccaggcugcugggauuacagacgugagcugccauguccacccugcaauuuuugcuuuuagaauuaaauguauucuguuuauaaaaggcaacaaguuaaaaagaagacuaguuaauuagaaucuacauuuauagauucuacuuuuaugcauacuauugauaugauacuuuuuuuuucuuuuucuuuugugguuuaucuauacuuaggguugaaacugugauuugaaugauauggaaagggagauaauuuccaagagacagaaagauuguaccaauauauaagacuaacugucucugauuuggaacuuaaacaucuuagcuaugggagggaaagcaaauauguuauagcuccaauuucccuuuaguauuagaaaacucaguguuucuagcuaagggaaucuagauuagaaaucaaaagacuguaauuaugugagugucauuagagaaauagggcugaauaaguagucgucuucagcuuucuguaauaagcauccuugaguuuagcucuguuuuguuuacuuuaaggaaaccuuuauugguagaaguguaauugccaaauugggaggaugggaagguguuuguuuuuuuuuucugaaagggggcaugugaaucuuuuuugguggggagaauauagaagggcaaagauugcuacuauucacaugugaagaaagagaaagguguuuguggugcauaaaauauugcaaguacuaaaguggacuucaaaauauguuggccuguuuuaaaacauaaaguuuuacaguguuuaaguaccuuuaaaaucauugaaaugauaguaguucucaauacuuuauuauauuuuaaagauaagaauugcugcaugccaaacuuaaaaccuaugucauuuaaauaggacauauaccagaaaggaauucuuuggggguguuuaccugguuuuguugauuaaaacuagaauacugacuguuacagccuugaauuuuauugaaauuuagaauauuugagaagauucucugccaaaauuuaaaguugaaaguuauauuuugauuauaugcuugauagcacacaugugacucaauucuuccugugcaucguguuuauucuuaaaguugauaaaccuaauguuguaugugccuaauagaaggauuuucauuugucaauuuaauuuuauugguuaguaauagauuauucugauuacagaucuuuuauuauuuuuuaauuaaaacauuuuuaaauaaaaagagaugggggucucacuguauugaccaggcaugaccaggaacuccuggccucaagugauccucccaucuuggccucccaaagugcugggauuacagggaugaaccaacaggcccagugcuauuuuauuuuauuuuuuugaggcaggaucuuguuauauugcccagacugguuuggaacuccugggcucaggugagccucccugugauuacaggugugccccacugugcccagugauuauagaucuuuugacagaagcagcuggugacaucgacaguuuauuugauaagccagugcugcuauuauuguuuugauaaccuucuauauuauagucagggcaccuugaaaugaguuuuugugaauaauuuauuuuagacaucuguaaaaccaguuuuacauuuugauuuagaaguuucauguauuguauuacaucuucaucuuagguuuuuuuuuuuuuuuuuuuuuuuuuuaagacagggucucacucugucacccaggcuggaguacaguggaucucagcucacugcagccucugccuccuggccugaagcgauccucccacguggcugggaccacagacacgugccaccauuccuggcuuuuuuuuuuuuuuuuuguauauguguguguguauauauauguguguguguguguguguguauguguauauauacacuuaaaaauauauguauguguacauauauacauuuauuuuuuaaguguguguguguguguguguguguguguguguguauaucuguacuuaccuggcgagacccuaucuguacuuaaaaaauauauacguguguguguguguauauauacguguguguguguguguagauauauauacacacacacacacguauauauuuuuuaaguacagauagggucucuccauguaacccaggcuguuuucaaauuccugagcucaagcaguccaccugccucagccucccaaagugcugggauuacaggugugaaccaccaugccugggauguuuuagguuuuuauuuaaaaucagguagacggauuauuuuuuauuuaagaauuuagugguacaaggauuauuuuaaaaucaugcacagcccauucuguuucauuuauuuauuuaaaacaaguuuuuaaagaugaggucuugcuguguugccagggcuagucuggaacuucuggccucaagugauccuacugccucagccuuccaaguagcugggacuacaagccugugcugcugcaccuggcucauauuuucacuuuuauuuucacaaacuuucuaguauuaaggagaacauugaaacuggagauuuaguaugcccuuuucuuuuagaaaugagaccauuuauauggacuuggagcuugaauuauuuguccagccacugaugccucuguucuuagcacauauuugugagauauuuauuuuauuuauuuuuuugagacagagucuugcucugucacacaggcuggagugcaguugugggaucacagcucacugcagccucaaucuccuaggcucaaucagucuucccacuucagucucccaaguagcugggaccacaggugugugccacaccaugcccagcuaauuuuuuauuuuaugcggagauggggucccacuauguugcccaggcuggucucaaacuccugggcuccagugauccucccaccuuggccucucaaaaugcugggauuacagacaugacccacugcacccagucugugagauauucagaucaaggaguuccuaucaugccuguguugcaagaugaagauaacuauauggaaaucagacuuuaauucuugaccuuauuaccuguuguuucaccguuauugcuacacauuuuaacuuuacaauuuauauaauuuagcaugaguuaauuuagcaacagucuuuguugccaguauccuuuaacugucuggacccuuuuuguuugcgccagucugaugaaauuccacacacuugaucagucucauguucuuucuuguuccuguauaucucaugagcacuacuagacuauguaaagaaauuccuguggaaaauaaagucauguuugccaaccucaaaugggaccucaaagcuuuccaggaauccucccaccagucugcucauuuuuccuuucuuguaccuucugaaaccucccaucccagugcucucuuaacucauauaaacuugccaccuggaaucauucagauggcagcucccucauuuuugacuacaagcugaaaaauccacuuauaucagcauccauucuuuccuucucuccuccugguacaauaaaauaaaugucccccagaauuguccaggguuaaucagucuucuuggugccguggaucuuaucuauucaggcugucucugggagcucagcccuaaaguuaucucuacuuuuuucuuuccagaguuucuaaaacaugcuuaaaauucucaucuugaaaaacagccaaccugaaaauccuuugcugccacaucccucuuuaucuuugacuucaaaguccuugaauugucuguauuuguugccacuuuuauguccugcucacuucuuaacucacuauacuuuggcagcuuuuuucuccuuagucacugguaaccacauugaugcuaauuugaaucaacagaucuccuuuguaccuugcuuucucuuuggcauuugucauguugaucauuuucuccuuagucacugguaaccacauugaugcuaauuugaaucaacagaucuccuuuguaccuugcuuucucuuuggcauuugucauguugaucauuuuuuccuucacuuuccuuggcuuaguuauaccauacucgcccccaaccccacccucuuagucauucucaguguucuuugcaagauaucuuucuugucugucccuuaaauauuggugaccgucaggccuaccaggccuugguccucuucucguuucauucuacaugcagcuccugguguauagucugugauggugagaucccugucuuuagcuucauauugauaauuuuaaauaccucuuggauuguuccacuugaaguugcuacaaauaaucaauuuuaaaauguucugcacgccuguaaucccagcacuuugggaggcugaggcggguggauugcuugaggucaggaguucuaggccagccuggccaacaugaugaaaccuguuucuacuaaaaauacaaaaaauuagccaggugugguggugggugccuaugaucucagcuacucgggagguugaggcaggauaauugcuugaaccuaggaggcagagguugcagugagccaagauugucucgcugcacuccauccugggcgacagagcaagacuucgucucaaaaauaauauaaguaaaauaaaguguucuauacucagucaacuccccuaccuuggugcaccuuccaacccacaccccaauuuguuuuguucguccuccuguguucauuaucucugugaaugguuccauuauccagcugguuuuuuuuaagccaaagauuuggaaauauccuuaacaccuaauccucccacauuuuucuuauacaaucaaucaagcccuguagauucugucuccugaguaauuuuaauauauuuccacuugucuuuucaguagugcaguuacucuguugaaauagccuuuuaaccucugucccuguauuuaaucauacuugucuucaacuuaaacaauauugccagagggaaucauuuuaaaaggcagauuaggauaagguaugaauucuucccaaugcauuuuacuguacuuuucuagucucucaucacuuuuccuccucucuguaauagcugccucccuaaacuguagcuauaucuaacgucuuuccauuuacacaguaagaaacgcuuucuuauuuucaagccauuucacaagcucuucaggaaacuuuucaauuaccccucccuaggcaaaaaagauguaaaucuggcuaacucaucccuaaaggcuugguuuugaugucccuagucagacuagaugaucuuccuauuuguagccuaucuuauaauuccuuuuucagauguuacccacuagaauuguacuaccucuagggacagugacuucauauugcauuccaaacagcuggcaagguagggccuaguaaauacaugaggacaaaugggacaaagaaaaccugugcuggagucagaagagcuccaaggacuaagcugucuguucugggcaaggcaaagaagacagcugcguuugggcugccuccccuucuucacucccagcuuaaaauccucaaaaagucaaauccagaugacuucuuggaaggccuuaggguaagaaagugucauuucagcuuucuauucacuccccacagaaauagcacucuuccuugauucauuuaacuaacauuuauugaugccauaugugugcgaggcauuguuuauugguagcuaaaaucuuuaccugagucagaaccuuuuuaaaauaaaacauauuuuaauguguaaaaacugcuugagaacauacuuugacucaaacaucuucacacuuaagucaauuaacagguauauauaguuggcuucugguuaaguuuuguuuuuauaggaggaauaagaacuccuaaguguuggaugcaagaaguguagaugagaaguuaaugugaagaagauauagagccgcagaaacaaagauugaagaccaacuuagacuuuaccaauuuuaaccagagguacccuugcuuaaccuuuucguuuuaacuaauggggacaaauugagacugugcauggagaauuuuguucuuacguguauuugaagguaguuuuuggccauaaguuauaaagguuuuaagaaaagaguuccuuuggaaauaaaaauugaguuuuuacugcauuugggguccugcuaucuaaaaauaugagaaagaauuacgaauaaacaugauucuugcccuucaggagccugauuuuauuguugucugaauugauugcugacugucauaacuauuucccagaggaaguuuucuuaagguuauauauauauauauauauauauacacacacacacacacacacacacacacacacacacauacacguauauacauguucuuagaauguuuuauaaaaucaauuuuuauuuuauuuauuuuuaauuuuuuuuagagacagagucuuacaguguuucccaggcugcaguguaguggcgcagucguaacucacugcagccucaaacucuugaguuuaaacagucaugcuaccucagccucuugaguagcugggacuacagacaugugccaccaugccuggcuuauuuuauuuuuuuagagacagggucucacucuguugcccagguuggagugcaauagugugaacucagcucacuguagcuucaacuuccuuggcucaaguagauccucccaccgcagugucccaaguagcugggacgacaggcaugucccaccaugccuggcuaauuuuuaaaauuuuuuguagaguggggucucacuguauuacccagacuggucgugaacuccugggcucaagcaauccucccacauuggccucccagagugcugggauuauuuauagaugugagcugccaugccuggccuuauuuuauuuuuuaauugaugccuaauagauguacaugcuuucaaaguaaaugugauaauuuaauacauucauauaauuugugaagauuaaaucacuguacuuggcauauccagcaccuuaaauauuuguguuuaugcuagaacuauuugaauucgucuagcuguuuugaaauauacaauagauuauuguaaacuacauuuacaguagugaucuguccaacacuaggucuuaugacuuccaucaaaccguuuauuaguuccaauuauucaacuucucuucaucgucucccccaaccuccuuagcccucugguaaccaucagucugcucuuuaugagauccacuuuuguagcucccacauaugaaugagaacaugugauauauuugucuuucugagcuuggcuuaugucacuuagaaugaccuccaguuccauccuuuuuauuguuuguuuguuuguuuugucagagucucaaaaaggcuggaaugcaguggcaugaucuuggcucacugcaaccucugcuucccagguucaggcgauuguugugccucagccuccccaguagcugugauuacaggcaugugucaccaugccuggcuaauuuuguauauacacacauauauauuuuuuaguagagauggguuucgccauguugaccaggcuggucucaaacuccuggccucaagugaucugcccaccuugacuucccaaaguguaguuccauccuuguugcugcaaauggcaggauuucauucuuuuuaauggcugaauaauauuucauuguguacauauacuacauuuuuuucauccacugaugggcacucagguugauuuuauuaucuuggguacugugaauagugcugcaaaaacaugggcacauagaugucuuuuugauguacugaauuucauucuuuugcauauauacccaguaauggaauugcuggaucauacgguuguucaguuauuagguuuuuggauuuuuugagauagagucuugcucuguugcccaggcuggagugcagugacacaaccuuggcucacugcaaccucugcuuccuagguucaagcgauucuccugccucugccucggaguagcugggauuacaggugugugccaccacgccuggcuaauuuuuguguuuuuaguagagaugggguuuuaugugagacaggcuggucucaaacuccuggccucaggugauccgccugccuuggccucccaaaaugcuggcauuacagcccugagccaccgugccugaccaguuuuuagguuuuugagaaccugcauacaguuaucuguagugguuuuacuaauuuacauucccaccaacacaguaccaggguucuccuuucucugcauuuuugagaacaucugcuauuuccagucuucuuguuaaaagccauuuuaacuggggugagaugauauauguuuauaguuuuuauuugcauuuuccugaugauuugugauguugaacauuuuuucauauaccuguuggccauuuguaugucuucuuuuuagaaaugucuguucauguauucccccccucaccccuuuuuuuuuuaagacggagucuugugcuguugcccaggcuggagugugguggcucauucuuggcucccugcaaccucugccuccuggguugaagcaauucuccugccucaaccuccagguagcugggauuacaggugcacaccaucaugcccggcuaauuuuuguauuuauaguagagacgggguuuugccauuuuggccaggcuggucucgaacuccugaccucaagugauucaccugccucagccucccaaaauguugggauuucaggcgugagccacugugccugaccuuuuccccaaaagcguucuuuuugcuuaaaauuguuuuggcuauuugggguguuuguggcuccaccuaaauuuuagggucauuuuuuucuauuucuuugaagaauguaaucuguaucagaauaccaaaaauacucuucacagaaauggaaaaaacgauccuuggcugggugcuguggcucaugcuuguaauccuagcacuuugggaggcugaggcggguggaucaucugaggcugugaguucgagaccagcaugugaccaacauggaaaaaccccaucucuacuaaaaauacaaaauuagcccggcgugguggcacaugccuguaauuccggcuacucgggaggcgaggcaggagaauugcuugaaccugggagguggagguuguggugagccaagaucacgccauugcacuccacccugggcaacaagagugaaacuccgucucaaaaaaaaaaaaaaaaagauccuaaaauugucuucuguguggucauuuuaacaauauuaauucuuccaauccaugagcauggaauaucuuuccauuuuuugugugucugcaucaauuucuuucaucagaguuuuauaguuuuccuuguacaaaucuuucacuucuuugguuaaauuaauuccagcuggucacaggggcucacuccuguaaucucaucacuuugggaggcugaggagggcagaucacaugaggccaagaguucaagaucacccuagccagcauggugaaaccccgucucuauuaaaaauacaaaaaaauuagccaggcaugguggugugcaccuguaguccuagcuacucgugagacugaggcgugagaaucgcuugaacccgggaggcagaggcugcagugaaccaagauuggugccacugcacuccagccugggcaacagagugagacuuugucucaaaaauaaauaaauaaauaaauaaauaaauaaauauaauaauaauaauuaauucuggauuuuuucuguucuucguagcuauuguaaugggauugcuuucugauuucuuuguaagauugcucgccauuggugagcauacaaugguguaugcuauucuauacaccauugauguauagaaaugcugcugauuuuuguauguugauuuugcauccuggaauuuuacugaauuuguucauccguucuaacagguuuuuuuggugcaaucuuaaggcuguucugaguauacaaucauaucauuugugaacaaggcuaauuugacuucuuccuuuccaauuugguuacccuuuauuuuuuucucuugcuuaacugcucuggccaggacuucuaguacuauacugaauaaaaguggugaaagucggcauucuuguuccauaucuuagaggaaaaaucuucaguuuuucccuauuuagaaugacguuagcuauggguuuuucauaaauaaucuuuauuauugugaggaauguuccuccuaugcccaguuuguugaggguuuuuaucauaaagggauguugaauuuuaucaaaugcuuuuccaggaucuauugaaacuaucauaugguuuuuguucuugguucuguuaaggugauauaucacguuuauugauuuacauauuguauuagucucuucaugcugcugauaaagacauacccaagacugagcaaguuacaaaagagguuuauuggacuuagaguuccauaugacuggggaggccucacaaucauggcugaaggugaaaggcacaucucacauggcaauggcaagagagagaaugagagccaagcaaaauggguuuccccuuaugaaaccaucagaucucgugagacuuauucacuaccgugaaaacaguaugggguaaaccgcccccaugauucaauuaucucccaccuggucccuuccacaacacauggaaauuaugggaguaccauucaagaugagauuuggguggggacacagagccaaaccauaucacauauguugaaccauccuugggucccugggaugaaugccacuuuaucauggugaaugaucuuuuaauguguuguucaauuugguuugcagguauuuuauugagaauuuuuguaucugucuucaugugugauaugggcuuguaguuuuuuguuguuguuguugcuuugucugguuuuggugucaggauaaugcuggucucauaggaugaguuuggaagucuuccuuucucuucaguuuuuuugaagaguuugaguagaauugguguuaguucuucuuuaaauguuugauagaauucagcagugaaaccaucagguccugagcuuuucuuugauaaaauacuuuuuauuauggcuuccaucucauuacucauuauugauuuguugagguuuugaauuuuuuuugaagaguuugaguagaguugguauuaguucuuuaaauguuugauagaauucagcagugaagccauagguccugagcuuuucuuugauaagauacuuuuuauuauggcuuccaucucauuacucauuauugauuuggugagguuuucuauuuccuuaugguucaaucuugguagguuguauguguccaggaauuuauccacucacuucuggauuuuauugaauuugcugguauaugguuguucauaaggauucuuuuuaguucuuugaucuaguuguuuugucuucuauuuaauuuguuacuuacuugggucuucucuuuuuugcuuagucaagccacaguuuuguugauuguaacuuuucauuaaaaaguuucauuucauugaucuuuuuuuuugucucuauuucauuuauuuaugcucugaucuuuauuuuuucuucauacaaauuuggguuugauuuguucuuguuuuucaaguuccuugaggugcauuauuagguuauuugaagucuuucuacuuuuuuucuuuuuucugcuuuuuuaauguaagcauuuauugcuuucaacuuuucuuaguacugcuuuugcuguauccuauagauucuguuauguuguauucccauuuucauuuguuuuaagaaaguuuuaauuuccuucuuaauuuuguuauugauccauuggucauucaggagcauauuugugaaguuuccaaggguuuucuuacugauuucuaguuuuauuccauuguagugagaaaagguacuugauauaauuucuguuuuucaaaaaauuguucagacuuguuuugugaccucagauaugucucuucuugggaauagucuaugugcugaugaaaauaauguauauucugcagcgguuagguggguguucuuuaaaugucaggccuauuagaucuaguguaucguuuaacugauguucuuuguugauucuucuguuagaucugucuauuacugagaguggggcguuaaauucuccuacguuauuguauugcauucuauuuagaucuauucauguuugcuuuauuuuuauuauuuuuuuuuugagacagagucucguucuguugcccaggcuggagugcaauggcgcuaucucugcuaacugcacccucugccucccagguucaagugauucuccugccucagccucccaaguagcugggauuacaggcacccuccaccaugccuggcuaauuuuuguauuuuuaguagagacaggguuucaccauguuggcuagacuggccucgaacuccugacuucaggugaucugccagccuccgccucccaaagugcugggauuacaggugugaggcaccaagcccagcaguguuugcuuuauaugcuugagagcucugguguugggcgauagagauauuuauaauuguuuauacuauuucuggauugacugcuuuaucguuauauaguaaucuuugucucuuuauagucugucuuugauuuguagcguauuuuaucugauguaaguauagcuagucaagcuauuuuuugguuuucaguugcauggaauaucuucuuccaccccuuuacuuucagucuguguaugcuuuuguugguaagguggguuucuugugggcaguauagaguugguucuuuuuucuucauuuauucagccacucugugccuucuaaugggagaauaaagccccuuuacauuguguuguuagguugcugcaaaaguaauugugaguuuugccuuuaaaaaaguauuauugguaaguaaggauuuacuacuagcguuuuguuguuuuucugguuguuuuucuaguccucucuuccuuucuuacuguuauccuuugugguuaaaugcucuucucuguuaguguguuuuacuuuguuacuguuuauuuuuaaaguauuuauuauugguuuuggcacuguggcuaccaugaggcucacauaaaacaucuuauugaagugcguuauuaucuuaaagguaugacagcuuauaucucaaagaauagaaacaaauaaaaauaaaaugcuauacucacauuuuuggcuuucaguugucuuaauuugccuguuuuuauauugccugucucuuaaaaaguuauuguagauauuguuuuugauagauuugucuuuugggcuucauaauagaguuaugaauagguuacacaccacaauuacaguauucuucuagauuugucugugacuuaauuuuuccagugaguuuuauaucuuccaaaacaauuuuuuuuuugcauauuagugguuuuuuuaauuucauguugaagaacucccuuuagcauuuuugcaagucuuaaugguggugaauuucgucacccuuugucugggaaauacuuuaucucuccuucauauuagaaggauaacuuugcuggcuacaauauuuauagaagacaacauuuugucuuuuagcauuuugaaagugucaucuagcucccuccuggccuaugugguuucucuugaugaaucuuuugccagacaaauuggagcuccauuauauaugcauauauauauauacauauauauauauauauuuuuuuuuuuuuuuuuuuuuuuuuuuuuuugagacagagucucauuccaucacccaggcuagagugcaguggcacgaucucagcucacugcaaccucugccuccuggguucaagcaguuuucaugccucagccucccgaguagcuggaauuacaggcgcgcaccaccacacccugcucauuuuuguauuuuuuuaguagagaugggguuuugccauuuuggccaggcuggucucaaacuccuggccucaagugaucuacccaccuuggccucccaaagugcugggauuacaagcaucagucuugugcacagcgacuucauuuuugguacugccuuuuuuuuuuuuuuuugagacagaguuucacucuuguugcccaggcuggugugcaauggcgcaaucuugucucaccgcaaccuccaccuccuggguucaagcaauucuucuggcucagcuuuccugaguagcugggauuacaggcauacgccaccauacccagcuaauuuuguauuuuuaguagagaugggguuucuccagguuggucaggcuggucuugaacuccacaccucaggugauccgcccgccuuggccucccgaagugcugggauuacagacuugagccacugcacccagcuuuuguacugcuuuuaggauuuucucuuuguccuugaccuuugagaguuugauuauuuuaugcuucggguuagucuuuuuuuuuuuuuuuuuuuuuuuuuuuuuuuuuuuuuugagaaggacuuucgcucuugucgcccaugcuggagugcaauggugagaucucggcucacugcaaccucugccucccggguucaagugauucuccugccucagccucccgaguagcugggauuauaggcgcccaccaccccacccagcuaauuuuuguguuuuuaguagagacaggguuucaccauguuggccaggcuagucuggaacuccggaccucaggugauuugccugccucaaccucccaaaguacugggauuacaggugugagccacugugcccggccacuugggguuaguauuauuugggucaaaucuguuugggguuuuuuggccuuugucuaccuggauauuuaugucuuuucugaaguuuuagaaaguuuucuguuacuucuuuggauaagcuuucuacuuucucuuguucaaaucccucuugaaugccaauucuuagauuucauuuuugagguaauuuuuuguaucuuguaggcaacuucauuacuuuucuuuuuuguuuuuuucuccucuguuuuuuuuuuuuuuuucuuugagacagaguuucacucuuuuugcccaggcuggggugcaauggcgcgaucucggcucaccgcaaccucugccucccguguucaagcgauucuccugccucagccucccaaguagcugggauuaccggcgccugcuaccaugccuggcuaauuuuuuuuuguauuuuuaguagagacgggguuucaccauguuggccaggguggucucgaucucucaaccuugugaucagcccgccuuggccucccaaagugcugggauuacaggcgugagccaccgugccuggcaguccucuguguguuuuuaaauagccugucuuugagcucacugauucuuucuucugcuugauccauucuucuauggagagccucuaaugaauuuuucaguucagcaaauguauuucucaguuccaagauuucuguuugauuuuuuaaaaauauuucaaucuguuuauuaacuuuuucugauaaauuucugaauugcuuuuugucuuaucuuagagaugacugaauaguuguuuccuuaaaacuauuuugaauucuuggucagagagcucacauaucgccuacugguuggggucagguuccuugcuuuguuuggugagaucaugguucccuguuugcugcauuuauuuauuuauuuauuuauuugacagugucuugcucuguugcccaggcuggagugcaguggugagaucacagcucacugcagccuuaauuuaccagcucaaguuguccucccaucucagccuccuugguagcugggacuacaggcacaugccaccacacccagcuaauguuuuuauuuuuguuuuuuuguagaggcaagucuugcugugcugcccagccugguuucaaacuccuaggcucaagggauccuccuguuuuggccucccaguguugggauuacaggcgugauccacugugcuuggccugcuguuucuuguggaugcacaccuaugucuuugcauuuauggauuaguuauuuauucuagucuuuggcuuguuuugguuuauauuggauaucuuuacuuggagauucuucacugcuaagccacugccccuuuuuaggcuccagguguugccuuaaguccagguucaccuuggcucuaguaaaccaucaaagggcugccguuccuaaagugaggagaucccacaggagguaucucagcagagggggaaugcuggcuaaggguucaugugcuggaaaccugugggacaaaccuccuacagggugguguuacuacugaacagccucucucauguggcaucuccuuuggcugaguuauggagcacuauuuucagggaugcagauaauaauacugccugcccucuuuguuucucccuguccucagagauauuucuuuaggcacuugugaugcuucuuauggguuagggcugggacagauauucugcuagagaacccaauaugguggggaagcuggcuguucaccauaaucucccuuuuuccaguguagaaacaauguuuggggaaauuuucugugcccuaagugcugggcagaauugggggagggguguugugaauguggaagucucuuugucuuuuuucauuucugaaaauugucuuuuuucauuccuguggccccaggaacugucuugucuucauaugugaguucuggguuauuucuggugauacuuucagcacuguauauuuguuuuggguuuucuuuuucuuuuauuuaagaaaaauucuuuuucuuuuuuuuucacauagggucuugcuguguugcccaggcugaucucaaacuccugggcucaagcgaucuuuucuccuuagccuccugauucggugggauuacaggugcaauguuguaugaaucuguuuuucauuuucuuuggaggcaagugaaacaccaccuuuuuggagccacaguuauuauuuuuuaaauaacagcuuuauugaaauauaauuuacauaccauaaaguucacccuuuuaaaguguaaauuuuagugguuuuaguguauuaacaauguguauuaccacaaucugauuauagaacauuuuccucacccccaagagaaaucccgugucuauuaccaaucacugucuauuugccacuaccccuagccacuggcagcugcuaucuuacagccacuuacauugcuuguuugcuuauuugcaccaacugccuuacugacucuauggauuugucuauucuggacauuucauauaagugaaauaauaaaauauguggucuuuuguaaaguucauccauguucuagcauuuacuaguacuuuuuauggcuuaauaauauuccauuguauggauauauacuauauuuuguuuagccauugacaguugauggacauuugaguuguuucccuuuguggccauuaugaauaaugcugguaugaacauugauguacagguuuuuguguggacauguuuucaguuuucuugaauacaggcauaucuuguuuucuugcucuuucccuuauugcacuucaaguauuaugauuuuuacaaauugaaguuuuguggcaacccuuuguugagcaaaucugucagcacuauuuuuccaguugcaugcgcucacuuugugucucugugucgcauuuugguaauucucaaaauauuucaaacuuuuuuuauuauuauuuuugaacagagucuugcucugucacccaggcuggagugcagcaacacgaucuuggcucagugcaaccucugccuccuggguucaaaugagcacgccuggcuaauuuucauauuuuuaguagagacuggauuucaccauguuggccaggcuggucuugaacuccugaccucaagugaucugccugccuuggccucccaaagugcugggauuacaggugugagccaccaugccuggccccuuuuaaaauuauuauuauaucuguuaugaugaucagugaucuuuguuacuauuguaaugguuguggaaugccaaugaacugcgcucagaccucccuauucacugagacacaaugauauagaaauuaugaauagugacaacccuacagugucuuuuaaguguucagaaaggaagaguuacacaucucuuucuuuaaaucaaaagcuagaaaugauuaaguuuagugaggagggugugucaagaugggccaaaaccuaggccuauugugcuaguuagcuguuguaaaugcaaagggaaaauuccaaaggaaacuauuaauuaaaguucugcuccauugaacacaugaaugauaaggaagcaaaauagccuuauugcuuauauggagaagguuugaguggucuggcuagaagaucagaccagccacaacauuccuuuaagccaaagccuaauccagagcaggacccuaacucuucucaauuccgugaaggcugggagaggugaggaagcugcaaaauuaaaguuugaagccagcagagguugguucaugagguauaagaaaagaagucaucuuuauaaccuauaagugcaagguaaagcagcaagcgcugagugauguagaagcuucggcauguuauccagaagaucuagcugagauaauugaugaagguggcuaugugaaagaacagauuuuaaagcagaugaaacagccuucuguuggaagaagaugccaucuaggccuuucauaacuagagaggagaggucaaugccuggcuucaaagcuucaaaggacaggcugacucuuguuaggggcuaaugcaguugguaacuuuaaguugaagcccaugcccauuuaucaugccgagaauccuagagucuuuaagaauuaugcuaaaccuagucugccugugcucuacaaguggaacaacaaagcccggaugacagcaccuauguauacagcacaguuuacuaaauauuuccagcccgcuguugagaccuacugcugagaaaaaagauuuccuuucaaaauauugcuguucauugacaaugaccugugcucugaucaggcagguguacaaggagauuaauguaguuuuuaugcuugcuaaaacauucauucuguaguccaugaaccaagaaaugcuuccaacuuuuaaagucuuauuuaagaaaguuauuucauaaggcuauagcugcuauagauaaugauuccucugauugaucuggacaaaguaaauugaaaaccuucuggaaaggcuucaccauucuagaugccauuagggacauuugcaaugcauaggaggaggucaaaauaucaacauuaccaagaguauggaagaaguugauuucauccuucacaaauuacuuugagggguucaagucuucaguagaggaaguaacugcagacuugcacaaucuuuuuuuuuuuuuuuuuuaauuuuuuauuuuuagacaaggucucacucuguugccugggcuggaguguagugaugcucaccacagccuugaccuucuaggcucagguuauccucccaccucagccuuuuggguagcugggacuacaggcguacgccacugcaaccagcuaauuuuuuguguuuucuguagagcugguuuugccauguugcccaagcuagucuuuaacuccuggacccaagcgacucaccugucuuggccucccaagguucugggauuacagaugugagccaccaugcucagccaaguucaauaauuuuauuugauuuaaaauuuaccaagacuacggagacagcuuuguuaacuucuaguaccaucgcugagaaaaagucaaauaguaguaguaugaugcagcagcagcaaaagaacaaggguaauucagaacuagauaagucauugaaugaugaagugguaauuguuauuaguugguauuuuccucuguauaguacuaaguguuuauuucugggauuacuuuacauuucucaacucugcaaguguaauauuuguauuaaguaguaauuugugugggcuucaaaauuaguauagacuugaugugggaaaauuuugggucauguuugacaaaauacuugcaacguaauaucugaaauuagguagauaauuucagguacaacaaaggugaaguugugaagacaugaguuuuuuuauuccacugaaaggaaacugaaaauguuguuuagaagggagcaaaucuaaauuguaaacauguaaaauucaacacaauauuuugagaaacagugacaaucaguauucucaaaauuuaauaucaaggagaaaaauuaguuucuaaauuauuugaaagacaacuucucuuaaaauuagccuuuggaauuuauucuugcuaauggucuuaugacaagccuuaugaucccaucauggauauuuauauaggagaggagaucaucaugugauuuuuuuguuuguuugagccaguucuuuucacuuugugaaacuaguggaaucauaauugauuauucuuucuaauuuuuagguaaaauuccaggcaagcauguuaacuagggaagccccuguugguaccauggaaauagcaggagaccaaaaaucaagagaucagguucugaagccccacucugccacuaagauguuaucaacuuauuugggccuugauuuucuuuuccauauagcacauucauuuguauguucucucaagucccauuuuuaauauuuuuugauagaguauacagaauaauuuugguuuugguaggaauuaagguguauaugaaguauaauuuuuuuuuuuuuuuugagauggaguuuugcucuuguugccuaggcuggagugcaguggcgcgaucucagcuugcugcaaucuccaccucccggguucaagcgauucuccugccucagccucccaaguagcugagauuacaggcaugcacgaccaugcccggcuaauuuuguauuuuuaguagagacgggguuucugcauguaggucaggcuggucuugaacuccagaccucaggugauccgccugccucagccugccaaagugcugggauuacaggcaugagccaccaugcccagccugaaguauaauuuuuaaauauaugugcgugugcaaaaaugaggagcaaguagagaguugauaaaaacuuuaugaacucagguuggaaaacaguuuguguuagaugucuuauuguuguaacgugugccagucuauaauaugaauccuaggagaacaaccauguacccuguaauggaaaaaacucccgugaucaaagaaggugguagggaaaaggacacacaaaagaagaguucuaguugggagaguuaugcuaacuguuguaaaauugaaaaagagcuaugaaaugcuuggcaacaagucuugagcuauguauacuuucuuuuguugugaugacuguuuuugugaaauuaaaugcuucauuuauuccacuuauaaauuauuagcugcauucuaggcccuuguguuagaauugaggacuagaguagagaacaagauaaacuugaauccuuccuuuuuggaauuuaacuuuuaauaauagauagggacaaaagacauuuaaaaauugugauauaugccgugaagaaaauaaacaguaaugugauagaaaguaaugggagagauagugguugggaauuguagccugaaugcuggaaagcagcuaacuagaaaagaccaggcagauaaaaggcagauaaacaccuugagauguaaaaaggaacagaaacaagagccagcugagagaaggaaagaauagccugagauggguuuauagaaggaccaccauuuaggauauugaccaugguaagguguugagauuuuauuccaagugcaguggaaaacuguugagggguuuaagcagggaaaauaacuuggugcaguaaacauucuucaaauaucacucuuuguggaaaugcauuagagggaggcaagaauggaaguuugcuauuaguagaauaggagagagaugaucaugguucaguuuagacaagggugguagcauucacuggagaugaaaaaagugagccgggcgcaguggcucacgccuguaaucccagcacuuugggaggccgagacggguggaucacgaggucaggagaucaagaccauccuggcuaacacggugaaaccccaucucuacuaaaaauacaaaaaacuagccgggcgugguggugggcaccuguagucucagcuacucaggaaauugaggcaggagaauggcgugaaccugggaggcggaacuuggagugagccgagauugcgccacugcacuccagccugggcgacagagugagacuccaucucaaaagaaaaaauaaaaaaguggacagaguucagaguugaugcauauuuugcagaaaggacugacagaauuugcuaauaggcuguauauggggagguaagggaaauagugccaaauguagauuuuuuuuuuaagaaaacaccuaaaauuggucuuuuaaaacauuuauucucccugccuuaaaacaugauaguuaauacuaguauucuacaugguaaauguuuccuugacacuuuuaucauuuuuauuuauuuauuuuuuuaggcuuaugcaucuggaugugacauuguaauacugggaagcgauuuugaaagauuacagauaaucccaggagcuaaacauggaaauauucaagugggauguguagacuguucaaugcaacaaggcaagguuuguaaucuucuucuaauauacaaauuuguuuggaauaugguuuuugucaggauaaucucugaaguguguauuuccuauugaauuagagacuuggcuuuguuucaaagauaguguagcuagaagaauuuuuggcugucuaagaugcauucuauagagugccagaaauucucuucuuauauaauuuuaaauuauagcaucaucuucucugagaaagaaauacaauacuuacugauauagaaugagucuaaagcuuacguauuuaaaaggugauuggacugggggaaaggaguaacaaugaaucuucaauauuuacaaauaaacuaaaggaaaugauuuagaauauuuuuuuuuuuuugucugugaacagguaguuaucuccuuguaacuucuauguaacaagggcuguguaacuuuuuguggaaaugaaaaacucuuugagaguuuauaauauucuaagcccauaagaaaagugaaaaacuuuaucuggacuucuauuugcauaugaaaaguagaaagguaaccuugaaaguaaaauagcaacaacauaaacaaaaguaacaaaguauaaaauucuucuagaucagguuaaauacaguuccuguaguaccagaaugagaaagucauacuacuaggcaaggcagcauaauauauagcuuaaaauaacuccauauaggcauaggugguaaggccuauauauaguuguagcuagacuggacugaacuucgcaaauacacucauaugauuccacuagaacauuuuguguaaggaaucaaaauggucauauuaagaguccauggacccaaucauuuguuuuuaaaucuaaucuucauuugagguaaacuuucuaggauuaaaaguugccaucugggacuuaaagauauuaauuauaaaacgaguuucuguuuucugaaucuuuacauauuuguuggacuacuguucuuuuuguuacaugguauuccuucccuuuaauauaguuacagguguccucuaucuuuuguugaggccucuuaugacuucucgcuguacaacaaaaaugaucuuuauuauggaaugcuggaaaucuuuggguuuuuuuuuuguuuuuuguuuguuuuuguuuguuuguuuuguuuuuuguuuuucagauggagucucgcuuuguugcccaggcuggagugcaguggugcaaucucagcucacugcagccucuggcuuccggguucaagcaauucuccugccucagccucccaaauagcuggaauuacaggugcucgccaucauacccggcuaauuuuuguauuuuuaguagaaacgggguuucaucauguugguaagucugguuucaaucuccugaccuagcgauuugcccuccuuggccucccaaagugcugggauuacgugagccacugcgcccagccuauccuugagauuuuuauuuucauucucuucauguuuguuugaucuucuagcucuuuuguucuguaaucuuucuuaacuguauaaaaacuugcuuaauaccaucuggacucacauggagcugguuaauguuaaaaauauaauuuaauacuuuccaauaugagcuaucuuuuugugauagacuauaugacaguccagguuagaaugaagaaaucauggccaugugugguggcucaugccuguaaucccagagcuuuaggagggucaaggugggcaaaucgcuugagaccagaaguuugagaccagcuuggggcaacccugucucuacaaaaauaaaaauaauaaguaaauagccggacaugguaguaugcuccuguaguccuagcuacccgggaagcugaggcgggagaaucacuugagcccaggaguuccaggcugcagucagcucugguggcaccacugcacugcagccugggugacaaagcaagaccccaucucuacaaagaaaaacaaaaagaggaauuaagaagucauuugguuuuauaaucauuuaaugaagaaauauuuucuucauuuacagauaucaguauuaucauagugguuccuuaaaguaucaggaagaaaauuggcagguucugguaccuggggacuucugacuguuuacauuuaagaaggaaauguucuuugggaagccgaggcagguggaucaugaggucaggaguucaagaccauucuggccaaaauagagaaaccccgucucuacuacaaaauaaaaaaaaaaacauuagcugggcgugguggcgggcgucuguaaucccagcuacucaggaggcugaggcaggagaaucgcuugaacccgggaggcagagguugcagugagcugagaucgugccacugcauuucaaccuggguaacagugugagacuccgucucauaaaaaaaaaaaaaaagaaggaaaugucauaggcaccuguauuuuuauuauuacuguuuuuuucuuuguacuguacuaccaccuaauucauuuuucugagaaaauuaauccucauuuauccuuuuauucaucagcuucaaaguauucuuagcccauuaccuuggaaaaguucaaauuguucaccuuggugugaggccuuuuacaaccuggcucagaucugccuuuuuagucucagguacacuauuguguuauaaggagcacucucuucuuggugggaugguggucauucaccucuaaacauacauugccucuuuuaaucuuuacaucuguuuucuuuuuuuuuuuuuuuuuuuuuuuuuuugagacggagucucacuuugucgcccaggcuggagugcaguggcgugaacucggcucacugcaagcuccgccucccggguucacgccauucuccugccucagccucccgaguagcugggacuacaggcgccugccaucgcccggcuaauuuuuuuuuguauuuuuuaguaaagacgggguuucaccguguuagccaggauggacucgaucuccugaccucaugauccucccgccucggccucccaaagugcugggauuacaggcgugagccaccgcggccggccuuacaccuguuuucauacuaugcccuauuuauaaaguugaauacucacugcuuuuugaaaucccacccauaauuaaaggcccaaacuaaacacuuccuccagaucaaugcagcacaagugauaucuauauccuaagaauucagaagccuuaaaauauccauucacaguuuuuucuccauguuuguuguguccucauuucuuaccuucucuuuacuacaucauauguuuuuuuuucuaucccugauucauucauuuaaucucucucucuguuugauuuccaauauuuugauguucuuuauaugagacucacucaaguuauaguaguaguuaccuuauaaaacagagccaggaaagguuaugauccaucaauuuaaagaguaaauucaaaggauaaaauagaauauguuuuaaaauguacucagggaguuuccagaggaauagaccuaaguuauauuuuugaaaaguuaauguacacugacagaauugucaauuuagaggauggaugacgacaauuaacauuuacugugcauauuguaugucacuuauuauauguuagguguuuuacaaauguuauuucaacccucaaugcuguuaggaagguaguguuguacauauuaugaacacuguaauggaaacuaacguuuggagagauuaaguugcuaguuaacguaguaaguugcaguucuaggauucuaaugcagaugugauagucuucaaaacugacauucuuaagcaucagugaaugaaauuguguguauuggcauauuuaaaguuauaguauucauuucuuugcuuuuuuugauucauaaguaaguuaacauaucccuaauaaauucuuuuuuucuuuuuaaaagauugcagcgucuuauggaaauguuaucuccauuuuugaaccaguuaaccuaccaaaacaaaagaaaaauuuggucaguaauuuaugauuucuucuuuuaggaauugaaauguuuuaaguauugaaagaguguaaaaucagagugaucauugaguaaaucgguauuacuuauauacuguaauugaaccuacauguuaaauuccauuuugauguuaaaaauauauuuaaauuuuucauuggaauagaacuaaaauaaauugugccaaugaauuguugaaaugcuuuauuauuuuauuucugacauuuuuaauuuuauaauauuucaagagucaguaaccuaaaguuuggcacuacuuuauugcuaguaucaaauaccguuguccagccauaugugguacucuuuccuuuguuuuauaaucuaccuuuauacagguuuucugccucuucagggcuuaacuuucuugcauuauuuagaucauguaauacagucguuaacaggucaaugaauguuuuucuuuauaagcaagcuguacucagaaauaguucugaaaacugguuacccaauaauuuauaaauauucgaaucauguuagcagauuuuauagguucuuuaaugcuugugccuguaauccucucuauuugggaggcugaggcaggaggauugcauaaggccaggaguuugaaaccagccugggcaagauuuuaaaaaaaguuuagccaggcaugguggcacaugccuauagucucaccugcucaggaggcugagaugggaggaucguuugagcccaaaaauuugagguuguggugagcaaugauggcaccacugcauuccagccagggugacacagugagacccugucucuaaaaauaaaaauaaaagcaaaccgucugaaagaagauaaguguagugucauugaaagagcaguguaagggagcuaaaugaugagaaauuaugaacacaaggaaacaacagacacugaggucuacuugaggguggaguguggcagaagggaggggagcagaaaagauaacuauuggguacugggcuuaauaccugggugaugaaauaauuuguacaagaaaaucccuugacacgaauuuaccuauguaacaaaucuucacagguacucccaaaccuaaaauuaaaagauuuuuuuuuuuuuuaaaaaaaaagaaagagcaguguauugggagucauaggacugguuucuauuucugggucuaucuagcuaguuggucuuagguaagucagccuuaagaaauucuuugcuuaacucucaaauugauuacuaucuauucagucuugaugggaauauuauuaggcuaacaugucaaagaugguuuaggaauguauuaauuauaaaggacuaaacuguuuuaauagcagacauaccuuuauauaucuuuugauaguuuucaugucaucuucacuuagcucauuaguauuuuacaaauuacuucaaaccuaguuugugcagccauuauuucuucuuuuuaugaauaaggcaguagaguaggcucaaagaauauagugacuugacaagugaagcagcuguuaagccacagaacuaagaguaaaaccaucuguauugauuccuaggugugaguguucuuuccuuaccuuguguuaaugaaaacuauuuucugaguuaauugauauuuaucuuuaaauuucauagaaauaguguucacacuucugauuucuauuuguuuuuauagauugccuagugaauccacuauuugagccucuuaaagccuuaagaauuaguaauuggcaguacuaaaaagaauuuuuuaaggcgauuaccccacccagcccagaacaguguauuucaguacucaauaaauauuuauuaaauaaaauaaguagcuuuugaaaaucaguauguuauguuaaaaugccuuuauugggaaggauagaauagagaauuucaauguuugcccauuuucuccuuuccuaauuauaauugaugaauguaauguauaaaacucaaaaagaggcugguuuauuggcuuaucagcacugacuuugcagaaaggacaauaaaaaacuugaugaagaagggcaaaaguggaucaaauggugaaguuauagacuugaaagauguauaaaaucuaugauucuaaaauauaguuucagaauguuuagauccuuguaaaaauauauucuuuccuuuucuuuguauauuauggaguauucuugugaggugguggucuucaugagaguugcacaucacaacuaccauuggauacaugugcccaaauccugcucugggaauuucuacaucuguagcugugggauugugucuaugcacuuauaugucuuguucuagagaggguucugguauguacugugauugaaagacauuccugcaaggcaguguuucaugaaagcauauucuguaggucaccuaugucaaaaucaccugggguguuaaaguacagguuucugugccccauccugaagcuuuugaaccugaauuuuugggcacaggucucggaaauuugaauuuuuaguaacaucucaggcuauuauuuguuguaccaaaguuugagagccaccacauuaagagaguaugaaucucaaucuguaauugggcugugaacucaacuuaguguaggccacaacccgaauuuaaaaagagaaugaaauagagaaaauaucagaguaugucacauguaauaaggacaaacauagguuauauuuauuuguauguguguguguucugggucagcauacauuguguauuucuuacugauuugcaggcagaaaaaaagggaaaaauuucgcuuuaagaaguuguaaggccauaaauuauauaguaguaucaaaauguuacaucuuuuauucugaauuuucccacauacuauuaugaucucagauggggacaaaacaguaaaagagaaggaaaugucaaauaguaaagccacagacacauuuaaaauuaacuuuuuaacuguaauaauaaaguaauaauuaaaucugaggcuauuaagacuguuauccaagguagcguaugguuauugauuguuuauacuaaagauagcauuuugaccaccaguuauggauauucucucacauaccuucuuuaucauguguucucuauuuuuguugacugaacugaacauuuuguuaucuuuaaaauugacugccuguguuauuguaagaauaacaagcauaaacguacacauuugacagagaaaauaugccaaucauaaugggcuaaaugacuuuucuuaauuuuaggaauuauauagucaguggcagaaaaguggccaauuuuuucuggaaucaauagcacacaauauaaccugggaucccacagguaagaaaauaagcaggauuaacuaaaaugaaauaucacuugccuaguuguucuuauuuuuauuacucuuauguauuucacuucugcugggugugagguuguggggaauaccaaagaaguaaaauggauuaugcccuuuuagaguuuauacugaaaugaagacagauaugcacuguaagaaaugagagaauguucuaagugccauaauaggauacccauuguuuuuggaaagagauauuucucuggagaauuaacguuucauugaaaaggagccuuuggaccugagaguaaacagacuuuagcaaugagaguuggguagauggaacaggaaaaaagugaaauuuaagaaaauauaugccaggcgugguggcucacgccuguauucccagcacuuugggaggcugaggugggcagaucaccugagguugggaguucaagacccgccugaccaacauggagaaacccugucucuacuaaaaauacaaaaaauuagcugggcauaguggcgcaugccuguaaucccagcuacuugggaggcugaggcuagagaaucguuugaaccuggaagguggagguugcagugagcugagcucaugccauugcacuucagccugggcaacaagagugaaacugucucaaaaaaaaaaaaaaaaggaagaaaauauaaugaauauauguaucaguuaucuauuucugcauuagaaaagcauccuccaaaaugauggauggcuuaaaacauccaucauuuuauugcuuaugauucuuuuggucaggaagacucugugggaauggcuugucuauuguuccaugugguagugacugaagcaguuuaucugcagcuaaaagauccaagaaaggcuuuguucacauaucugggccuugcugcuugcuaucuacuggaaugccuuuguucuccuccacauggccucuucuguggcccucuguagcagggcagccuggauuuuacaugguggcugcauucugagagugaaaguagaagcugcaaggaagucccagaauguuauugcugccacauuauauggucacagguccagcuaauauuaaggguugggagacauagacucccccucuugaugaaagauauggcaaagucauauuacauggaggcaucaacacagagagacauaauuuauugggagccauuuuuaccauucuacgaaagugagggaaggcacagagagagaaagcauaagauacauuauaauaaggauuaguauuucacugggcugagucucaguggugguaaggagauaagaccuuaccauguuauaggagaccuuuaaagucaugcuaaaaauuugaauuuaauucuuuaugguugucuaaaaacuauagguuuucaaaagaggcuagucauacaagauuuaugguuuugcgagauuugucugcuagcagugaguuagaagggucaguggcaaauggaacaggagaaggagugaccuuuggagagguuguauucucauuagucuggaugagaaauaagaacuuauuucaaugccuuuuccauaguagguguucaauuaauauuaaaugaauuaaugaauagugaaagguauacauggauaugaaauguguuuaggcaguagaauugacauuacuuaacaacuggauuugaaauuacuuugagaguaucuaugaccacacaaagaguaauauguaggaguuagagguaguggaacauaagguauuaauuggauauguggaccuugagaagcuuguauaucauaaagcaauauauagacauuugaaucuagaacauaaaaaguuaucuuuggggcugggcacggugguucaaaccuguaauaucagcacuuuaggaggcugaguggggagaauugcuugagcccaggaguuugagaccagccugggcaacauagggagacuccaucucuacaaaaaaauuuuugaaaaguuagucaggcuugguggcuggcaccugaggucucagcuauucaggaggcugaggugggaggcuuguuugagcccaggagguugaggcugcagugagccaugauugugcuacugcuuucuagccugggugacagagcaagaacuugucucagaaaaaaaaaaagaaaaguuaucuuugagacauagaagucaucagagagagauauaaaacuauugguaaacugauuaaugccuuucuuuuguguccaaauuuaauauuuuauguugccuaauucauaagauuuucuguuuuagacuuuuuaugcuuuuuuccugcuuuacuauccauaauauccugcuuuaauaucuguaauuuaauaucuguaauaucuaauucuuagaguuugaaaucaguauaccauauuauaucuuaccuacuuuuguuccauuccauaccugggauuaaguuuauauucuguauuaaauucuuaaucuuuuaugggauaucuuaauguuaucuucaguuuauauuaagcaaaagaaaaguuguaucuguugguaaguucaaaaguggaauaaucaacauauuuaaauggaauguuucauuacuucuugugcuuuuuuuuggccccugucuaugaaaccuucugucuaguugcucuacuauuuauugagcuucugcuuagugccuggccugugcuagagacuuugugcauauuauauagcuaauccuuacaacaacuguauuuaaaccucaaauuuuauagaugagaaaauugaaguucagaaauuacccaacuagaucaaauucacauggcuaauuaagcaucuuacuugggauuuagacacagggauuucugaucuaaagucuaugccagagauccacuuuccuuuugaaacaagaaaacgagggcgaagcaugcuggcccauaccuguaaucccagcaguuugggaggcugaguugggaggaucgcuugagcccaggaguuugagaccagccugggcaacauagcaagacccugucucuucaaaaaauuuaaaaaagugauuguucuagaaauacacaaaucuauagucuuaaauugccaaggugaaugccaucuuuauugucagcuuuuuugccaaaauugcuugucuuuuguauggaugauagcacggccuucuacuuaauucccaagucauagaguuggaaucuguccuuuaacccucuuguuuuuucucuguauuuauuuggugucaaaucuugacaauucuuuuuuucauuuuuucuugagacagggucuugcucuguugcccaggcuagacugcaguagcacaaucauagcucacugcagccuugacuccccaggcuugagugauccuuucaccucagccucccuagugucugguacuacaagugcgugucuaacuaauuuuuguaauuuuuuucuguagaggcaggguuucacuauguugcccagacaggucuugaacuccugggcucaagcaguccucccaccuuggccucccaaaguggugggauuacaggugugagccacugcacccagccuugacaauacuuuuugaaauggcuuucaaaugcuugcuuuuuaaauauuugguugagauccucauuauuuaccaucugaauuuuuuuuccuuuuuuuuugaggugguguuucgcucuuguugcucaggcuggagugcaauggugugaucucaacucacugcaaccucugccucccggguucaagugauucuccugccucagccuccugaguagcuggguuuacaggcaugcuccaccaugcccggcuaauuuuguauuuuuaguagagaugggguuucuccauguuggucagguuaaucuuggacucccgaccucaggugauccacccgccuuggccucccaaagugcugggauugcaggugugagccaccgugccuggccuaccaucugaauuucuauaguuaauuaaccagguuuaauaguuuaauaguugguuaaccacacacuuaugguuucccugauguugucugucucuggaguuguuuucuaaaaaguauuuuuaaccuucuuuguauacuagagucuuugaaauuucgauguaaguuacauauuaucuuucuggaaaaaugcacauauuguaugugugauuuuuguauguuaucucaauagagggagacucacaggccucuccaucuguugacugccccucuuccaguuaagcccucuuguucugaaauacagauccaauuuuguaacaacucccccacaaucccccacugccacuugaaaaucuuuuacucccaacuaccuauaacaaaguccaaacgcugugaacuugaaaaacucuucacagucucaccuuggcauuuuuuccguaguaauuuuuuuucuagccuaucuguguacguuauucguuaaccuauaccagauuaagaggcauucuugggaaaauacauaaauuuauaugucuucaugccuuuguucauguuagguuuccuuucugaaaugccugucucuucugcuuauucauccauuaaggaccagguuucauuuccucacuuuuccuggcacuuuuacuacagguacacauuaaugucuccuuccugugggcuuccauaaagcuuugcaugcauuucuaucauguauguaacacuuccacaugguaucauauuuccaugucuuucugcugaaauaugaacucaugaaaaacgacaauguuuuguuugucauuguauuuccaaugucuagcacagugcccgggacaaagaagaugcucauuaaauacuuguuaagugagagauuauaagauuucuuccuuucuaucucaagcuauuuuaacgaaauuaaaauacagccuucuccuccguucuucaaaauuuuuuuugauauuugacuuuuuuuuagaaguuguuuuauaugaaauucuugagcauguaaauuaagucacuauuaaauaccuaaauaauaaaugaggaauaauauuuuuuuuaggcagucgucuuuuaacugguuccagcuauuugcaacucugguccaauacuaacuuggagaagccaacugaagaugaaaauuuaaauaaaacagaucuuaacuuuggagauuggaaaugcauuuggcauugcaaguaagcaauuaaucaggggaguaaacugauaaaccuguuguucuaugugguuuuauuauaaauguauuuuaguuguguaaaaccacacugacauaaaaaguauugauuuuuagucuaugauaugcuuuuucuuauacacagauaauucucuauuucccguguucuacaaauacauuuuuuaaaaaugucaauuaaaauaggaagaaacaaauguguaaggcuuacaugaagaccauuaaauacaaacuugccaaauuauaugaaaagauagaugacuuucaugcuuuugaauggaagacuuccuauucugaagaaaucuauuuuucccacauaaucuauauauugaacauaauccuugccaaaaucugaguggaauuucuauuaagcauaguucuaaacucuacuuaaaaggacaaauaugggaaagucagagaaauucugaaagaaaagaagaaugaagauuugcaguauaguaaaaugaauucuaaugccacagaugaucaagcauuuuguuauugauguaggaacagacagauuaggauccaggauuagacucuggagugcaaugaugugaggcuuacugcaaccuccaccucccugguucaagcaauucuccugccucagccuccugaggcacugggauuacaggcacgcgccaccacaucuggcuaauuuuuguauuuuuaguagagacgggguuucaccauguuggccaggcuggucuugaacuccugaccucaggugaucugcccgccucagccucccaaagugcuggcauuacaggugugagccaccgugcucagccuuaagauagucuuuuauagcagggaaaacuagcuagcucuguagacgggaaauuaaauuagagucuuucauaccugauaccaaaacaaaugugagauggaaaaaauuucuauaaaaugaaacaaaaauauuagaggaaaauacaggugaaauuuuauauuuuagagcuacauuguccaguaugguagccacuaauuacauguuauuauugagcacuugaaaugcaacuaguccaaauugagaugugcuggacuucaaaaauuuaguauuaaaaauaguguaaaauaucucuaacauuuuaaaaaauauguugaaaugauguuuuuauauauuagguuaaauaaaaaauauuaauuuugccuguuuuaacuuuuuuuaaaaauguggcugauaggaaauuuaaaauuacauauuuggcuaacauuugucauuuauguuauauugcuguucgacaagaaaugcugcuuuagaguuagggaaagacuaagaaugacacccaaacuggaaauggauaggauaggaaaaauuaauaguucuaaccguaucaauaaaacauuucuauaaagcaaauuguccauaagggaagaaacacaaacaugaggagaaauaugugcaguuuugggcaaaugcguuuuuaaaaguaggccuuaaauuaguuagaaaagaacagguauaacaauaguaagcaacauugggcaauggagagaaaauuuuaacaagauauagcacauauuaaaaauaagugcaauaagaggugaucucacuugaaaucaagaaugugaaauguucagaaaaaggaugaauguuaucuaauaguguuuagagaaauaggugcucuuguauacugucaauaaagcaguacaguugauauuaucuuuauuuuuuuuuuuugagacgaagucucgcucugucgcccagccuggaaugcaguggugugaucucagcucacugcaagcuccgccucccggguucauaccauucuccugccucggccucccaaguaguugggacuacaggcgcucuaccaccaugcccggcuaauuuuuuguguuuuuaguggaaacgagguuucaccauguuagccaugauggucucaaucuccugaccucgugaucugccugccucagccuccccaagugcugggauuacaggcaugagccaccgugcccggccugauaauaucuuucuagagcacauuuuggaaguaugauucaacaggcuuaauuuuuuucauacccuuuaaauaagauugccagguuucauuccuucauucaacaaauauuuguugaaugguuccagucagcuuuaaagaugcuuagaauauugcuaugaacagauagggguagauagaaaauaaaccaguaaacugguguaacaggauuuaagugaaacugacuagguuuauaugaaguggugauagcauaaauaucacauaccaaaguaaggcagacgucccauauguagaauuuacagaggagauuucaaaggagcucguuccauguauuuugcaccccucagauagguaauggguuaacauguagaaagggaacagaauuuugcauaaauaauucuuuagaaagagcuguaggcugggcucgguggcucacgccuguaaucugaacacuuugggaggccgagguggguggaucaccugaggucggcaauucaagaccagccuggccaccauggcgaaaccccgucucuacuaaaaauacaaaaauuagccaggcgugguggugcaugccuguaaucccagcuacuugggaggcugaggcaugagaauagcuugaacccggugguggagguuacaaugagccgagaucacaccacugcacuccagccugggcaauagagugagacuccaucucaguaaaaaaaagaaaaaaauaauaauaguauuuugucuuaaggauauccuuaggauuaaccagauguucuaaaaauguguguacaggcauguucacuucucuuuuuuguucuuguugcagcaaaaauuagaaaacagcagugaaaaauuauuugaaaucauuguauguauauauauguaaacauauacaguggaauauaagccaguaaaguaauaauguagaucuguacaccugcacacauauacacaucuuuugcaucuauaugcaaagauguucaugacauauuuuuguuguuguuguuguucgagacggagucuugcucugucacccaggcugaguaugguggcgugaucuuggcucacugcaaccucuaccuccuggguucaagcaauucuccugccucagccuuccaaguagcugggauuacgggggcaugccaccacgccuggcuaauuuuuuguauuuuuagcagagaugggguuucaucauguuggccaggcuggucucgaacuccugaccuuguggucugcccacuucaggcucccaaggugcugggauuacaggcgugagccacugugcccagcccaugacauauuuuuuuagugggugauaagugugacuucaguuucuagcccuacuuuucccaccuuuuccugcagaaaguagagagaguggagagaaggauuuggaaguuuauguauuaaaauguuaacauuggcuuugucugaggaaaggauguggugguacuggugaaaaauguaaaugauuucauuugguuuuuaucuaccuguaucaacuuuucuguaauguauuaugcuuaaaaucagaaaaaaaaguuauuuguaucugaaaugaaaugugacagaauuccucuuuggauaucuuuauaaauaaauuuagaauugaccuaucuaaucaugcauuugagcaaagaaaaggaaagcagugauaguggugagugucuugagaucaguauauaugaguagcuguaagggaaggcaaugaagagaaaugaaccaaaguuccuuugagaagaaaaggcaaguaucuaacaaguauauaggugaagcugguaggcugaauuccuaauuguugcaaguccccuguuaacccacacauaaucuuuaauuagguaaguauuacccuaaggcaaacuuauuauauauuauccaugaaaauguauguuggcauauagggauccaugguucuggaaacuagauuuucagauuuaaaaaaugaaaccauucucucucauucuaagggaaugaaaguuacaacuuuuguuuuaggcuuuaaagauuuugacaagccauuccuuccaugagucuauggguguauguuuuuauauuuaaaauuuaucuuacuaacuaguucauuuuucagguacacaaagaugugggugugaaacuuauaacauuuucugucuuuugaaccaauugcugauuuauaauuuugagaauauugaacuuuuucuuuuuaguuuucauugcaaauuauuccuuaucuguuuaauuuacagaacugcuucccaaguucauuuaaugaaauuuucaccagauggagaauuuuuugccacugcugggaagguaaauugugaaaaugcuauugccaaauuauguguuuauaguuuacuuugaaacuuuaaaaacaucaacuggcuucauucuuuuauuuauuuaacuugaaaauaauaguuuccauuaaaaauuguuuuuuuuguuuguuuguuuugugauggagacucacucugucauccagacuggagugcaguggcacgaucucggcucacugcagccucugccucccagguuaaagcgauucuccugccucagccucucaaguagcugggacuauagccccacaccacuaugcccgucuaauuuuuguauuuuuuaauagagacgggauuucaccauauuggccaggcuggucuugaaccccugaccuugugauccgcccaccucggccucccaaagugcugagauuauaggcgugagccaccaugcccggccauuaaaaauuuuaaauagcaaaaauugacuccauuauugugguguuaaaagacugugugauauaauugaaauuacauagacuuaggggcagaucuggauauaaaucugccauuuaccagcuuuaucaccuugggcaaguuaaucuuauugagccuuucuuuucucauguguaauaugaggauaaaaacaccuaccucauaggucauuaaucguaggauuaauuuagacaauauaugcaguauagagugaccggcacagugccuuucauguaguauacaaucaauaaagcauagcuucaauuuauauuaccuuuuagcugauguguauuaggcuguuuuuaauauauaagacuucauaggcuuucuagaaagauacuaguaaccauuucuuuaguguguauacuuuauuaccugucuauuuuaaagcaauguauuucuuugaaguuauuuuuauucauugguucauagagcauuucacgagcugcuaauaagucaaauuauuguucucauggcucaaagcauucugcaaacuaagaguguaaguuacucuaaaaccacaguaagguuuuuguuuuuuaggagagaaguugagcuguuuauucugauugacuuuacaggugggaacucaguuauagcuuaaaagcaguaccugguacauucuaguccccuuugcuuuuccuuuauuucccaaauuaugacuauaaauuugauuguacaaagaauauuuuauauaguauuuauauauuaacucauuuuuuucaccaucaacauuuucuuugaaaagucacaugaaaauucaugaaaaguaucucuuuuuuucaauaauuagcagucuucauaagucugcuagugguguugauuacuuauuuaauauuuggcuuacuggaaaagacguccuuaauuuuaucuuucaguguuuccugaaugacuccauuccccuuacucuaguaauuagcaagcauuuuucuugaacacagaauacacacauucacacacuucaguuuuuaaagcacaguuaggcaaugcuaauagaaaagugccagaaucagaauuuucuuaauuccucugugcucaacgucucuucccauccccaaguucuugccauuggggagaaaauucuuacuuuugcuauuugauuuaaucuuuaauucugaucuccaugauuuucuguuuuguuuuuuuuuuccuuaggaugacugucuuuugaagguuugguauaauguagaaaacuggcggacagcuguuacuucuccagauggaaguucagaaaaacaaucccaaggagaaauugacuuuucuuuuguguaucuggcccauccucgagcaguaaauggauuuuccuggcguaaaacaagcaaauauaugccuaggucaguggauuggucauuucccuccacauauuaagggagcaucaucuuuguuacuuugauugcuucucucacuuuugagaguccauaguuacaggacuucugagccuaugaagauuagaguaauauuaaaucgucucuggccugcacaucucuggcuguggcucaacuauguuugaugcuuaggauaagagccguauuaaaggaguuuaagcugggauaguuuacuccauaucagaugucuuuaagucacagaguuguacauauuuucuuuuucuuuguguuuugugucuaauucugucaucuauuuucuccagauuguuguuuguuuauauuuuuacauaaauacucugucgucuuguaccuucuaguaugucuucccugguuuucuucuuuuaaaaaauagcuuuauuaagaggauauaucaugaguucuuguauguuuauuugacuacacccagcauaugugaggaaaagagagaguagguuaauacccuaccuuauucuucuuugaaacagcuauaaguuuaaccacaaaagcacacagugacacacacauacauauccucaguaucuucuuuuuuuuuucuguaguucuggaaagaguuaauguaauacugaauuuuaguagguuauagagaccuauuacuuaaauacagguauaaauucccuauuuuuguuuguuuuuuauguguuuuuguuuuguuuaguuuugagacagggucuugcuuugucacccagacuggagugcggugccccagucauggcucacugcaaccucuaccuccugggcucaagugauccucccgccucagcgucucaaauagcggggacuacaggugugugccaccaugcugggcuaauauauuuuuuucuuuucggauuuuuuguagagaugggguuuugccauguugcccaggcuugucuugaacuccugagcucaggcgaucugccugccucagucucccaaagugcuggaauuacaagcaugagccaugugcgcagccagaaaucccauuuuguacuauauggccauuuucaacuuggccacaccauguggcauuuuuucccuagcuuuucacuguucuaugaauuuugcugacuagauguuuugagcuauaguguagcuauagccaggacagggauagagaaaagagagugagaaaaaauggagggagaugggugugaggauggggaaaggaggagaaacaagggguuggggaaggaaaggaaaaagaugcuaggaagggagagguaggggacagaaggagagagguagaaagggaagguggccuggaaaggcugugaaagcaaagaauggugggagagagaagcccggagaggagguagaaagggagaagaaaacaaggaaguagacagaaagaggagagggcgccagagggagagagaugcaagaauggaggagggaaggagaaggagagagcaaccaauacaaauuaugcuguucucccuucuguucugcaacuucuuuuuuagucaguuagguaaguuuaacaaaguggcuacuagacaauauuuugauuucucauuuacuuuaacucacugaguuacugauaaaaccugcugauuguuccguuuuuaaaaaucagauauguaugcuggaacaaguuacuacuacaaaauauugugacuuuuucuuucuuucuucuaaacuuacugaauucccugauggaagguaguccuugcugauaggguuucaggcuuugagcucuuguugcuuguuggacuuauuaacauauauguaauugauuuuugcuuuuauuuuaaggagguggcaaaaaggaaauuaacugaaagucaaggaugacuaaggagggggaaguguuuaguacuuuaucaugaauauucaauucuugcauuucacugcuuugggcaucuguuagguaaggagagaauaaguguacucaguaguuacuguagcuuuuugugacagugugcaggugccuuuauaggaaguagaaaugaagcauaugauauaauucaaagaacuauccacucaauaaaucagaaaaucuuauuagaagaugugguuauuucuuaugugucaacugagagauuguggcuuaaucucagucuuuguuuuuuuagauguaaaaagaaucuuauugagugcugggaugguggcacacaccuguaaucccaggaugaggcgggaggauuacuugagccagaggauugcuugaauccaggaguuugagagcacccugggcaacauagugagaccacaucucuuaaaaaaaagaaagaacguuuggcaacauuauugaaacaagaacuacugaauucuaggcagaaaagaaauagguuggcaagcauuugcugugaugaaaucuguacauauugauauuuucuucauugguaccuuaguugguacauuuaaguaauuacagaaacaucguagaauuucugugauacuaugugaaauuuguauuuuugcuucuaaaaucuuuucauuccuuagggcuucuguauguaauguacuguugacuugcugcaaagauaaugugugucgucuuuggguagagacauuuuuaccaaaugauuguuugcuauacggaggugacugcagccauuggacugaaucaauuaauuuaacaaauaacuucaagagaaaugcuuccaguaaagaacgaguucaaaaugcuuuagaagugaguguuuuuguuacauuacuuacuacaaguuuuaaaaccuuugguacauugccuuuuugguaacacaguaauguuauaaaaaaacuauauccuaggaaaauaauucuuagaaaauuuucaguucuauuugguucaaaaaacauauuuuuaucuagauuuugucuggaacacaaaacuaccuauaauuaugaaguuacucuuagguuuacugaugaugauaaaaggaugauuacauuugacuuggcugaaguaacaugaaguaaaaucugagaaugcagagauuuaacucugaaaauaacuuauuuuuucuuucuuagagcuugaguaguuuguccuauucuguucuucuaccauuuuaucuuuagaaaacccaccccacccccagaacuuggggucuuuacaaauuaauauugaaaguaaaagucaauuuuugauuuuuggacaugcuaaagguagaauaguaauacauuugaucguagccuaaaggcugagaaacaauaguagaauaguaauacagauucuuccaauuuuuuuuuuuuuuuuucugagacagauucucacucugucaaccaggcuggagugcaguggcaugaucuuggcucacuguauuccuggccuuagacuccugaguagcuggaauuacaggugugcaucaccacgcccagcuaauuuuuguauuuuuaguagggagagggcuuuaccauguuugccagggcuggucucgaacucuugaccucaagugaucuaccugccucggccucccaaaggacugggauuacaggcauaagccauggcgcucggccuauuauuuucuuaauauugaaaacgaagugauuuuauuuuuuguggauuuuuuuuuugggugggggaguuguuuuguuguuguuuuuugagacagagucucugucugucacccaggauggaguguaguggggcgauaccagcucacugcaaccucugcuucccggguucaagcaguagucccuccucagccucccgaguagcugggauuacaggugugugccaccacgccuggcuaauuuuuguauuuaaaguggagaugggguuuugccauguuggcucaaguaauccucccacaccgguuggucucgaacuccuggccucaagugaucugacugccuuggccucccaaagugcugggaucacaggcgugagccaccaugcccggcccugaaaacagaagugauuuugaaacaauuuaucuuugaaugcuuuguaugauuaugcagcaacaauuuuucuaauuugaauaguauucugaugccucagaauauaauaaauucuguauugauucaacaacgaauagaaugguuacauguaguaauagcugaaagaaguuacugaccaggaaucugaagacuuguucuaccuuuugcccugccucuucuuagcuagaugaucuuggguucuauauagaccauuuuaucauaugaaagaugggaauaacaauauuugcacugccugccucauggcaucaaaugggaugaucucuaugaaaaugcuuuguaaauuaugaaauguuccaugugcagugguaauauuauuuaauacuguguggucacaaggaguuagcuauagacaaaagacaguguauguagagauaucagucacaaacaauaguauugggaaaaaaauuuuuaacauuugauuuuaggaaauacauuuuaagaaaauaagccuaauaaaaauugcaaaacacugugugaggauuaagagaacagccagguacuuuaagucauaacuuuauucuucaggauucaaauuugcuauaccaaaauauugaaagguguuuuuacauauaaaauguuaaaaggcguuuuuacauauaaaacauguaaaauguucugagcuaggauauauguaacuucugacaaucauuauauaaccuauacguguaugacuuuugacaauauagguauuaguuuuguuucuauucacacagguaaaucugagacauuuucguagaggucggaggagaucacuugcucuuguagcacauacgggauaucuaccacaucagcaggauccucaucauguucacaggaacacuccacugcaugccaaugcacuuugccacuuucauauugcagccagcaucaacccagccacagguaaugaaacauuguucaaaacauguuucugaaauugaauagauugauuuuauaacaacuaaguuauacuuuuaguuuucaaauaaguaaaauauuggaggugacugucuuagccuauuuuucuuuuuuuuuucuuuuuuuuuaauuuauuauuuauuuuuauugaucauucuuggguguuucuugcagagggagguuuggcacggucauaggacaauaguggagggaaggucagcagaucaacaagugaacaaaggucucugguuuuccuaggcagaggacccugcggccuuccgcuguguuugugucccuggguacuugagauuagggaguggugaugacucuuaacgagcaugcugccuucaggcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaacaugaaaagucucccaugucuacuucucucuacacagacacggcaaccauccgauuucucaaucuuuuccccaccuuuccacccuuucuguuccacaaaaccgccauugucauccuggcccguucucaaugagcuguuggguacaccucccagacggggugguggccgggcagaggggcuccucacuucccaguagggguggccgggcagaggcgccccucaccuccuggacggggcggcuggccgggcggggggcugaccccccccaccucccucccggacggggcggcuggccgggcagaguggcuccucacuucccaguaggggcggccgggcagaggcgccccucaccucccggacggggcggcuggccgggcagggggcugaccccccaaccucccucccggucggggcggcuggccgggcggggggcugacccccccaccucccucccggacggggcggcuggccgggcggggggcugacccccccaccucccucccagacggggcggcuggccgggcagaguggcuccucacuucccaguaggggcggccgggcagaggcgccccucaccucccggacggggcggcuggcugggcggggggccgaccaccccaccucccucccggacggggcggcuggccgggcggggggcugacccccccaccucccucccggagggggcggcuggccgggcagaggggcuccucacuucccaguaggggcgaccgggcagaggcgccccucaccucccggauggggcagcuggccgggcggggggcuaaccccccccaccucccucccagacgggguggcugccaggcggagaugcuccucacuucccagacgggguggcugccgggcggagaggcuccucacuucucagauggggcggcugccgggcggaggggcuccucacuucucugacgggucgguugccaggcagagggucuccucacuucucagacggggcggccgggcagagacgcccuuccccucccagacggggucgcugccgggcagaggcgcuccucacaucccagacggggcggcggggcagagacgcuccucacuuccuagaugugaugguggccgggaagaggcgcuccucacuuacuagaugggauggcggccgggcagagaugcuccucacuuuccagacugggcagccaggcagaggggcuccucacaucccagacgaugggcggccaggcagagacgcuccuuacuucccagaugggguggcggccgggcagaggcugcaaucucggcacuuugggaggccaaggcaggcagcugggagguggagguuguagcgagcggagaucacgccacugcacuccagccugggcaccauugagcacugagugaacaagacuccaucugcagucccggcaccugggaggccgaggcugguggaucacucgugguuaggagcuggagaccggcccggccaacacagcgaaaucccgucuccaccaaaaaaauacgaaaaccagucaggcguagcggcgcgcgccugcaaucgcaggcacucggcaggcugaggcaggagaaucaggcagggaggcugcagugagccgagauggcggcaguacaguccagcuucggcucggcaucagagggagagcguggaaagagggagaggggagaccguggaaaggggagagggagaggagggagagggagaggagggagagggagaggagggagagggagagggagaggagggagaggagggggagggagagggagaggagggagagggagaggagggagagggagaggagggagaggaggagagguagagggagagggagaggccuauuuuucauuguagcaagcucacugauuucuguuuguuugcccuuuaaggccaugacuugacuugugauuuaggaucuugauaaggcauugaaguucauuauuaguuuauucaaaaauugauauuugaacuguuacuuaauaaagguuaguacuacagauauaguauuguauuuuuuuaauuuuuauuuuuuauaggcauggagucucacuguuuugcccaggcuggugucaaacucuuggccucaagcaaucuucuugccuuggccucccaaagugcugggauuacaggcgggagccacugugccuggccuuucuuuaccuuucuuuuaaaccauagauuuguuuuggagaaaauuguuuacacuccuugaguucauucuagccuuuacaguuuagcagacaccaacaugauccagguuugauuuaaugugauacuuaaauuuuugcuuacuucuacuaauuagggauuauuugcagcaacucacuggauuaguacaucaguguacucaauuuaacauucauaucaaaaguaacaccaaggagcugggcauggucacucauaccuguaaucccaacacuuugggaggcugaggcaggcagaucaccugaggccaggaguucaagaccagccuggcuaacaugguaaaaccccgucucuaccaaaaauacaaaaaaaaaaauuagccaggugugguggcaggcaccuguagucccagcuacuugggaggcuggggcaggagaauugcuugaaccuggaaggcagagguuguagugagccgagauuacacuacugcacuccagcuuccuggguggcagagcgagacuccaucucaaaaaaaaaaaaaaaaaguaagaaagaccaaggaacaaaugcuuuuuuagcugugugacugucuugaaugcuuuccuugagcgugagaagggaaccucaacuucagucuuaaugcuaacaaauaagcaguccaucuuagaauuagcucauuaaagagguugauaggucagucuauuaaguaaaaacuaguuguuguugauauuaagauacauauguuacuaguuccuuugacauuauggugaugacuuuuuuuuuuuuuuuuuuuuugagacagagucuugcucugucgccaagcuggagugcagugguguaaucaaggcucacugcaaccucugccucucggguucaagugauucuucugccucagccuccugaguagcugggauuacaggcaugagccaccaugccuggcuaauuuuuguauuuuuaguagagaugguguuucaccauguuggccaggcuggucucgagcuccugaccuccucgugaucugccugccuuggccucccaagguggugggauuacaggcgugagucacugcacccaaccaacauuuuucuuuuauuguggaucaguuuaaaauuugcuuguuaccaaaauuuguuauaaauuaagauacuucuauuaacagagcuacaaauuauagacauuuuaucaugugaauauuuuucacuguuaaacauuuaugguuaaauaaauuauacuguaugaccuaggacauauaauuuaaucuccuuugcaauagauacauuaaauuuaccguuuaaaucuguuacuguuaauaauaguggcaaacauuauguuggaagucuucuuuuacaucacaacauuguuaugugaauuuuugacaguagaaacaaaaauagagaacuacaauauaugaauauagcuaaauacagaauggugacuuuuuucucuucaaggguaaaaagacuuuuuuucucuucuagugaauuagacugcauaaauagaaaaagauugauucauuagcuuuacaguuuugccuaggaaugaucuauaaaugcauuuccccaccugcugcuuacggaaaguauaaaaaggaaguuaaaggaaaguuuccuuguugguuacuaccauaagaaaggugcuauauucuauuuuagcagggccacuauauggaaaauaucuaaauuaaauguuguuacaaaaaugaauuacuaaugagauucuagcuaaggagggcacuaaauguggauuuuguguguguauauauauauguaauuauuauuauuguuauuauuuuugagaugaagucucacucuguugcccaggcugaagugcaauggugugaucucggcucacagcaaacuccaccucccggguucaugccauucuccugccucugccucccaaguagcugggacuacagacgcccgccaccacuccuggcuacuuuuuuguauuuuuaauaaaggcgggguuucaccauguuagcaaggauggucucaaucuccugaccucgugauccacccaccuugaccucccaaagcauugggaauacaggcgugagccaccgcgccuggccaauauauauuuaaaaaauccaaaacaaacaaagguugcuauaaaaaagcucuguauguacuguaagcauauagguuuuuuucuuuuuuucauguguguuuuuaaacaauggaagagucaacuguguuagacuaaauuauguuauugacuggguucgauggcucacaucucuaaucccagcacuuugggaggccgaggcgguggugaagucaggaauuugaaaccagccuggccaacauggugaaaccccgucucugcuaaaaauacaaaauuagccaggcgugguggugucugccuuuaaucccagcuacuugggaggcugaggcaggagaaucgcuugaaccugggaggcggagguuguagugagcugagauugcgccauugcccuccacccugggcagcaagagugaaacucugucucaaaaauaaaauaagguaaaauaaaauaaaagcauuauuguaugugcugcauugaauggaacguuuauauuauaauuaucaaaaaaguuugcgucauagcaauuuauccucauugaaaaccuugcagcauccuuuuauuuuggaauauccucucaacagucauaccaccaggacaugacuguauaacaauaaaauauucucuugcauuaaauuggggauaucuauucaauaaaagacaaaaaagaaaauguaggaaguguacuuagagcuguuacuuucuaagugcccaacaccguggacaauucaagcaucguaaucucuguaaauaacaauaacaaaaaaaauuuuuguccugcuguuaaaauccaucauuauagacaaaacuggugaagauugauuagacagauucaucuaacacugauguccaagcuggcguuggcaacuaaugcauaacugguggucaauagagauuuugaaagaucuucacuuucuauuguucuuuuccaggggucuugaagaguucuguucuaaaauauguuguugaguugagcuucucaguuugcuuuuucauucucaaacuggugacguuuuuccucuaauucuuugugcugugcuuaaauuccuuuuugcucuuggcaccguuggagcucaguuucagaguccuucaguuuuugaacuuuuuuuuuuuugaccuucaucuugaacgccugcuucaucuuuguccccaucuucuucauuuuagcuacaugcugucuucuuuccucuuccauuugugccagagggcucuuaguaagcugcccuuuauucuuguuguuuucaacuccauuguaagucaggugccauuuuucugcuucugugguuuucguaaugggcauuaucaggaacaucuuucaagucuuguauguguguuccuaucaagauacuccuuagaauuguaaaauuacagugcucaccauauucaacaucagcaacacccuuaggauacugccuuccucugacucucuugccauuaacuucaaugguaguauuauuggcuaccacagcaagugguaaacaguccuuuauccuuuuuuuuuuuuuuuuuuugagacagagucucgcucugucacccaggcaagccuggugauagcugguuguccaggauagaauuuuaguucaacuuuaaacuuaccgaauuacucacagaauuuuacuuagucugguaaucuggagugcagugaccgauagcucacugcaacuucugccuccuggcuucaagugauucuugugacucagccucccaaguaauugggauuacaggcacaugccaccaugccuggcuaauuuuuguauuuuuaguagagaugggguuucgucauguugaccaggcuggucucgaaccccuggccucaagugauuugccugcucuggccucccagagugcugggauuacagacaugagcugcugcacccagccaguccuuuaucuuuuuaacaaguuuauuuucuucaucauguguuuuuggaaauucauauauuuaauuuuauguucuuagauuucuuucauuaucuguuuuuaaacuauuggcauuucucugguaucagcaugucugcuuuggcaauaagugggaaugauauucacuuuuucaagcaaaagcuucauaaacuuaguaucaaaugguuuaaguccauguccugaaggagaaaugaaguauaaacaacccugcacccuguuaugaggcaucugacaucuguuuuaucaugauucuccauuuaggugguccucaauuuacuaucaguguagucaguaaccaacaauuacuauuacccauugcaagucuaaaucaugggauaucaacucuugugagcagcaacugaacaccaccuucuuugauuaaaacuuugcauaguuccaccugcacggucuuuuuaauucugugagaagaaucuggauacucuggagaauacagagugaagaauaaugaguugauuaauguaaaguuucugaauccagauuuccccacugccauaaguaugaauuccaacccucucuucacugauuuucuggauauuugauuugggagacuggaaaaucccacguagacuucaggguucuuccguugagcuaccaugcugcuguugaugcuucucuccucagcagcagaucucuugcugacugacauacccuccccacuccaugacuagccccagcuggaaaucuuauuuagagguuaaauaaaauguguuccagagauuuaaagauaaaugaaauauuauaaauuuguucagacccguagaauguacaacaccaagaaugaacccuaagguaaacuguagacguugggugauagugaugugucaguguagauucaucaauuguaauaaauguaccacuuuugguaguggauguugauaaugugggaggcuaugcauauguaggauggggaauauggcuguaccuuugaauuuugcugugaacuuaaaaauacucuaaaaaauaguauuuaaaaaaucuuaaaauaggccaggcacgguggcucacgucuguaaucccagcacuuugggaggcugaggcagguagaucacgagguugggagaucgagaccaucuuggccagcguggugaaacccugucucuacugaaaauacaaaaauuagcugggcgugguggcgugugccuguaaucacagcuacucgggaggcugaggcaggagaauggcuugaaccagggaguuugcaguaagccaagaucacaccagugcacuccagccuggcaacagagcgaaacucugucucaaaaaaacaaaaucucaaaauaaaauuaaaaagugaaagagaaggacuuucaggcaaacaaaauauaaauguaauaguaauaaaaauaugaaacauggauguuucauaugcuagaagguaaaaauuuuaauuuuaucuuuuuuuucucuuauagacauuccacuucuuccaucuauuacaucucugagucuaaaugaaaaugaagagaagaccggaccuuuuguuguacacuggcuaaacaauaaagaacugcauuuuacuuuguccauggaaguuuuuuuacagcaacuuagaaaaaguuuugaacaaccaucuucugaggccaguguagaagauucuaaucaggcagauguaaaaucugaugaagguaaacuuuaagaggaaaggaaaauuuaaaguuuugcucaaaauagcaaacauuuucauauuaggguaaaacuagcuacuuguaauaaacuuuaaaguugcaaugacaugauccaaacauggacuagcucauuuaauaaucuaauguagauauuucuguuauagguagcuuucuuccacaugguuauuuaaggacuggggguucucauucuucugguuuuguuagcccuuaggacuuuccuauauaaaggacuaucuguagacuagcagcauugguguuacccaggagcuuguuagaaugcaugucucaagguccacacagacccaccaaaccagaaucugcaauuuaaugaaauuuccaggugauuuguauguacauuaaaguuugagaagcauugaaacuaggacauuaaauuucucugccuuuggccuucaguugguauagagagagaguuagagagaaagaaagcauagcuauuugucagcuaccuugauugacgcauaucacuuacacugucauucagcuggcaagaacauucagcuggaauucacagggcccguguaguuccugacucuguagccuuuauaugcugagaaauggaaaguaagaaacuguggugugcagcuagccaucucugugacagucugugguucauaaauguguuugguuuuuuuuuuuaaaguuuuguuuuaauuuguuuaauuuuuaauuucaagaugguuuaugaucauuagguaagaaaaaucaaacagguacacagauaguuaugaaguuuccacauuguuaaguuugauaaguauccuuccaguuugauucuuugcuuaugcucacacaaacaucuaaauacagacacuuaaaaguuguacugugggugugcauuuuuauacagaaauaauguucugcacuuuguguuuuuuuuuuguuuguuuguuuuuuuuugauggggucuugcucugucacccaggcuggagugcaguggcacaaucuuggcucacugcagccuccaccucccggguucaagcaauucuccugccucagccucccgaguagcuaggauuacaggcauccgccaccacaccuggcuaauuuuuuuauuuuuagucaagacaggguuucaccauguuagucagacuggucucgaacuccugaccucaggugauccauccaccugggccucccaaagugcugggauuacaggcgugagacaccaugcucggccugugcuuuguuuuaauucagucaguaaugggcaguuuuucauaucauuguauuuaacggcugcugaguauuccaugucuaagagaaaugucuaacaggucuucuauugauaaacauuuaaauuaauuuaaauuguuuuucauuauucuagguacaaugacuugucuuuuucuuuuuucugugaguuuuucuauaaucuugauuucuagauggggaauuuccagggaguguagcaauuuaaaauaucaauaacuucugacaaauugcccuccagaaauguuuuaccaguuuauacuuccucuaaguguaucuaaauauaugcuuuacauccuuaucaacauuggauguuuucauuauauuacuuuuuuuuuuuuuugccaguugauaacgggacaauggacaucuuguuuuacuuugcauuuucuugaugcaaauuaagcagaauaucuuuuauuauauuuuugcccuucuguggcuugccuuuuaauacccuuuaucuaauuuccugcugaguuuuuuuuuuuuucuuauugauuuguauaucuugacuuacuuuuuaaaucugguaaacagucaaaacuuaaaaaaaauauaucucuucagagaaaggcucuauauugcuaaccaggaauugggggagggugaggggacugggauuuuugaaagaggaaagaauauacauauuuaccuguauugauaaguugauacacaguuuauuuuuuguuacuaagguguugaaggaaaccuggaaauuggcaccauaaaugcauuuccuugaaaugauuucuuuaagaugccauaccaguuacaaguccauacaccuagaggauaacuaauguagcauacugagguuuggauaaaccugguacuuuagagauaaaguacaaauuacacucaaauaauguauuuuaaaaacucagucccaauuuuaguuccaauuccaauuccuucuuuuuaccaugagcaaaacugagguccagaaaaguaguguguguuacuaaagguuaacugagugguuaaauauagaacaucugcauugagaagccaguuuacuuauuuuccaguuuaauauuaggucuucuaccaguaauccacugacucaguccuguauggcuacugauuacucagugaacuucagugaccuuauauuccuggagcaaaguuacuuuuaaugcagagcccauuucuuauuaauaugaaaacuguuauguuuuucaucuugaauccauuuauaaagauauuuguguguguguuuguacuaauuguauuaguuuugcuaaggcauuuuauguuccucacacucaaggcaaagagauaaaacauaaucugaagaaaaauauauacuucuucaaaauaaaaagagucuucuucauuaugcagaucugggcauauuguacaauacuuaauggcucaaggggaucaaaguaccaguuugaugcugauucacuaaauagaaucucauucauauuugaugacuggacuguuugcgggcugugauagauugaaccauucuggugauauccccagaucucacuaaauaagaaaaggcucuacacuagaauaugugacaauugaucuggcuauaaauuaugucuauaggcucuuuauuauuauaagguggcgaaagaggccccuuucuugagcacauguuuaauaaaaguauuauugucaucuauagauugcuggauugauuuuguguuguuauaaugaagauaaggugcauauaccacugucagauuaagaaaguuacauaacuuggccgggcacaguggcucacgccuguaaugccaguacuuugggaggccgaggcagguggaucacgaggucaggaguucaagaccagcuugaccaagauggugaaaccccgucucuacuaaaaaguacaaaaauuagccgggcgcaguggcaggcaccuguaaucccagcuacuugggaggcugaggcggaauugcuuggacccgggcagcagagguugcagugagcugagaucacgccacuguacuccagcuggggcaagaguaagacuccgucucaaaaaaaaaaaaaaaauggagcaagucccuuuucuggguugacaauuaguccuauauuggcauugcugcuggcuaugaaacucaccaccaaagguaaacgauuaauuugaacuacuugguagguguuaugguaacaaaugauacuuuuauuuuuugaaaguccaaguuuucuccuuucaucugugcaagggcaaaaguagauaagaaacuagaucucaaaguaugcucuggagcauuaucauuaagcauuacauuuacugguuuacuuaaaguauauugcaaagaauacggauaaagagauguguagggugagguguggcggaagggguacagagcuuccaugcucuccuuaggcaugagaucuccauguguucagcuauccagaagcucgguaauucuuaauuuauaguaauaaccuguuuguauuuacuugguucaugaacucuuuugcuuauagaaacugaugaugguguugaugaucugaaaauaaaucccgaaaagaaggaauuaggcugugauaaaaugguaccaaacucaaguuuuacaucauuaucgucagcugccauugaucaucagauugaaguacuucugucugaauggaguaaaaaugcagauaugcuauuuaguauucaucccauggaugguucuuugcuaguuuggcauguggauuggcuggaugaauaccagccugguauguuucgucaaguacagguacuacuguuauuucuggagagcuacuuccuuguuuauguggguacuauuuucuaauaccucuuuauauaauuuuauauguucuaacacuugcuuucuugauucuagguguccuuuguuuccagaauuccaguagcuuuccccacaggugaugcaaacucucucuguaaaagcauaaugauguaugccuguaccaagaauguugacuuggcuauucagcaggggaaacaaaaaccuucuggccucacccguuccacaucaaugcuuauuucuucuggucacaauaaaucaucuaauaguuuaaaauuaaguauuuuuacgccuaauguuaugaugauaucaaaacaugcugaugguucucugaaucaguggcuggucaguuuugccgaggaaucugcuuuuucuacuguucucaguauuucccacaaauccagauauuguggucaucguuuucaucuuaaugauuuagcuugccacucaguauuaccauuauugcugacaacaucacaccauaaugcauuaaggacaccagauguugauaacccagagcaaccuuuugaugcucuaaauauugaagaaugcucuuugacacaacaaaauaaaagcacuguugacguggcauuucaggaucccagugcaguuuacagugagcuuauucuguggaggguugacccaguugggccauugucuuuuucuggaggaguuucugagcuugcccggauuaauucucuucauguuucugccuuuuccaauguggcauggcugcccacucuuauacccaguuauugucuggguaaguauucugguuuuuauuacaguaauuuagauuugcugacauuaucaucaaagggugaaauuuuaauauuuguaaauacuuucuaggugcauacugcaacucuccuagugcaugcuuuguagccagugauggacaauaucugagauuauaugaagcaguuauugaugcuaagaaacuuuuaucugagcuuucuaacccugaaauuucuguaaguaaugucuuuuaaaacagcuuaaguauauaauauuauguuuucagauaguuuauauuuauugggcauguucuacaauugugaccuauaauuuguaauaagcauuuguaucuuuguuuuauuuuuucacauuuguacucuuguaaugauuuaaagcuccuuuaaaaggaaaccauuucuuucacucuuugaaagaaaguagagucucaucuccuguaauauguuucuguaacacuucuuuacucauagauaaaugaggacuacugacaguauaauguagaaguuauaucggccccccugcaauuauuuuauaggcaggaggagcuggaacaacaggaauagaauuuuaaucuuaaacaugaaaagaaagagcccuuagcuugguuacaguucagacaagaguucuuucaguauuguuguaaggcuuuugccuuaugacaggccacauuuguucucauacccaccuaauaacaaccuucuaacugcauugucuugggacauccaacaagcaagcguuuccacuuuucugguuuuggcgauuuuucuuuugguauccccagaggcagccuucggcuguaccaagcuuucuauuuaggagauucaagccaucucccugacuaccaauuaauguauuuguuaaugcucggcuuacagaguugcauaaaugucagugaucuguuccaauccuguuuuuuucuguaaguuaauuuuaaugcauaauuuugcagaacacaagguuuuccaaagcauguauauaguauuacaguagaaauguauauauuuuggggggggucuucuauuuaucaggcauuuuuaaguaaugggaauuuagaugugaagaaaacagguaaaaauuuguaucauagagcuuauauucgggugaagggagauaggaagaaaacagauaaaaauauauuaauuaaaaauacuauggauagaaacaguguugcagaagaauuaggaauugccaaguaaguugcuggucagggaaaauuucacagaaaaaguacuauuugauuaaagaucugaaggagaugugggaacuagauacguagauauuuauuaaagagaaugugauuugggaaaacggacagccaguucagagaucccaaggccggagcauguuugguaugugauaagguuuggcucugugucccacccaaaucucaucuugaauuauacuucccacguguugagggagggaccuggugggaggugauuggaucaugggggcaguucucccauccuguucucaugauagugagggaguucucacaagaucugaugaucuuaaaaguggcaguuuccccugugcacgugccgucuccugacaccugugaagaaggugcuugcuucuccuuugccuucugccaugauuguaaguccugaggccuccugagccauguagaauuaugaaucaauuaaacuuauuuauaaauuacccagucucagguauuucuucauagaguguaaaaacagccuacuacagauaauugguaccaggaguggggcacugcuauaaggauaacccaaaauguggaagcgguguuggaacuggguaacaggcagagguuggaauaguuuggagggcucagaagaagacaggaagaugugggaaaguuuggaacuuccuagagacuuguugaaugguuuugaccaaaaugcugauagugauacggacaaugaagucccggcugagguagucucugauggagaugacgaacuuacugggaucuggagcaaagaucacucauguuaaugcuuuagcaaagagacugguugcauuuuggcccugcucuagagaucuguggaacuuugaacuugagagaugauuuagguuaucuggcagaagaaauuucuaagcagcaaagcauucaagaggucaccuggcuuauucugaaugcauucaguuauauguguuuacaaagagaugguuugaaauugaaauuuauguuaacuuacguuuaaaagggaagcagagcauaaagguuuagaaaauaugcagccugaccaugugguagaaaagaaaaacucauuccuggagaagaauucaagggcuacagaaauuugcauaaguaaccaggagcugaauguuaauagccaaggcaauggggaaaaugucucugggacaugucaaagaucuucauggcagccccucccaucagagguccagaggccuaagcgggaaaaugguuucaugggccaggcccagggcccagcugcucugugcagccuugggauucagugcccugccucccagcugcucuagcuccagccauggcuaaaaggggccgugguacagcugcggcuguugcuucagagagugcaagccccaagccuuggcagcugccacaugguauugggccuguggguaugcagaagaugagaguugaggcuuggcagcaaccaccuagauuucagaggauguauggaaacaccuggauguucaggcagaggucugcggcaggggcgaagcccucauggaaaacuucuacuagggcaaugcagagggagaaaguggaguuggagcgucccacagaguccccacuggggccucauggaacugggagaagaggaccaccaucauccuccagaccccaaaaagguagauccacugacaguuugcaccaugugccuggaaaagccauaagcacucaacacuagccugugaaagcagccacaggcacuguacccugcagagccacaggggcagaguuucccaaggccgugggaacccacaccugugucaaugugcccuggaugcaagacauguagucaaaggagauuuuggagcuuaagauuuaaugacugccuggccagguuucagacuugcauggggcuuauggccccuuuguuuuggccaguuucuucuauuuggaacagaacauuuacccaaugccugugcucgcauuguaucuuggaaguaaccaacuugcuuuugauuuuacaggcucauaggcagaagggaguucccuugucucagaugauacuuuggacuuggacuuuuggguuaaugcuguaaggaguuaagacuuuggggaacuauugggaaggcaugauugguuuugaaaugugaaaaggggauuugggaggggcuuggguggauugauaugguuuauugcugugugcucacccaaaucucauuucgaauuauaauugccacauaucaagggaggcaccuggugggaggugauaggaacaugguggccauuucccuuaugcuguuugcauuauagugagcaaguucucacaagaucugaugguuuaaaaagugucaguuuccccugcaugcuuucuuuccugccaccuugugaagaaggugcuugcuucuccuucaucuuccgccaugauuguaaguuuccugagggcuccccugccaugcagaacugugagucuguuaaaauuacccagucucagguauuuauuuauagcaguaugaaaauggacuaauacaguauguaaaggaacagcaaaaaggccacuguggcuggagcagagcaugugagguggaaaauagucagggauaaagucggaaaguuagccuggccaggucauaugaagccugauaggccauugugguaacuucagguuuuacucugaauaacauggaaacuauagaagagguaugaaaugauuuagguuuuaaaugauuccucugguggcuauauagauuagacgugggaugcggaaguagauccagagagaccaauuuaggaaccaauuacaguaguccaggagagggaaaaaaggagcuuagaauauagcaagugguaauggcagagaugauaaaaauggccaaauucaagauguuguuuagaacauugaauagcuaugaauggacuggaugcgguaugugugagaaaaaaagaggacucccaagguuugugauugaauauuaggaagaacagaauugcugugaauugagauguggaagaauguagaaguagcagguuuugaggggcagggaaauucaagagucuggcuuuggucauauuaauuuugagaugccuguuugacauccaaaagacauaguagguuaguaucuggaguucagagagaggucuggccugaaaauauacaguaguugucagcauauaaauuugaaguuguggaagugaaugagauugccaagggugagacuauaguuagaaaacagaaguguuaagccaggaacgauggcucaugccuguagucccagcacuuuuggaggccguggcagguggaucacuugaggucagaaguuugagaccagcuuggccaacauggugaaaccccaucuauuaaaaauauaaaaauuagccagaugugguggcaggaaccuguagucucagcuaccugggaggcugaggcaggagaaucacuugaaacugggaggcagagguugcagugagccaagaugacacgacugcacuccagccuugggugacagagagagacaccaucuuaagaaguaauagauugaaugugugcucacuucagcagcacauaaacugaaauuggaauaauacugagaagaugagcauggcuccugugcaaggaugacaugcaaauucaugaaguguuccauauuucuccagaagagacuggggaccuauauucaacauccuuaaagaaaaaaaagucuucaaccaagaauuucauaucuagucaaacuaagcuuccgaagugaagaagaaauaagauccuuuuuagauaaaccaauguugagggaguuugccuuacaagaggucuugaagggaguaguaaauauugaauggaaagaucacuaccaccuaauauaaaaacacacuuaaauauacacagaccaguaacacuauaaagcaaccacacaagccagcauaguaaccagcuaacaacauaauaacacaaucagauccacacaugucagugcuaaccuugaauguaaacaggcuuaaugccccacguaaaagguauagaguggcacacuggauuuaaaaaaacaaugguauguggucuucaagagaccccucucacauguaaugacacccauaggcucaaaauaaagggauggagaaaaaucuaccaaguaaauggaaaucagaaagaagccggguugccauccugauuucagacaaagcagacucugaaccaacaaagauuagaaaaagacaaagaagggcauuacacaaugguaaaggguucaauucaacaagaagaccuaacuaugguaaauauauaugcaaccaacacaggagcacccagauucauaaaacaacuucuuagaaaccuacaaagagacauagacucccacacaauaauagugggagccuucaacacuucaaugucaguauuagacagcucaucgaggcagaagaguaacagagauauuccggaccugaacucaacauuggaccaaauguaucugacagacugcugcagaacucuccacccaaaacaacagaauauauauuccucucauugccacgucacauacucuaaauuggaccacauaauuggacauaaaacaauccucagcaaaugcagaagaaccaaaaucauaccaaacacacuguuggaccacagugcaauaaaaauagaagucaggauuuaaaaaauagcuuaaaccagucaauuacauggauauuaaaaacaugcuccugaaugacuuuuggguaaauagugaaauuaagacagaaaccaagaaguucucugaaaguaaugggaauaaagauauaacaugccagaaucucugggacacaacuaaggcaguguuaagauggaaauuuauaguacuaaaugcccacaucaaaaagucagaaagaucucaaacuaauaaccuaacaucacuacugaaagaacuagagaaggaaaaacaaaucaaccccaaagcuagcagaagauaagcaauaaucaaaaucagagaugaacugaaggaaaucgaaacacaaaauaccauucaaaagaucagcaauuccaggaaauggcuguuugaaaagauuaauaagauaaguacguugcuaacuaagccaauagaaaauccaaauaaacccaauuagaaauuaccaagggaauguuaaccacugacucuacagaaauaaaaacaauaaucagaaacuacuacgaacaccucugugcacacagacuacaaaaccuacaagggauggauaaauuccuggacauauacccccuccuaagacugaaccaggaagaaauugauucccuaaacagacuaauacgagcuccgaaauugagucaguaauaaauagccuaccaaccgaaaaacccaggaucugagggauucauagcugaauuacaccagaugcacaaagaagagcugguaccauuccuacugaaacuauuccaaaaaauugaggaggagggacuccuccccaacuaauuuuuugaggccagcauuauccugauaccaaaaccuggcagacacacacacacaaaaagaaaacuuuagcccaauauccucuaugaauaucaaugcaaaaauccuugacaaaauacuggcaagccaaauccagcagcacauuaaaaagcuaguucacagugaucaaguaggcuuaauucccgggaugcaaguuuuguucaacauaugaaaauuaaaugugauuuaucacauaaggagaacugaagacaaaaaacacauaauuuuuuugauagaugcagaaaagguuuuugauaaaauucaacauuccuucauguuaaaaacucucaauaaacuagguguugaaggaacauaccucagaauaauaagagcuaucuuugacagacucucagccaacaucauacugaaugggcaaaagcuggaagcauucccccugaaaacugacacaaggaaaggaugcccugucuugccacuccuauucagcauauuauuggaagugcuggccacagcaaucaggaaagaggaauaaaaggcaucuaaauaggaagagaggaaguaaaacuaucacuguuuguacaugacauguuucuauaucuagauaacccuaugucuuggcccaaaagcuccuagaucugauaaacagcuucaguaaaguuucaggauacaaaaauuaauguagaagaaaugacuagcauuccuauacaccaacaacagcuaaucugagaaccaauucaggaagacagucccauucccaacugccacaaaaagaauaaaauaccuaggaauacagcuauccagggggguggaagaucucuacaaugagaauuacaaaacauugcucagauaaaucagagaagacacaaacacaugggaaaaacauccuauguugauggauagaaagaaucaauaucauuaaaaugaccauacugcccaaaguauggcccaaaaauuuacagauucaaugcuauuccuaucaaacuaccaacaacauuguucacagaacuagagaaaccuauuuuaaaagucauauggaaccaaaauaagaggcuguguagccaaggcaaucguaaaaaaaagaacagagcuuugagguaucauguuacccgacuucaaacuauacugcagggauacaguagccaaaacagcauaguagugguacaaaaacaggcacauugaccaauggaacacaauagagaauccagauauaagaccacacaccuacaacugucugaucuuugacaaaccugacaaaaacaagcaauggggaaaggauuccauuaauaaaugaugcuggcagaauuggcuagccauauguagaaaauugaaacuggaucccuuccuuacaucauauacagaaaucaacucaaaauggauuaaagacuuaaauguaaaaccuaaaacucuaaaaacccuggaagacaaucuaggcgauaccauucuggacauaggaaugggcagugauuucaugacaaagacaucaaaagcaaucauaacagaguaaauagacaaccuacagaauaggagaaaauauuugcaaacuaugcaucugagaaaggucugaauauccaacaucuguaaggaacuuaaauuuacaagagaaaaacagcuccaucaaaaagugaguaaaggacaugagcacuuuucaaaagaagacauacguguggcaacaaacaugauaaaaagcucaaucacugaucauuagagaaaugcagauaaaaaccgcaauguggcaccaucucacaccagucagaauggcuauuauuaaaaaguaaaaaaaaaaaaaaaaaaaaagaugcugaugagguugcagugaaaagggaacacuuacacaguguugaugggaguguaaauuaauucaaccguuguggaaagcaguacugugauuccucaaagagcuaaaaacaaaacugccuuuugacccagcaaucccauuacuggcuauguaccuagaggaguauaaaucauucugugguaagggcacaugcaggcaaauguucauugcagcauuauucacaauagcaaagacauagaaucaacccaaaugcccaugagugacagauuggauuaagaaaaugugguacauacacaugauggaauacugugcagccauaaaaaagaaugaaaugauguaauuugcaggaacauggguggagcuggcauucauaaagcaacuucuuuauggaggccauucuuuaaggaggccauuauccuuagcaaacuaacaggaauagaaaaccagauacugcauguucucacuuacaagugggagcuaaauaaugagaacucaugaacccaaagaauggaaaaacagacacuggggacuucuucauguuggaaguugggaggagggagaggaccagaaaaaauaacucucggguacugggcuuaguaccuggaugaugaaauaaucuguacaacaaagcccugugacaugaguuuagcacacguacucccaaaccuacaaugaaaguuaaaaaaaauuaaagauugaaugcuggaaugcucgguuaaaaguaggguggaaauacaagggugaaugugguguauaauggaaggcaaaagaaaaaaaauauuucaaggaggaagaaggaaugauuaccaagaucagauacugcugauaaaggaagucugauaaagauuugaaaauagaccacugaauuuagcagugugaccuugacuaaagcagucaggacaugaauggcucaagagaucagcauauuugaauaguauguaaucuuguuucuuuagcucuauccuuccuaucucaaaauuaauguuuaaaaagcacuaauuauuagaacauuucuaggagauugaaaucaauuuuucacauuuauggauguaauuuuuuuccuuaacaguuaucaagcauuacuuuuauuuuucucuguaccaacugagcuguaaugcuuuuucauucguuuguuaauuccuauaaagacuaaagaccuagaauuuuuauaguugaaagggacuauauuuaggcccacuugaauuuuauuguuauuuaucuguuaugcuugaaauuuuguuauuuacucuuauuugcauaugaauuguuuaguaaauuauaaauuuuuuuaaaaaaaacagaaauauguuggugaagucuuuaacaucgucagucaacaaucaacagccaggccaggaugcauuauugcauuagaucccauuaccaaacuuguaaguauuaauuuugggggggagguauauuaaaaaaaaguuuaugaaagcauuuugcauaaaaucuauauauuaauguaauuugaaaauuugcuauauauuuacagguagauucaguaauuaacucaucacauaauagauaacauauuauuguauauuuuacuuccuagacuucaaacuagaaaacaaauuauccucauuacuauauucacagccaaauaaauuuucaaacuuugacucaaacauauuagaaauauuaucauauuaccauuagauuuaauaaagugguguuagguuccucauccaugguuauugaaaaucacugaaaagaaaacuagguuccaauuuguggcuaaauaaaaaacauugguggauauuauuucuuacuuauaaagacucauuguaaugaaagcaaaucaucuugaccuaaauuuuuauauucaucuguuuaaucuaauggaggugccauacgcuuacguucugcugaacuuuugacuucuuauucugccuuuaaauaucucauuaugaaguauuauuuuucuggcuauuuagcauuagguaaauaacacauaggucaacuuacguugauauuuauuuauauucagcauggcagaaaaacccaacugcuucauguuuuugaagaagacuucauuuugaauaaccuugagaagaaaagccuuggcaaagacagcauuuuaucuaaugcagguaaggaagaauuauuuauggaaugagaaauacuauguacaguauguuaggcaguuaauaaagaugaauugguaaaaugcuuuacauugucuauuugaaguaaaaauugggguagguuuguuuauuaaauauuuaucauaaauaugaguaucuuuuuauucuuaaccagguaauaaauacgaacaaaauuaaaggggcaucuugguuguauguuuuuuaaacugcauaauagaaaugcuuuauuauuaacauaugagagcuuuuugcauggaugggguccuacccauccauuuggauauuauggaccuccugccuuuugaaaauuuauaauuuaaagaaguagcuuaaaacuucaagcuagaagguccuuaauuuaaaaacuaauugucuuaauuaaugcuuuuauaauaaaaguuuuuaaaauguuaaacuccucucaucaacacuuuacaugaaggcacacugaguaaaauaaagcuacagucucuuggucaucacuugcgauuacagagccaaaccaaacucaaaaauggcauucuugaauaucacaaucuuauaaaucaauuauacaguaugugccuguugcacaaagaaguuaucaagauucauauguuaaauaucuucuccauuuguucagacuuuuuucuucucuuuuacaucaugucuuucugccaccuuuuccauuuuucuuuuaugagaaguacuccuuagaguucugcacuuuuauguugacaucuaauuucuuaccauugcuuuuagucuucuaucaguuuucucugaguuaaugagcugugcaaauacacuuuauguguuuuuuaaaacucugaacauguuggaaguaugcuaaaaauggggauuaaagauaucaggcguaagagauaagauuauuuauuguauaaacaaaacuauccuuuucauauuaaaauauuaaugaacauguuaauauuguuaacaauuuaagucucuuuaaaacuuuuaaaagaaguuacucuccuuugcauaauaagguugaguuuuucuguguucuucuuguauucuagcauuugcuuuuuucggauucuucaauuuuuaauguauuuuaauucucuuuaaggcuaagauuuuucuuaaaauauucaggaaauuuuuacuuuuacccaaaaacuauuauguucauuauuagaguuuccuagaaaauaccuaaggaguuaaugguuucauaucuuuugcucuauuaugaagaagaaaaauguuuuacaaauauuuucauuauuggagcauuuuuuguuguuagugaaauuaucaaaacuaggauugauuucuauucuguuuacuuuuguuauaaucuuuauccuuuucucuuaauuucuguauuuuggaugccuaacuuagaauacauuaccaaaguuaccuuuucauuuagucucucaauacaagaugauuuaaaacauuuaugguuaccuuuuuuaauuuuuuugcuaugcaaauuuauaaaagggcaaagucuuugugcucuaauaauaccugcuuucucauguuuuacauguucuacgauuuauuuuguuuuuauaauguaauuuucguuuaccuaauugugcacauagugaauaauagauuauaaugaagaaaacuuggauuaaaaucuauuguuaaaaagguuuuucaggcaauaauaaaucauugauuuuucugauguauuuuaaaaagauauguuuauuuugagcaacucgugugcuguuuaugcaauuugggagaagacaaauuuucuugaaugauauguuuuauaaugaaaacuuaugguuuggccauuggauaaauaucaugaagucauccauuauagaacuuauucauuugaaaaauguuuggcaccaccauuucaucaugauauguugaguugaaguacauauuacauaguuccuaucuguuuagaaauuuccuacuucuuaugguuuaaucuuugugaacaauuugaugaugaugacuguaaaccuaucaauucaaacaugaaauagcauacauauuauuguaaaaauuuuaaguuaauacaaauucaugugguaaaggauuugaauauauuuuauaauaccacuuguguuugaagccuuagguaaaaguuuuuaaucuucuuuuuuuaaaguccaauuauuuuaacuuggcauguuuagcaaguugucucuuuuacacauaguaacagugaaaaauaucauuaauaccaacaggcagcucaccuaauggauuuucugagaaguucuaccuaauuguaauagaaugcacucaagacaaccguucacuguuacacauguggaauuuacaucuaaagucaauuccugucucauuaggugagucuuuuguguguguguuugugcaacuuuaauagguguaaguuaacaaauuacacaaaauuagauaauuugggacauauuucuuaaagccauucucauuaaauggugauaacuguagauuauucaauuaauucaaaaagcuuuucuuauuuucuuucugugaagaaucauauuaauauguuuacuauuuuaucuuuuacaaggcaguuuuggauuguaaaauguaacaaucguaauauuuauaggguuccccugccucaguuuuugguucuuuucuuauguuuuguagaugaaaaaguagauacaaaauuauccgaagcgguuuggcagccagaagaacauuauucuucuucuccagagaagauccuaucuccuuuuucacaaaaguaucaggcuugcagagcaaaucuccagaguaccagcagguugacucuguuuucagaaaugguuuauagccaagaauugcauuuaccagaaggaguugagauaauaaguauuaagccaucagcagguuuguaaauuuuaugaaaagagacuaauuuuguaacacaugaguauuuaccagguauuuaaaaauaggugcugcaacuaucucuuaaauccacacagaacuagaaauggaaauaauauauucaaguacccuaaauugaagacuuauaguucucauuauguuuucagauuacucugacauuuaucagccaguucuagucuuaaauauugauuucuaaaacaaauuuucuuugucuuuuugggaagacaaagggacaguuucuggagcggagaugguaacuaaguuguacuuuauuugcagacuuugaugguauuggcaauagcugccuggagccaugauucugauugugugguuucugcuauauauuuauuauccuuauuccagagcagugguuuucaaaguguccccaggccagcagcaucagcguccuggaaacuuguuagaaauuggccacuccauuucuugggccacccaggguuacugaaucucagacucugggauggggcccaguggccuggacuuacaaaccuuuaaagugauucuuaugcuugcaaaaggucaagaaccacuguucuggaguaucaagaauacuaaucaaaaauacaaauuaaggcuuauguuuuaggaaacuaauagugcaugauuacuuuaagucuaagcaaauguuaaguuguaguuaggaaucuucucagcauuuguuauggcaaauauaccucaaucaugaagggcccuguaaagugaccauucaguacuuaaguaaacauaggccauucacauuuauauugaaaaaugugaaagagaaggagccagugaguguugacaaauuuaaaaaaaugcauugauaccuuuaaaauuagauuuauaauguauaaaacuagcaaagagcugugaaacaaauucgggauuaacuagaauuaaauucugccuaugccuaaguuguuugauuuaggcccaagauguuuaaccuucaagaauugaaguaaauuaucucagaguucccuuucaacucuagguuuuggugauacuuucuuuuuauauaccuuucugaugucauuaaaagccucuuucuuacuauucuugcugccccuuuuuaacuuaaauaaauauaggcugucuauuaugcaguuuaaaaaacauacagccaagaugccccuuugauuuuguucauauuuauaguaguuaauacaaaagacuaaaaucguaaguacauaaaaacagaaguauuuaaccaaauuugacauuuuguuaacggauuauuuuuauuuuaggacaucugaguucaucuucuauauauccugcaugcagugcuccuuauuuauuggcaacuucauguucagaugagaaaguaagauucuggagaugcagaguaacagauggagaaucugccacgucaaagaauggaaaaauugaucuugcauacauuugggaagaauggccauuacuuauugaagauggacuucagagcaauaguaguauaacuguaccugguaggccuguagaaguuagcugugcacauacaaaucguuuagcaguagcuuauaagcagccugcaucuaauaguagaucuucccaggacuuugugaugcauguaaguauuuuugaaugugagucaacaggagguucauguuggguccuugagcagacaauucauuuagaugaguuaagcacaguauuggauucuggcauuaguguugauagcaauuuaguggccuauaauaaacaagacauguauuuaucuaguaaagagaauaucacaucaaacacaaagcauuuaguucacuuagauuggaugucuagagaagacgguucucauauccugacuguaggaauuggaucaaaacuuuuuauguauggaccccuggcuggcaagguacaagaccaaacugguaaggaaacccuggcauuuccucucugggagaguaccaaaguugugccccuuucuaaauuuguacuauuacgaaguguggaccuaguuucuucuguagauggcuccccaccuuuuccuguuucuuuaucguggguccgggauggcauccuugugguaggaauggacugugaaaugcauguguauugccaauggcaaccaucuucuaaacaagaaccuguuauaacagauucguacagugggagcacuccaucuauaacaaguuuaauaaaacagaguaacuccaguucuggguuacauccuccaaagaaaacucugacucgauccaugaccagucuugcacagaaaaucuguggaaagaaaacugcauucgauccuucaguggauauggaagauucaggucuuuuugaagcagcucauguacuuuccccgacucuaccucaguaucaucccuugcagcuuuuggaacucauggaucuugguaaaguucggagagccaaggccaucuugucccaucuuguuaagugcauugcuggggaaguuguggcucugaaugaagcugaaucuaaucaugaacgccgccuuaggucucucacaaucagugcuaguggaagcacuaccagagacccccaggcauucaacaaggcugaaaauacagauuacacagaaauagauucuguuccuccacuuccuuuauaugccuuacuugcagcagaugaugauagcuguuacucaucuuuggagaaaucuaguaaugagaguacguuaaguaaaucaaaccaauuaucuaaagaaaguuaugaugagcuuuuucagacucaacuucuaaugacugauacucauauguuagagacagaugaagaaaauacaaagccuagaguuauugaccuuucacaguacaguccgacuuacuuuggaccugagcaugcucagguucuuucuggccacuuacuucauucuaguuuaccaggacucagccggauggagcagaugucuuugauggccuuagcagauacaauugcaacuacaagcacugauauuggagaaagccgagacagaagccaagguaaaacuaaacuccguacugauaacauuuuuacuuacuuucacagaaaauaauuuuaaauaauuuuuauuaaaaugaugccauuggcuaggcacaggggcuuaugccuguaaauucagcucuuugggaggcugaggcaggaggaucacuugaaccuaggaguuuaagaccagucugggcaacauaguugagacccccaucucuaugaaaacaaaaaaaaauuagccagauauggugccucaugccuauaguccuagcuacucaggaggcugaggugggaugaugcuugagcccaggagguugagcuggcagugaacugauugugccacugcacuacagccuggacaauagagcaagacccugucucuuaaaaaaaaaaauaccaugaagguuuuuuuuggaaacaucuuugcuaccuucacaacaguuuuaacuuuuuuuccccccgagacuaucauaaacagcaaacucuuaauaugcacuauuuauccuguaaaucauaguacuaugagcgagugcacaaagacucguuaugcuguucauuuuuacuaauuuucugcucaauaguauaaaagauccaacugaaucuuucugaguuuagcaaaauuuaacagauucuuauuaaacaauuauuuuaaguaccuaaaaaugugguuucuggguuuuuuccccucauuuuguaauaauccacuauuaacaauuauaauuugguuuuuaaaacauugaguuuuuuuuaaauuagcauuaauguaugcuccuaccuagaaaagcauaauguaauuaggucuuuuccucacccagagagcauuuaaaaaaaaaauacugccaaguuaugaacaguuugccauaaaaucucaaguaaguucugaaaugaacaaauugagccuuguagaccauauauacgucaguaucccuuugaaugaaacuugaaaggaaaauauaggguaaauuuaauauaauaacaaaauuuaaauuuaagaaaaauuaaguugguuaugaaucuugacacuuuuagagauauuacuaguagauacuauuuuugaugugaauauguuauagguguuuuauguuuuuaguuuuugcuucaaggaaaaaauaucaggcccucccaccauagaacuguuucucccaguguuaacagcagauuauugggguggauguaugauucgaacaaacuguauugguuaaagauaauacuguacaugugccacagaaaagguuaaacuguucaaaaaucagucacauuuuaauuuaaauaagauuucagucagaagaggucaguuuauaaagaguaucagauucucuuuauucucuuuauuauuuuuccaauuguuuauacuauuuuuucuguaauguaaaauucuguagaaaaagauaaauguuagaaaauauuuuacacugauaacuuuuuucuuggucagguuaagaauguuauaugccuauauuggguguucuuuugcuuacaauuuuuuuuuuaauacauugcuuccccuuucucccauugcagguggagaaacucuugaugaauguggguuaaaauuucuuuuggcuguucgacuccauaccuuucuuacaacuucccuuccagccuaucgagcucaacuccuucaccaaggugauuuugauaguaaucuauuaaagggaaauaaagcgaguagaaaaugagagacuugggaguuuuuaaacuuguuuuuacccaaaaaugauaaugaugacauauuuaacauauuuuaaguuuccuuuauuuguuaaaauguuuauuuugucauaaucuuugcuuaaaacauuggaauuuuuaaugguaggcaaaaggaguuaaugaagaaacauacuggagauguucuguguuauguuuuuaaaugcaugauauguucaaggcaaauuaguauuguuucauuuucuuuaauuucuucuuuagauugucuuuucucuccuuuuuuuugacauuuaucuaaauucaguuuuuccaccaaacauugaauaacauuuguguuauaauacauucucaaauuuuaaauauuucacagaguacagaauauugaaaguguaaauuuacccacacuuaaaacuacugauaaaauauguauuucagauauuaguuuaguauauuucauguauucuauauuuagugcuguauuucagauacuguuaguucucuuacuuugaacuaucuuagacuuugaacugucuuagcauaacguaauagauucuuauuaaacgauuauuguagguaccagaaaauaacauugucuuagagaguucaaaguaagagaaaucucacuuaaguucacuuaaacaaaacagcauguuuuuuggcucaucucccgggaaguucaagaaauagagcugacuuucagcauuauuggaacuauagguuuaaaaaguguuauugggacuuugcaguuuagccuuuuagccucugcuccuuggucucagucucuugcucguaccuuaugucucugucucuuuguuucucucacuauuuucuuuuucucauuuugcauauagcuuugaaaaaaguaaaguugaaaauucuaaaucaaauucuuuuuaguuuuuuuuuuuucuuuuuugagauagagucuugcucugucacccaggcuggaguacaguggugugauuuccgcacacugcaaccuccauuuccuggguucaacugauucuccugccucagccucucgaauaccugggacuacaggcgcacaccaccacgccuggcuaauuuuuguauuuuuaauagagaugggguuucaccauauuggccaggcuagucuugaacuccugaccucaagcaauccaccugccucggccucccaaagugcugggcauuaugggcgugagccaucuugccaggccaaauucucuuuaaaauuuuuagauuguaauuuagcacauuaaaauuguauguauuuauaggguacaaaguaauguucugauauauguauacaaaguggaaugauuaagucaaacuaaacauauccaucaccucagauauguaaaauauuugugguaagaauauuugaaauguacucucuuagcaauauugaaauauacaauacacuauuauuaaagguagcuaccaugcugugcaguagauaucaaaaauguauuccuccuaacugaaacuuuuuacccuuugaccaaugucucccuucucauccuguccccagccuugggcaaauaccguuuauucucuguuucuuugauuucaauuguauucgauuccacagauaagugagaucaugcaauauuugucuaugacuggcuuauuucacuuacuguaauguucuccagguucauccauguuguugcaaaugacaagauuucguuuuuuaaggcugacugguacuccaguguauauacaggcauacuccuuuuuauuguguucugcuagguugcauuuugcaaauacagcaguuuuuacaaauugaagcuuuguggcaaccguuuguugagcaagucuuucagcaccguuuuuccaacagcauguguucacuucaugucucugugucucauuuugguaauucucacaauauuucaaacuuuuucugucaucugugaucagugaucuuuguuacuauuauaaugguuuuggagugccaugaacugcgccuauguaggacaaugaauuuaaucaauaaauguuguguguacuguggcuacaacacugaucagccauuccccuguauuucucccucugcucagaccucccuauucacugagacauaacaauauagaaauuaggacaguuuaacaacccuacaaugucuucuaaguguucaagugaaaggaagagcugcauaucucucccuuuaaaucaaaagcuagaaaggacuaagcuuaguaaggaaggcauguugaaagccgagauaggcugaaagcuaagccucuugugccaaacaguuuaccaaauuguaaaugcaaaggacaagguccaaaggaaacuaaacguucuccauugaacacauaaaugauaagaaagcaagguagccuuauugcuuauguggagaaaguuugaguggucuagauggaucgaacuagccacaagauucucuuaugccaaagccuaauccagaacaaggcuguaacucgucuuaauuucaugaaagcugagagaagugaggaagcugcacaauuaaaguuugaagcuagcagagguugguccaugagguuuaaggaaaggagcuuucuccguaaacuacaaguacaaggugaagcuaggucuucuggauaacaugcugaagcuucuacgucauucagcacuugcuucagcauguuuuccagaggaucuagcuaagauaauggaugaagguggcuacacaaaaggacagauuuuuaaaguacauggaacagccuucuguuggaagaagaugccaucuaggacuuucguaguuagagagcagucagugccuggcuucaaagaacagacugacucuuguuaggggcuaaugcagcugguaacuaaguugaagccaaugcccauuuaccauucugaaaauccuagaguguuuaagaauuaugugaaaccuauucugccugcgcucuacacauggaauagcaaagcccaauggcagcaccucuguuuauagcauaauuuacugaauauuugcagccuacuauugagaccuucuguugagaagaaagauuuccuuucgaaauauugcuguuauugacagugaccuguucacgcaagagcucugaugcagguguacaaggagauuaauauaguuuuuaugccugcuaacacaacauucauuuugcaguccaugaaucaaagaaugccuccaacuuuuaagucuuaucauuuaagaaauacauuucauaaggcuauagcugcuauagauaauuauuccucugauggaucuggacaaaguaaauugaaaaccacuggaaaggcuucaccauucuagaugccauuggggacauguguaauucaugggaggaggucaaaauaucaacauuaacaagaguuuggaagaaguugauuccagccuucacagaugacuuugagagguucaagacuucaguagaggaaguaauugcagauacgguagaaauagcaggggaacuagaauuaaaaguagaaccugaauaugugacugaauugcugcaaucucaggguaaaacuucagcagagccaggcacgauggcucaucccuguaaucucaacacuuugggauauugaggugggaggaucgcuuaaggccaggaguuuaggaucagccugggcaacauagacgccaucucugaaaaaaauuuagguagguuuaguguuacgugccuguaguccuagcuauucagggagcugaauaggaauaucacuugaguccaggaggucaagacugcaacgagcuaugaucacaccacugcacuccagccugggcaacaggaggagacccugucucaaaaaaaaaaaaaaaaaacaaaacuucagcagaugaggaguugcuucuuaaaggaugagcaaugaaugugguuucuuaagguggaaucuauuccuggugaagaugcagugaacaugguugaaaugacaacaaaggauuuagaauagucuguaaacuuaguugauagagcauuggcaggguuugagaggacugacuccaauuuugaaagaaguucuaaauucuaucaaauagaauuacaugguauagagaaaucuuacauaaaaggaagaguccaucuauguggcacacuucauuguugccuuauuuuaagaaauugcuauagccaucccagccuucaguaaccucuacccugaucagucagcagccgguaacaucaaggcaagauucuccaucagcaaaaauuaugacuugcuuaaggcucaggugauuguuauguuuuagcaaugauguauuuuuuaauuaagguauguacacucauuuuagacauaacgcuauugcacaguuaauagaccacaguaugauguaaccauagcuuguauaugcacugggaaacaaaaaauuguguuacucauuuuauugcaauauuugcuuuauugugguggucugaaaucgaacccaugguaucuccaaggucugccuauauauacgauauuuucuuuauuaauuuauugauggauacuuagguugaauugauaacuaaacuauugugaagaaaacuucacuuaacauuggagugcagcuaucucuucaacauacugauuucacauccuuugacuauauacacauaagugggauugguggaucaugugguaauuuuguuuuuaaauuuuuucuuuuuuuuuuuaguuaaaauuucuuuucuuuucuucucuuuuaauaaaacauugucccagaauauuuuuagauauuugaggaaccuucauacccucuuccauaauggcuguacuaauuuauguucccauuagcaguguaccaggcuccccuuuucgccacuucuuuaugaaaacuguuuguuuuuuucucuuucugauaauagacauucuagcaggugugaguuguuaucucauuauggcuuuaauuugcauuuuccugaugauuauagauaucaagcgcuuuuuucauuuaucuguuggacauucauaugucuucauuugagaaauaucuguucaguucauuuauccccucugguuuuuuuuuuuuucccccaagaguugagggucuuacucuguugcccaggcuggagucaaacuccuggccucaagccauccuccugccucagccucucaaauagcugggucuacaggugugcaccacuugugccuggcaugccuauuuuuuaauugaguuguuuucuugcuauuggguuacuugaguucuugauauauuuuggauauuaacuccuuaucagauauacagauugcagauauuauuucccaauccacggcuuuucucuucacucugcuaauuguauucuuugcuaugcagacauuuucaguuugaugucaucccauuuguucauuuuugcuuuuguugcccgucccuuuggugugauauccaaaaaaaucauugcccagacugaugacauguaguuuucccucuguguuuuccucuaguaguuuuacaaugcaggucuuaugcuuaaguauuuaauccauuuugaccuauuuuuguauaugguguaagauaaugguccaauuucauucuucugcaugugguuaucuaguuuucccagcaccauuuuuugaagaaacuauccuuucccauuguguguuccuggcacguuugacaaaaaucaauugaguauaaauguauggguugauuuccgugccuucuauucuguuccauuggucuguuucuguuuuuacaccaguaucaugcuauuuugguuacccuagcuuuguaauauaguuugaaaucagguagugugaugucucuagguuuguucuuucaucucaaguuuacuuugaguauuugguguuucuugguauuccuaaugaauuuuaggguuuuuuucuucuauuucugugaaaaaugacaucaguauuuugauagagauugcguugaaucuguagaucauuuuggauaguuuggacauuuuaacaaauuaaaaauuuaacaaauuaauuuuuccaaucugugaacacuggauaucuuaccauuuauuugugucuucaaauuucuuucaucaauauuuuauaguuuuuauuuuagagcucuuuuaucuccuugguuaaauuuuuguuuuuaaugagauggggucuugcuguguugcccaggcuuuucuuaaacuccugagcucaaaugauccucccacccuggccucccaaagugcuaggauuacagaugugagccaccggccuggccgauauauuucuaagguuuuuuuuuuuuuuuuuuaaguagcaaugauuaaugagauuguuuuguuuauuuuuaaaaucagaucagauaauuuguuguuacuguauggaaaugccacugcuuuuugcauuuuaauuuuguauccuucauguuuaauguaguuguuuauuaguucuaacuguuucuuugguggagucuuauguguuuucuguauguaagauuguguuguuagcaaacagugacauuuucacuucuuuauuuccuauuuggaugccuuuuuauuucuuucucuugucuaaaugcucuggcagggacuucuaguacuaucauaauugaguagaaguugugagagagugcauccuuguccucuuucugaucuuagaggaaaagcuuuugaauugucacuguuggguaugauguuuagcucugggcuugucauuuauggccuuuguuguguugaggaacauuccuucuacaccuaauuugggagaguuuuugucaugaaaggaugucgaauuuuaucagaugcuuuuuuugcaucaguugagaggaucauaugguuuuguccuuaauuuuguuaauaugaacagaaugacaucaguuaauuugcacauguugagcuaaucuugaacccauggcauaauuccuacuugaucacagugggugauccuuuuauugugcuguuaauuugguuugcugguauuuugugggggguuuuacauuuguauuuaucagggauaauggccuauaauuuuuuuuaauucauuuugccuggcauuggcauaagggaaauccuggucucauaaaaagaggaacuuuucuuuccuuucuguucuucggaggaguucaagaaggauugguguuaguuuuucuuuaaauguuuaguagaauucaccggugaugcgaucagauucuaggcuuuuguuuugauggguugaugggagacuuuuuuuuuuucuuugagacagagucucgcuucugucacccaacgcuggagugcaguggugcaaucucggcucacugcaacuucugcccccggguuucaggugauucuccuacuucagccuccugaguagcugggguauuuuuaguagagacagaguuucaccauguuggcaaggcugguuuggaacuucugaccucaaguaaucugccugccuuggccucccaaaaugcugggguuacaggcgugagacgccaugcccggccugaugggaaacuuuguauuacugauuuauguccuuacucaucaucaaucuguucagauauuuuauuuuuucauauuucaguucuggcagguugucugugucuaggaaguuaucuauuucuucuggguuauccaauuuguuggcauauaucugcauauuaaucucuuaugauuauuugugguaucaguuguagugucucuucguuaacuucuaauuuuauuuuuagucuuugguuuauuuauuuauugagauagagucuugcucugucgcccaggcuggagugccguggcgccucgcagcucacugcgaccugugccucguggguccaagcgauucuccugccucaaucucucaaguagcugggauuacagguuugcuccaccacacccagcuaauuuuuguauuuuuaguagaaacaggguuuugccauguuggccaggcuggucucgaacuccuggucucaagugaucugccugccuccgucuucuaaagugcugguauuacaggcaugagccacugcgccuagccuuucuuuuucuuaaucuugcuaaggaguugucaauuauauuuaucuuuccagaaaacuggaaaguguucagguuuuuuuccccugucauuuuucuaguuuauacuuuauuuauuucuccucugauuuucauuuccuuucuucugcuaacuuugggcugaguuucuuccaauuuuuguuccuugauguauaauaguagguuguuuauuugacagagauauauauauauauauggggggaggcacugaaugcuguaauuuucucucuuagaaaugguuuugcugcaucccauaaauuuuagcauauucuguuuuuguauuuguuugucucaagauaauuuuuaauuucucuuuugguuucuucuuugacucauuguuuuuucaggagcauguuguuuaauuuccacaaauuggugacuuuuccaagauuucuccuguuauuuauuucucauuucauacuauugugaucagaaaagauacuucauaugauuuacauacacuugaauuuuuuaaaacuugcuuuguaaucuaacacaguaucuauucuggggaauauucuuugugugcacaaaaaagaaugcguauucucuugcuguuugguagaauguucuguacaugucuuuuagguacauuuggucuaagagacuaaacauucugucuggauggucuguccuuuguugcaaguaggguauugaaucccccuauuauuacuguauuguaaucuaucucucccuuuaguuucuuuaauauuuguuuucgaagucuaagugccucuguuguugaguacauauauauuuauaauuauuaauauccucuggaugaauugaccccuuuaucauuauguaacauacuucuuugucuccuuucacaguuuuugacuuaaagucuauuuugucuaaguauagcuaccccuauucuauuucgguuucuauuugaguaggauuuauuuaaauaagaauaaauuuauuuuaauuuuccucuauauauucagguaguucacugaacuuuuuaaguggauuauuccaaauauucgucagucauuucauagaucuguuuccuuuggguucauuauuggaaauuuauuaguuuguuucgagauauaaugauucccugauucuucaccauucucguguauuugcuuuggggucugcucauuugagcaagcuaucuggccaagauagagcuucacuauuaaaccuagccucugauuaugcgugguucagccugaaaugaccccagggaggcagggcuugcaguuggguucucuagguggcuaggccccugccuuuagguucugagguuggauguugcugcucucuagguucugcugucuggcaagaccacugucaagaccacuggcuggucucugcagucagucagaccugcuggcugggcacugcgauagccucuaauugggcuggguuacaggauguguucucuggccaggcaguauuaucguuuggguucugaaguugggcaggguugcaggcuggccccgagguuaggcagaguuguuacuccagauggacagauucagaggcuauguuuuauagaaaugcguguuugaagcuugcccuccugccugaacggaaccuuggugugaggucuggggcugggccaagccccuguuuggccucccagguugggcaggccugucuucuaaggaaauacacagugaucggugucucccugccuggguaggaccugggagugguguuugaggcugagccaagccacuguuugaacucucugguugggcaggucuagccccugagcuuugcugaaauaugcugagguagaugucuaccagucugggcggggcuuuggggugggcucugaggcugguuguggagguuggccauuuaaggacugaagccagguugaauuuuuuaccaugcuucuggaagcaaccagcuugacuuugcagguaggauaggcuauuggcuguuaccucuaauuggaugcuaccacuggcaggaacacagagcuaccaccaacgucugcaggcuaguugcuauaaggucuaccuccuuucuuuguuucuacgcaacaccagaugaucuagcugugacauugcccacauuguuucccuugaggugagaccagcgugagcuuccugggaaacauuuuagaacacuggggaagcucaaugucugaccguggcuuucuuuuuccacuguacaaacuguggaucuagggaauuuucuucuuguaccgcaagcaaaucagcugggaugggaacaggugaugugcucaaagugagacuguuacucuuacccuucuacugcaguuuuuguuugguucugugguccucgcaggugucucagcucauucccaaguuuggggguaaaauggcauuuucuaaucuguggcuaguugcuacuuaaacucucuuugugcaggggugucugucuuuuggggcuucuauaacaaauaucuuagacuggguaauuuguaaauaggaacaaguuauuuuucauauuucugcaggcugggaaguccaagaucaagacaccagcagauuuggugucugguaagggcuugaucucugcuccauaguugacaccuucuugcuacauccuuaaaugauggaacugguaaaaaggacuaccuaugucucuugaucccuuuuauaaggauguuaaucccauucacgagggcaauggcuaguuaucuccuuaaggcucugccuguuaaugcuguuacauugcagguuaaguuucaacaugaaaucugaagggauauaaauaugcaaaucauagcaaggaaugaaaccuggaacuucuauuccugccaucuuacugaugucuaaaucagauucuuuaauuauuuaugaaaauguauugaaguugcuggagagauaacaggaauccaaaaauuugauuuagaauaauaguccauucacaauguaggguuuuuuuguuuuguuuuuaccuuucauuuauuuucaaaguguuccguauagaaagcauuucacauugcuuggcaugggaggugauuccuugcuuggcuuagguuaaaaauuugaggccauauaucucaaagccacaugcuauaauuaaucauuuacuuuaccuaguaaugcuaaacaaaauguauuaugaaaagugaaaauagaagcugagcaauaaacauguguaggccacuggguugagagaauuacugacauaaaugauguuguauaaauauacaaauaucuuauuaauauggugauauggaguaauaauuacugugugccagauucuauucuaaauuuuauaacuauauuauuuaauuaucaaaacuauguuauaagauaguuccaugauuauuugcauuuuuuacauacagagagauugaggcauuaagagacaacguaacuuauccaaagauuauaugaauauauuaugcugguacaaaagcaacugcaguuuuugccuuuuuugauggcagaaaccaccugcaauuacuuuuguaccaacuuaauagucaacaauagagcuggaauuuauuuuuuguuuuuauuuucauuuuugagacagagccuuacucuguugccgaggcuggagugcaguggcacgaucuugccucacugccaugucuaccuccccaguucaagugauuuuucugccucagcuucuugaguagcugggauuacaggcacauaccaccaugccuggcuaauuguaugguuuuguuuuguuuugaagacggagucucacucuguugcccaggcuggagugcaguggcacaaucucggcucacugcaagcucugccuccuggguucacgccauucuccugcgucagccuaucgaguagcugggacuaccaugcccggcuaauuuuuuguauuuuuaguagagauaggguuucaccguguuagccaggauggucucgaucuccugaccucgugauccgcccgccucggccucccaaagugcugggauuacaggcaugagccagcgcgcccggccuaauuguacguuuuuugaguagagacaggguuucaccauguuggccagacuggucucgaacuucugaccucaagugauccacccaccuaggccucccaaagugcugggauuacagcguaagccaccgcacccugcuagagcuggaauuuaacauaugcauuaugauucuggagucuuugcagugcuauuccuaauucaucaaccugaacugcuugcuugauguuuuuuuuuuuuuuuacuaauuccauggaauuacauccacaaaacaaauguugaccaaacaaaggugaaaagcagcuuugaagacagaaauauaucaacauaaaauaaugcuuuaaguguuacucauuuuuuaaaaaggauccgaaauacaucagcacaguggaauuugccauaagcauuuuuucuuuuccuuucaaaaaaaugcuauuuuugcaaaacauauaugugcucauuggagugauacaguuauuugaagaaggaaaaacuuaaaaaagcccauauuuccaaucuuaaacugugagucucauagaaguuuacacauuuauauugaaaauauggaacauacauuucugauaaucauauaagcauauuuauaauucuuauaaacaucauuuuuuacauuucuucaggccugucuacaagucauuuugcuugggcauuucacucaguagcagaagaagaacugcugaacauguugccagccaugcagaaagaugaucccacuuggucugaacuaagagcuauggguguggggugguggguccggaauacccgcaucuuacgcaaaugcauagaaaaaguaaguguuuuauuuugguguauaagugaauuaauauuuuuuggacguuucuuuaaauggcauuucauaucuucucugccauuacucccucuuguuuuugaagcagcaaaaggcuuuugaauagucuuuacauuucauuuauaacguguuucaaaauaucuaaaguuuuaaaauguauauucuaauucccaaguuuuuaauugacaaacuuguuaguaguauaugucugauuuuuacaaaauaauauauauguuuagaaaaauuuaaaaauaguacagaagaacuuguaaugaaaggcaauaguccuauuauucucuguauccauugaagccaccacuguaagucacuuuuguuauuauuuuauauauacaugcacauauuauucauauacauauuuuuaaaauuuuauuaaacauucaauggauaugugccagccuuucauaugaaagaaauuacuuguucaaaacuguuucugugaaauuuugaucaauauuuuuugauuauagguagcuaaagcagccuuuuauagaaagaaugauccuuuagaugcugccauuuuuuaccuugcaaugaaaaagaaagcugugauuuggggauuauauagguagguaaaaaaaaaaaaaaaaaagggugcuucaaugugaaaaccuguucauaagaaguaaaugaaugaaguaagauuuguuguucuuguugauguugauucauguagauucuuaguuguuuuauauuuaaaagagagauuucguaaggaaaaagccccaaguguuuuucagaguggaagaaaccugaugaggucaguuuaauuuguuuucagauuuaucaauccagaaacaauauuuugcuuaagaacuucucauuaugcuccuauaaaacaaagguaauguauuaguccguuuucaugcugcuaauaaagacauacccaagacugggcaauuuacaaaagaaagagguuuauuggacuuacaguuccacguggcugggaaggccucacaaucauggcacaaggugaaaggcaugucucacauggcagcagacaagacaaaacagagcuugugcggggaaacuccuguuuguaaaaccaacaagucucuugaggcuuauucacuaucacaagaauagcauggaaaagacuugccccaaugauucaguuaccucccacugggucccucccacagcacuugggaauucaagaugagauuuggguggggacacagccaaaccauaucagguaacuaaaccagaaacuuaugcuugggacagggaagaagaugaauuaaaugguggagucuggaacaggcauuuaccucugcacuaugggccagccuaccccacaaaacuaucuccuuccugugggccccaccuucuuucugagcugaauucacuuagaauuuuucucucucacuucugagcaagacuggugaacaugauuaucauaaauaguucaucauuuguuuugaguuuauuuccagaugacccacaugaacagcgaccuuugggggaaaaaucacgauaacaaaucgguuuucuaagagacuugaugauuuacgguuguuuugauucaaggcacauucuuuagauuuuuaucucuuaggucauucucagauggcaggggugaaaagauacugaugaguuucaaugguggcacccaaguuaauauaaaucaaacauuuugcauggauuuaaaaguaauuuucacaguccugcuaauguaguuuucuuuguauuuagaaagaaaaauuuuuuguaaucucugagacuuauauaacaaauguuuaccuaauauaauuuuuacugggaaaagaagcagauacauaguaaguuaugaacuggcagauguuucuauuuagacuuagccaaaucuuaacuuuagaaaauugauucugauguaaagaaaauuguauuccaaaauuuucacaccauuuuuuuuccuuuauagagcugaaaaaaacaccaggaugacacaguuuuuuggacacaauuuugaggaugagagguggcguaaagcagcuuuaaagaaugcuuuuucuuugcuaggcaaacaaagauuugaacauucugcagcauuuuuucuuuuagcugguugccucagagaugcaauugagguaaugagugaaauuuaaauaacaaaguauagcaaugucaucuuuuaaagcuccuuagugcuuaaauuuuuauuuuuuuaaauucaacuuuauuggaaauaacacaaggccaaauaucugaaauaacuguuaauauuuaauaaagacauuuaaaauuuugacuguuaacuugaacgguauuuauacagaauuaagauuaaccaaaugguguuuguuaguugguagagauagguaauugauuugacucuugagaauauucaaaaaauuaaaggguuuguccuaccaguuuaaacauauuugaaccccauaucuggcucucuauuauuugaugaauguuagaaaauccuuaacugauuauuucuuaguaaaccuuaaaaaaauuaugaauauuuaagauacaacauuucugucucaaauugcccuuuugcucagaguuucauacaaguaauucaaaacaaccuuuuaauauggagacuaaagucuccaggggcggauggagaauaguagagguucaagacagaaauaaaauaauauagcuuaaauugacgucauuuaaauuauccauuguuuccucauuuaguuuaauuuuugcacauauauauauauuuaguacuagaagguagguuugcaguuauuaaauguugucaaguagauuugcuaaaaucuaaaagcaagcagcauauguuuuguuucuuauccuucuuugcuaauuuuggauauuuauaagccuuuauauuuuucuaguuauuagugaguuaacagaauuuauccuaaaaugaaaccugcuccugcuuauuuaaaaacaauauuuuuuuuuaaagguaugucuugagaaauugaaugacauucaguuggcucuuguaauagcaagacucuaugagucugaauuugauacaucugcagcauauaaaucuauuuuacguaaaaaaguuuugggaaucgauucuccugucagugaacuguguucauugaacauaaauaugcaucaugauccuuuucuucggagcauggcauauuggauuuuggaagauuauaguggugcucuggaaacauuaauaaagcaaccuaucagagagaaugaugguaagcugcacuucuaagauguuaaugauuaagaauauuauugguaauugcuacaugugcagaucacucuauuaggugguaaggguaauacaaacaaauugaauucauggucuuuauaacaguuuuugguugguuguuugguuuuuuucuccagaaagauaaauccuuugaaaacaaagaacguuggauuuucuguuuuuacaaaauagauuuacauaaauauugaacauaaauauugucaacacuugaauauaaacauuuugaagaaauacuguuauaaagccaguuuuuaaaucuuagguugaauuuaguguguuugucaaucaguuuuagaauucuuacagugaaaaauguguucaguguaaaaacaaguugacuuaagugaugugauaagaaaaucuuuagcuagaugaacuuuugacugucuuguuaugaacugguagagcuuauguacucuuuugagucugcuaguaccuuuucuuuuagaaauccucuuugcuaaagcuuucuuagaggccaguauaaaauggaauuuuuuauauagaugcauauaaaaaugagauuuacuuuucagauauguuuucauagauugaauuguguuugguagcugauaaaauagguauuauauuauuuggaauacuaauuggaaaagggucuaguucauagauuuuuaugugcuaucauuuaaucaggaaguggccuucgccuuacuuccuaaaccuuugagaaagcugugugacucauuuguuuaagucuccuagccauuuaagcuaaagauuuucaaacuagccucuauguaaugaagggaaaauguaaaugccuuuuccagccacuuucuuuuuuuaguguuuuuauuuaaaaaaaaaaaaauuagacacaguaucuugcuuuguugcccuggcucaucucaaacaccuggcaucuagcuguccucccaccucagccucccaaagucuggaauuacaggcaugagcuacugugccuggcccccuuucccuuucccuuccucuuuccuuuugucuugucuuuucucuuuucuuucuuuuucuucuuucuugagguggagucucacucucacccaggcuggagugcaguggggcuaucucagcucacugcagcuuccaccucccaagcucaagcaaucuucccaccccagcguccugaguagcggggaccacaggugugugccaccaugccuagcuaauuuuuuuguauuuuugcuggagaugggguuucaccauguugcccaggguggucuugaacuccugagcucaaagugcugggauuacaggcaugagccaccacaccuggcccuggcccacuuucuuauacuuaacacauauucauguaaaaauuguauuuugauuugggacuaguacauuuuuacauacuuuuauuaugaauuaaacuuguauucuucuagaagaaaauugcaaaaaauaauagcggcuuggaccagaaugauuggaauggaggcagagagaugugguuggauuugggauaugauuuuaagauugauuacauaggacuggauuugauaaggaguguaaaggaauuaggagucaaagguaacuccuggcuuuuuagauugaacaauagguagaugauauggggaagaauuguuuuagaucauggagcuuucucugauaaggugaacuuugaucagagaacugguugaaaugagugaguuaaucaguauagauauagguaaagagugguuugggucaagggcacacuaaauaaaaaggccccaaagcaagaguuuauacacauaaguaaaaaugaaauguaggccuuuggauauaggaguuuagguuuucagugugaaguugggacuggagauagagaugauguccaaguuaucaguguguagauguuauugaaagucauggggacuauaugaauucaacucagggaauauagauagaaaauaagucagcaguugaacccuaggagacucucaguguucaaagguagagaagaugaggaggacuagcaaagcagacugaggagaaguguucagggaaguaggagaaaaagaacuaagagucuauaacuggacguuuuaaauuauccuagaauauuaccugaagagacuuguuucaaugggaaagcaucauaaucuuuguuuuccuacuuuguuagaacauguucauuauaaauguguuguugucucuucagugccauggaucauuguggccuauuaguaaaauuuugucaaaagacucuuuagauaaaggugucauaguagauagagaaaagacacuacaauagaaacacacaguucauaacuuuucuuggcucauaaaaugaauuuacuuucagaucaaguuuuaucagccaguaauccuacaguuuuuaauuucuacaauuaucuaagaacacauccucuuuugcugagacgucauuuuggaucaucugauacauuuuccacacauaugagccuaacaggaaaaaguggacuggcaggaacaauuaauuuaagugaaagacguuuauuuuuuaccacugccagugcucauuuaaaagcuggcugcccaauguuggcuuuggaaguauuaucaaagaugccuaaagucaucaagaaaacaagaccuuuuuauagggcuucuaguuuucuggauacuaguaaagacuguucuccuucuucuccauuaaaguuggaugcaagggaagauaagucuucugcuguugauuggucacagucacugauaaaugguuuuggaucuucuucagaggguuccucagagaagcaaucaaacuccacucuuucuuuugacuggagccaaccaaguguuguguuucaggaugacucuuuagaguuaaaaugggacagugauaaugaugaagaaaaugaggaugucccuauuucaaugaaagaacuaaaaccuuuacagagaaaaacagauaaaaaguuggaugacauaaguucuaacuacacagaaucuuucagcacacuagaugaaaaugaccuuuuaaauccaucagaagauauaauugcaguucaguuaaaauuuagagcauguuuaaagauucucacaguagaacuucguacuuuaucuacuggcuaugaaauagaugguggaaaauugcguuaccaacuauaccacuggcuugaaaaagaggugauagcucuucagaggacuugugacuuuugcucagaugcugaagaacuacagucugcauuuggcagaaaugaagaugaauuuggauuaaaugaggaugcugaagauuugccucaccaaacaaaagugaaacaacugagagaaaauuuucaggaaaaaagacaguggcucuugaaguaucagucacuuuugagaauguuucuuaguuacugcauacuucauggaucccauggugggggucuugcaucuguaagaauggaauugauuuugcuuuugcaagaaucucagcagguauguaauuuacuugauagucaaaaaugguacaugucuaaaacuguuuuugguguuucuuuuuugguuuugaauacuaagacuugauuuucuuuauuacgguugcuuuagggaaagcucccuuuugugugguccuucauauuaugaauuauagaguuguguauuuauaguaguuacagacgauucaguaucaggccuuaugaccugcuuaauucacacuccaaaguguugucugaaugccuuuguagggugacagacuucuuauugcaagaggauauugucuuauuuuuuuuuucccucucugugccccuaaaugucuuauuuuuaaauaugauuauugaaaugcugacuucuucacaucccuucuaacucuaaguuucuauuaugcuuuuauuuuuuaauuguuuugaaguguuuuaaagagcccuugauuuacugaaguaaugguuuguaacuguaaauaguugguuaaccuuuuaucccucuuuguuuuuaaggaaacaucagaaccacuauuuucuagcccucugucagagcaaaccucagugccucuccucuuugcuuguacagccaaugccaaaacaguaguugccaauccauuauugcaccuuaguaaucugacacaugauauucuccaugccauaauaaacuuugauucaccaccccacccugauauccaaagcaauaaaguaaguaugcuugguuucaagcuuuuacuucaucuguacaaugauaaaacuacaagauaaauauuaaggcuuuuuuuuaaguaauuuuaaacaucagacuaagcauagcaauuguuacauugccaaguuuauguugauuccuauuaaagaaaucuucugguuguagacuggcuuaucuuacucauguuacuuacacccgguagaguucuugaauuuuuuaucacaaugccuaguuauuuagucuagcugcuuuaagaaaaauagguacguaugaguccuuuaguaguacauuuaaccaaaaagcucauuguuuuuuaaauauagaaacuuaauauuuuaauguaaaggcacuaauauguaaacgaaguuuucccuuguuaauacuaaagaaauccacauuuuaaggauaaugugaacuauuugccccugucauccuucuaggauaggcaguacuuugugaaccagcuacaacagaaucagcugcagugcuuguuaaaagucuggauucucaaguucacuccaaacuuauucaaucaguuugugagaguaugucccaggaauguauauuuuuaaagaaguuccuugugugauucuaaugcaugcaacuaauuauauuguuauaguuaauugucuaaucaaccaaagcauccuauucaucauuacuuuaucugcuguuaaugucauauuuuaucuuuacuuuucagacauauugaaauccuuugaaguauaacugacuuugaccauuuucauauaucccuagugguuuuuguuuuuuuuuaauagucuaucauguagcucucauccaccucacagguuguaucacaccaauucgauuuucuguuuuccugaugguggacuguccuacaauuuuacccucuuuaguuaccuuaauccuuguaauuaaauuucacuacuuauuuuucuguacugcucuguaguauaaaugcccauagugcuuauuauacaguuuggaauuuaauuucuuucagauugugcucauuuuagccaaacuauauuucauauuuaaaacuaauuauagcauaccugugguguaucaguuaccuuuugcugcuuaagaacuguccugaggccaguguggugguucacgccucuaaucccagcauuuugggaggucgaggcaggcagaucaccugaggccaggaauucaagaccagccugaccaacauggagaaaccuugucucuacuaaaaauacaaaaaauuagccaggcguaguggcacaugccuauaaucucagguguuugggaggcugaggcaggagaaucacuugaacccaggaggcagagguugcggugagccaagaucgcaccauuacacuccaaccugggcaacaagagcaaaacuccgcgcccaccccccgccaaaaaaaaaaaaaaaacuguccugaaacauuaguggcuuaaaaagccaucauuuauuuugcuuauaauucugugaguugguucauuaguucuuugguuugggccagcuauacuaaugucuggacucucucauucaucuuuggucaacugguggguuagucagguucuagaugaucuaagaaggcaucauuuacauuucuggugguuggcgcauguugacagcacugacaggagaaucugggucauauguaucucauccuccagcaggcaagccuaauauauuugucuggauucaccaaagaaacagaaucaguaggauguauguguguguguguguguguguguguguauauauauauguguguguguauauauauauauguguguauauauauauguguguguauauauauauauguguguguguauauauauauauauauauauaaugagagagagauuuauuauaaggaauuguuuuaugugguuuuggaggcugaaaagucccaagaucugcaguuggcaaguuggacacccaggagagcugaugguguaguuccgguccaaaucagaaggccugagaaccaggagagcuauaauuuaaguucaggucagaaagucagcaggcugaagacccaaaaagagcugauguuuuaguucaagucugaagacaggaaaagcaaugacccagcucagugcaguuagaugcgaguuacucagccuuuuuguucuguucaggucuugccaguugagucuacucacauuacagagcacaaucugcuuuaaucagucugauucaaauguuugucucaucugaaaacauuucacagacacccagaauaauguuuggucaaaugucugugcaccccauggcccagucacaccuagauuuuuuucaaaugguaguuucagggguucaagagcagcaagaauagaauuugcaaggcuuuuugagguguagauucggaacucacacuucacuucuguuggguccucuuggucgaacaagucaagcccagcucagauucagugaguggagaaguacguccaacucucucuugcagaagcugcaaaauacugugaucauuuuugcaagcucccauauauaguuuuugucaucuucaauuauauaauaucuuuuaauucauacuacguuuuauugacauuugaaggaaaaauuagcaauuagauuugaucugucauucuccauuuuuaucuacaaaaugacuggcauacuucacaaucagaugaagaaccuggucuuuuaauauucuagucugguuugcuuucuuaccuagcugaaguuucuccuucauccucaguucugccuaauguuauggcccuugccaugccauguuuagagucuucucuuccuuaaaacaaaugccugacuccacugccuuucaguuacugccuuuuauaccuuauauccuuucucuuucucuuuccucuaguuucacucucuucaaauuguuuuuaagguaacuagaauaugugguagcauauucuucagugaccuguccguuggugaacugucaguuaucaggcuguuucuucacauuuugguugaggaaaaagcagauugaguguuggagggcuuacuuuaauacaugguucaugcucuacuggagagcugacaucuguuccccuuugcucuagaaaaagaaauuagguagcaaauguguguuuuauaauuucugcugaagacuuuagcguguuuucuuuaaauuuucuguaguaagacucauguagauaaaaaugaguguuguagaaaaaaaggaaauaguucaugaaggcaaagaaucaaaaauuuuuucauucuuuuaaaaaugcugauuauauuaggucuugaaaaaaaaucugcacuuuaaaaagguuauacuuaaaguaauuuuguuuuuguuuuccagguguauguaaugcauacuuuagcagcuucacuuucugcuuguauuuaucagugccuuugugguagucauaacuacagguaacuaucuuuuuaugaaauuuaagaaugcuuacaguaagcaaugagguuucauauuuuguauguuagugguuuagaacuauauauaacagucuuuuaaauaaugcaaaaagcauaugguugagguuuugaguacuuuuuguucauauuugaaauuuuuauggcagaugaaucucaaacccuuauucuguauaacuuauuuagcagccuauuacuggucacugccuuaugucagacauugugauuggcacugagaauuuuaacgcaaauaauaugauaaagucuauuucuuagggccagucuaguuagagacaaacaugugaguugauaaaugauauguauauaauauggcauaguacuaaaaugguaacuauaauaagacaguagauaguaaaaggcucagggaccacaugggagggaguaacuuggaauugagaaaaauuuuaccaaauaauugauguauaggauauuucucuguauuucucuuuauguuauaaaguuuuacugaaauuuaucuaggcuucaaaaaaauaguuuguuacccucuggggucuuucuauaucuaucuuuaguuguuugaaguacucuauuucuucaaguauugucucaucucucuucuaucuuuccuauuaaacagauauugcaacuucugggucauuucuuaauguucuuuaacuuuccccuccuauauuccauuucuuuaucucuuuuuguuucauuucaggagaaauucuagcuucauuuuccaaacacggauucauuauucagcaauguccugucuuauuuagcaagaauuuauauuuuagaaauucuguuuuucauuuucgggaucucuuguugaauuuaguauuugcuucuguuucuauaacauuucuugauuaaaaaaaauuauuuugaguauggaguacuuuacugauaaguuggguuucucaggugaagaucuuuuguugaguuuguuauuucuuacauggugucagccuuccuuguuaauuuuugguugucuguccaguuuguguuuuugaauuuucuguggguagccuuacuuaccacucugguuguauauuucccaagguaacuucaacuugauuucuuuaacccucauccuucaagaauucacuuucuuauuauuuaggcuuuauuuucauuaacuucuuuuuaucuuuccuaucuaugauuucuauaggaaugagggaguuuuuuuuguuguuacucugccaucuugaaacuggaaaguaaagcaagggaaacuacaaaggcaucaaaauguuauaaccaaugagauuugccaaucauaacacauuuacaccaauaaaugcgcuauauuuaaguauauucauguacuuaauguaugauauaggaauuucuaaaggaaauuccuuauaccauuuucugucagaauuauuucauaguuuaugucaagcugcagguuuuuuuguucauucaucuguuagucuuagcuuugcaucuuuuacuuggggaagcuuauccugaauucucaaauugugugaaauacuccucuguauugccuugauagcgucauaugcauagguuucaucuuuuaagaguaguaugauaacauuauuuguguuuuguuccacuauuaaauuuuauggggacagagacauuguuauuccuuauaugccuaguaccugcuacagugccugauguaggguaggcuagccauuauacaugaaagugagccuaaacggacuucauuuucaaccagauaacuauguuuuuaagucaaauauguaaucuugcuacuugugguacauagcgauuuaguuuucucauuuguacuuauucugucccuuaaaauguguuuuaauuuagaaaauguguauauuuacacuuaaaggauacuuuguuuuuauauagcacuagacuguacauuauauuacuuagauguacuagcaguauaauuaauaaacaaaaauugauacucuugaaaguagaucugaaacaugaaaauauuauauaaaauuuaucauagauuuaaauauuguuuuuuucucuuaguucauuucagacgaaucaguuuacuggaaugguauaucagacaguacugcuuccucaucgaccuucuuugaaaacaggaagcuuagaugaagcauuaacucccaauacgucaccagcucaauggccagguauaauuuuuauguauagaucaguuuuuucuuagucuuauuuauaaucuuagauaaguagaaagacuuuuaguuuugccacaugauaaucauuguuaaauacuguuagaauugauaccaguuaaguauucaccacucauucugaauuacaguuacuuaacauuaguauucccuugaucauuauacuaauauaacucaaauguuuuguaauaccguuuuuuaaaucauuuugcuuuugacauacuagaaaaacccgucuaugaaaauuuaucuaugacaucuuagucaugaaagauuuuaauguuuaauauuaaagauuuuuaauguuucucucaaguaacucauuugugcuuaacuauaauaaccgcuacuagucugugaaucuagggaagaaaauacaguauuaacuccugaugcaauacauuuuuuccugaaauuagaaaaauauaguuaauuuuuaaaauuuuaaaaauuuauagucagugacagcuauguuuguuugucguucuaggaauaacuugucuaauucgacuuuugaauucuucuggcgaggaagcccagucagggcuuacagucuugcucugugagauucucacagcaguguaucuuagucucuucauccauggccuggccacacauucaaguaaugagcuauuucggauuguggcccauccucuaaaugagaaaauguggucugcuguguuugguggaggugcacauguuccuagcaaagaacagacacauucaaaaacuuuaccuggugaguuuaaaaaauuuuuuuaggacugaagcuuuauuuaucugagugauaucauucucaaacguaauuacauuuuaauuuaguuauagaaaguucugguuagagaccauuugcgaaaagcauaaacaaauagucauacagugaaaaugcaguauuaaaguuucuggugcaguuuuuaaucuuuaagauauuccuguaccaauaauuagaacgaucuuauguaaauuuauuaaauauuuuacuacugaaacuuucauuuguuuugaaacacacuguaauauugguuuuuguucuaucccaaauacggauucuuucuucuuucuuuggcaggaaggcacuuugcuaugccuagcccccaccagguagugguauucuccauggaaugugugggcuuuuccaaagcucuuucagccaucaguucucauagcccucccagucuugcaggcaagauaugagcuuuagaaauaggcuuuuaucauucagcuugcuuuguguuguuuugagggguugggguacagugggacaguuuuauuuuguuuggcauuuauagaaaauugagaaguuuccuuugaucaagccauauuuuugauuuaaaacaaugauuagcaguuuagaaaacuaucucugcuauuuuauucugcuuuuaaauucuuuguuuuuuauauuucugucccuuagacuuuaacauuuuaaaguguguaaaaauaaaacacugucagugcuaaucauagaaaaucagacuauggcuugaaaugacuagaaaaacauuucaaauuaggcugcuuuaugauuugcauauuaugauuccggccauuggaguuuuuggauuucuaaguguucauaauaccaugaaaaguaaauauuuuaaacaauuguauccccguuuaaaaacuuucuaauguuaaaacuguauuuuuuucauguauuagcccaugugugauaaucuuaguuuuccaauuauggagggcaugaggaguagcuuuauuuuuaauacauaguacuugaaaacuuauuucauucuauauugguguugaauaaauugaaaauguuaaauguuuuuccaaaaaaaaaaaaaaaagcccuaugcauacauuugagagaagcucagcaagguuauuuaucucuuuaugagcuuucauucacuucuucccugacguuuacacugaacauaugcuuguacauauagguguaugugggcuuggauauauauguuuugggaggucaagcaguuggugagggacaugagagaauaagaaaagcuugaauuuggcuucauuauuugggaaaaaaauuauugccaaaaucuuuaccaugauugaugaauauucuuugaaugaagcuauauuaaaaagaauuuagaaaaguuauuaccuuguuaaaauauuuaaaaguuauuaguagcaauguuggcauauauuauacuuuucaaaagcaguuuccacuaaccuguggcccugcaugacuauauagcaaaaaaucaugauggccuagcuucuacuuccucuccuuaauugaaauuguuucuucaguuaccuagcuaggacucucauacuuucuagucuggguccugccucuuucuuccaucaagaaaaaacaggcaggaauuucuuuauguauaauacuuaccaugaggcaaauucaguuuauaacuuucagcagaguucaacuagcuuuuucuguaaaaagccaaauauauauuuuagguuuuggaguccauuugguaucucacaacuauuuaguucugcccuuguagcacaaaggcagccauagaccauuuguaaacagaugaguacagcuguguucuaagaaaacauuauuuauuuguuggauugcaauuugccaaccccugcuuuacaaguagaagcauuuuauuauuggucuauuuggaauagaauauuugccuucccuguuaaaggaauuucagguuuuaagaacaacugaaguuaauauuuugggagauagaguucacugugggucucuuaacguauuugaccuaaccacaaauuguacuuauggaauaguauaaguggcaucagagggauaauuuguaaucuucccugccauggcccuuagcuuccuuuagccaaucuaggggcuaauucaguuuuugcuguuguaaaauacugaaaauguagaauccuaacaugacuucuccagaaaccugauaccauccugccuauuacucauccaccuaccacacuuugcuuacuacuuugauggcuguuuuaucucuguggucccucccauuugccuuaaauuaaacucauuuacuucuccuuuuucuucuuaugcacaucagauuucauaugcaaauuuaccuuauuugccaaguuuaccuuugcuuauuaaaauauuaaguauuuuguuuuuguaacauuccuuuucuguuuuuuaaaaaguuguuuauugugcuuuuuguauagauuuuuuuaaaagacuaauuucacaugaaauuugccuuggacuauauuuauacuugagauaucugaauucaauuaaggaaaaacuuucaaagucuaagggaaguaggauccauagcucuguugaguuuaauuuuaaauuaaaaauuggcaaauuaauuuugaccauauuuuuaauauguucugagaaaaauucauuuguuaagacuuugaucuuguugauguaaaauguuaaaaagggauaaauuauugcuaaggaaugugcagauauccauaaaaaagaaaaugaaaaauacauucuuacuagccaucaggucucaauuucauccauuuuuccugagcacagauauguguaaggaaccauauugaaaguccagguugaucuuuguauaagguuggugcaaaagcaauggcaaaacugcaguuacuuuugcaccaaucuuauuaaccacucuaguuguugguuguaggcaaaaauaccauuacauaaauuauuuugggggggccauuauaaguccgucauaagcuguauccuaccacuuauuuaaccccaaguaaaaaauaaagugaccuaaaauuaucugcaucuauauguuuaaccucagccaauaauaaggaauacuuaaaacguauuguucacuuagugguagggcuggauauagucauauccagguuauauggugcucaucuguccuugaguacccagaaaguauucuaaauacaaucauggaaguaacugaaggaguacuuaaagaaaacaugaaugguacgauuuguccauuugcuaaccagaaaaaaaggaauauauucacugaaugaugaaaacuaaaggccugcugguuucaaagccaagcuaauuugaaaaggagcaggagggcuggaugugguggcucacaccuguaaucccagcauuuugggaggccuaggugggcagaucaccugaggucaggaguuugagaccagccuggccaacaagugaaacacugucucuacaaaaauuagccgggugugguggcaugugccuguagacccagcuacucaggaggcugaggcaggagaaucgcuugaaccugggagguggagguugcagugagcugagauugcgccacugcacuccagccugggcgacagagcgagacuccaucucaaaaaagaaaagaaaaggagcaggcagaaagaggaaaggaaagaagcgaagagaaagggaaagaagcgaagguccuguggaguacggauccacugaaaacuagagagagaaaaaucucagaacagaaaaucaaccaagacaaggaacuacuagcagcauuggcuuucaauauaaaguaacguucagaaaucucaguuuuuuuaaggcauuauuauguugcccugaaaacuuaccgaggcaggacagcaaccugauaaauuuuagguuguagguaagcaguccuguguguuuggauuacugcuaaucauaaucauugaugugccaagagucuaauugcauuaaguaauguucaauauacauuguugaccaagggaauaaaacaguguauuuuagaaaaguugacuugaauccaguuaaaauuaauguguauuuaaaauuuuuuaucuuuuaaauuuggccagugaaagcugacaaaucuagaauauuucauuuuccugacuacucaaacgugucaaagcauuguauauugaagaugaaauacgugcauauugaaauacauuguauauugaagaugaaauacauuguauauugaagaugaaauacccuuaaacauguuuucuaaaaguguuccauaaguuuagguacuguauuaugagaggaauuugaaagccaucauuuguuuuccuuguucuguuauaaauuuggauuuaaauuuucuuugcaaugauggccucaugaacuagauuauauuucuuucuauauaucuauuauauacuuaauguauucuuguaguaacauaauauuuaaagauaagcuucauaacugaaggaaauuauagauuuuuauuagacucuagucuggcaggucaaaauucuuaacaaaaauguuaauguacauaaauuaacuuaaucaaauuuuuuuuggugaauuccacauuauauauuaaugaagaguuugauuuuucuaauuaacuaaaacugcagugcagguauauguucauggaacucugaauuguuuuguuauggucaauuuuaaagaagagaaccagcuaagcaauagcaauuuucaaaaaauuacuuuuucugcuaacaguuagaaauccauacuuuugcuuuuuauucuguauuauaaauaaagcaguguuuuuaagaauuguuauuguguuuugugauacuugcauuuauaagaacugugaauuaccucuuuaucuuaauaaauucauaguaaugacuuuuuuaugucuccaaguugaggaauggaaauauaaaaugaacauuuuauuugugguaagcaugucauauauuuuuuacuaugagauugcuaaugauauucuagacauaaaguuuauuucugacuuauuacgcuaaaacagaucagaaaauccacuuuuugcuuuuucuuauaaaacuuguguaaaaacaaaaguucuguauucaguagucagugauuaucacaugucauugcuaacauuccuuuagcaaaguaagcaaaacagcaaaauaucuugaccagaaaagacuugagcauauuaaaauauaaaacaaaauaggugauuuaaaauauaauugaauaugccaaacauuuaacuggugguuuauuauaaggaacuuuuaaaagacugcugaacuucaaaguaacuaauucuguggaagggaauacuuuccuuuucuuuucuuugugaggcagagacucguaccgucgcccaggcuggagugcaguggcgugaucucggcucacugcagccuccgccucccagguucaagugauucucccaccucagccucccaaguagcugggauuacaggcgugcaccaccacaccuggcuaauuuuuguguuuuuugguagagacgggcuaggcuggucucaaucuccugaccuucagugauccgccugcccuggccuccuaaagugcuuggauuacaagugugagccaccacgccuggccaggaguacauuuuuguuagacuuuucauugaagaccauauaauauaaauuuuaauuuaaaguuuaaaaaguguucuauucauucauuuuacaaaugagucaggaaggcaaauuuuuauacaagaguagagaaagcguagaagauaaaagaaacuccaagaaaugugcauguauagauuuuuacauguaauuauucuuuuauuucacugcuaaagccugaugacaguagaagaaacuaacccuauaagaaaugcaacauucauuuaucugaccuagacucccucauucaauguuuucuucucuuuuuuuuuuuugagacagggucuugcucugucgcccaggcuggaaugcaguggugugaucacagcucauuuuacagccuuggccucuugggcucaagugauccuuccaccucagugccccaaguagcugggacuauaggugcaggccaucauugauuagccuaguuaauuuuuuaaguuuuauuuuuauagagacaaggucucacuauacccaggcuggucuuggacuccuggacucaagugaucuucccaccucagccucccaaauugcugggauuacaggugugagccaccauguccugcuuaauucaguauuucuguguaccuuacugagaccaaucaugugaucucucucuucaacccaguuuucuaauauuucuaaguccuaaguccugcagcaaaauggcuugaauauauuuuuuccauuauaguuuuuuuauuaugacuaaaaacacaugauauaaaauuuagcaagugaaccauuuuuaaguauauaguuuaguaguaagucuaucauguggugaaacaaaucucuguaacuuuuucaucuugcaaaucugaaacuauacccauuaaacaauucccccacuucauacaaucccugguaaucacuauucuacucuguuuccagggauuugauuacuuuauauaccucauauaaguggaauuauauaguguuuugucuuuuugugacuggcuuauuucaccuaguguaauguucuuccauguuguagcuugcgacagaauuuccuuccuuuuuaaugcugaauguuccguuguguguguauacuccauucacauuuucaauaaguuuguugaguuuggguugaaaucuuauauacagaaccguguuguggcauucagggugauugaaaaguaaguacuacucuagggcagugacuucaggcuuuugaagacauuaccuuauccauaaaacaugcuugaccaaauucucaauauauguauauugaugucuacuacuaucgauccagauguuaaacauugacaaaauuuaguuucuucuccuuacuuuccuucuuccccuucuuuccucugcuuucaccuccaccugcccccaucucuccuuucuucuugucccuucuccuuucccucuacuucuuccccugucacuuucugcuccucuaccuccuucccuucuccuucugcccuuucccccuauuuaucaaaaaauaaaucuaaguagaaguuguaguauuuuccuuccauauucuggugaaucauuuuguacaacuaccguggagacucccuugcucugugguuuggagacaaaucaccacuuucuauuaagauauuuauuauuucauuuuuauagauauuuauggagccauguucaagauacgguguaugguaaugauccuaggaagacuuugagggucagucuuucuaaaagcuggauaguaucaucuuccagacuuuuuuuguuuguuuguuuguuuuuuugagacagagucucacuuugucacccaggcuggagugcacuggcaugauccuggcucacugcaaccucugccucccagguucaggugauucuuguaccucagcuucccaagcagcugggacuacaggugcacaccacgacacuuggcuaauuuuuguauuuuuaguagagaugagguuuugccauuuuggccuggcuggucucaaacuccuggucucacguggucugccugucucagccucccaaagugcugggauuacaggcaugauccacugugccuggccagacuuuuuuuuuuuaaucacuaaucuuauucuuugaugauuaagaaguaccuucaauuaauugcuucuuuaauccuuuuauuuuuggaauauuugaaguuuacuuggaaaaucauguuuuacauuuaauuuugaggauuuguuuuauacuuaguguucacguacauuuguaguucucaaacuuuuuaccugaagauaaagguuaacauauaccucuuaggagacugaggacuuagacugaauuggcuugcugaaagcaagaaauaaauuugaaaucuguuugucuuaaacuugcaugacuuuuaucuuuuccauauuuggggggcucaguuagaagguccagacuaaugugccuccugaagcuucguguauacucuggcacacucaugaauagcucuguggauaugggugccuuagauugagaaauagagagugagaccugcugguuacuuuaaguucaguuauuuuguuguuuguuuuguuguugagacagguucuuguucuguugcccaggcuggagugcaauggugugaucucagcucacugcaaccuccaccuccugggcucaagugauccucccaaguggcugggacuacaggcaugugccaccaugcccagcuaauuuuucuauuuuuuuguagagacuggguuucaccauguugcccaggcuggucuugaacucuaaguucaguuuuuaaagaaaugacauuuaaaucuacauucagaauauuaauuucauugugcugauuuuaaaugauaaacugaaaaguaaauauuaacuuaauaaccuuccccuuauauuuuaguuuuaaucacagcaauauaugugugugguaacaagucuagcaguacagaagaauuuauaggaaggaauguugucuuauuccucugcuccuccccuucccuauguguagccuguuagccauuucuccauuucuguuuuggguucuuuggggaguuacuuuuauaauucuuagaaaaccacagugcagauauucugagggugaggaaaggauuguuaagggaaggaagguguauuugucuguacagucuacuaucuugacauggaagcuuuguuuuaaaaaguacgggaaggggaacaucacacacuggggccugucgugggguggggggaugggggagggauagcauuaggagauauaucuaauguaaaugacgaguuaaugggugcagcacaccaacauggcacauguauacuuauguaacaaaccugcacguugugcacauguacgauagaacuuaaaguauaauuuaaaaaaaaaaaagugcuuccugggaaagcaacugaaacuuauuuuuaaaauuuaugucaggacauuauucuguuuuuccugugaaugccuuaguuuuucuucagccacuuuguagccucccuauaccucuuaaaauucauaaauucuauauucaaguugcucuuaauuucucccuaauacuauuuucuuucuucuguuacuaauaaaguagcgguuuucccauaauaguagaaccauaggguuaguuugcacccaaggaauggcaaacguucuugauauuugauuauuagcauuuucaaaaacaaccaguugaacacccagcagcuauaguuuuuaucggugccccuaagcuucacgaccaaucugacccagcaggauucaagcauaaaauugccuuaagucuuccuacaauuggaggacaaagaagagggaguaacuacccuauugacaagucacaggucauuucuuguuuacuggguggcaucgcuaaggucuuuuuaguuaaagcaucuaaaguaauacacauucauuacugugaaacugccgauuuuuuuuccuuugguccugcuucauuaaaaguguuguuuuuguuguuguuguuuuugagaugaagucuugcucuguugcccaggcuggagugcaguggugcgaucuuggcucacugcaaccucccccucccagguucaagcaauucuccugucucagccucccgaguagcugggauuacaggcacgugccaccaugccuggcuaauuuuuguauuuuuaguaaaggcaggguuucaccauguuggccaggcuggauccugaccucaggugaucugcccaccucugccucccaaagugcugggauuauaggcguaagccaccgcacccagccaaaaaguguuuuaauaagugguuuuauacuuccugguguugagucuguaaauuuuaaacauuuccucccagugugguuaauauuuucaugucacgugacuggauucacagcuuguaguuucaaauguuucugucuuuaaaaacucucuuauauuuuacuuuuaaaacuauuuuuaucuaccagugggucaguaaaagaaaaaaagaaaacuauuuuuaugacauacuaaucuuggcaaaaaucuauuaauuuaacauuguacguguuuuuuuuucagagauugucuauacuucuugguucacaugcuuuuuaauaacauaaaaacaaaaacagccaggugcaguggcacaagccuguagucccagcuacucaggcgucugagguguggauaucccuugagucaagggauuaaauccagccuaggcaacauaaggagaccuccaucucuuaaaaaagacaaaacaguaauguuaaagccaaaugauaaauugauauauuuaucuuaaaacuuagcauuaaguuuuugaaagguaaaaaaauaucucuauaguucucacuuuucacuugaugagaaguugguaaacuaccguuuaaguuuuagaauguguguuaauguaugcagcaguaauacuggaaacuugauuguugguuaucaaauguuaguaagaacaaagaaaaaaauuugcacauuuaaucucacaguuccuuuuaaaaucauuugaaagauuaaguaauaaucaugccacuuuuuaguaaucucuuagaauacuaauauuuuauucaucuuucccuuuuucugaaauaaccaaauuacuuuguuaaacucagcuugacuauagcuuguuauaaugcaugugcaugaugugucugcaagcugagacgcuucaaacaauaaaaccaaauuguauuacagcacaaguauuugcauuccuuuggaaggugaguaaaaucucaucggagccauuaaaggagaauauuggugugccuuaauguggaauucuuugccuguguauuagaucaugccuuugucugcaaaauccuugauugucuacugaugauuugcauuuuguaacucaagguugauuaaagauuuguauaauuuuuuuaaugcuaaucucuuuaguauucugagguaauauacuaaaaaaauacuaucuaauuauagaguguucacaaaauaaaacaacaaaauugcauuauuuucuucuuuguaauuccauugacuggaaaauucugucucugagccguuuccgaaaguuugaaucaguuuaaguaguuauggugccugaauuuuguuuauauuuucuaaugaaaaauauaguuuuagauauaaggccacaucauuaccgaagaaucucagaagggaguuguugcuuuuaauuaacacugacaucccaugauaaucuuuaaaaaaaagcaaaguagaaggauguuggaaauuuccuaucguguuccuaguuaaauuguggacugauuuaugggcggauauuacauccuucuauuuuucacauacaauagguaagucagcauuuagagagugagggacaaauugaggaaaaagcagagguugcuagacagaaaugauuuuugucuuccucuacuuauuuucuuaccugcuguguacuuucauaaucucaaucuuauuuuuuugugugugcuuauuuguaguuaaccuuagcucuuauguaaacacaggugaaauaaaugcaaugaaaauaguacuucaguaacauuuuauuuucuuuuuguuaguuucuucacuaguugaagaaggagaaaaacagaacaaacguuuuaggccgucaaaaaugucuugcagagaaucugccccacugaccccuuccucggcaccaguaagccaggagucacuggcgguuaaagaaaaguucaucccaccugagcucaguaucugggacuauuucauagcuaagguaauuaaaaugcuaucuagaucaauauuuucauagucaaauagaaaugagaauaucagaaauaagugucauuuuuggugcuuccaaauguuuucccacuuugguuuagaaaauuuucauuaguaucaggcuacauuccaaaaauauauacccuagaauauuuugaccauauuucauauaguuuuuaaggcaguuuuuugguaaauuaugacauuugcauuuuaaacaauagcuuuugcauuuuauuauauuucuuauaagauaaaagagaauuugcguaacaucuucauguuaauguacuugauggugauuaaggaaucaaagugcucuggucaucuauuauccauauacucuuuuuuauacuacagcagucucucauuauucugaaauccauaaauuucaauuaccaguguuaaguaacauuauucccucaacaacaugguucacauuuguuaccacaguguauuaaauaugaguaaacuucccugcuagcgcuucauucuagaaaucacuucguaaaugugcacuuuuugaucagugaccaaucaugucaguucuuuuaaagucuuucagugauugauuauguagcaccuguuacucaguucauacacagcaaagcaugcaguuguuuugcuucaucuccugugauaaauccauaugauaguguacaaaauuggauuugaucaaaagagggaaauggccaacuaagaugaaagugcauccauaaaaaaagugauaguacugagagugaaauucaaguugaacauaaaugaaguuagagagaaaauagccaacuguggguauguugacagugcugccauuugaaagacucuagaugaacagccagaggaauuuagugaaagugaacuuauaaauguagaaaguaguugugauaaaaugaugaagauguucagagauagugacuuugccaaaaaacuuuacguuaaagggauucacaacauugaaaaugcaaagaacaguauguuggaagcugauaaaaucuuagaaaugugacaguuuguuuaaggcacagaagaaaugcuugcuucauauccugaguuacagagauagaaggcaauugcuauucaaacuacucuugauaaaauguuuuauuucuuuguauuccuaauguuuuaauuacaguauguuaaaauuaguuuauuuaaaaaaacuuuuucuauacauuuauagcuaaugguaagaguuuuuaggguuuugacaaauaucuuuaaaggucacaaaacauuuguaacuuuucccauugauuauuauugcucuguauaguuuaugcgugcguggucauuuuuguaggcaugcaauacugugcaaaacaaggacugccuauauaaguaucuuucacuuuuugugucaucagccacaucccucacauucucaauuuccagacguucuccugcacaaauugacaucuaacuguaacuguucucuggugacacaagucucccaggccugcugagcuauggcuuuuauuuuucucauauccuaaauguuuaaggguagugaagggaguuugggucuccuuguuccucacugcccuuuuuugagucauuuauucauucauauauucaacaaauguuuauuaagcacuucauuuaucuaggaauaucuuuauuucaccuccauauuuugaaggagaguuuugcuggauauaggauuguugguuagcaaggccuucuuuagcuaucuuguuucugaaucuuuuuguuaaauauuuagugucugcccuuccacccaaucaauaucacaaccucaaaguaguugagauguuaccuucccuaauuguuuguuacugagaucucuguugcuuuugauaaugccugugggccuagaauuuuaaagacaauccugucuggcagggcaucagaacucagucuucacagccuucccugcugacccugguggaacaccuacaccacagagauuggggugggaugggaacagcuccugaccaaguucuuacuguuuuacccagaucagaucccauagauuuuuaaaaauaaauacuucucuauguguuauaugcaugggucaaccauuguuuguuuucuacaauuuuguucaauuuuauuguugcuuuuuggagaaaggacuuaccaagcucuuuacucagcuguuccagaaguuccacucucccugcuguguuucuuuguuggucuuccaagguuuuccaaccuuuuuuucaaacuuccugcaucuccccuuccauccuauccucacucuuaauugaugaccucaccuuguaagucacugagaaaaauaaaaucagacaaaacuuuuucaucaucccaauuuaaaguuacagaucaauuacauuugcuccugucuuauuuccuccuguuauaauggagaaaguccuucuaucagacaccuuuucucgaguuuuacucugaauugcauucuuucuuuucuucucuacucuccccuguguuuucaguucucuuccucucuguugaauccuucacaucaggacagaaaugugcuuuaguaucucccauuccaaaccccugcuuugacccugaaacuuuuuccagcugcuaucccauuucucuguucccacucacauucagcuuuucaaaacuagacacauuugcuuucuacugccuuuuuccccuuucauacuuacuuauauaacuuucugacccaguuacacccguuaaaacugaucuuguugagauucacgugauauccaugucaaauguaguggaaacuuuuaaauuauuuucuuaucugucuucuuagcaucauucaacauucuucacuacucccauauugaaaugcuuuucucuccuuuucucuugaugacaaucucuuguagcuuuuuuucuuaaacuuacuauuuauuccuucauaaucuucuuucuucauccuuccucuucuguuugacacauaaaucuuggucuucaugauuugggcauuuuauaucgauuuuucccaaaaccuucccucucauacccagucuuuccauuuuaugaaauuguauauucacccuuauaguugcucaggccaaaaaccuaagagucauucauuuuuccucaacuucucuuguucuccaaaucuaucagcagaccuguugguucuuucuccaaaauauaucuuaaaucuacuacuugucucuagcuucauuacuaaccaccuauguccaaccugccaacuccuguuuuaguuacugaugucuccauuucuacccuugccguuuagcuuuucucucauaagagagugaucguagugauauacuuagcauauaaaccucaguaccugucuucuacguacaacuuauugguggcauucccuuacauuccuuuaccauggccuacaagacccugucugagccgucauuugcuauucucuccaaccuuucucccagcauuuuuuugcuuagcagacuugaucaaacuacuauuuucaaaccaaacucuuucccaaacucuuucugcauuauuuuuccccugucuaaaaugcuuuucuucccucuuauuauauggcuuguuccuucuugucauuuaguucucguacuuuucaaagaggccuuccauggucagcuuaucucaauucuccuuauucuccauuucuuuucuuuguagcacauaauacaguuuguauuuaguuuucuguuauuugccuauuuuuuuccaguaacauguaaaaaguaaaugaggguggugauuguaucugucuuaaaaauucuuaaauccgguagaauucuugccgcacaguggauacuuaauaaauuuuugcugaauggaugaauaaauaauggaauaguaucaauugaugucaaaggcauaggaugguaagauaauaguuacuuaacucucuuauaaugaaguaucugcaaaugagaugaauuauuacuauuagacuguauguuugaauguauuaaauuagauauguggcugcuaaauuucaugauuucuuuauuuuagccuuuucuacccucuucucaaaguagagccgaauaugauucagaggagagucugggaagugaugaugaugacaaugaugaugaugaugauguuuuagcaucagauuuccaucuccaggaacauucuaauucaaauucauauagguaugguauauuuuauuuuaaauuucuuuuuaaaaauaaugguguauauaaauaauauuuuugaaaaaauuacaugugaaauuaauagcuuguugacuuuauaacacauuauaacccagauuucuuuaguugaaauuguuaaauuccuuuccuuaacaauaauuucucuguugacuuuauaacacauuguaacucagauuucuuuaguugaaauuguuaaauuccuuuccuuaacaauaauuuaucacauaccuuugguuguccauuaauggaccauccguaauuugcaucauuccucacagaucuugcuccaagauuauaccuugcauuuugggcucuaacauaaacaaguucuacuguuuuugucuggaaaauauauuuucaguagaacacuaguacuauaagaugucaauagguacuaucuucaaaaaguacucuguaugucauacacauguucuaaaugcucaccucuagcuccaauacugcguuauucuuacauucaugaaugauggaauauuaucuagucucuauugauauguuuacaucuaaaacguguauguuuuacuaaaacaugguauguuaauggugugauaaaaaaugugaauuuuccaaaagaaguaaauauaugagggacauugaagucauucuuuauuugaaaguuaccaugagauuuuuacuuccugguuuauugagguuuuucccccugcugaaugaauuuuacuuuuugaauauauaaaucauuuaaaagucaaacugcacaacucaacaacaaaaagguaaauaauuaaaaaaaugaacaaagggcugggcaugguggccuaugccuguaaucccagaacauugggaggccgagguggucagaucacuugagcgcaggaguucaagaccagcccaggcaacauggcaaaacccgaucuauauuucuaaaaaaaaaaauuuuaaugaacaaaaaacuugaauagacauuucuccaaagacgauaugaaaauagccaauaagcauaugaaaagaugcucaauaucauuaaucauuagagaaaugcagaucaguuucccaaugagacaacaucucauaugcauuaggauggcuaccaaaaaaaaaacaaaaacaaaaacaaaaaaaauaacagugcuggcaaggaugaggagaaauuggaaucuuugugcacuuuuggugggaacguaaaaucgugcagcaacuguggaaaacgguauacugguuccuuaaaaaguuaaaaauagaauuaccauaugauccagcauuuccacuauggauauauaccugaaaauauugaaaacagggacugaaacagguauuuguacuucccauguucuuagcagcauuauuuacaguaacugaggggaagaaacaaucaaguguguuuuaacagaugaauuacuaaacaaaaugugcuauguacguucaacggaguauuauucagccuuaggaaggaaauucugacacaugcugcaacauggauauaaugcuaagugaaauaaaucagucacagaaaggguuauaguaugugauuucacuuacaugagguaccuagaauagugaaauacauaaagaauaaaaauaaaauagugguuuucaagggcuggugguggggggagaauggggaaugaauuuagaguuucagcuuugcaagaugaaaggaauucuggaguuggauggugguggugguugcacagcaaugugaauguacuuaaugccccugaacuauaaacuuaaaaauggccaaaaugguaaauuuuauguuuuuguauuuuaccauuaaaaaauuacuaaaaauucaauccuuuaagaaauaaauauguuccacuugaaauaaaagagaaccugacuuuuuuaaaaaucaaacuauauaaaaaugugaaaucacaaguuuuacuuaaacuucucuuuacucuauccaauuucuucugcacauccucuacagcuaaccacuuuuauuagcuucugguuuauccuucuguuugcaaaaauaagcaaaagcaucuaucuaaauuuauucccccugcuuucuugcagagaggguggcauacuacauacaguguucugcuaccugcuuuuuauuuauuacuacauaccgaaacugacuccauauuaacacuuagagauccuucuucauucuuccuuaugguuacccuaauauuccauaggucaaaaauaguuauucaacaaguacucuccucauggacaauuuugguuauuucuacacuucugcuauuguagauaaagcugacaugacuaccucuaugcauauauuauuuuguuuucauagagggguauguucagguugauuccugauaguggaauuuguugagucaaaggguaguauacucuucuaaaucccuauagaaauaguuaacagauccaucguugcuuuauuuuuaguugguccuugaugcgguuggcgauggugcaauuggugcucaacaauuugaagacuuuuuaucccuucgcaggucaugaucuugcagguaauaaauagcucaacaugagcuaauggugccauugcuuuugacuuacuacucuguuguuuuuuuuuuuuuuuuuuuggucuggacuggggggaaaauuuagugauuuccuguuacagaaguuagauuucuuuuaacuaaaccaaccaucuguaaauguauccgucauacuguuaggugcuugaggauggcaacauccaagaaaucaagggcacugaaugugaugugauugacugucuugagacucuauuuauacucuagccaaguguugagggauuuuacaauggagagaaaacuaagcaaaugcaaaagcuagcaauuauuaacuucaaaggaggaaaagauuguacaggaaagaaaggggcaugauaacauacuaagugauucugcuaugaacuauaguucccuauauaugauaagguaaacacaaaaauaccaauuuaaccaaagauuuuuauaagacacuaucauaaugauggacagaggaguuuauucucauuaugccguaguaguaaaucaguaggucauuucuaaaauugaaaaauuaaguauuaagcauguuauuuagauauagggagguaaguaguaggaauaacuaaaaguugaaacugagaucaguacucaagaguauggaugggcagaacugcuaagugcugaguuccauggcaaguauuauuuaauuuuaacuuuauguauuguuuucauuuucuacagaucuuaaagaguuauaugccauacagaaauuagucugauacaaauuaaagcagggguguccaaucuuuuggcuucccugggccacacaggaagaagaauaauugccuugggccacacauaaaauacauugauacuaacaauagaugaugagcuaaaaagaaaaaucacaaaaaauuucauaauguuuuaagaaaguuuaugaauuuguguugggcuuuauucaaagcugucugggccgcaugcagccugugggccauggguuggacaaguuugauuuaaagcgauuaauuuuccccacauacauauuuucauaaucuucagauacauuuuucugguaauauuaaggucaaaagcaguaauguugaaauacuuacacagauuuauggcauaccuuuuguaauccacuggguuucuuugcccaccucaccuugcacaucuucccugccaaaguguauguuaauauuucaucucagucuuuuuuuuuuuccugcaucugcucuccccucucucauuucagucuuucuuaaaauugaauauggcauuuuacugcauaagauuaauaugagucaauguucccauuuuagagcuuccaguuaguucaccucuuugucaugcgguucuaaaaacucuucaauguugggaacaaguucuucuccgacgacuugaaauccauggugggccaccucaaaauuauaucgcaagucauaccgccgaagagaguuugucugcagguccugcaauucuucgccacaaagcuuuacuggaaccuacaaacacuccuuucaaguagguuuucuuaugaaugcuauuuggguuuuuuuguuuguuuguuuuuugagauggugucucgcucugucauccgggcuggagugcaguggcacaaucucagcucacugcagccucugccuccuggguucaagugauucuccugccucagucuccugaguagcugggauuacaggcgccugccaccacgccugguuaauuuuuguauuuuuaguagagaugggguuucaccauguuggccaggcuggucucaaacuccugaccucaggugauccaccugccucggccucccaaagugcugggauuacaggcgugagccaccgcaccugcccugaauacuguuuuuaagauaggaguuuuacuuuuugugcuguacauucuugucauaacuacucaacccugccauuguagaauaaaagcaaccauagacaacauguacacaaauauauucaguuuuuguccaauaaacuuuauuucuuaaaaugguagguaggcuagauuuggacugugagcuauaguuuauugaugccugcucuagaacgaugcuuuucaaaauagcuggucacaaaaguguuaagaggaaaguuuauagcacuaaacaacaagcagucaacagauucagcacaauuccugucaaauuaccaacaucauucuuaacagaauuagaaaaaaauuauucuaaaaucagauggaaccaguagagagcuggaauagccaaagcaauccucagcaaaaagaacaaggcaucacauuaccugacuucaaacuguacuacaaagcaacaguaaccaaaacagcaugguacugguacaaaaauagacaaauagaccaguggaacaaaauagagaucccagaaauaaacucacaucgugaggauuuguucuacaaauuauuucaucacucagguaguacuaagccugguacccaguaguuauuuuuccuuuuuuggagacaaagucuugcucuauuaaucaggcuggaguagaguggcacaaucacagcucacugcagccuccaccuccuaggcacaaacaguccuccugucucacccuccugaauagcugggaucacaggcacacaccaccaugcccagcuaauuuuuuguauuuuuuguagagacaggguuucaccuuguuacucaggcuggucucaaacuccugugcucaagcaguccgccugucacagccccccaaagugcugggauuuuagcugugagccaccaugccuggcccccaguaguuauuuuugugauccucuuucuccuccccacuucccccucaaguagaccccacugucuguuguucccuucuuuguguucaugaguucucaacauuuaguucccacuuauaagugagaacauacaguguuugguuuucuguucuugugcuaguuugcuaaggauaguaaccuccagcuccauccauguucccacaaaagaugugaucucauucuuuuuuauggcuacauaguauuucuuguaucuguaccagauuuucuuuauccagucugucacugaugagcguuuagguuccauuucuuugcuauugugaauaaugcugcagcgaacacuugugugcauguguuuuuuaugguagaaugauuuauauuacccuagguauauacccaguaauggguuugcuaggucaaaugauaguucuguuuuuagcucuuugaggaaucgccauacugcuuuccacaaugauugaaguaauuuacacucccacugacagugcguaaguguucccuuuucucugcaaccuucccagcaucuguuauuuuuuauaaauaaucuguuauuuuuaaaugauaaccauucugacuggugugagaugguaucucauugugcuuuugauuugcuuuucucaaaugaucaguuauauuaagcuuuuuucuuaggcuuauuggcacguacgucuucuugugcaaagugucuguucauguccuuugcccacuuuuuaauggugguguuuguuuuucuuuuuuaaauugguugaaguucguuauagaugcuggauauuagaccuuuaucagguacauagaaaguauuuucucccauuucuguagguugucuguuuacucuguugauaguuucuuuuguuuugcagaagcucuuaaguuuaauuagauccuauuugucaauuuuugcuuuuguugaaauuccuuuugggguccuugucauaaaaucuuugccuguuccuguguccggggugguauugccuagguuguuugcuaaaauuuuuguagcuuuugguuuuacauguaagucuuuaauccaucuugaguugauuuuuguguauguugcaaggaaggcauucaguuucaaucuucugcauuuggcuagccgguuaucccagcaccauuuauagaauagggagucuuuucuugauugcuuguuuuugucagcuuugucaaagaucagauggccagaggcgugucaccuuacuucccaguucucuauucuguuccaguggucaaugugccuguuuuuguaccaauacuguucuguuuugguuacuguguuuuuguagcauacaucgaaaucagguaaugugauuccaguuuuguucuuuuugcuuaggaucgccuugcuauucaggcucuuuuuacguuccauauuaauuuuaaaauagguuucucuaguucugugaagaauguugguggugguuuguuaggaauagcauugaaucuguaaauugcuuugggcaauauggccaguuuaaugauauugauucuucuucuccaugaacaugggauguuuuuuccauuuguuugugucuuaucugauuucuuugcacaguguuuuguaauuauuguagagaucuuucaccuccugguuagcuguauuccuagguauuuuauucuuuuuguggcaguugugaauggggcugccuuccugauuuggcucucagcuuagcuguuguugguguauaggaaugcuagugauuucuuguacacugauuuuuguauccugaaacuuugcuaaguuguuuaucagaucuaggagcuuuugggcugagacaugggguuuucuagauauagaaucauguuaucuacaaacaggcauaguuuuacuuccucucuuccuauguggaugccuuuuauuucuuccucuuuccugcuugcucuggccaggacuuucaauacuagguugaauaggaguggugagacaaagcauccuugucuuguguugguuuucaaggagaaagcuuccugcuuuugcccauucaguaugauguuggcuguggguuugucauagauggcucuuacuauuuugaaguauguucuuucaauaccuagcuuauugagaguuuuuacauggauugauguugaauuuuaucaaaagccuuuucuucaucuauugauauaauuaugugguuuuugucuuuaguucuguuuaugugauucaucacauuuguugauuugcauauguugaaccaaacuugcauccugggaaugaagccuacuugaucauggugaauuagcuuuuugaugugcugcuggguuugguuugcaaguauuuuguugaggauuuuuguguugacauucaucaaggauauuggcuugaaguuuuguuuuuuuuguuguuacuucugccagguuuugguaucaggauaauguugacuucauagaauuaggugugaaggaguuccaccuccucaguuuuuugguauaguuuuaguaugaaugguaccagcuuuucuuuguacauuucguagaauuuggcugcgaauccaucugguucuaugccuuuuuugguugguaugcuauucauuacugauugaauuucagagcucauuauuaguuuggucagggaaucauuucuuccagguucagucuugggaggguguauguguccaggaauuuauccaucucuuguagguuuuguagucugugugcauagagguguccauaguaguuucugaugguuauuuuuauuucuguggggucagugguaacaucuccuuggucauuucuaauuguguuuauuuguaucuucucucuuuucuuuuuuauuagucuagcuggcagucugucugucuuacuaauuuuuucaaaagaccaacuccuggauucguugaucuuuugaaugguuuugugugucucaauuucuuucauuucagcuuugauauuuguuauuuuuuaucuucugcuagcuuugggguuuauuuguucuugcuucucugauauuuuccauuaugauguuagguuguuaauuugagaucuuucuaacuuuugauguggacauuuagugcugugaauuucccucuuaaugcugccuuagcuaugucccagagauuuugcuaaagcauaccuacuuuuguuagauccuauggcccuagguuagggaucaacaaacuauggccauccccacaggugaaauccagaccucuccaugcuucuuuaaauaaaguuuuauuggauuauagccauaaauccucucaauugcauauugccaguaguugcuuucccacugcaaguugacagucccuaauucaaaucugaaaugcuccaaaauucaaaauuuuuugaguaccaacaugaugcuauaaguagaaaaugccacauauaacuauuuaacacaaacuuuguuucaugcacacaauuauuaaaaauauaauuucucaccuucacugccuguaaugccagcacuuuggaaggccgaaguggguggaucaccugaggucaggaguucaagaccagccugccaacauggugaaacccugucucuacuaaaaauacaaaaauuagcugggcaugguggcaggugccuguaaucccagcuacucgggaggcugaggcaggagaaucgcuugaacccaggagguggagguugcagugagccaagaucgcccuguugcacuccagucugggccaaagauugagauuccaucucaaaaauauacauacauauauauauauauauauuuuuauauauauauauauauauauuuauauauuuuuauauauauauaauuucuuaccuucagguuaugcauauaagauguauaugaaacauaaaugaauuuuuaauuuagacauauauauucaaauauuucaaaaucugaaaacauaugaaauucaaaauacuucuggucccaaguacuuuaguuaagggauacuuuaccuguacauuaucagacuugaguaguugugacagagaccauaugguccacaaagccugaauuauguacuaauccuuuaaggaaauccuuuaaggaaaagguuggccauaugaucugccuccagucauacagucugauugcaguuaauuuauuauaauuuauauggcaccaaggaauuguuaucaaguuagucagaaauuucugaaguuuaucauuaaauuugcugucucucucuguagauccaaacaccaucuggcacugucugugaagaggcuuuggcaguauuuggugaagcaggaagaaauucaggaaaccuuuaucaaaaauauauucacaaagaaacggugucuaaaugaggucuguauaaguuaaaaccuguuuacuauuuuauuauugaagucuuuuauauuaucauguaaccauuaaaaugaguuguauuuuacagauuuuuugaaaacacguaucauaaacauaggcaauuaaugcuuagaacaguguaauuuauaaaaggggcaguauuuucauaaaucaauuuaauuaauucaaauguauuugggacuuuuuucucgauaaaaauguuuaauauuccgcaucuuguuuugaauugucaugaucaucaauuuaagagacaagauagaaauuuucuaugauuuucaugugacaguuaaaagaagucuaucuuagaaguuuaauuguaacuuagaaguuuaauuguauacugaaaauuuuuuauuuauuuauuuauuuauuuuuucuuuggagauggagucuuguucugucacccaggcuggagugcaguggugcgaucucagcuuacugcaagcuccgcaccucccagguucacaccauucuccugccucagccucccgaguagcugggacuacaggugcccgccaccacgcccaacuaauuuuuuguauuuuuaguagagacgggguuucacuguguuagccaggauggucucgaucuccugaccuggugauccacccgccucagccucccaaagugcuaggauuacaggugugaaccaccacgcccggccugaaaaauuuuuauuguauuuauuuaucuuuuuugagauggagucucacucugucacacagguuggaguacaguggcaccauuucagcucacugcaaccucugccucccaggcucaagcgauccucccaccucagccucccuagcagcugggacugcagaugaacgccaccaugccuggcuaauuuuuuguauuuuugguagagacuggguuucaccauauugcccaggguggucuugaauuccugagcccaggcgaucuaccugccuuggccucccaaagugcugagauuacaggcuugagccacugcacccagccaacuuuuuaaauauguacauuuucuuuucuguggauuaugcuuaaauuaaugaaauuuuacaaacccaaauuaaccuguaguguaacugguugcuuauaccuugauauuaucauaauggguuuuuuuuuuuuuuugucauuuaguuuagugcuaguaauaaauaucagucugaugauauggggaacuuguuucuuucauuggguaaguuuuguuacuaaaaaguucaggugaacugaacaguagaugcagugauguagucaauucuuuuugucuccuggacugguaacgaagaguucagaacugacauuugguaugugaaccacauuuugaguagcauugaacuagucugaaagcaagcuuuguacaguuuuugaaguuggaggaaacacugaagauauuucaguugaagaaauaaauugaauggcuucacaauagacaaguaagcaaaaagcaagauugacaucuaaccuuucuaccuuaaaggaaaauuacauauauaucucauugucucucaauuuaagcaccaauuuuaaguggaaacuguauaugcuguuauuuacuauuugccucauuuuguaaauauauucaaaucgaccaagucaggaaauaguauguaguguucuugcugacuuagaagacuuuugaccugaguaccuugguguaauauugaaauuuagacaaacaugaauguauuucauuuguuuauuugaucuuuuuuuaaaaaaauugacauauuugauuaaucuuagaaaaaucuuauuuuucuacugccgauauauuuggguauuugggaaaugaaguaguucugaaaacaauacaaaaaaacuauugagccauuagauugucuaguugauucaggaauagacucauuaaagaaauagaguaguauagucaagccagaguacguaaacauagcaaauaauaaguauaacuacacauuuuaaaauuucuguuauucuuuggaguuucaugauaucucaagaaaauuuuaaaauuauuuuuauuguaauuauuuuaaucaggagcaugaauaugaauguuggacuaacaguuuugugacuaucaguaagcugaauauuuucucugaauuuuguuuuuuuaaugcacaaugacuauaauagcccuuacuuugcaauguuuugauaaauagauuuaacuuauuuaaaccuugacacaauuaaugguaguuauuaaaaguuuguuguuauugcuuuguuguuuuauucuugauagugauacucuuaaaauagugucuuuuugauagagaauaugaaaagaaaaauguuacauaguaaagcauagauuugaauggaauuaaauagaauauagaguuugugugaaauuaaucuuuaccggaaagguuacuagccuauuuuuaguauuaacaaaaucaccuuccaucucuuauuuuucuaaaaugaugauuaugcuuaaauauuuuagucaaagucacugugauuuuccagaugguuaggagauacauauaugacaggcccuguauuuuggauggcaggugaugggagaguauucugagaacugcucuuucuuuauuucuuuauguguuugaaaaugaaauuuuacaguuucuucaucugacccuaaaauccugguuuucucagaucuuuucuuuuccuguuugguaaaguuuacugguaccuguguuuuaaaauagaauguccucccuuuguauuuaaauagaaaguacagacaacugcaauuagauuaagucauucuuaauaaaaaauugggacuugacaacucccaucauuguucccaauuccuuuuucuguuuuuuuuuguuuuguuuuguuugaguuucugagaagaacuaaaagucuuggaacaacucuuucuuuaacaaguacuacuauucccuuuuaagaaguguaugugcuucccagcaauuuauugacuauuucuggcuucaucaguggaagagaauuagauacauguagaaauugaaauuuucuaaucaagagauuuuccugaagguucagauguggagauaagacaaagcagcgaguaagagaauaauucgacuuuguucauaguacucugacaccaguagcucugauuauuuuaauauaaaguauuuugguuucaaucgugcuuuaaugucaacauuucgaaauugaguaaaaacuucuuaggguuagaauaaaauuuauagugguaguuaaugaguucugagggauuaaguuuugcucauuuccuaaccaugcacccucacacaugcuucuuauaagguguaugaaauuuugagaauaguaacuccauauaauguucuuuucuaguaaauuugguuuaaaauauagcauugaaacaauccccaguauuuugcauguuacaucucaucuuuacucuuugucaugugguuauucuuucuugaugaagucauuagaggacaacagugaaaccaucaaaaauucuaugauggaggagccaaacaucaauaagguacaaaauaucauucaacugaaauuaaaaauugcauucuuucacaaaagaacaaagcauuugcauuuuacuuuuaaacuggucuuuguuuccaauggauuuaaaguauuguucccucaaauuauucuccuuuuauuuuaacaacuuaaauacugcaguuguaaaagugguuucuguuuuguuagauaagagaaugcaauuuuaaagggaguugaauguaucuuguuuuggcuacaaauuuuucugaguaaauacaacuaaaguucuuaauacaugugauuacaauagcaauugucuaguaguauuguuuuaauucugcaaauaucacuucugaaguuaaaauucaaauuaggaauuaaugauacuaaaauuaggaauuaaugauauuaaaauuaaugauauuaaaaaauucaaauuaggaauuaauauuaauuccuaaaaauauaguaaauacuguuacauagcauuuauuuuacugguagcaauagcauguagcaaagugccuuaagaggauacauaguaaguacucaugguacuugagaaccaaagcacaaaagaugagaaucuguauaauuaugaaaaaacuccuaggcguccugugauugcauauucaacuaugacuauauuuuauuuuauuuuugagacggaguuucgcucuuuugcccaggcuggagugaagugucacagucuugguucagugcaaccucugccccccagguucaagcgauucuccugccucaaccucccuaguagcugggauuauaggcgcccaccaccacaccuggcuaauucuuuuuguauuuuuaguagagaugagguuuugccauguuggccaggcugaugucaaacuccugaccucaggugauccaccugccuuggccucccaaagugcuaggauuacaggcgugagccaccgcgccuggccaauucaacuacgacuuuaugagguuaauauuuaacucauguuuuucauauucuauauuuaaaacaaucucagcagugauuuuuaagugaaaaauugcucaaaaaaauuuuuaagguuacuaauuucuaccccuuauucuuuccaaugggaauccuuugguaaaauaggagaaauaauucugugcaauuaauuaaaaagccugauuugauaucagguguauauuauaacuaaaacuuuugcaaaauaagucuguaugucauucauacuuucaaacuaucuaguggccuuuggggguuuugagggaauauaauucaaacuuuuaaucaguuaacaauuuuccuugccuggguuuugaugauuacuuauuacugucuacacauuaucaggaauuuuuuuuuuuuuuuuuuuggaaacagaguuucacucagguuucccagacuggagugcaguggcgcgaucucagcuuacugcaagcuccgccucccggguucaagcgauucuccugccucagccucccgaguagcugggauuacacgcaugggccaccacauccagccaauuuuuguauuuuuaauagagacaggguuucuccauguugguccggcuggucuugaacucccaacgucaggugaucugccugccuuggccucccaaagugcugggauuacaggugugagacaccgugcccagccacauaucaggaauucuuauacaaacauuuuuguuuugaugcuguuuauaaaaugcuaauaaucauaauguuguauuucuauagucagcuucaugcuacgucaaaauacagucuuuuugaggggaggguuaacaucauuuuggccagcauuuuuccaagcccacugcuauauaguuuaaaaaaaaaaucuuuguaagguaugccugaccuaaaauaacuacauauauuuaaaguguacaacuuguucaauuuuggcauguauauacacuagcgaagccaucaccacaaccaggauaaugauuauauccaucaguccccagaauuuaaucccuccauuuuuuuuucucucccaccugugcccucuuccccaggcagcuaccaaacuuuuuccugguguuaaagauucauuuguuguuuucuggaauuuuauguaaauagaaucauauaauacaucauuuuugguuuauagucuguguccauugacuuagcauaauuauuucaagauucaucuauguuguguguuuuaguaguucauucuuguuauuuugaugcuuauuacauuauauggauauaccauaguuuauuuaccuguuaaugaacacuugagcugauuuuauuuuggaccuauuccaaauaagacugcuuugaauauucaugcaaaagucacauuuuauggaaaaaugcuuucauuucucuuguguaaaugccuaggaguagaaagacuggaucauguguagguauauguuaaacguuuugugaaacuauucaaauauuuuccaaggugguuguaccauuuauguauauucucaauggauuguguacgaaaucccauucuauuuuuuuuuuuuuuuuuuaaaaggcagggucucacugugucucccaggcuggguguaguggugugauugcggcucacugcagccuugaccuccugggcucaagcaguucucuugccucagccuucugagcagcugggacuacaggcaugcaucaccaugcccagcucaauuuuauuuuuuguagagaugggguuucuccauguugcucaggcuggucucaaacuucugggcucaagcagucuucccaccucagccuccugaaguguucggauuacaggugugacccaccaugcccagccuugcaucacauucuuaccaacaguugguguguagucuauauuuucauuuuaaccauucuaguagguauguaguaguaguucauugugguuuuaauuugcaucaagcaucuuaucacaugcuuauuugccauuugucuaucuuucugcaugaauugccuucaaaucuuauguuuauuuuguauuagguugcuuguuuucuugauucaauuuuaacaguuauuuguauguucuggauaaaaguaauuuaucagaaaugugauuugcaaauauuuucucuuacucuauggcuugucuuuucauucuguuuacaagguguuuucauuuuauuuauuuauuuuuuaagcaaagucuugcucuguugccuaugcuggagugcagugguaugaucuuggcucacugcaaucuccaccuccuggguacaagcgauucucauaccucaggugugcacuaacacacccggcuaauuuuuauauuuuuaguagaugaguagacuggguuucaccauguuacccaggcuggucucaaacuccugggcucaagugaucugcccaccucggccuccuaaagugcugggauuaggagcgugaaccaccgcagccggccacaaguucuuuugaagugcagaaguucuuaauuuugaugaugucuaauguauuaguucugguuauucauuuucuuuuggguguuguauuuaagaaaucuuugccuaaccuaagaucacaaaaacuuucuccuguucuaaguguuuuugaguuucaguauuacauuuaggucuaauccauuucaaguuaauuuguuuacauggugugaaguauagaccucaguucuuuguuacuguuguuguuuuugcaucuguaugucaauuguuacagcauuauuucuugaaaagauuaucuuuucuuucacuaaacuaccucuuucaccuuuucaaaaaucaguugacacagaugaguaggucuaauucuggagucuguuuugggccauugauccaucuuuaugguaauagcucacugucuuuaucacuauaaccuuauaauaaaucaugaagucauguauuguaagucauucaaauauauuauucuucuaaguucuuuuuucuuuuuucuuucguuuuuuuuuuuuuuuuuuugccuuaucacucugacuuagaacuuccaguccaauguugaauagaagugaucaccagcagacauuauuaucuuguuucugaucuuggggaaagcagucuuuuauuauuaaguauaauguuuucuuuaaguuuguuguagaugcccuuuauaaguuugaggacguuucuuugcauuccuacuuuguuaagaguuuucauaaggaaaggauguuggauuuuaucaaaugauuuuuuuuuuuuuuuugccuacuauugaaaugaucauccuuuuuucuuuuuuaguaugauagguuaaggauuuuuuuaaaaaauguuaaaccaaucuagcauucccagcauaagcuauacuuggucgugauguguuauccuuuuuauauauaguuacauuugauaaaauuuuaagaauuuuuacaucuauguucaugagggauauugguuuguaguuuucuuacaauguuguuuguguuggucucagauuagugcuagacucuuagaaugaauugacgaagguucuguccucuuuaauuuuggggaauaauuuuuauagaauuaguguuauuucugaaguguuugguagaauccugaaguuuuuuaaaugacaaauuuaauuucuuuaacagauguagggcaauucagguuuaucuauuucuuaagucaguuuugguaguacaugucuuucaagaaguguacauuucauuuauguugucaaacuuacuggcauaaaguuaucauguugcccuauuaaaauauguguagaauccauggugaugcugccucuccuucuucugcuaugacuuugaaaaccaaauuaugucuucuuuaguauuuauauucccuaauauuugggguauugacaccauuuuauguucaccugauugcuuccuauuuucuuucaguuaugccuucggcauucuuuagauaucauuuuacuucauauuugugucauuagaguggcaaugaaguguuccaaguacacaaccuuauauuguagguuuuaguaaaugaaaaucacuacugacuacccagggucucagucacuuuuuccauggaucugcuguaugaccuuucacuucuuccacucuuggagccucauuuacugacauguaaaauuagggcugauaauuuuaaaccuguugcuucucuaauugaaauauuccguaggauccugguguuaaucuauuguaacuaucucuuucuccuccagcuucuaagggcagcucuguggaacccaagcaauguucagaucaguuucugcauaauuccuuuuugugguaaaauauaaauaacauaaaaguuaccauuuuaaccauuuguaaagcagcccaguggccauaaguacauuuacacugcucugcaaccaacacaccauccaucuccagaacuuuuucauccucuccaaacugaaacuuugugcccgcuaaacaacagcuccccauuccucuggcgcccacuccaggcaaccaccauucugcuuuuuguaucuaugaauuuuacuaucccuagguaccucauguaaauggaauuguauaauaguuauccuuuugugacuaguuuauuucaccaagcauaaugucuuugagguucauccauauuuuagcaugugucagaauuuccuuucuuuuuaaggcugaauaguauucuaauguauguucauacauuuuguuuauccauucgucaguuaguggacauuugaguugugucugucuugguuauugugaauaauggugcuaugaacauugauauacaaauaucugaaucucugcuuucaguuuuuugggguauauacagaaguggaauugcuagaucauauagcaauucuguguuuaguuuuugaucugcauaaucucuuuaaaucucuuuuagcguuaauauuuggauucuuuuuucuucacauguccagcccaaucaaagcaugaaaucuuuacagagugugacuugaaacuuuaggagaucuuuuaagaccauauucauugugauuuuuuuuuuaacuauaauguuauguugugaggccuuuaacaaauaaaauuacauucauagcacaugcaaguucugucucuauuuuuagcugacuguaucauguuccuaguuccuucccuucccagcuuagauuucaugauccaucauggaaucaaucagucacuugcaaacauccuuaucccuguucuuccuacuugccuugaaaauucccaaaccuucuuaaacccaacuuuuuguccuauucugugccugcacucaagcagcugaacauguuuggaggaaaagcacaaacccuggagcuugccucacuuuacauuuauuagcacaaauccaaaauuaauauaaaacuacccugcagucauaauaaauugcucuguagcaaauuuguuuuuucauuuucauuuucauacuuuuuccuuguuuccugaaacuuccaguauuuguuuccuacuccccacagaucaauauauuuugcugucaaaauaaguguagucagcagugauuuagccuaaccugcccaucaucaucuaauuucugcucuguaugcagauauuuucuucugccuccucuaacagagugaacuguuacccuuuuuguucaaggccagaacuuucacuugugcacaguucuuaucugcuuucaccuacccaagaacuugucuucaguucuuaauaacugaagcccaucucccucucuccuugucaauaaauguuuaccucucucaaauuauucucauuagcaugagcaaauauauuuuaauguuuugccuuuaaaaaauacuccauuucucuagucuccuauguagcaaaauucacuuagaguugccuauaaaguccuucaagauuuaaacaauaauguugaaacaccauaaacaaaccacccagcuuaagaaauaaaacauuaucaauucaguugaaugucucugugauccuuuccccguggacuccccuucuuauucaccagauaucacauucucucuaauuugguuauuaucuccagcccacuccacugagauuguccuagacacagucaccacugacuuccaguauacuaaauuuaguagucaauuaucuaucuucauaugauucaacuucuuaauaaucauuugguaguguugacgcauaacauuuuucuaaaauuguuuccucacuuaguuuccauaauaucaaacuaaucuauuucuuauauuagcuaauugauaacuacugaauuguccuuuuucccauccuugaaauauugguugccccagaauucaguucucuaacuuuuuaucuuuccugucuuuacucucuccuuggguuaucuuacgguuuaaauauuaauauaauuuguaugcugacaacucucaaaucucucucaacuaauuucccgaacuccagacauugccugcuccgaaccuacucccuacuguuuccuucacuucuguccaucucaguaaaugguaccuuuacucacccaccuaucaggccugacacuaggauucauccuuuuucuuuccuucuuuuauucacacuaugauuacaguccauuaacaaaauguaucccaauuccagccacuuaucacuaucaccauuccuacugcccuaauccaacccacuaugaucucucacuucagcuacuguagucgccuuuuaacugguuuucugauagucauucucaaacccuuuauguuuuaucucacaguagccuggcuuuucaaaauccaccaaugguuucgcugccuuagaacaggauuugaacucuuuauuaugucuuuuaaggcccugcaagaacugaaccucuaccuuuaucuccaaucuuaucuucugccacuuauggucauucacaaauuuaauuuaagacuucugagauaccacuauuucuuugacccacccccaugacauucugauuauguaucugacaugggguucagaguauuuguauuuaaaaaaaaaucaccucaguugauucuuauucagguuaucuugacaccaccuuacugagaaacaauguuuuuaguaaauaaugaggacaggaauguauuccuacauagagaaagguuuuuugaaguucauaccugcaggagcuuucuucccaaacuuuacauguaaaguucgaaaaagcuccccaggugaaacugguaugaugcccuauccaaccauuaccagcaaguggcacaucccucuauuccauggagccaucaucuuucucugucgccaauuucuucaaaaccuaagaaugaacauuuaguauacuuuagaugccaggcagauugguggguaaguuggaauuuugucauaaaauuauggaauuugacuuguacaucauuaacggaugaucggcguuuuguagucagagcugagacuuuccuuagaagacaaguugauccucaagucagccagaauguucagcgaauacugaaauucuuccuaagcaaguuauacuuuagauuagaauauauuugacucuuuauaucuggcaacugauuuuuguuuguguagggauauuuugguuugguuaucuuguaggucucuuugaacuuuccaauugaacagugaucuuaauugccuuucuuuuauuuauuuauuuuuuugagacagggucuugcucuguugccugggcuggaguacaauggcucgaucuuggcuuacugcagucucugccuccuggguucaagugauucucgugccucagccacucaaguagcugggauuaccgaugcgcaccaucacgccuggcuaauuuuuguauuuuuaguaaaguaauuucuaguuaauuuuuguaauuuuaguaaaauuuuguacuuuucuccauguuggccacuccugaccucaagugauccacucaccucagccucucaaagugcugggauuauaggcgugagccaccacaccugaccuuaguugcuauuuuuaaaacacugcauauucugauccauucuguggucaauggccgggcauuggugauauuucuaucaaaauuuugcaguaaguaaauuuauuguaugcugauuucagauaauuuaugcauuucacaauaagucugaaaaccuaauucauuuuaaaagauugaaaguuagaauggcugggugugguggcucacgcccauaaucccagcauuugggaggccaagguggccaaaucaccugaagucuggaguuccagaccagccuggccaaaauggugaaacccugucucuacuaaaaauacaaaacuuagcccggugugguggcaggugccuguaaucccagcuacuugggagucuggagcaggagaauugcuuaaaccugggaggcagagguugcagugagcugagacugugggccacugcccuccagccugggcgacaagagcauccaucucaaaaaaaaaaaaaaaaaaaaaaaaaaaagcaggauaauaugaaauaauguccuauauuaggcaacauuucaacucuuuaauugccuccucuuuucugcuuauuuuaguaagugucgauuuuauauaguauucuuuucuaaguccaaagauguauacacuuugucuggaguaagcagaaggucaaauauaugucccucaucuaaaguacuuagaauggugguuuauuuagcuacuaaaaugauuacucacuugggcaaguuacauugccuuucagaauuucagguuucucuauaaaucaaagguuaacuacagccaucuggccaaaucucaccugcuucuauauaguccaugagcugagaauuuuuaaaggguuuggaaaaaaugcaacagugacccuuuguggucugcaaaaccuaaaauauugacuaucugaccuuuuaaauuuuaaaaaauaauaugaaagaauuauaaugcuaggaaacuugguaaauacauuuugcuuuaauaauuagaauguguugauccuuuaaaguuaauuaacuguaucucgggaggauagccacuuaaugaaguuguauguuguaucagcuguuuuuuuauguguaaaaaagcaaguuugaagaaauuuaaauuucccaugucaaauuuuguuuuagggauaauuagcauauacaauaauaccuuuagaauugaaauaucuacuuucuuaaaauaauuuaugcaaguacuaauugauagauuggcauauauuauuaguucuauuacuaaaaucagugcauuuuuguguuuuguuuccuuuuauuuagauagaagcagauuugggauauccuggagguaaagcaagaauuauucauaaggaaucugauaucauuacugcguuugcuguuaauaagguaaguacauagacauucuucuuuuguuuauuaaguauuuauaguuggauaauaucuucuguuuuaucaguuuauccaguauuucuuucccaaagcugcuuccaguuccuuaaauugcaaucuggauacuuuuuuaauuuuauaaaaugauauuauuugauaaugugauuuuguuauuauaugauuuuggagauacagcugauacauaauguuuuauuacuaugcagagagaaguaccaaauauauagacaaucgcuuuagaauuuauacaauguacuauaguaguuaacccacagaaaaaguuuuuuauguuccuuaugaauaugucaaaugugguucuggguauuugguaagauuuaagcuuauaugugacucaaauucucccucuuugauuuauaccuccgauagcugcccaacguguguauuuucuuaguauuucuuaaauuucuacuuaacauccuccuuagaugucuauacacuccucacagaagagguggccuuagguacuauaguccaagauugaaaucugucuuauuaaucauuuuccccuucugucuccccuaauugccuuacuguaugguuccuaaugacuucuaguuauucuuuuguuuuccuuccauuaacuuaaaggauauguguaucuucuuuuuauguauucauagaagauaccuaaaggagauauuguauacauauauauaagauguucauauguuccuaauuuuaaaauaauuguuaaauguuauguagauacauacccuguaauauguauauguaauauguaauacagggaagugugauauacggggaaauuacccauuuaguaauccuuucaccaguugguuuucugucuuucugugcuaugucugucuucucugaauucuucuggacaguaucuuuguuguucugugugcuucacuuaauuuccuucuuagacaccguugagcaaugacuggcuaaagggcugauuccagauuugccugcuucagacaguucuguuaucaaagaaacaguucuguuugaaacaggcaaaucuggagucagccccuuagccaguuguaauaucuguauaacaugauauuauauauacaugucaaauacaaaauuauuggccaggugugguugcucacaccugucaucccaacacuuugggaggccaaggcaguaggaucacuagaggccaggaguuugauaccagccugggcaacauugugagacccugucucuacaaaaaaaaauuaucuauaccugcauuaccugcucuuucuugaagaaaauaugauuuaaaauagucugugcuauaaaagaaacuaguuguuuucuucuugaggguuuauauauaaguacugguaaugaauagcuauucacauauauaaagucuacaaguuacugucuaugaauaugccuguuuaauuuuuauuuccccagauuugcuauuuuuauuuauuuuauuuuauuuuauuuuacuuuauuuuauuuuauuuuauuuugagacggagucucgcucuguugcccaggcuggagugcaguggcgcgaucuuggcuuacugcaaccucugccucccggguucaagcgauucuccugccucagccucccaaguagcugggacuacaggugugcaccacuacacccagcuaauuuuuguauuuuuaguagagacggcguuucaccauguugguuggccaggauggucucgaucucuuuaccucgugauccgccugccucggccucccaaagugcugggauuacaggcgugagccacugcacccagcugauaugcuauuuuuaauauccuuacuaaauuugcagcugagaaauaauaccucuugcuuuaaguugcauuuuuuuaaaugccauugagauuuuuuuugccauuuguuuaguugggaacuaccugugucaaaaacuaugaagggucucagauuuuaccuuaaauuaaaacuaacaguuagcuuucuguuucuguugccacagaaacaguucuguuugaggcaggcaguggauuguuuaaacaguccauuuaauugauccauuaaacauuuuaguggaugcuguuagaagacauacgacucuuggaucagagacaaaggacaguuuaugucuaacagcaaaagcaauaaccagaaaaucagcacuuuacacugguugccugagccacaauuuccagagaaugacgggaagagggccagaugauaccuaccuuaccuacacacauaguagguuauauuacaggagaggaucucugaguuuaggggacccaaaucuuuuauaaucgauaguaagcauacuugcccuuugcucuggagggagagacgauaguuauacaaacauccuggcaauuauacugcagaaaaaagggcagacaugacucacuuauaaaacaugcagaauuugggauacccauggagaauaaccacccaauaaucuagcuauaucauuuuuucauuuauuucuaaggucucaguuuuuucuuaauaguuuguguuaaaaucuaacauaacaguaaugguaauccuauuuucucuuugcugucaauaucuuccuguuuucuguuucaaagauacacauuuaauuaauuaauuaauuuauuuauuuauuuauuuauugagacaggguaucaugccuggugcccagugcuguggugcaaugucagcucacugcagccucgaccuccugggcucaagcaaucguuucaccucauucucccaaguagcugggacugcaggugcaugccaccaugcccaacuaauuuuuguauuuuuuguagagacaguguuuugccauguugcccaggcuacuaucgaacuccugagcucaagcugucugccugcuucagccuccuaaagugcuaggauuauagacgugagccacugcccccagccaagauguacauuuuugauucauaggcauuuaaaauuucaugucauuuaaccuuagcaacuuuucauuugugaucuuuuucuggcauacuucucccacuauauuucugccccuacaccuuuuuucugugacccuuucccacuucuuuuuuuuuuuuuugccuaagauugaaaagcuuuaggagaaaguuuguuuuauuuaaauaauuaauaauuauguuuuuaguuuggaguuccuuauugcccucaccuuucuguacccuacagguuccuaucuuuuucagcaucuuccuccacauuucugaauugugcauaccuuagagcgaucauagcauucuagcagucuagaaaaacaguacugggagaggaaauaaaaugcugcauguauugccauuuauacuggcuuucuauuggauguacuuuucauagaacauaaacguaucuccaaacugaagcuuauuauuucacuaaaaguaagaaugcuguauauccuguacuuuaguuaucacugcuagagguuauuucaaaacuaccauuuucaaaagcagcucauauacuaucucuuuugccuauugcuuuuaaaauuaccauuugacuuauuuuucaggcaaauagaaacugcauagcaaucgcuuccagucaugauguucaagaacuggauguuucuggaauucuggccacacaggucuacacuuggguagaugaugauauagaaguggaaaccaaaggguaccuucauaguuuguuucuauuuaguaauguugcaauaugagugacuauauuuacugaacuaaaacuuucaaaagauucuuuaaagcaauguauagauuguaagcagaguagaagcugaugugcuaaaugagggguggcaagagcuuuaaauaagggaacugagagaagaguaagugaagggaacagaaauuguugagguaugaggucauugugugugaguuacaaauaagagcugaagaaaauuaauuuuaaagggaacuauaaauucaaauuuuagaccuuucaaguguaaaaaagaaagaaaugaugaguuguuuuuauucugguugacauuccuuuauagaucagaagauuucuugguuauacaugcucgugaugauuuaacagcuguucaagguacaacuccauauacacauagcaauccuggcacuccaaucaacaugccauggcuugguaguacacagacuggcagaggagcaucugugguauguaaaguuaaaaauaaauuuaaguuauauguaacuuuuauuuuucccucuagguuaauggauaaaggaugauuuaaaacauuuuucuuaauuccuaaaguuuuaguaagucuuacauguuggaaauuguaaauuuugauaaugaagacuaguauguuuucauuugaaaggguaauaauaaauuguuuuaaaaauauacuuugcuugaaaaccaaagagcuauauuuuaauuaagaauuauuugaaacaugguucagaucaggcuucagcaagguguuccccauagaucaaauauuacccaugaccuguuuuuauauagcuaauaugcuaagaaugguguauacauuuuagugaaaugguuuauacauuguuuuuucaauaguugaaaaaacaaacauaguauuuuuuggcacaugaaaauuacaugaaacuggauuucaguguuuuuuuacaaauaaaguuuuauaggaacacagccagucauuuguuuccauuuugucuguggaugccuucacacuacaguggcagaauugaguaucugcaacagaaaguaaaugcccauaaagccaaaacacuugcuauccaguccuuuauaaaaaaagguuugcuaaccccuugucuagguaucuuuuaauggauaucaauuaauaacuauauccauauuaaguaucacuuuuuuaaaugccaggacaaauauucuuuuuuuuuuuuuaacaaaaacaauauauaauuucuuaaguuaagcaaaaagcaauauaauaaugaacugaaacauaauuuuucuguaguguuggaggaucuuuuuuagcccugauuaccuagagaugugauucauauuuguacuuccaagccuuuauuauuacguagguuauaggaacuaaugaacggauuugaagaagcaaagaaaggugguaggguuuuucagaauuucauaaguacuguagaaugcuuuccuuggccaaaaaaaaaauuauuuuucauuaauuaguaugagcaauuguucaaguaaaaucugaguuaucuuuaauaauaccuuguaauauuuuguaccuaauggaguuccuuuauaguugcuauaaccuuauaauuugcaguaucuguuguaguuguuauuuacucguauuuaaacauucuucagaugaagcuugagauccaaaaaggucaaguggaucaacuuaugucacuuuguuaaauguaugguagagcuuguuuuaaagcccucuguucuccuuaguucagugauuucaaguagcaguguuuuaaggauuaaaaugaacuugaaaagcaaucuaguaauuauucaaaugaaaugacuugcucaguggugguuaaauaauuuuuccagcugacagauauguuacaauucauugguaaaacuuacugauauuauauucuuuuaaaggagaacucaaagggaauauaugccaaagaagugcauaggacuaauaggcacuuuuuugaauuccaaccucagagauuacaauauaguucuuccuguaacaucuuucuuguuggucucuuccuacuucuauucuuuacacagcagcagccaguuacucuuuucuaaaacaucauucagguugucacucgcuuucuaaaaaauuucagauuucccaauacggcuuuuaaauaacaagucauuaauagggcccuacaaaauuuaaccuucugccaucucaucucccuuuauucuacaucugauucucuuugcuguaauuacacuggcuucuuucugucucuugaacuuauuaagcucaugguuaugucaggagcccuugacuuuccuucugcuuaaaaugcucuaucccucuguuguaccauucacaucucaacucaaauccccccacauuucccuggcuucccuaauuaaggcauuugccccuacccacucuacccccagucaccuuauauuuuaucaucuuuauuaucccuugcgcuuaccaguuauugaaauuauucauuacuuaguuguguuuuuuuuuuuuuuuuugagauggagucucgcucuauugcccagucugcagugcaguggugcaauauuggcucacugcaaccuccaccccacagguucaagcaauucuccugccucagccucccuaguagcugggauuacaggcaugcacuaccaugcccggcuaauuuuuguauuuuuaguagagaugggguuuugccauguuggccaggcuggucuugaacuccuggccucaagugaugcacccagcuuggccucccaaaaugcugggaugacaggcaugagccaccgugcccugccuuaaguugucuuuuuuauaugcccuggaaucuaagcucuucgagagcuuggauucugccugccuugcagauugaugauuucuaacuagaaugguauuggacguauaguagguguucagaaaaauguguuuauacuccaaagcauuguaauacagaaaucuaccauaggcauaacacuaaggauugaauuuucuuccuaccuaaaucuuaggacaucuuuuuauuucggauaacugugauuuguuaacaugaggguucggauugccucacucuacccucaacaaaaagacaccaguagaauaagguuguucuuuuuuacauggaucuucuaaaauaaugauuuuacauauuuuacauaugcuuucagaaacuuuuuuaaaccuguguuuguauauuuuuuuuacguaugguucuccugugaauauuaaaaaaagaagacaaaagcaagaauaggaaccuucaggcauuucuuuaauuaagaagaacauggaauuuaaauaugaaguuuacuaaacagaagucauaugcagcagguuuuuauuuuuucuagagaacugauaaaauauuuucuuuauccuuucauuuuaucaaaugauaaaaacuaauagcaaaaaaauaucauuaugaccagcuucugcuauuuuggaguauaacugcaucaauauauguguuucaguuuuauuuaucccucuucuuuucucuggccuagucucuguucucccuaccaacuccccaccuucuccacaacuuuaggcuaauugaaccauuuaaaauccaaaagaauaacaauaacaaaaccuaccugagacugaugcuacaaauuuaagauaacauauauuuguaguuaugaugcuauauaaauuggaaauguucuauaaauuuuuccuuuaauuuuauguguuuguuuuacucuuauuugacaggcuaguuaaauuauucaaagcauaacuuuaaaaugaguaaauacauaguuccaaacuguuuuuaaauuuauuuaauuuucucuucuuuuauuuucacaugcuccugucuuuuaaacuuacacuauucaggauuauuacugaauaauaaauguaaugggaucagaaaagaauugacaagaaaggagggaagacuaaauucuugaaaggaauuuaucuuuagauccuagucaguaaugcccaaaauauaugugcaaauauaagagcugcacuauuaaauuucuguuaucauguuuaguauuuuuagcacccauaaugauaguuaugaacucauguaaaaauaaauaaaugaauguuauuugaauuuccugucacaauuuaaauguuuaauccuuuuuauuaugccuauaaaauaauuuuucuauuuuaccagaugauuaagaaagccauuaauaauguuagaagaaugacuucucauccaacucuuccuuacuguaaguugaauaauaauuagcaauuguccuuucuuauucuuaaaucuauuuuugguaauuuuauuauaagaaaugugugggaaccuuuuuguuuuaauugaaagcauuuauuugacuuuuuuucuagcgaauauuugccaguaaauaaaaucuugauuucaaaacuggguaaaaauagaaaaagauauuucccuaaaagagaaagcugauuuaaugaaguaaauuuuuugacauuuugacuaccaaucaaaauuugcgacuaccaauacacaaaauuuguguauuucuaaguuaacacauuuuaucuuugaacauuucuggauuucuuugaucaugcuaaauuauagugaauaauuauuuuaauaauagaaccacugccaaccuuuauuacauaagccacaaccguaccucaauuauuuauuaccucaucguacucaguuuguauuuuauuacuuuuuuucaguuggucuuuuaugagacacauuaauaguaaacauaggaaauuauuauuaguuuuuauauucuaaggcagaauauauguguuuucaguuaaucuuccuaggaaucuuaaaaguuucucuuccuucaaccaagaacuuaauuaauggggaauuuauuggagguauugauucugguggguuggaaucaauacucauacuggugugugaguauuccaaguuuuuuaauauuuuuuuuuaaguuaugcccuucgucaaauuguccuacuacauaguaacaagaauaaugcauguuaauuaauggguauucaugucccccaguuuaauagccuauuaaaaacuuuagaaacuuuucucuugggagauauucugauaaaaugcaguuaacaaaaucaguauucuuuucugcuucauuuaugauaaaugcucaaauaaucuauuaucaaaguuguguacgcuguacgaaacaaggcucaagagaaccguauauguaaaaugaagagaauaacaucuguuacuuaugcuagagguauaacauaauauaaaaaauuugucuguuuucacuacaucaaauuuauucaucgcuagaaguguguauuuuuuacccacaaguuuaaugucaggugagaacuaaaaagcagucaugaagccuauaguguaaggagucaaaauguguuuuauauauaaaauuuaaauaauauuauucuacaucaggaaauacuugauauugcuuaaaacuacccuauucuaugcagucugguuggaaguuuucugagauacugaagggacuucauuuuucucucagucccauaccauguguccuggcagguguaaauauccuauaccuuaaucccauaaacuuaaagaggccacgcucaaagcuucaaagguaauugauggaccuauugucagagguguuagguagcaucaauuacugcugucuugagagauaaauccuuucucuguuuagagaacugccaaaacuagcagauaagacaccugaaaaauuaaaagcuaauuacuggauuuuuuuuccaguauaucuuuucaugucacaaacaagucccacagguaguaauuuaguuugauaacaaacacuuuucguguugugaaaauguuaugagacaggauuuuuaaaaauauuagucugaaguucagauaccucaagauagcuguuuucuuuccuuggaauagaucuuuugaaaaauucuuaaagaacuuuuuagaaguuagccuaguacauuuuauaauuuucugaguagaaaacacacuguuucucuaugcugucauguacaguucugauaccagauguguuggcuuuuguccacuccaagccauucuccaccucuccaaguacuggcugggugccuuauaauuugguuuaauuaugacacagucuaccuggaguuagaaucauauccuacagguuaagggcucagucccacaaaacugcuccuuacuucagacaccacucgcagguuaucaguuuucaccuacacaucuggcauacuggcuauaaaucagagugcccacagcucccuccuuggguuugauuaauuuguuacacugauucacagaacucagggaaaaugcuuuacuuacauuuaucaguuuauuauaaaagaaacagaugaaaaguacauagaaugaggucuguaagacuccuaagcagaggagcuucucuccccuuggaguuagggugcacuacaaaccuggcacauggauguguucaccagccaagaagcucaucagaucuccuuguucaagaguuuuuauagaacuuaaucuccagcucccuuucccacccuuuucuggagguuggcgaguggaacugaaaguuucaaugcuuuaggcuaucugugggaccccaucuaagacacugcauuagcauaaauucaggugcucuuccauggguuuuaguagcuguaugccaggauccagggacaaagaccaaauauguauuuuaugucacacugggucauuuuuuuucccuucuaaaauguuuaauguguuuucccuguuuaauuuuuuuccccuucuaaaauguuuaauguguuuucccuuuuuaauaaguauuuguugaaaucauacacuugauagguucuauauaagccuagcugaguaaaagugaagucugcucugcuggaacauuaauaaggaaucucagauaagauuuuuaaaaaccucuugaggcucagaagucaagccaaggacuugccaucugauuucaccugcaguccuauagauuuggguugauugcucuuuucuugagguccucagaaaauccugggguuccuuugucugccaggaagugauagucuuuacucuucuguaaggcaaccauguaagggacuauauauguacaguaccaggccaguuuuucuguuuuuugguuuuuuuucaagguaucuuauuugcucugucagccuuugguuccuuaaagcugucugggugauaucugauucugugcauagucuccaauaugauauaugagucaaagccuugguaauacgaccgauguuuccaauuauguccugcuauaagaaggacagguucuuuuugcuuuuacuccuggcaagcuguaaagaacagauucuuacugaacuuaugcaaauaacuauauugccaugaaaauaagaauacucacuaauagcuuccaaauucuggagggaucagguagagagaaaaaguaauuguuuuaucuuuguucacgaaggcauacuuugccaaauuuccauaaacuacugaauagcuuaagagaaaagaaaaaaguuuucuuaaaucuggaaaacaaaauaaagaccuagcaauguuucaaaaccauaauuauuaaaaaaccauagauuuucuucaauaaguuauucagccucucauacuuaauucuuguucgacuugaucuugguuagcaguuuaaugaauuuauaaguuuuuucccuuagaguucuggaaguucuuacacuguccaaugauaggaucuaaauguuaucagaaaccaguaccuuucagagucuuuucuaugaaucuccuugaagacagagcacuuuaggauuauaguuacuugcagacacuuucagugaagaucaggagaaacaauaaccaucugucagugacaaaagacuuaacauggccaugacuaaagaucaauucauuaucauaaugcacaauugacaaguaaauuugauugcuucuguggcauacaauauuuuaacaaaauaacugaaaguauggcugauaacauuauacaaggacacaucagauuuuuagaaccuucaugcaauuucuggaauacuuaucuaauaguauauacccauacaaauauaauauaagaagguaucaccguuauuugacaaugcuucccaugcaauuuaacauaucaauuaagccuaauuauuuuaacauucuucuuuuuagagggagugagaacaaauuuuuuuugagauauugcaagggcccuuuggaaacucgcaaaguuagagugaggucaaaaguacuucauuuauaauguauuuuugggaaauuugucaaaaauaucaaacaguuuaaaacacuugauuauaguaagguuacuguggaaaaauauuuaaccagagugauaauuaaaagacaucaaaggcaaauacagaaaguuauguuguuguagaaaaauccuuagcuauuuuaauguuguaggaaaaaaaccuuagauauuuuaauauugaaauauagcuaauuuaauaauaauguuaauauuaacauuaggucuuagguaaucaaagaccuaaaaagacaugaagcacaggaaauuaucuugauaaaacaaaaucucggcugggcgcggugacucaugucuguaaucccaccucuuagggaggcagagguguggggauagcuugagcccaggaguucaagaccugccugggcaauauagggagaccccauucuccacaauaaaggaaaaaaaaaaaagacaaaaaaacaaaaucucgauuuuguagucagauugcuuaaaagguaaaaauaauaauauuaacauuaggucuagguaaucaaagaccuaaaaagacaugaagcacaggaaauuaucuugauaaaacaaaaucucgauuuuguggucagauugcuuaaaagguaaaggaaaaccuuucauaaucucuugucaagagaaaaccaauacuccaguaaaacuuugcaccaauguacuucugauauuaaggcucaucauucuuuuaauaacauauauaaauacacacauauuagccagcuuggccacacauaaaauuauuuuuccaaauuccucuuacacaaacccuguauagcauucucguauccaugcauauuuuguucuguacucuuccucuuucccaauauggaacagucugcuuuaggacaaaaauuauucuuuuucccauaagaaaaacauccuucauaccucauagcuucacauuccaaaaacaucuuacuuuccugacauacaaaauuauuuaucuauuuucaguaguuuuaauuacauauauugauuagaauucuuaacuguuaguaauguuaguuucuagugaaaacuagguaauaagcaguugugcacugucagucacaccagcauucuauagaguagcaaaucuauaucuuucauaauuuacagaagcauguucuuuuucauaguauaguuuuucagugugucacaggacaccuuuacuaacagacccaaauaucuuuauucuucugcaauaagaagccaaaaguagauaagcuuauguuuagcaauuaauguuuuaguauuuuauguaauuuggaagugaucuagauauucaauuaauauccaucauuuaauuuaacuuaaugaaauacuaaggguauaaguugucaaagggauuuggaaaacuguuuugaaguagacauaacaccagacaaggccagccaucaaguuagucauuauuuauuuuuugcugacaaauuuuguaacaaagauaacaugaguguauuugacuaguaagccuaaguaaaauaaaaguuguauaucacauuauauuuagugcugguaacucuuaaggauaugccugcuuuaauuaaaccaacaaacuuaaauuugcuuucauuuaccaaagauuaucccacaucagaugaacuugaaaaacauuugggucuguuucuaucuuucuaaaaguuuaaggaauacuuaauuuauauaagugcuuauuuuaagugcguuagauauaauuauuaaaaauuaauuuugacaauaccaucuggugauagaaaaauauuacauauauuuaacauauauaaagucauacacaaacauacaggcagaagcagauucuauaguuuuccuucuaaauuuuggcgaucugccagauacaaaauaucaaacucagucguuuauaaaaaggauaucugggccgggcacaguggcucacgccuguaaucccagcacuuugggaggccaaggcgggcagaucacaagguaaggagauugauaccaaccuggcuaacaugguaaaaccccaccucuacuaaaaauacaaaaaauuagcugggcgugguggcacacgccuguagucccaucuacucaggaggcugaggcaggagaaucacuugaacccaggagguggagguuacagugagccgagaucacacgauugcacuccagccugggcaacagaacaagacuccgucucaaaauaaauaaauaaauaaauaaauaggauaucuggauccaaauuguguuucugaaaaugggacaagauuacccacccagauugcuaaaacuuuacuauuauuuguugaagacuuuuaagauuucucauuugucuuuuguaaagacucuuuuagagagacaauuuacaguucauuuagucuucuaguagccucugcauaccaaucaaaaaaugccucccacuguuugugaagcauuagagauucccuuuuauuuagugcuuccuguagauggacaauuuuguguaaauuaaaaacuucccuguuguggccaccauaauucuaaauugucuuugguaaauauacucauuucucuaggaaagcacagguucuggguccauaauguuuaugcauaaaauuagcuggaguuccaguuggaggaguuuuugaauuccuuaaauucagaugaacccaugauuucuuguccuuccaaaaucuuaucuaccugaggccucugacuggacccaauccagucagguucagucugacuucuagaccugaucugaaugaaaaaugcuuaaaggauaaaaguugcagguuucaggucaagcgguaaccuucaaaugcacagugagaaacaguaggcacaaggggccuaccaggagguaacugugccugguuacuuguugcuccuggaggucaucaucaggggaucuccuucauguuccucugcugagaacucuuaaaacauagguacauuaaaaauuuaaugaguuuauuuuagcuuucagcucaaauucaugaacugggcaacaccagaccagaagccauuaaggcuucaccgagguggcaugaggggaaaacuuuuauaagguguucaaggaagcacaacaaagacaguauuugauugguuaaguggaaaguccucaguuagaaguuaguuggggguuucuaauugauaagcaucuaguuagaaguuaguuggugguuucugauugauuaagcuuaagcuucauuuuacuguuuacauugaauugaguuuugauuugcucguauaggcaugcaaggcccuggagcugucuuagccuaauagccucccaauuaauuucuuuuuuuuaagauuuuuuuaagagacagggucucauuauguugcccaggcaggaguuuuauggcuacuuacagcacaaucaaggcacacuacagcuuugaacuccugggcucaagugauucuucugccucagucuccugaguagcuaguacuauaggugugugccaccaaacccagcucuuaauuuuuuaacguuauaaauaauaauagaaaaguugagcgauuuuagugcaaccaccccaauuuauuuuucugauuaagcuaugcaagcgcauugggggaaagggaguagagccagucaaauaccuagucucaaaaaacucuaccuccuaccgcugcccaaugguaaaagcuuucaaaccaauugaaguucauuuauuuuaaauauuugauaaggaaugagggaaacuugacugauaugugacuagcaagugcuagauguuuuauauaaauguauuuuuuuuacuaccuccauaccacauuaauauugauaaugauacucuauaaauugaguguuauauguuaggcauauuucugggugccuuauauaugugaucucauuuucuacucacaacuguccagugacuuauauaucauuagucccuuuuuacaggaaggaaauggucucagagagauuaaguaaauuuccuaguauaacacaaauaauaaauggcaaagcgaagaaucaauagucauuuaucuuauucauauuucucaguaaaacaaguccggugcaguggcacgugccuauaaaucccagccucuuagaggcugaaguggaaggaucacuugaggccaagaguuaaagaccagccuuggcaacacugcaagacccugucucuaaaaaaaaaaaaaauuaacuacaaaauuacaaaaaaaacagauaacauauauuugagauauuaggccaaucaggauaacuuuuagaacugauuuuuuucuuuagcaugacauuuaaaaccuucuuuaaucugauuuuuuucaaagaaaaauguguauacauuuacacauuaauaguauaauaaggauugauucuaaccuaagaauuucuuauaaugaguaauauauaauuuauuauaaaaaauaaaaggcuguuaagacaucauugagauaacuuuaaagggaaauaaaauuuauggagcuaugauuuaaaugcuccuaucguauuugaggauguguucuuagucaaaugaaaguguauuguauaacuauuuuuaugaugaauaguauucaacugaaauuucauacaaagguaaauuuauauaaguugauuuagauguuucuuucauaaagauuuucacauaggauaaagaaauaacuuuucccaaagauucuugaaauaaaucugcaauuuuugcccucuuguaaugcagaucugacaggagcucaagauggaagugucagaauguuugaauggggccauucucaacaaauaaccuguuuucgaucugguggcaauucaagaguuacaagaaugagauuuaacuaucagggaaauaagguauuauauaaaaauguaaaugguaaaaaauuuauuguguuggagguuuauaaauuccacuaguuuggguuucugaaaagaacagcuccguggguaguaguaaaguauugaucuauauagaugcuuuuaaauucuucucaaagaacacuuaacuucacuuguucuuccuagaaguauguuauauagguguccauuaaaacucaguuaagugauucuuaaugaccaaacgauuauaaguucaccuuauauuacacacuuuuuauuauuaaaugcuccuacucucuuuaucccucggaaccuacucagugugugauccagcagcaaguaacaucuagagcuuauuauaaaugcauauuauuguuccuucuccagaugugcugaaucaccaucugcauuuuaacccgauauuguugugauuuuuacaaauauuaaaguuuuuuaagagguacugcuccagaacaacaucagcaaacuacauccuagccaccugcuuuauaaauaaaguuuuguuggaccacaguuacccccauucauuauuuuucuuuggcuacuuccuacuacagcagcauaguucaggaggacaaagaccuuauagcuggcaaaauaaaauauuuauuauguggccaccuaagaaaaaguuugccagaccugcucuagagcauccuuuacugucuucacuucucauaauccuuuguucaaacugccccccuccccacuuuuauguuagacagcaaucuuuuauugaacaguacugcuccuugugaagcagggcuaguucagaggcagugcacccacagccagcccaaacugccucuuuuugcuccuaauauguuauuagcccuuuacaaaauaauuaaagaguaaaucagucuucuuuuugucuucagggccaugcugcaccaaaaauuacucucacagacucuaacugaugguucaccuugccuuuucuuuccccucagccucccucacacauuaaauucuccucacacauuccuuuuaucauugugugcugcaaccuuuuuugucuaccauguuuaucacauggcucuauuuucauuucacaaaaguaguuuuauguaguugugaaacaaaauuuugagagcuuguuucuuaauacuaauuagcaacauucuuagcuccuuagugggaaauuaagggaacuuaguacagaugccuguauaauucuauuguacuuuuaguuguauucucuaucaaugugcuuuuugugcauuucaacuuggguugucaguuuuauauugcuccuaacuaaucucuauaccugaacccuuaucucucuaaugcaucuugccaacaguauuauauaacaaaaaacauagcuacaugauuacaauauaggugagaucacauuauuauuuuuuucaagaacccuucaaggcuccucaugucaacuucuuuaacaaguauuuaagaccuucuauaaugugacuauuuuucagcuuuaacacucacuacagccuucugcauaggcuauuuuaaggcacaaaaaacugcuugucuuugccugcacaaguaucuuugaccggcagucaacuuacuauucauucaccuuagccuugacgaagucuaauagcacagccccuaagcaugcuaucucuucuaguagggaagccucuuaagguaaauggaagagauaacucacacuguaucacaguaauucugaugaauuggauauucaauuaugaauagaaauacagugccaaaagccagugaauauuucagaaaaacuaagugucuggaaagggguauuaagcagaauaaauaauaaauaaccuaugaggacuaauuccucagagauucaagaauauauuacauuuauacaacaagaacaugcuagcauuaaacaaggacaguaggaaaacagaaaagaguuauuggaaauuaaaaauacgauucccaaaaauguggucagugggggaacuacuuauuagaaaagcugaacagcagaauggaaauaguugaaaaucagguuuguugcugggaagcacaaauuaagaaacuaucccauaaugaugauaauuuaggaaauauuucagaagaaaaaaauggaggaaaaacaauauucaaaggaauaauagauacuuccccaaagcaaagaauagaauauuggaagagaaagggccuaccaaguauugagaagcaacacguaccugcacacauccuguuuguguaacuuuugguuuuuagaguuaaagagagaauccuauaagguucuaaaaaggagugagaaugaaaaagguuauuuacaacccacaucccacccugccacuaaaugucguuggccugucacaaauagauaggagaacaauauccacagaauucugauggacaaggaaugggaacugagucgaugugcauccaaacuaucauucaaauuugcuagcaaaauaaacauauuuuuagguauacagagacuuaacacauuccauguguauacccuuucugaagaacauaccuagaucuacuccagaaaauguaagauaaacuagaaaaaggaauagaccugggaaaauauuauuaacaaauauaaaaacaguagguuaauauucauaauauuagucauaucaguuaaauuuuuuaaaagacaaauaguagagaaauagauaaaacaucuuaacaguuuaccaagaaacuuugccuggccaguagccuucuaccuucacuaauaauugaagaagugcaaauaaauugagacuuauucuugucugcauaaaauuaacaaguauuuuagauuuuaaaaauaccccauguuaacuaaaguguaagaaaaauggcuguaucaauuuauauuaccacauaggauuuaauuuuggcauagucuauuaauuuuaagugaugcucuuuaacaaaacuuucccauuucuagaugucuauccuacauaauuaugcaaagguauauguauauauaggaauguucaaagcagcccuuuuuauauuacagaaaauugaaaacgguauggggaaaguuuuaaauuguaauaccacuguacaguguaauacuacacacagcacaagaaugaucuaaauuuauguguaauuaccugggaaagauagcuauaauaaauaaaaaauguaauuguguagugguauuauuaugaucccaauuuuuuaaaugcuauauugugaauuuuugaauacucauagaaacaaaucugaaaggaagcacaucaaauuguuaauagauguuagaucuagaggcagaggagggugggaguacaaagcagacauuuauuuuauauacuuuauaauaagcugcguuauuuuuauaaucaaagggaaaaaauuuagcugucuuacucauccuucaagaucuguaucaagaauaccucccuuaguggauuauuuugacaucuuaccagucagacuugcccugagcucccauagcggaauuauuuuacuuugauaauccuuauaucauuuuacuuuguacucuuguucauguguuuuccuuauuguuuguuucugaaaauccuuauuuuaucuuucuggaaaugaacaguuuucuuucuuauauaugauaaaguucugucacauagcauaaucuguuaauccaguauccuguuuuuguaauacuuacagagaauauauagacuaugcuagaggcuacuguaauaaaaugggugucugauguuuguucucuuuauguucacccugggauuuuuaaaguaguagcugaauguuuuucugaaauagauccauguauaggugaagugaaaaaucacaugacauacagucaaauguuuacgagucaaaauaugggugucacacugaggguaaggauaaauauaugcuuuuauauuuauauuaaauacuuuuaaauauuuucuuucucuaaguuuggaauaguugaugcugauggauauuuaaguuuguaucaaacaaacuggaaauguuguccaguuacuggaagcaugccuaagccauaccugguaagccaagaauuucuaccuuuaaauaaaauuugaauuuucauuuuaaauaaaccaagaauacguauuugagacaagaaauauagaacuaauaaauaaaauauaguccuguguucucagucacuuugcuguaagauucuguccuuguguuaugugaaaauuacucugugaagcauaaaauuccuuagucucugauaauuugggaaguugacauguauagaagcaacaugauacccccagauaccuauacaucuuguggauuacuagagcccuuuucuaaccucacuaaacugguuauuauauuaugccuaaauagaaugauuaccagaccaaugcgucugguuauuuuucugcaauuaucucuuaugaacaaacaaagugaaaaggacauccuauagcugguacuguuauuuucuuguucaucucuuuuaauuuaggauuaugcaggcuuuuaugaacuuucuguggcuucauagaauacugaauuuauauuucauaucuucagugaagcucuuuauaggacuaagcaauuccuaucagaaaaaaaguuaagaauauagguuaagauucugguaauuugcccaagguuaauugcuagaauacaguacugaucuaaguaaaagcaagcaagcaugggaggauugauuaggguaccuugaaagaauauuaacuguuucucauauuuuuauuaagcuuaaagauuuagauguauaaguuuguucucuaagggacuguuuuuuuuaacuuuuaaaaaaaugaauugguuuaaauuaugaauaacuggcuuuuggagauuaagaggauuuugucuguuuuaaggacacaucaucuagcccagcuccaguaguguuccaggggaaauggggaguuggcucaaaggaauaaucuuugguguggugauuuugggauacuuaaaaaaaaucauuuuuuauuaaagagaaauauguaaaacauaauuuugaagcuuuuauaaaugaagaaaccucauaauuaaguguacuguuugguagaauauugaaaaaugcuauauguuuucuaauuuugaugacuauuaguaauuuuuuucauguacuugaauuuuuaaaagcuuaaauauuuuugaaaaauauaugucaauuauuuaacaaaagucugguaucaucuaaaauucuaguuucuaucuucugaaacagaaauuuucacuaugcuaggagaaggucuuuaaguuuaaccucauguuuuccuuugaacuuuugguugaacaaaagcaaagagauucauaacgggucaugauauaugcagccuacuuaaauaguucaggaaaaguguguguaugcgugggugucuacaaauaugaaagagaaguagaggcaaaacaaaugugccaaaauguuaaaaaguugcugcaucuggguaaaagguauaugaaaguucucuguauuacuuuuacaauuuuucuaaaguucaaaggaaaaaaacgauacagaggauuuaagaaagccagaaacuacaugaucacuuuucgaagaauacauuuaccugguuaugacauuuuuagugagaggaguaacacguauuguuuguaaccauuccagacuuggcagugucauaacaaaacagccaaugauuuugucuucguuaguuccuccucucugauagcuacagcuggucuuucaacugacaauagguaagagaugauagcuaaaauugaaguaugagaaaguauagcugaacuuuuuuuuauuguuucuguccuuguguuugacuaaaguuuacuuauggcuuuagauacaguauuuuuauucuaaaaacuauuauuuauuggccauguuauuccagccccacccccaaaagcugugguuguaagaaagugucaucuccugccccaguaucugucugccucuuuugauuucuguuauauaacugaguucugagaucaaggcccacugaguuugcuuagcuuauauauuuaucuguaaggccacacuuugcacuagaaacaggauuguaagacuauagauucuucagcucgucuuccguagauauuucuuacguauguugguccccccacacaguagaaacaaguuuucuuugugcuuaagaaaauucagcaucucuccuguuaauguaugucaguccaacuguuagagauucagugaauacaaaaagaaguuuccauauucagacuucauauauuauuauuuguaaacgcauguuaaucuaaaguuauucaaauuuuuaagcuauaauaguagcuuuaaauuuucuguaaaaauugugggucgggcacaguggcucaugcuuguaaucccagcacuuugggaggccgaggugggcggaucacuugaggccaggaguuugaguccagccugggcaacauggugaaacccuaucucuacuaaaaauacaaaaaauuagccaggcgugguggcaggugccuguaaucccagcuacucugggggcugaggcaggagaaucgcuugaaccugggaggcagagguugcagugagccaagaucacaccauugcacuccagccuaggcaacaagaguguaaaacuccaucucaaaaaaaaaaaaaaacaaaaaauuguagccagagcauguuggcucaugccuguaaucccagugccuuggcaggcugaggcaggaggaucauuucagcccaggaauuugagaccagccugggcaacauagggagacuccaucucuacaaaaaaaaauuuaaaaaauuagccagacaugguggcacacaucuguagucccagcuacucgggacauugaggugggaagauugcuugagcccagaaggucgaggcugcagugagccaagauuccaccacugcauucuuuuuuuuauauaaaaauuaguuucauauaaauuuguugguuacuuguauuuguugcuuuuauaaauuuaagaaccuucugugacagcaagguuuaaaggucacacaguuauauaugacauauuuuuuauuguuagcuuuugugucacucagaaguaaucuuuuuuuuuuuuuccagaaacguauguuugugggauacucuuguagcaccugccaauaguuuaguccaugguaaguuuucaaagcauuuuauaaauuuugaaagucaggaaauucauaagcuaaauauuauuuauaaguggauuuguuacugaugacacauauauuuauuaacccaugagauuucuuuugcccaggauggcaggauuugaaagcaaaaagaugcaauauacguaauuaacucuucacuauaccuugaugggggacagugagacaucgauaauauaaaaaucauuugucuuuacuuugaaucugauagccacagguuaucguuguaaacaugauguaaacucaauauuauguccccucuuaccacuccuauucaacauugcacuggaauuccuagcuaaugcaguaacacaauaauaggaaauaaaauguauauaaauggaagggaagaaauaaaacugucuuuauucacagaaaacauaauuuucuauaaaauaucccaaagaaucuacaaaauaaauucacaaguauagcaaggucccaggauacaaggucaauauacaguugacccuugaacaacauaaggauugggaugcugaccccugcacagaugaaaaucauaauuuuuuauuccccccagaauuuaacuacuaauagccuaguguuuacuggauaccuuauuauuaauauagucaauuaacacauauuuuguauauguguuuuauaggaagcuagaaaaaagaaaauguuaugaaaaucaugaguacauacaguaguguacuguauuuauugauauuguaaaguuuaugucaucuguuuacaagaugaauuuucugucugaggccgggcgcaguggcucaugccuguaaucccagcacuuugggaggccaaggcggguggaucacgaggucaggagaucuagacaauccuggcuaacacggugaaaccccaucucuacuuaaaauaccaaaaaaaaauuagccaggcguugugguggaugccuguaguccuagcuacuugggaggcugaggcaggagaauggugugaacccgggaggcggagcuugcagugagcugagauggagccacugcucuccagccugggcgacagagcaagacuccgucucaaaaaaaaaaaaaaaaaaaagaugaauuaucugucugaaauggcaggcaacuacagcugcagaccucaauuuguggugcauaucaagcaauucaacuuuuuucuuguaaugucuugacuuuggucugcuuuuugggagcacuuccagcauuacuaguggcauguuguaugguucccaugguguuauucaagguuuacacuguugcacuaaauacaaugaaaaauucacaagugccacaggagaucacuuuucacugcaauauacaguuuacuggagagaagaccugcucacauggagaugaugagcaucacacagcauuuuaaguauauacucgcaacacuugagcuaacugcaauagcaacaggagguggcuacuaaauuauaacaguaguacaguauguacuauaauuaauuuuauguacuuaugauuucauacuguauuuuuguuuacauuucucgacugucgauggcaccacuuacaaucuguauuugugugcguauguuucaauaaauuuaacuuuuuguaauuuguguauauuuuaugguaguaaaugauaaaauagacuaguaucuacauauguuuuaugcauucauggcauacuuuuucuuaauuuuuuggauauuucuuggcuauguggguugucugcaaguuuuuucaaauuaucucaaaucuuuaaaaaauguuccaauauaucuauugaauaaaccacaucuaaguggacccacacauuucaaaccaguguuguugaagggucagcuguacuaaauucaguugcuuuuugaugcaucaacaaugaacaauugcaauuugaaauuuaaagaauauuaccauuuacaauagcacccaaaacaaugaaauacugagacauaaaucuaacaaaauauguacaggguguguaugcacaaaacuauaaaaaugauuuaaaucaaagaagaucuaaauaaaugagugauacuccacauucacagauuagaagacacaauauucuuaagaugucaguucgucuugauuuuauagauucaacacaauccuaaucaaaauuccagcaugcuacuuugcagauaucaacaaacugauucugaaguuuauaugggaaagcaaaggaauagccaaccaaauacuagagaaaaacacacuugugggacucacauuauacuaucugauuucaacacuuauaagcuacaguaaucaagacauugugguauuagcuuaagaauauacauauagaucauagaacagaauggggagcccacuaauagacucacauauauaguagacuuauguuuaauaugucacagaggcaauucaguggagaaacgauagucuuuucaacaaauaaugccagaacaauuuaaugucaacauauaaaaaauugaacccagauacagaccucaccuuucauaaaaauuaacucaaaauggaccauaaaccugcauguaauaugcaaaauaauagaacuucuggaaugaacuaauuggauagaagucagaauagugauugcuuuuguuggggaggagaauugaccaugaaggggcaugaaggaacguucugggaugaugaaaauauucuguaccuugaucuuagugaugguuacacagauguauucauuugucagugcucaucaagguauauacuuaaaaagugugcauuuuccucugggaaguuauaucucaaagugcuggucaaaguuccuucucuguaauuaauuuuauuucaagucuuacaauaauaacuaaguguuuaguuuaugccauggacuauacaugaucugcauauauuaaauccucaggcaacccuauuagguaggugauaaucucuuuuacaaaugaugaaacugagacuuagguaaguaauucagcagaaguacacauuuaaucccacacagaaaccaggauugaaacccaggcaaucuaacuccagaauccucacuguucauuaugcaauauucuccuugagcuauaugcagauuuuuuucccuaaaauuuguuaggcuggacucuuuuuuaaagaaaaauaguaucauauuuuuauauuucucauacugcugugucuucaaauucaugaaucuuuuauuuuacaaggcuuaaucugcuguuaaucccauccaguuccuuuuuuaucuugagccuugcuguuuuuaaucuguuaaauuuugauuuaggccuuucaugccucuaauuaacuuaaaauuauaauggacuuuuaauuuccuuaccuacuaauucugucaucucuauuauuucuggguuaguuucaauugauggauuuuucuucuccuuauggguuauauuuucugcuuuaucacauuccuguuaauuuauuauuagauggcaagcauugugaauuuuacuucauuaagugccuauuauuuuuguauucuguaaauguucuugagcuuugcucagggacaacuuacuuggaaacaguugaaucugggggaccuugguuaaacaggaccaaagcagcauuuggucuagggcugauuuuccuccgcuacugagucaaaugcuucugaguacuccaccgaggcugguacggaaccaguucaaccaggguuccucuccuggugccauggucaggaaacucuaaguaguaagcuagggcaguuuuaugacucacccaguuuguuucccaucucucagagaucauucuucauuaccuuauauccagugucugaaaucauugguuuuuauauuucauuugauuuuuuaauuguuucaggcaggauugcaaaucuggucuauuauuucacuuuagccaaaagccagaagucuauuucuuuuauuguuaaguguuuuuguuuuuuuuuuaauuuacuuucagcauuuaccugccaugacaguggagccacaguuuuagcauaugcuccaaaacaucagcuacuaauaucagguggcagaaaagguuuuacauauguauuugaccuuugucaacgacaacagaggcagcuuuuccagagccaugauucuccuguuaaagccguugcuguugauccaacugaagaguacuuuguuacaggaucugccgaaggcaauauaaagguaaacacaguugaugccacaacaucuacaaaaugaaaucuucagaaaccuuagcucuuuaaucguauugaugacaucaaucuauuuaaauaauaguuauauuaauuccuuuguagucagcagugcuaauugcuauuuaaucuuucaaugaauggaauauuuaacuugaaaauuuucuauuuuucaguuguuugaaaauauguuuaauucauacuaaaacaccaaauuuuccaugaauauaaacauaauucagauauuagaauuugucuugacuccauguucagaguuacauaauuuacugaauuuaauuuccaggggcugagaaauguauugauauuuucuuuuaucccacauugcucgccaguuuuucauauauauuauuaucuagucccucagugccuaauucaagaauucuggauaaaccuugccuuuagcaguccuuuucagaguccauuguguugaaaacuuaagacagguuuuuucaaauguuaagcagcuuguuaaaaauguuaaacagcuuauuaaauaugcaaauugcugggucucacuccagaaauacucaguugauaaguaaguccaagacucagggaucugcauuuuaauaacacaccuaguaauuuuaauggagggucuuuuggcccuguuugguaauugguaaaucaguuuagacuaaucccuauguuauuuuaauggucagcaacccuagacuagggggguuuaguuucaucgaauuuauuaauuuaagcacuuacacuuauuuaguagaaucagauggguuuuuuaaaaccagcaaauuguuuucauaauucucaaccaggaaaagacuagaauuauggaauuuuuaaaagccuuuuucuuaaaaucaaauauauauauaccaacagaauuauuuuccuucaguuugaaacuacuuucuuauuuggacugacucucuaguuuagaauaugccauaguuaagucgguucuuuuuuuuuuuuuuuuugagacggagucuuacucugucgccaggcuggagcacaguggcacgaucucggcucacugcaaccuccaccucccggguucaagcgauuucccugcuucagcuuccagaguagcugggacuacaggcgugcgccacuacacccugcuaauuuuuuguguuuuaguagagaugggguuucgccauguuggccaggauggucucgaucuccugaccuugugauccgccugccugccucugccucccaaagugcugggauuacaguugugagccaccgcaccuggccuagauugguucuuuaguuuguacuuugauccugugguuuauuguuuaaucaagguuaaaaaaaaaaaagaguugaaaauauacaauguauucagaagcccuaauuuaacaaauucauaugcaggguaguaugaauuaaugaauuucuuagaguaaagaaacguuuagaaaaaugaucuccaauaaaaccaggaaauaaguagguuucgcuaaaccuaaaauacauguccugaaagcauuuacguucuucccauaaguaaagaugcguauaauuugcuuuacaggcacauuuauuuugauaagggcuggaaauacaaaaucuuaguaaauuaaguauccugaaauuguaauaauugacuuugucuuauaguuaaaauauagcuuugccuggucagagggccucuaggugucaaguacuucccucuuucuagcuguucugaucccuggugagcauucaauaauguaaagaagagauuaccuuacuguacaccuauacggcaaaagcucugcugagagauaggaaacguugauuuuaaucccuacaguauuguaaguuucuguagcauuguacacuuaaccuccuuguuaccuacauuguuucucuuacucucuuacuagauggauuuuuaaguauuuuguguuaaagcaauugguagauuacaacacucuauacagaaucaagguguuaugauccuaggccuacacagauuuuucucuauuuuuguuuuggaaauuccuuacugcacaggaaugcaggccuaaaauuuuuauuugguuucuuuucuuuuccuuuuuuuuuuuuuuuuuuuugagauggaguuucacucuuguugcccaggcuggagcgcaauggugugaucuugggucacuacaaacuccaccucccgggucgaagcaguucuccugccccagccuccugaguagcugggauuacaggcaugugccaccucgccgggcuaguuuuguauuuuuaguagagaugggguuucuccuuguuggucaggcuggucuugaacuccuuaccuuagguggucugccugccuugaccucccaaagugcugggauuacaggcaugagccaccgcaccuggccucauuugauuucuuaaggucaucaucaacccuaauuuuccguuuguucuuaauaucuuucagauuuggagucucucuaccuuuggucuucuccauacuuuugucagugaacaugcucggcaguccauuuuuagaaauauuggaacuggagugaugcaaauugagacagggccugcaaaucacauuuucuccuguggagcugauggaacaaugaaaaugagaauacugccagaucaguuuagcccuuuaaaugaaguguugaaaaaugaugugaaauuuaugcuauaacauuuuuacaauaagauguacaauuuauuaccuauauggaaguggccaacagauauaauauacagugaucauucucuaugccacaaauuagcuaaugcuuucuuguuuuuauauuuauuuuauggagcuuugcccuugaugcacugaugccuuaaaaauuaacaaggucauucagaaguagauuacauugccuaaaguagaauguguaaguaaugcuguaauaauacauaucauaguauauuauaaucaguaugucauaguguuaaagguguuuuguuuucuuauugauacuuuuccacaggcaucucugcaugaauuucuuccacaguaaaaauacguuuuuuguaaaggcaauuguacauaauacucaucacuuaauucaccacacucucacuuccuuuauuagccuuauacaucucaaacucuucucuuaauuaaugauagguauuugaguaagaaugaaaaaaauaaugaacaucuucauuaaaauugucauugagacgucagugauaaaugagcuagauggcucaauauguaagguuuucaguaguuuacccuccggaacccaaguuguauguauguauacguguguguguguguguguguguguaucuuacacaucuuauuugaacuuaguuguauauauuagcgaaaacugguuuuucauguguuuuugugccauaacaacuauugccaccagaauaacuuuuuuuuugcaacugugcuuuucauuuuuaaaaaauuuuugaauucccauccuaauuuucaaauaaguuucaaggagacuaucaggauuauuauuuuaaagauuagauuuagucaaauaagucuuagcaggcaauaaaguuucugugguggcauauaucauguaagacacuuaaaguaaguuugugaauuugucaacuuucgagcaucaaacaaauauuuuacuuaaauuuuauuuuaucuuauuuuuaggugcuuuuaaucucaaaauucugaaaagcgaauagcaguguuuucagaaacaaaugugaaagcagucaaauuaaguagauacuauuuagaaauguaaaauacucuccagaucuaccauuaauagaaaauaaacuaaaccuuauauuuuauuuuugccaaaauauuuuauuauaaaauaugaccaaaauauuuaaaaugcacaaugcuuuuaacuuaaaugugcuaacccuguuucugucuguuuugugcuguaccuuuucugauucagaauuauagaaaacuugauaaauacuugauuuuaaccaaugagacuacaggcagaugggacuaaguguuuaugggacaauuauguacuauuuaacuuaaauauauuuuguuuaauaggaaauauauaauaauagcauuuuauguaauaaaauaugggcaacgauuaucuuggaaauuaaagagucaaagcaaagaaaugaagggcugguaaaaugaauuuuguaauauccucaggauacuuuuaucuuaaaaguauguuguuaaagauuuuguaaauuguauuucaacaauuuuaaauguguugagcaaguugcagugcaaacacugucauuauguagagaguuuauaugcacauaauaaccuguaccuauaaaucgugcaauaaccauaugcgacuauuuugccauggagaaaucugacagcauugcaaacaauaguauuguuugauguaguuaaccuuaaguuauuuuucaguaauuucuucacaaaucaagauucaaacagcuuuaaacacuuccaaugagauaaaauauuuacuauuaugcuuauuagaacaaaagguguuuaaggaugaacuaaauauuuuaauugagcauuuauauggauaaucauacauuauguaagcccauauguauuuacauccagagucauaauauuuuaaauaaacaaucaugcagaaacuuuuuuaggggguauacuauuguuuuaauaucguugccaauuuagcugacuuaaaauaugugacauuuuaaaaucaagaauuuccauauuuguauuugguuaauguaaggaggauggaauaacuuucccgaauacccuguucuuuucuaccgucuuuuuaaguugauagguaagcagcauucaaggaaggugggaauaaaaauuguugaaauguuuaaauauaaaaugauauacauauauguaaaauuucauuauccacauuaauggaguggauacaucaaaauacauuuuuuaauuguguguuuccuaagaauguggcuuugugaucauauaaggauucacaacauuaacaaaucuuauuuucugauaucuaggauuuuucuuaacuaaaaccauggaccagucaucuccauccuccuuucuugcucuuugcccuugcccucccuucuuugaaaaaaaaaauauuuuuuagaagaauugcagaaauuucucacauuggucccaacaauggaaacacaauacaaagacacauucaaagaaaagucuauacaaccuuaggguggaagugaucuuuuuaacaagauuggaaacacagacauauuuuacuuaauaaaaaauuuaaaugucauauggcagggaccacagucaaaguuaaaacaacaaguagacuagaagaaauauuuguauaguaauaggaaacaugucagugucccuguauacaaagagaaguuuaaguuauuggagaaguggucacacugugaauaagcaauucacagaacaggacauugaaaaagucaacaaauauaaaguguguucaucuucauuauaaggguuaauggauuguuuuuuaaaaaguauuacuguaauacuaguuuuuaucagauugguuuaagguuaaauagugacaauauccauuuuggugaagaugcaaggaaauuggcagaaacauugcuggcaaaguuaucugggugugaauuaaaaucaaauacacauaacuuucagugaacaaccuucugagaaauuauaaaaauaaaagcuuccaugcauaaaaauguaaggacacagauguuuauugaaacauauucuagaggccagauguguuggcucacaccuguaaucucagcacuuuaggaggcugaagcaagcacaggucacuugaggucaggaguuuguggccagccuggccaacauggugaaacccaucucuacuaaaaauacaaaaauuaguggaguaugggguugugugccuguagucccagcuacucaggaggcugaggcaggagaaccacuugaacccaggagguggagguugcagugagccgagaucaugccacugcacuccagccugggugacagagcaaaagucugucucaaaaaauaaaaaugaaaaaaaaaaaaaaaaaaaaacuggaaaucuaaauguuaauuagcaaguaaaugguugaauaaauuaugguacauacauguaauauuauagaauauucucucaccacuaaaaagaauguuagauauguauauguuggccugagaagaggcugaugaggaaaaaaaauuacagagcaaaagauacaauauccuaauuguuuagacuuuuuaaaauauauaugaacaaagaaaugcauguggaaaaaauacacaaaacuuuuagcauugggaaaaggaagaaggcuguaauauuuucccaaacuccuuuaaaccucacucaguaaaguaauaccaaagauaguuuuguugaauguguguacgugggaaaaacagcuuuauuuuuaaaccaaguaguacuucaugacuuugggagcugcucuguugaauaaagugaucuggugucaggaacacuccucuuugaauuguugagauauuuuuggugaaauuuauuuaagcugaauguuaaaauguuacccuuuggagcaggaguccccagcccaugggugacaacugguaccggguugcacagcaggaggugaguguugggcaaagcuucauguguauuuauagcugcuccccauugcuugcauuaccaccugagcuccgccuccugucagaucaguggaggcauucgauucucauaggagcaggaacccuacugugaacugcgcaugcaagggaucuagguugugugcucauuaugagagugaugccugaugaucugucacugucucccaucacccccagaugggaccauccaguuguaggaaaacaagcucaagacucccacugauuuuaugucauggugaguuguauaauuauuucaucauauauuacaauguaauaauaaacugcacaauacguguaaugcgcuugaaucauccugaaaccaucuggcuccauggaauaacugucuucccacgaaaccagucccuggugccaaaaggguuggggauugcugcauuggaguaccuggaaaaaguugaucauagauuauuugaaugugccuguuaguauucuagaaauguguguagauuucaguccaguuauuuucaaagcugaaucuguuuuugagcuuuucaagauguuuuuucuuucugcuuggcugucauugcacauauaugguccauuacucaaggaacuaacacugagagugucacauuguuucacagggguccuuggaacaaaaacacuuuuaaguucuuccacugcaaauacagaugacuaauagaaacaauuggugugacaacacauuucacuccacaguggaaaaaaugcuuuauucauggacaaucaauuuucuaugcaauguacagguaugaccuguguaacagaacucagccaguaugguguaucccuggacauacguuaaauaaguuuuaaaaauccuuuggaaucuacucuuagcaucauuucugaaauugcagcauauuuguuuucugaagccauaccuuuuuuuuuuuuuuuucaguuuauucugaacacaagcaaagauaauuccuuaaaauaggaucugguugucuguauuuggguuguuucauucuguguuuugcagaaaaugcaucagauuacuauggccauucagacaugaagauaacuaagcaagcuacaauacuugcaguguauguuaagaucucauagggcuuuuuccuaaugagaaguuuuaugacgggggggaaugccccaucuggaguuuacauuaaagaaaacuucauguguagaugaaguuacauggauguagcccuacaaaugaggcauaucuucugauaaugcaguuccacaagaaacagcaaaugaagcgagggcuagacuucaccccaacacaucccccuaauaaguuauauaagcauucaccauggcccuguaccucauagucagaagcccaagauucuuauacaguaaugacagucaucuaaauuucaacuguuucacaaaucccuuuaaagaacaaaaagaacaaaucacucagauaccauaccuaagcauauuagauggcagagaagacagcaaccuuuaaauuacauauaauuuaggaaauaaauaucugagucucccagaccccacacuguagcagaaaaugauuggaaaagggguacauagaagagugcaggauucuacugguacugacacaauaugaacuggaguuuagaaggagagggucucauucugaauggugaaauagaacaaauaacuggcuacugaaaaauagaguuggaaauuguaugugauuaggugugaauauuuugggaaauuaguucugaaauaggccaucuucagaggaacugauguccuuuggaggcuuauuggugaagggagagaaggaaguaaaugaagguaagugucguuuaacaagauaucaaagaauccaaaaauauccuccauaaaggugugugauuuuuuuaaaggaaaucgugauuuauuuuacaaauaaagcacugugcuccugaaugaaaaaaacagccccccuacacuuguccauaagauuguuuacuauuguaacgugaauaguuuauaccacaugugaaaaaaaaauccacacaaauuuacucucaaaacguuucuuugaacauacaaaaacacgcuaggccaggugcaguggccaguuccuguaaucccagcacuggaaggcccaggcaagaggauugcuugagccuaagaguucaagaccagccugggcaacauaggaagacccccaucucuacaaauaauuuaaaaauuagccgggcaugguagcacauucuuguggucccagcuacuugaggcaggaggauugucugagcuggggagguugaggcugcagugaguagugaucauaccacuacuucagucuggguccaaagugagaccaugucucaaaaaaagcaggggaggagggguggcucaugucuguaaucccagcacuuugagaggucaaagugggaggauugcuugaguccaggaguucaagaccagucugggaaacauggugaaaccccuucuacaaaagaaaaaaaaaauagaaaaauuagucaugcauggugucacguuccuguagucccagcuacucaggaggcugagaugaaaggauuaccugagccugaggagaccaaggcugcagugagccaugauugugccacugcacuccagccugggugauagagugagacagucucaaacauaaaaauauaaaccacccucaauaauuucaugaaacagaggaaagcaguaauucaaaauagucuaacuuacuaauugaucgacagggucucacucuugcccaggcugcauuuacaggaccugcauuuacucaggaaugaaaacagcaaaauuaucucauaaaucaaggcuaaauuagagauggcccaagggagaagagauaugacugaaagcacacauguaacagagagaauagaaauuaaaugagccaaaaaaugaaguaaaaaauuguuguagagaaaauaauagauauagaacacagaaaaauaugcaauguuuaugggaaggcagaacucugggugcagagccaggaguugcaagcccagagagcagagcuuugaaucacaggguuauucucaggccuugaagcugaauggaauuuucccugcuguucuuugaaauugcuugggacaaugucagcaccccaucaaaaauuaccagacaggaacagaagcugaaaaaugugacucauacgagagaaauaucagucaauagaaacagaaaacaugggccgggugcaguggcucacgccuguaaucccagcacuuugggaggccaaggcggguggaucacaaggucaggagaucgagaccauccuggcuaacacggugaaaccccgucucuacuaaaaaauacaaaaaaauuagcugggcacaguggcaggcgccuguagucccagcuacucgggaggcugaggcaggagaauggcaggaaccugggaggcagaguuugcagugagcagagaucacgccacugcacuccagccugggagacagagcaagacuccgucucaaaaaaaaaaaaaaaaaaaagcagaaaacauggcagacuagaaguucuggcacuugucucucucacaaugacaaccaaaacgaugaaaacuacaauuuaaucugggcaugguggcucaugucuguaaucccacuacuuugggaagaugaagugaaaggaucccuugaagccaggaguuugagaccagccuaggcaacauagcaagacuccaucucuacaaaaaauuacuuaaaaauuagcuggauguggguggugcauuccuguaguccuagcuacuagggaggcugagauaggaguauugcccaggaguuugagguguaucacagugagcuaugauugcaccacuguacuccagccuggacaacagugagauccugucucaaaagaaaacacaacauuuuaaaaacaacaaacaaaaauaaaacggagaguuccaaagugucucagaggaguaacauaaaucuggaugggaacagaaacagauggccaccuagaaaacagaagaaaacauugggccucuaccaccccauuccccaacuaggauuagcugaaaaccaggaggaacuucuccuuucaauaaggagguaggaaugaggaugguagcaacucccaucaauacuuuggacaccaaaaaacaaaacaaaacaaaacaaaaacggauaggaggcaggacuaaaucacagcucccacucauacagagcauuggguggagacacauugugaacucuugcuccaagaacuacugcaggaauauaccaggaaagaugagcgaauccacagacccuuugaaggaaguggauugcuccugcaggacccaggagauagcccaaauacugugagugcccaaacugugaaagugggaaagagggaucaucugccccugaacacauacccucacuggggaaccugaagguucaggucauaggagaaggauuugacuuaccaggagcugagacaauuuagaaagccaagcaaauuacauggguagaggaagcagugggaaaagcccugugggcucucuggguccccacgaaagccauuucugacuuuucucucagggauccuuggggagguacgccagaggaacagggaaaagaccacagggagaaagaaaccuccagcugaacuuuguaacaauuccaacuaaacacaaagucuccuggccagaacucuggggauggugugaauccagugugcagaccgauaggcggggaggagugaaagcccugcuugcuuccucagccaggaggcugguagccuggggcaaguucucagcccugcuugcccacugccuggaaaccaacuaggugcuguugguuggggggcauggugagagugagaucagccuuuucaauuacaugggagcugggugaggccuguaacugccagcuuucccacacuucccugacaaccugcaugacacagcagagacagccauaauccuccugggaacauaacuccauugaccugggagccacacccccauccccaacagccaccacagcaagccccgcccaaggagagucugaacucagacacgccuaacccugcccuuaccugaugguccuucccuacccaaccugguagcuaaagacaaaggucauauucucuugggaguuccagggcccugcccacuggcugauccuccuccauacuaccacagcugaugcucuuuugauagauagcaccaccuccugguaagaggucaaccagcagaaaacuagugcauuaaacaacuacaacuaaagacacucagaguccauuucacucaucugccaccucuacaaaagcagguacugguauccauggcugacagaccugaagaugauucacaucacaggacucugugcagacaccccccaguagcagcccagagccuggcagcccugcugaguggcuagauccagaagagaaauaacaauuacuacaauuuggcucucaggaagccacaucccuaggaaaagggggagaguacuacaucaagggagcaccucaugggacaaaagaaccugaauggcagccuugagccccagauuuucccucugacauagccuacccaaaugagaaggaaacagaaaaacaauuguaaugugacaaauuaaguuucgucaacaccccccaaaaaucacacuagcucaccagcaauggauccaaaccaagacgaaaucccugaauugccagaaaaagaauucagaaggucaauuauuaagcuaaucaaggagucaccagagaaaugugaaguccaacuuaaggaaauaaaaaaaaugacacaagauaugaggggaaaaaucaguauguauaauugugucaauuaaaaacaauaaaagcauaaaagaaaaaagacucagaaaugacacauaauggaauuaauagaaaagggcuguaaaacagcuauuguaaguaugcacaagaucugaggaaaaacauuaauguaaugaaagcagaugguagaacuauguugaacuuuuagagaugaaaaauacaauaucugaaguaauucacuggaugggcuuaauucuaaaacacuuuugaagagaagaucagagaauuuaaagacauggcaagugaagcuauucaagagaaagcaaacauaauaaaaaaaaauuagaaaaaauacaagagagcaaggaacacugauuaauuaaugaugcuauaauaccaagugguaugauacaucuacuuagagucccaggagaaugaaaauaagaggaagaaaaaauacuuuaaaaaauagcuuuaaaauuuuccaaacuugaugaaaacuauaaaccugaagauacaggaaacucaaaaacccauaguugagacaaggucuggcucuauugcccaggcuggagugcaguggcaugaucucagcucacugcagccuccaucucccaggcucaagugauccucccaccucagccuccugaguagcuggcacuacaggcacacaccaccacgccuggcuauuuuuuuuuuuuuuuuuguauuuuuaguagaaauggguucucgccaguugcccagguugaucucgaacucuugagcucaagcgaucugcccaccucagccucccaaagugcugagauuacaggugugagccaccgugccuggccuccauaacuggauuaacacacauacauaccgccaugauaccucauaauggcauugcugaaaaucagugauaaugaggaaaugauaaauguagccagagaaagcaauauauuaggcaacgaaaaacaauauaaaccagucuuuucucagaaauuaugcaagucagaagacaauggaacaauaccuuuaaagugcugaggaaacaacaaagacaaacaaaaaaucuauacccagcaaaaauauccuucaaacaugagggcaaaacaaagcccuuuuagacaaaagaaacuagugaauuuguaauuuguugccaaugcaucugaacuacaagaaauacaaaaggauguuuuuuaaagauucaaugcuauuccugucaaacuaccaaugacauucuucacaaaacuagaaaaaaacuauuuuaaaauucauguagaaccaaaaaagagcccaaauagccauggaaauccuaaucaaaaagaagaaaacuggaggcaucacauuaccugacuucaaacuauaucacagggcuacaguaaccagaacaggggaaaggaaaggacuucccaucaauaaauggugcugggauaacuggcuagcuauaugcagaagauugaagcuggaccccuuccuuacaccauauacaaaaauuaacucaagauggauuaaagacuuacauguaaaaaucaaaacuauaaaaacccuggaagacaaccuaggcaauaccauccuggauauaggaaugggcaaagauuuuaugacaaagacaccaagaagcaauugcaacaaaagcaaguauuaacaacagugaucuaauuaaacuuaagagcuucugcacagcaaaagaaacuauccacagagcaaacagacaaccuauagaaugggagaaaauauuugcaaacuaggcaucugacaaaggucuaauauccaggaucuauaaggaacuucaacagauuuacaagagaaagacaaacaaccccauuaaaaagugagcaaaggacaugaacagacacuuugcaaaagaagacauacaugaagccaacaagcauaugagaaaagcucaaaaucacugaucauuugagaaaugcaaaucaaaaccacaaugggauacuauuaucauuuuuugacuuuuuaauaaaaucaaaaaacaacaugcuggcaauguugcagagaaaagggaacacucagacacuguugguggaaguguaaauuaguucaaccauuguggaaagcaguguggcgauuccucagugagcuaaaaaugaacuaucauuugaccaggcaguccuauuacuggguauauacccagagaaauguaaaucauucuaccauaaagacacaugcacauguauucacagcaugugaauuauucacgcagcagcauuauucacaauagcaaagacauggaaccaaccuacaugcccaucaaugacagaauggauaaagaaaaugugguauacauacgccauggaauaucaugcagucauaaaaaagaaugagauugugucuuuugugggaacaugaauggaggaaaaggccauuauucuuagcaaacuaaugcaggaacagaaaaccaaauacugcaugcugucaccuaucagugggagcuaaaugaugagaacacguggacacgaacgaagggaacaacagacacuggggccuacuugaggguggaggguggaaaaaaggagaggagcagaaaaaauaacuauuguaccugagugaugaaauaaucuguacaacaaacuccugugacacaagucugccuauauaacaaaccugcacagguaccccugaaccuaaaaugaaaguuaaaaaggaaauguuaaaguacaguggcacgaucuuggcucacugcaacucugccuccugucuucaagcgauucuucugccucagcauccugaguagcggggacuacaggcacgcgucaccacgcccggcuaauuuuuguauuucuaguauagacgggguuucaccauauuggccacacuggucucgaacuccugaccuccugauuugccugccucagccucccaaagugcuaggauuacaggcguaagccaccgugccuggccaagaguuccuuuuuuuaaggaguccaauuuuuuuaaaaaagaaaauuaaaaaaggaauuucuucaggcuaaaggcuaaaaggaauaccugauggaaacuuggaucuacaguaaaaauuaagagucccaaauauacuaaauaagugagcauauauuuuuaaaacuuuucuucuguuuuaacuuuuucaaaagauggcugggcaucauggcuggaacuggaacccaggaggcagagguugcagugagcugagauugcgccacugcaguccagccugggugacagagcgagacuccaucuaaaaaaaaaaaaaaaaaaaaaaaaaaaaaugaauguguguguauauauauauauacacauauauauauuuuuauauuuuauauaaauauaaauuuauauaaauauauauuuauauauuuauauaaauauuuauauauauuuguuuaaagcaaaaaauaaauauuuuuauaguuauuauaugcauaaauagaaguaaacuguaugacaaucauaauacaaaggguguuauuuuuaauauccuuuaugaagaugauuguuaugguuugaauugugucccugacaaaauucauauauugaaucccuaagccccacugugacuguauuuggagauaggccuuuaaagagguaauuaagguuaaaugagauccuacagguggggcccuaauucaauaugacugauuucccuauaagaacagagacuaaagagagagagagacauuugauaugugcaugcacaaaccaaagaccaugugaggauacagcaagaaaguggucaucugcaagcuaaggagagaggccuguagagaaaccagauguauuaccucgaucuuggacuuccagccuucaguacugugagaaaauaaauuucuguuguuuaagccaccuggucuguuguagugaucauguaguuuuuuaguugugccagaacaaaccaaaagcauuuccacuggucaaauuuacaauaauuugaucaucaaauguaauguuaauuaaauguuaaacuuuguaugcuguguaaccaacuacucccuaauuuagugguuuaaaauagcaaccauuugauaauguaauguuccauggcuuugugagucaggaauucagaggacucaucuggguaauucuccugcuccauguggcaucaagugggguggcccaguaauauucagcaggcagcauagcuagucuggagugccaaagacagguuuacuaacacaccuuggagggcaugaccagaaguaugggcugaggcggaacucucccucuacauguaguuucagggccuuuccauaccguuucuucaacaggguccagacaucuuacauuauggcuuagggcuccaagaauaaaugucccaagagauaguugaagauaacagucucuuaagguuggaccuagaaacuugcacaaugucauuucuaucauauuuuauuggucaaaacuucacagagcccauccagcuuuaagaggggaggccguacccuccaucucugauggguaaaagugucaaagaacuaguuguguccacuuaaaaucuaccacaguccauccucuguccauaaauuauuuauguuucucuuacauauaaaauaaacucccuccuuauaaaacucuaguaguuucauccuacuacaucaucaggacauuaggaccagacucaagccucaggauccccauuauuuaaaucagguccaaguaucuauuaggcuuuuuuuuuuuugagacucagucucaacgcccaagcuggagugcaguggugggaucucggcucacugcaaccucugccuccuggguucaagcgauucuccuaucucagccuccugaguagcuggaauuacaggugcccgcuaccacgccuggcuaauuuuuguauuuucguagagaugggguuucgccaaguuggccagacuggugucgaacuccucaccucaaguaauccgcccaccuuggccugccaaagugcugggauugcaggccuaagccacugugcccggccucuacuaggcuucuuaagugagguuuuaaaaguaugauaccuuucauucugaagaccggugaacuaaagagacaaauugugugccuccuacacaccaagcauacagugaugaaacaaagaagagcucucucccauucaaaaagaaggaaacauuagaauuacauagcagucccugguccauagagauucuaaaauuuagauaggcacuuguugccaguuccuuaaauaacccuuuucccugggaguuacucuccacagaucuuggcuccucccucugggcuucccaccacccuauccccacucccagucauucuuccuuuuccauaaaaguggaccacgguuucaacugauuagucuucucagcuugauuucuggccauagaaguuugaagguugaaaggcuucuuuaaauuuuaugugguuccuguguuuuacaguucaaucuaguaaaauucuuuuuaaaacuuuguggauuucuuauauacugaauuauaaaccacuccacuugacaaaagccacaccaguauuuuuuuuuuucugagacaggcuauucuuuaccuugggccaccugugagauugcugugguguaccaccuucagauucuuagaaauccuagugucucacagaaaaggucuacauggcacacccuuaaauccuucugagaucuuaacaaagggaauaacaacuaaaaucucggcuauauuuuuacuuugagaucuuuuuuuuguggagacggagucucgcucugucacccaggcuggagugcagugggcgcgaucucggcugacugcaagcuccagccucccagguucacgccauucuucucagccuccugaguagcugggacuacaggcgcccaccaccaugcccagcuaauuuuuuguauuuuuaguagagacgggguuucacuguguuagccaggauggucucgaucuccugaccuugggauccgccugccucggccucccaaagugcugggauuacaggcgugagccaccgugccuggcugagguaauuuuuaauccacaacgauguugaauaaauuuuuuaaguccaggagaccauugcuaugaagagugagaacucauacaugauaguaagcaguauaccaacucuuuacccugaggauugguauuuauaaugaaagaaguaaggcuauugaaggagaacaacauggaagucaaaaucuacuagguaagggugcugugcuugaagcaauacaggacuaagaugggaacuugucuuguuuaaaaucaaguagagcauucccaacguggacuagcauuuggugaguagagguauacaagauagcucugucaauagagccaggacuuuaagcuauauuuauuuauuuuaaaaggccuuaaaaggagcugaaaaaguaaaauugugucuucaagaacaagacaaaacaaaacuggucauugugguauuugggauagauucacaugagauuugagacgguccaaaaggagaaaauaguucagguggggaagaacccacgcagagaaacuaauggugcaaucauagaaaaauaaggauuccggcuagagacaacacuauaauuccuaagaaugucuuaagggguggccaauuagaaacacacaaagaacuugguuucauggggaguguggcugacccaauuggggacaguuguagauaaagucacauuuugaagcagccuauagucuagcaagcuuucuuuggaagagauguguuuuugugcccacguuaucauaggagguaaauaauucugcuuaaagagugaaaaauacucuaaaauggagguacagucacuagugauauguaauagccaugagaggcgauugaggucuauuaaagcaaugggaaaagaucacuaucuuaaaaccuugauucuuauucuaucccagaguuucuauuauuuaauagaaaaaaaaacuauacucuucaucucacucaucugguuacuuugaggacaagauaagauuuuaugauaauccuccaaaaauaaauaggacuugaaagauagaguugaaacaguggacaauuaaagaguaauuuggaagaauggugaaauuacagccaugcuuugaaucaggcggguucacuggcacauucccacaaagaugugguuaaggcacaaaggcuacauaaaccuuuaugugggcugcauuuaaguugcacaucuuugcuucaguacuuugcagcuugcuggaaaauguuaaaccuaucuuucccuuuucucuuacuuuugcccauaguauccuccucugcuuggcgaacuccaguucauccuuuuaacucaaauggauggaaccuccuuugugaaaucuuccccauuuucccagggaaugugagcuacuucuuuucucuccucccagacuauuugugcauacauuuuuuauugcauguaucacagugccacacaauuauuuccuuacacucaaaaagaagaugcuuucuucugaguaagcagaguaggggcuuggaggaaaagagaagaguacacaagaaaacuggguuagaagauuuuuuaaaacuucacaacuuucucuggaguuaguuuccuuaccuucagcugggcagaaacaaaaauagaaggcaugcacagagguauuuuuggcaugcagcuacaguaacagcuaucucuacuucaugugauuuauggaguuuggggguuuuuggguccgggaggauucaucaauuuagauguagcuacaauuauuuuagaauauauuuagccauugaguaauggacuaguuauuaggagcuucuagauuccaauguguuuuauuggccccaaauuggaaacaugcaagagauagcuugaaaaggaaaugacccaauuaucuauuggcccaaauaagacagcaaaguuaguuaucuugcuaauuucuaaacaucaucacacuaugaaauaaggcagagaggaaaaaaagcccuauucaauuucauuaguaacaaaaugaugaauugauuuucaaugcaaaggaccccaggguugcaagucacauaaccugagcaugcccacauaaaccaaguguucccaauucaugaccccggagccaaccacagcagaauguaaguacucagauugaagaaugggaauggaauuaagaagugagggguacuguguuuugcugcaguauggauuuaagagccaaggacccagcaucaccucuuugcaugacccaaucagaucaugccuccuugcauuguucugucucucucacaguuauccucugccuauaaacccucccuccagaccccagccuggggagacagauuugagcauugcauccuaucaccuugccagucaacuugcaauaaagcuuucucauuuuucaaaagccagugccauagaauuguuuucuaaacacauugggcggugagcucacugauaggaugcaaguugccuaagauuucaggggugccccacucuccauuccuccccaaaaguaaacacugagacaguggucacucugcauuguuucuaccauuagagucucucgucucuuaaguuuagaugguucuagaaaguggaucaugcugagagagugggaccuccauguagaauuuuaaauuuuguauuauuuuuuaaauuuuagcauuuuuauguuuugcaggggaaguacagaaaugaaagauugaggauaaaagugaaugaauaguuaauggauauggccucuguagauagaagaaagugaucaucgaggacccagagaacugcugaaugaguuugcucugauccauugagacaagaagaaaggaagucaagaugaauguggaugcagagagcauuuuggguggcuggggcaugaugucaagaaacuucucuauugaugaucucuaaauuuccuaugaacuaggaagugaaaucauauaucaagagagugggaaaaaugucuugaggacaugguaaaaagauuaaaccccuucuccuucccauccaugaugcuggaggauaugcaggcugcaggauggcuuaguggagacuugaggucauaaaucuguagugguaccaaguuucacacuuuuugguuguuaaguaguccauauaaaaaauguggauggcuaaaaagauuugccagguggguacagggaaaggacaaugggauaaagcaagggagugacugauguguugacucucggaguuaggcuggauaggaaaagaggcugaguggaagaaaugcaaaucuagaucagauaaaagaagauuguggggaucaagggugggagguuguaguugggguauagaaugucagagauacagauaauaaagguagagguggcucugagggugcugcuacagagugcagccggggacaagggagacuaaaaucaagcaauggugaaaguuacugggguugagguuucaaacaccaugacauccugggugacucucacagcaaucaugcagauggagcuucuccuucuaucucacacaguagaagcuaagucucauuaagguuuugggcuuugcccagagucauccagcuuacacaaggcaguuccaguauuagaauucucaauuggugguaacaaauaucacuauccaugggcauucagagauaguuucugauuauuuggggaugggagagguugggugucuacaaacccuuuuaauccuuuaaauucuaguuuaguugcauuacugcagaauccagagguauuuagaaaguaccuaucuuuguccuucuuuccacugaaugacaccaccaacgacugacccugccaguccugaaacccuuuaaaucuaccuacaugacucaccuuccuucacucccuccauccccucaaucuccaggcuuuuauaagucuugaaugcauauucuccuuuccauccacauaguuuaggcccucagcaucuguauuaguuuucuacuauugccauagcaaaugaucacaaauuuagggguuuaaaauaacacaaauguauuacuuuacaguucuguaggccauaaaucaguauuagucucaccaggauaaaauuaaggugucaguagagcucaaucacuuucugaagacucuaagggaggauccauuuccuugcucauuuagguuauuggcagaauucaguuucugcuguuguaggacuguggaagaaaaacaagucuagaccagauaaagaaagugaauuuuuuguuggcugucagcuaagguccuuucccagcuccuggagguuauccacaguccuugguucgugguucagguugagucccucucacacuuugaaucucuuugacccacucuucuuccauuuuaggggauucaugugauuagauugggcucacugaaauaauccaggauaaucccccaucucaauggcaucaaucuuaaucacaccugcaaaauuucuuuauucuuuuuuuucccaugaccgaaugagaagguaacaccugcaaaaauucuuuugccauguaagauaacauauuuacagguuccagggauuaagaaguggaccucuuucuguaacucuacucauucugccuacugaaguaucucaccgacauauuucaauauuuccuaagcaaguuucuugguucugggaucuucuauguuuccagauuaaacuuucuagaaccacaccugacauaucuccugugcuuaaaacccuucuggcuuccuaccaaucaaaggucaaauuaauguuguuuaguuucuauaggaaaacagcccuugaguuugguccuguuuuacuguuuuagcuuuauuccggccaccauuccacuucuccuccauccuuauucaggcuugaaaaaguuuacugugauucuucuucacuuauaagcugccuuugaagcucccauuucuucuuccaaacccagcucagacaucaccuacaccaggaagaucucccugacgcccuuccccaaaguuauaaccacaggacaagguccucuuuuaaaaaccuccguaccuuguguauguuucuaucuuuugcauuaaacccaaauguguugugauuuugucuauuucaccuaucaagaguuuacuuuccucucuccaagccaaacucagccauuucccaaacguguaacuuucuuugggaaggcuauuuacuucacgaugucucccuuucccuuuguaaaacagggauagcgacaggaucuauaucauagauuguuguaaggaguagaacggugaccuacacauauuaaguuuuacuaguauuauuaauauuuccagcccucugccccccgcugccauguacuaggugcuuaauggauguuuauuguauggauggauucaucguacucccaccaaggucccucgcccuugaaaauggcuaccccgggccagggcuccucaacagacugaagguccagauccuacuccauccuggcggucucggguggccccugaggagggcaagccuucugcuccacaggcaaggacagucacagcuaaguccgcggggggcggcagagagcgagggcuuuccaggagccaaugagucuuuaacuccaagaggaagcccugcauucuccgcaaauggaaaccaggaaucgggagcgcgucagcuaucguaggguagacuuaaggcccgcagaaaauuaaaagcaaaagagcaggcggaauucaggggcuuucacggaucaucaucauaauagucaauaaugauggcagcagacacuaacauucacgcguucuuguuaagugcaaggcacagugcaaauguguauggccccauuuaaccaucucaacacacuacgagguuggcgucucauuuuuacaacggaagaaacugagaggcucaggaauaccguauccuaugcacaucucccaagaggguccuguucuccagcgcccagcgaucugggccucgcgguccgaguccggcucccgggccgccgcccagcccuucuccgcgcucuccugcgccugggccacuuccgacuccugcuguccgguccccagcuccuccucacccacuccgccccgccaugccccgccccagccgcucggcuccuccuucccugcacgcuccgcccccgaccucccggcuccuccccggccugcccgccacacccuuggucccuccugcaaguuccgccccuggccucugccuccuuuucucccgccggcucuaacccgcgcuuggcuaagguccgcgggaacccgugagccaccgagagagcagagaacucggcgccgccaaacagcccagcucgcgcuucagcgucccggcgccgucgcgccacuccuccgaguaaguggcuccugggcgcgcccgucccgcgcacacuccagcgcgccucucccgccgcugggcugcgggcugcucucggggagcgccuccggcucagagaguuucugaagcgagugugagugagugugagugggugcguuugaacaacuuguuuaggugggugugcguacgagugugugcaggagcgcacagccucggaaacuccgcgaaauuuuacucgguuccagugccgcacugaggauccaagaccccuuuuaggaacccuuaccuauucagggcgaccucuuaaccaccuccugccgugagccucauuccuucccucccuuuguaacuggguucccgcuauuugucacguccuccuguaaccgcacauacuggcgaaagcacugcccggguuaucagggugccccagauugcagacugagaugcuggccugagauuguaauccaaccuugcauuguaaaacgggcagagaccagagcccugcuuugagaucauucgguggagacuuccuuugaggaagaaaauguguguguguguguguauguguguguguguacaugacugcacaugucgcacuggagcccucagcaccugcugcaaagacaccugaugagcgcccaggcuccacggacuccucgcgacugauaggcacguucaagaccaggcugacccaacaggcuuaggcaccuugaauauguuuauugcuucagugacacuguauuucuaaaccaacagauuuucgaaaacacagaagcucuaaguagaaaaagcaguaucccuagaggaaucauggaaggaaucaaacaguaguucagugcccaguguugaaacaagaaaauccuuggauugcuuaagacugauaauuccaucccuacauaauuauuuuuauggggggaggugggggucaguacucccucaaugcaggacauauuucuacauuuaaaaaguuaauuggaagcuaugguaucauaacagcaguauuguacaaauaguuucuucaucuauaaaaugauugccugguugcugggguccuaucuaauuuuaauagucucucugaguucuacauuucaguuuauucuugcuacuuucuugcuaugaaaguaaaauauucuccuacuuccuugauaauaauccauuuaugaaauguucaaaaucacauucugaguagaaauuauucuucgaggguaaggauaacaaagcuguguggccaaaggaaauaaccaaaaaggguaggcuuuaagaagccauugugcauuggcacaugaaagguaagaguugauaaaucacuguaagugcugcuuaucgcagccgauauuuuuauccugguuugaauccuguauuacacagaaguguuuccacacuguuuuaacuaaggaaacauuauacuuugcaguguaaacauaugacuccaucucucuuuaaggaaagaaauaauuaucacguuugaugaaacacuuagacacguuuauugccaccgucuaauuagaucugucaugagcaguuaagucagcaagcuaugguuguuguuguuuuuagagacagggucuugcuauguuguccaagguggucuugaacuccugggcucaagugauccuccugccucagccuccugaguaacugggacuacaggggcccacaaguaauuguuaauauucuagcuaguaacacaauuugcuuuuuugcagauuuuuuggaugccuuuuguccuccauacacauuaauugccucuggcauucacugcccaucuuuucaguuuuuacuuguaaucugaguaaauaaaguuuagggaaguagacuaccaccuacuccucuguaaaauaugaaucccuuagauauugaauguguuguguuaagcucuuuggauugacauauguagacuuuauaaaccauuauauuaaucuagauuaugugaugauuuaagaauuauuaauaaaucagugaauaaaacaagguucuaccaaaagcauagugauccugcacaaaugggccuuuuaaacacuuucuuuaagggcaacuuuuacuccguguaccuuuuguuccaguguguuuaaacucaccaagaaaaguuggugugaguugagaaaucucauguuuguugucucuuaauuuucuauuucagacuauauugcuagacauagucuuuguuuacguguugagcugucgugaggacaggcuguccugggauccuaaacagaauagcagaaaccugggggugaacacacugcagaggccaggaacagaguauuuuaugaggccaguucuuugcaauucucauucuguugaaauggaggaaaggguguguggagaggaaugauugcauccaaacaguacuaauuaggaaaugcugaguugggggaggaguggauuucuaugugacuuacggcuuggagaacuucacagaggugaucuuuaaaguugagucugccacagugccaggcacugcagaggucucauauuuaauugauccaauuaauccucuuuugcagaagauagcccaaugugguaguaacacccuuccuggagauuucauucauucucagaauugagcuuugaucuaccucauguagaaugguccauuccucacugccuccauuuaugcgugauagcaguugaaggggcugaaaaugggauaaccuccaggagacgggagaagcagugaugauaaauaagggccaccugcuuuuucacagaggggaagggcauaggggcuauuaguacaauuccagugccaggggcauugacuuuggcaauggcgacaugcacaggggccaaucuggauaacaaaguggacaauuuucccugcuuuggcauucucagggaucucuggcucugauacagaaguuaagggaaggaguuguguggugccagauuaacuuuuaucaccucaccccuccucacacugcccacauccugcauuuaauaccaaaugcacacagcaagaacucaacaaacacugaaaaggcccucguaacacccaaccuuuauguuucccucuggcuaagaauuuucuucccauacucuugucucugguuuugaugacuguggcccuggagucugagccaacugcaguuucuaggcuucuauacuucaguugugcugcccaguagcugaaaaugaauaauuuguagaggguaaaaaacaaaaacagagaaccauguugcaaaauguaaaggaggucaguucauuuuuagccuacauuuuggccugaagaggaggaaaugagcuacaaguggaggguagauaauucuagaauagcagagccaagggguaucuuggaaaccaccuggucuauggccuuacaccauaugguugcuauuccucaacuuuggagguguccaucuccuuaaguccagcuugcaggaggagagcaccauucauucacacagcaggcauuuauugagcuccugcuaugugccugguacagcacacccuucucauguuuacaugaaauccuugggauuugagaaggcagguaacuugcguaaagaugucuguugauaagaaggagucccugaagguaaguugcuaguggcaaaaauggguuuggaauucuguuguguuucacaagggcaguagaaugauauucaaaauauuugucuuucucaacaauaagaaacucaaaagaagcacauuucugccaacaucuguuucaaauaaccagugguauuacugaaacaaaccugauuccauaggauuuuguuuuacaucagacauaaguuaccugagaauuguuugaaaaugucacaggcucagcaauaaucaaauaauacccagcccauccuuuuagacagcaguuguuuuuucucuggaagcaaguguuuaugguucagaacuaagguagcugagguucagaaccagcugcaaagcugggugugugccaaaaagguuguuuuccuaggcuugcccuuuuccguauaggacaagggggauuaaaaaccaacauggugauguuucugucaaggugacggggggcuagguguacagaucuuuuccacuaaaaacaaggguugcgggcagguggucacaggauugagacuccaggcuaacucguaaacaccucuggguucguuucuuuaauaacagaauggaauuaaguucaaaauuccacuuguaguuuccuuaaacauugggaauaaagaugacuuuagucaagaaguaguugguccaaaugacuuugcuggaaucagcagcucaugucucagccccugcuggcuguguggcuuuggacaaucuacuuagcucucugagccuguuucuucaccagaguaaaaacuggggauaguauuuauauuauaggauuguugugcagauuaagccagauguuccucuccuguaucagugugcagaaggcacccauuaaguggaggacuuaguuagauuggccaaauaggucucauuccaguaaguguuaguacugagccacaguggaguagagagggaaaguaguaacuugugucauaugugauuuuagcaugaauucuuuuuuccuuuaacaaugccagaggagcccagagaauggggugaauguagcacaacuucagugauugcuagcugcagggucacaugauuauauaagggaaaugucaccgcugcugccaaagauaagugagccagagcagggcauucgaguuuuaugugccugagaacgaagacgagccauaguacccauuaagcuucucugcaugagggaagcuuucaaaagaccuauuacaguuaaauugugagcaguggguuggccuuucacaacucccauguuuaaaacagguagugaaugaaaccagauuauuuaagacagacagcugcccuugguguugcaaagggaaucgggcuggcaugucuucaggggaaguugcgugagguccgggaggcccagggcagggaccgcaucugcaggauuaggcaccggggcaaggucuuuugggaacacaguacucagcaaggcacacaguagacucuuggauauuuuaaaggagccaaaaaguaagcaacagcucacucugucaauacccucucuaagccuggcucuuacuccuucaacccaaauucauuuagcucaagccuuccucauuccuaacucuuauuuauuacucuuauuuaucauuuguuuaacaaaaugagguuuuuuguuuguuuguuuguuugguuuuacaacauggcugucaacaaaaauaggggagacagagauuguggugugugcuauguagaccuaacuacacucgucuuuccuguccugagcucucuucugacuguguucagacccucacacacaugcagacacgaaaaaaaaugccagucuucugagaaaaaaaugcauggacaguguuggcaacagugcaaguuucagaacaaacuuuggucacguaaaucuuugggaaguaaguccaguaccucauuccaucauucuguggucaggaaacuacucuuuuauuuuuccuucuucacucuuuaaaggguugagauuguuuucuggaaaauggcagguguuugguuaaauacuguuuugcuacacuugaagggcagagcaguccucacuuagugauggaauuccuuuugccuugaggcagaauuaggcugcuagugacucaugagguauaccuggaagaggugagugaacucaggccuucccaacauccggugaugaccucuguuugcacacacguagccacuuugcuccuuugcuuuuaugaccuggaaugacugauagugccugaaggaacaggcugcuauuacuuuucaagguaagagacccuguguaaauagggagccuccugaggaagcaaggauucccugcccuguguaccuguggugcuuaucaccucccuggcagggaagcucugcccagguaggguaguuugagaacaucauuaucugggcagcuacaaaagugauacaccaaaugaaacuuugaacuuauccaaugugcuguauuuuagggcucaucugggacuauuccugugaaccugacuguuaagucagaaucaccagugaagcuugaugcaaauugagaaccccuagccugggagacuuaugugacucauuuuccugucuuguucuagaaagaagcuuauucaggcagcagcuagcuguagggauuuuuuuuuaauuuuuuuuuuuuuuuuggcaguggaaagagcucuugaaaguacagaguggcuuuaaaguuuaaagaagauuaaaaugaacacaacauauaaaauaaacacaacauauaaaaugaacaccuauguacccaucuuaagaaauaacaaaguuguuuuuauaggucuucacuggguggaaaaauauuaacaagcaaccaggucaagaacaaaaaauaacaaccaaaacaauuaguggugucccacaaauagauccagaaauugaaggccaugaaacagagacauuggagagucugcccaguguucauuaguugaaaaucuagacuugagucaccaacaaugcugacaucauaaauccaguaugccagcugacuuaaggauaacucaggugguuuguagauacugaacugggaugggcauccuuauuucaacagcggcgcauguuuggaagagcacgggcccaacucaggacucggaguugccaagcggaccguuuccccuaacccaggccuguuuccuguccugagguccugguaccuccaggaaucuauucuguucucagagugucccucucauuuuguaaugguagaaaaugagaaaaugaaaaacagaccauuuuuuucuuugaagccauguucuguaacuuccuccugcuucuuuugcauuuuggguuuugccaguacuugagacuucccuuuuucugaauuuuagucaguuuuuaauuuaucauucuaauaggggccauggaaauuagaauaauaaagguuugcuacugaucauaacauaguauuaauuuuaguagauugacagcuuuuuuuuuccccucuagauuuaaauauuugaacagagaauaacagguuaugaaacugacuaauucaggucuggccucugccuuccucuguagucagccaucccccagguuugcugcccuggaguugagcacaccagggccuuucagccuuaccauuagggaaaugaggcagauagaggagguugggcagugacuugcggagacagguggcaggggcagaggauuaaccacccaagcccaacaagcauauccacacugaauuuuacgcuuuaaucagucuuucguuaaguucuguuuuuuuuuuuuucuuuuuuuugaguuggagucuugcucugucucccaggcugaagugcaguggugcaaacuuggcucacugcaaccucuaacucccggguucaagcgaagcuccuaccucagccucccgaguagcugggauuacaggcaaacaccaccacaucuggcuaauuuuuguauuuuuaguagagacaggguuucaccauguuggccaggcuggucucgaacuccugaccucaagugauccaccugccuuggccucccaaaguguugggauuacaggcuugagccaccgcaccuggccuguaaguucuguuuuuuuuaugguugccuuuagugaugauaguguucuauauaaguguauuaguuuuuaagggcugccauaacaaaauaccacagacugguggcuuaaacaacagaaauuuauauucucacaguucuggagacuggaaguucaagaucaagacgucaacagguuugauuucccugaggccucccuccuugccuuucagauggccacauuucugcuguauucucacaagaacauuucucugugcacaacccuggugucucucccucuucauagagugccagucauauuagauuagggucccacccuuaugaucuuauuuaaccuuaauuguuuauuaaagccugucuccaaacacagccauacuagagaucaggguuucaguauaugaauuugggugguacauuucagucuauaacaaucgccuuuauaaaggauauuaguuguccuccuuuacacagggaggaucuuuucaggaccugcagucuaugccugaaacugcacauaguacugaacccuauauaagcuauauuuuuuccuauacauauguaccuaugauaaaauuuaauuuauaauuuaagcacaguaagagauuaaccauaauaccgaauaauaaaauagaacaauuauaacaauauauuguaauaagauuuauauaaaaaugaucuuucugucuucacuuucucucaaaauaucuuguauacugcacucaccuguuuucagacugcauggucuguggucacacugcaacuguggaaaccgagaccauagauacgggggacuacugaggagaccacaccguuuguguugugauugucauaugguuuauuucuguaucuauguauaaucccuacaaauuauaguuacuuuuuucuuuaaacaaugaucuuuugaagaaauuaaaacaggagaaaaauacgcauuuacuguguguggggcuuuugauuuuuuaguguagacacaaguuuccaucagggauuuuuuuuuuguccuucagccugaagaauaaaaauuuuuaauauuauagcucacgucuacuggccacagauccucucagcuuguuguuugugcgcacacuuggcgucuguguguccagcucuccucuuauaaggauaccaaucaaauuggauuggggaccaccuuaagacuaauuuuaacugagucaccucuuuaaacauucuguuuccaaaugcaguugcuuucugagauauugggaguuaagucuucagcauaugaacuuuuugguguuucuuagucuguuuguacugcuguaacaaaauaucugagacuggguaauuuguaaagaacagaaauuuauuuuccacaguucugggggcugggaauucaagaucagggcacccacagauucagugucuggugagggcagcucugggcuuccaagagggugcuuucuugcuguguccucacaugguagaugagaugggagguggaggggcaaaaggcacugggguacaccuuucaacaucuuuuguaaaagcacuaauccacucauaaggguggagcccuuaugacuuaaucacuucuaaccaccucuuaauaccaccaccuugggguuuagguuucaacauaugaauuuugaggggagauacaccuucagaccauagcaggagggacacaauucagaucauaacaaucgggauguuuuagacugcaauuaagcaaaugccaaugaacagugauuugaauaguaaagacauuaaauugucuuauaugaagggcagucugggauuggguagauucaggauuggauccuuggcuaaacagugucaucagggaccaguucuaucuauucucauccuuagcauguuacauuuuuaucugcagacuugccucuuugugggcggaaauagcuuucucagcaacagguaucacagguuccugccaaccucuuuuuaagacaggaagggggagagagagagagagagagagagagugugugugugugugugugugugugugugugugugugugugugugaaggguggacacagagggcagcaauaaauugcuucucuaguagugucuaucccuuuucauccgggaguaaaaucuuuccuggagccucuuuaagccucauuggccagaacugagucacagccuuaagggaagcugugaaagugaguauugggcauugagggagaaccucuauugugggagguuggcugugcccauaggggaaggggaggggcaugguuacaggguggacaagaagcaucuguacuaacccugggcucccauucccuaaaggccaguuacagccaucaguauuccugauacuaauaaucccagguuucauuggaguuaaaacuaaccacccaugaugguaguugggaggagaaaaccaaauaauaauauggaagguguugaaaaucacauauacauaauuacuacuagcagugacuuuuucuuauucuuuuucauuuuaaaacugacuggaaguaucuugaagcagugauuuuuugauguuaaaggucauggguuuauaaaauagcacuacuuacuuuggggaaagcauccuacauuccagccagaaagguauccaucauauagagaauuccuuaauuuuccagaaauguuuaccaucccaguaaucauggcaaacacuuguugaguacguagggugggccagcaggcacugugcugagugcuuuauacacauuauuuaauuucaucuucaggaggaaucuaugagaaagauacuauuguuaagccuuguuugcagauaaggaauugaggcuuaaggagguuaaguaacaugcugugaaugccuggccacgcugggauuuacacucugguggcucagcugcccucccauacuugugcuacaggguguuacucuucaauaauacugccacaaacacccucuuuuucugugaacucucaaaggcuguugccucuccaaccagucugguucugcuacaaagcuugucuccauguuucauucuucacauuuuguuguuuuuaauaguagaaggaugaaccaugguggugugcagagcuggucaugccauaccucauggagugugagaugugucaucuuguauuugugagaacccaaugcccgacuguucauugcaauucugguagauaucuaagagguuauuuuguuauuuuauuuuuuuuauuuauuauauguguuuguuagagauagggucuugcucuguugcccaggcuggagugcaauggcuauucacaggcacaaucauagcacacuacaaccucaaacucuuggcuucaagcaguucucucgccucaaccuuuuguguagcugggacuacaggugcaugccaccacacccaacucuaggaagucauuuugaauugagauugcucuugagguauuuuggagcaugucauuuguuauaugcuuuuaaaaauaauuuaaaguguuauaaggcaaauuuuaauuaaacaguguacauucaguuauuuaccuucaaagugaaaaguucauugaaacaguguucguaagaugcugguuccugucugauuuauuacugggucccuacacuuuuccaccuagcacugagagacacguugcaauuuuuuccgucaguuggcuacugugcugauaugccuagauuuucuuaaugcuuuuuuaauacuuuuauuguaaaacauaaauaucaaaaagccacacaaaacaaauguacacaacuuagugaauuauuacaaagcaaacacccauauauaucacuagcauuuaggucaagaaauagaacuuugccagagggaccaaaauuuuacaucccauccugaucacauuucccucuguuccuccaaaaauaaaugccauccugacuuuauaguaauuacuuccuugcaucucuuuaugguuuuauuacccaaaugagcagccugacccacugaguuuuagucuuacccauuaaaaaaaaaaaaagauguuuaagucucuuuuaaucuacagaccccucuaccagagucuccuuccuuuaaauuuuuuuuuuuaauuuguugcaggaccugggcuguuuaauuuguagaguuucccacaguguugauaacaagaaagauucacacucacgguacaguuuaacuuacugcuuuucccucuguuuccuguaucuggauccagagacuugaucagauucaggucucaucccuuuggcaagauuacagauggugguguauucuuucacugggagacacauggggucugguuuuuccacucuuuugauguuagcagcuguugauccucagugucucgaucuguuaauucagugggggcaauugcagaauggugauacucuaauucuaucauuuugauuuuauuuauuagcuggaauaauuuuauaaggauagacgccuuuucaaucuguuauuugauugcccagugguacaauucacauaggaaagggaugauaaaugcuugauucuuuccuuugauuuacucaguuuucaagaauugauuucaugucauucucagaagaucacugauuaggguuuuuuuuuaauuguuaugagcucauggaauuaaaucuuuuuuauagguuuuagucuauugaaauuuuaguuuuuacugagacucaaauugucccaucuuugaccaaugggagccucuucaguuggccccuaaguccuccugaccugaccuuaguauucuuguuaguuuccugcucuuugauuuguuaaggugauccaugcuugucuuguacauuucuugccuauaccuggagucaaccauuuucccaagaaacccugguuauuuuuuagcgagaaaugguauuucaagacuauaguccagacgcugggaauccucauucacuggaaugguuaguauuuauaggccuuuccucggucagagcugggaaacacacacacauacacacacacacacacacacucucucucucucacacuuacaugcaaacauaaauacucauauaaagauaaaauacuuugugaguucauaaugcuauuuccaauuaaaguucaagacuauaggguuucuguuuaaccucuuauauauuacauuuuuauuccuuuucuuccacacuuagaauccugguuuuuuggucacaagggaaauagacuauuguguaauuaccuauuugauuaccccauauuacacacaaaucgucuccaaauaaugacauuaauacuaccauuaccagcuaugauuacugaaaacaauaaaaauaauuucuuuggcauaugccauacuaauucuuucccaccuuaaaaaaaugguuuaguacuucugcaucaucagaucuuauuauuguuauauauuaaaauaucucccuuuuaauacucauuuagucuuauuuguacagguuguuguauauaucaugcuuaucacuuguccucauaucagugucucuagacauuuugauugaagcucuuucucuaguagauuuaauaggaggggaucaugagaacaauauucccuaauuucaaguugauaaaacuuggucugugaccuuuauaauuaagggucacuguugucugauauaaaauccuuggcucaaauuuucuuuccuugagaaucuuaaauaugucacuccauuuucuucugacguaaacuauuguuguccgaaagagucuaaugaugaugaucucaauguuuuccugcuauacgugcuacucuuuuagcacuuuucagaguaucaacuauauaucauuucauucagucaacagaguaugagcauuccaguacuguaacuagugagcuguuauguuaccaaaucugagugugugacuuggucaacccuguucccaaauaaucucuuucugcucuugacccagaauaagccacuuacucucaguagcuguagguuuuuuaucuuuguaacaucugcuggaccuuguaaagaguucaguuaacacuaaauauauauuuguuuaugaaauaaaugcuguggaaggaugugggcuuuuuucuuuuucuuauuagccuguugggaacugucccaucccuuugccucuuuuccucugaucuggugaggcuuugccuuugugcuccuugaaacgggcccuuccccugagcagaagguaugugggugcagcacccauugguucuggguugucccauggauucagugucagguuuucagacuguguucuuguuguauugcauuuucaggacuagcauguugggaacuccuggcgcacagagugucugacuccacaguaaggccacugugguccccacgccugcuugcccuuuucuuugucuacacccugaucuguuccuuccuggguuucacagccuaggccccuggcauguggggcauagaccccagccucucugugaccuuccuuuucugaccacugcaucagugggugccagggauuccaccugcccagacaggcccuuucuuccuuccugcccuuuccuuucuugacugaucuuuuuggucuucauuucuugcccaucacaaccuuuugcagggcacuacaaaaugggacccuuggccaagaugugacccagaugcauuuugcucaacuuauacacuguguucagcuuuuaaaauuuucaucucacuuaguggggcauuugugcgaguuuggccaaagacucugcugcucccuauuguguuccuccuggucggucauacauuucauuuaucugccuggcuucuagagacaggugaguuggugaccucugaacuuugguaucucuugcuucucaaagcauucaccauguggugaugaccuugggcugcccuauuuuauucaugaccugcacuaguucagcaagacauucuugcccugguucacucacccuguuagguccuggccugugggccauuccgacuuuuucuuucauccucuugaggaucccaaucacauguaauaauaggaaaaaaacaaucuuaugacacuuagcuuuuaaaagcauucauucuacaaaaacaaugaugaaaaugaucaaggagugauaggcuaggcauaguggcccaaaccugaagucccagcuacucuggaggcugagguggaaggaucccuugagcccaggaguuugagaccagccuggcaacauagcaagacccuguuuguauuaauuaaaaaaaaguaauggaauaaugguucuucccugauggaugugaaugcuuaggugaucucuuauugcagguauaaagaaaaagggaaacucuuagccuuggucacaccagggagagcuugcuguaagagagucggugauauggaaaagcugccugugacuugagaaauugcucuuacucccuccuuuucuguuccuugucagugcccugaaguaaggaguuguagaguugggcucuucucugcuguggcugggccugugggaggcagcucaugagccugacugcccuagugaauuucuucccagguguaguuuuucaggucacaauugaagcaguacuggaaaugacucuuugcuccuaagaaucuucgagacaaauaaggacuuggguuaaaaaaacaaaacaaaacaaaacuguuucuauuccauuuuauuaauucagcagaagucauacugaagacuuguucuucgccuguucucagcugccugucuuuuugccuuuugccucugguuagcccauguaugugccaaguguggcaguaaaggcugaguaguuuuugaccacuuacuaugugccaggcacugugcuaagaucucucuguacauugccacauucuucaauggcaguuugaaauaaguucuaucauuauuauccccauuuuaaagaugggaaaacagacugcaagaacuuaaguuguuacccaaggucagaggcaaucugauguucaaauccggugguuucuaaccauauugccauaguuccucuugcaggaacuaugccaccuagccagcuugcaggggcuugcuggagggcaguaacagagcuggguuccagaggcugcaggauggagaucuugaauauuguagaacaguucuucaacagaaaaaaaaaaucuuuugaacagauuuuucucagagcuauuuaaaaaucccugauuuaggccaggcaccuauaaucccagcacuuugggaggcugagauggguggaucacuugaggccaggaguucaagaccagcuugaccaacauggcaaaacccccucucuaauaaaaauacaaaaauuagcccggcaugguggugcacgccuguagucccagcuccuugggaggcugaggcaggagaaucgcuugaacccaggaugaggagguugcagugagccaagauugcaucgcugcacuccagccugggugacagagcgaggcuccaucuagaaaaaaaaaaaaaauucuguagcauaaaaacaugacucuaagucucacagccugaguagccccagguuuauaaauccauugucagggcugcaaacaacuugagagcaaccugccuugcugauaacaagucagcaguguuacuagcauuugcuuguuaacaauaccucaauaagggacaagaagaagggaggugaaacuuaaaugugccaauuuugaaacuugcuaggcauucuaguagugaguuugguggagaaagaaguuaaaauuaucuaaaaauaacguuuuugaauuucuuacuaucugugccaucucuccauauguugucagaaucuuuuuuuuucuaauuuaaagcaucauuuauacccagaggaauaucauagagaaauuuugcuuacauggucuuuuugaaauaguuaagcaaaggacgcagccauuauuugguacuagguaaugggaaaagcucuggacaggcgagcaggaggaggcgagcaggcgagcagacuggguauauaauauugcugagaugcucaaccccucugggccauaauugguauaucuaagaaaugugaguugucaacuauaaaucaucucuaaucccucagugugaaaauucuguauucugauaauugucacauguacuuuucauucucauuuuaagcaugggaaccagggaguccaaagcuacugguagagccagagggguaguauccugggucccugugggaaggagugcugacugccccaguguggaaugaggaauucugcacaaguggcuuugggugggaagucaggaagaacucuggccccagaggcuucccaggaggcuccagaacuacaaaauguugccuugagauaaucuugugaguagauuuauuuuuaggcuauauuuguguucccucucauugcuaagauaagugacuguuaacuauacuaacauacaaggaaacuuugcuaaauuaucuuuuacacaagagagccuaucugugaaaguauccaagaagcugauacaagugaccacaagugaauuaauuuugauacaaaaagcguucauuacagcauuguucuuaagaaugaacaaaacaaaaacucaaaccacuuaaauaugcaucagcugcuuacauacaugagggugcuuccuugagaugaaacacugugcagcuuuagaacaagguuggucucuaugcacugauauggaaagaucuccaagacagauuaacuuaaaaaacaaaauacugaucucauuauguguaaaaaggcauauuguaaguuuaugaguacauacgcuuuuuuuuuagaagaaugaacaacauacuguuaguaguagaacuaugaguugaaagaaaaaguuuaacuuuuuauuuuauacugucuguguguuuaaauuguguaauaaaaauauauuuggcaaaggagggaauuuagauuucaguucagguuuugaggcauucuaguacuuccuuagaaaaaucuguguaaaaagugcaugcugagaaaaggugggcauugucuggaaacucuucaggcucccaauguuggguaacucccucacugcacuuccccagccuuuacuauccucuucucaaaacagaaaucucugguuauugauuccucuaacccagaauagucaauggcuccuagugucuauuaaaaaaaagucccgguuggcacgguggcucacgccuguaaucccagcacuuuuggaggccgagguggguggaucacgaggucaggagaucgagaccauccuggcuaacacggugaaaccccgucucuacuaaaaaugcaaaaaaauuaucugggcauaguggcgggcgccuguaauuccagcuacucuggaggcugaggcaggagaauggcgagaacccgggaggcagagcuugcagagagccaagaaugagccccugugcuccagccagggcgacagagcaagacucccucucaaaaaaaaaaaaaaaaagucccaaagagcaucauggcagagcagacaggguaugggccugcccugugaguuugucaucuugcauuugggcaauguuugugguggcucugccaugccccagucacaguguuagugcgggaauacaaaggugaacugcaugcugugaaacuguaugcaacuuccucuagccucagucuucccacuuacaagacaaguugucaggauuaaauagaacaacaaaugcacagagcccagaggacaauauuugcucgcuugccccauccuucucuccauguccaaggccagaugugaugccuacuccuccucugagugucuccuuugguucccauuucuaaacccugcauuguuccagaacgcaucgcaagcaucccuuccuuugccugguuguauugccccuuuccugcacugcccauugcuucucuuuccuggacaucauuagccuacccuuuaggagccaguucagaugcugccuccuccaggaaaccuuuucugguccagaagucaucucuuccucuuaagguuuuguguaguucuuucuagucuccuuucuuuauauugauucuaucacuuacagcauuccuccuuaguuugcagcuuucugugccuuacuaggauagcuuccaggggacaguaaccaaguuuuuuuuuuuuuuuuuuuugcuuuuuuuccccagcuuuacugagauauaauugacacauaaaaauuguauauauucaagggguagaaugugaugauuugauguguaaugauuaccacagucaaguuaauuaacacauccuucaucacacauaguuaccguguguguguauguguggugggaacacuuaaaaucugcucuauuaguaaauuucaaguaaacaauacagaauuauuaacuauagucgccgugcuguauauuagaucuccagaacuuacucaucuuauaacugaagguuuguaucaacaacuccccauuccccacccuccaaacccagccccuggcagcugcuguucugcugucugcuucuaggaaguaacucaguuuuguuaucucuagaacucaucuuugugcccguguucucaguaaauauguguuaacgaaugacuucauuuuuaggauuugccuaaauaucauuuuuacuuucacuuaagggauuauuuuaguuucaacuaaaaauuagaacauuuccuugaaauccacucuguuuagcaggcuagacacaguuucuuuccccaugcagggauuaaacuugaaaauuguggcuuuacuaacccugaggaauuuuuaggaggagaccaggcaggcaucuuaucucaguuggucuagacagucaccaccuuguacgugaguaauuggcccauaagcucuugucugaugaggugagauguuauccugauaauuuaaaaagcaaacauacuacccccauuacuaagacaacucccagcaaaaguaaaggaaauguauaaagaaaaaacaguaagguuauagaggugugugugaaaacaucuguuucauuucucauauuccuuuccauccucaucugugguuauauauagcugugaccauagaauauacacaguuuaauguucuguuuccucuuaacauuauuuuguacacaguuuuucauguuuuuauggacacuugauauguuucuaaaugaaacaauuggaguucaguugauuguugccuuuccugagagagaaauggagagugugaaacaaagguguaccuugagggaaugucagcaucaucuauuccuaaaaggcacggucuuauucugauguugcuaaauuuuacuggagcaaaaacauuaacaaaugauuugauugauguuugcagcacaaucaaugggauuaaggucuugagccacuggaaaaaaguuuucuuuaauuaaauacacaucuuuaagagauuagacagaguuuugcucaagcaauggcucuuuauuuagaaaagcuguugggaacagcuggaaggcagccuuuccuuaucaacaggcuuguauaacuaaccccaaguuguuugcuaauaaauuucaggucccuaacacuaauaggaugaaauaauuuuacauagaaggaucaaucucuaaccucuuuuuucagaagaaacuaaucugacuggugccuauaggcaaugagguguguuuaacauauggaaagaauuagacuaaauaccagaaucucuuugaaguuuguggauguagucuccaaagagagagaagggcauuuaaaauuaaacugcacagaauuauaacaagcacuuacuacucauucuuggaaugaaucuugcuuuggcccuaggcuaaauugucuagauuugugcuccuuuuguuggcuuaaagccacauucacuccuuuuuacagugagaaccaacugcuuccuagcacgguuuuguagcuuucuuuuauggagguucuuaauuauuuugcuauuucuuucaucaugcagagucauuaauacaaauguugauucaaaguaaauuuaccugcugggccagcuuaccuguuaggaauuaguguauuuuauaucaugaucacaccuuacuauacuuauuguauacaaucaaaucuccuauaauuucgcaaagggauacuuaucagacuuguguucccaauaguguguaucuuugugugguaucugugguuuuauuugugaaagaacugccaaaagauugguccagguuuguuucuguuuuuauuuaugacuuaaagagaggcauucggucuuacuagucacccagagcaguuucacuggaucccaagaagaccuaagaggacuguuagguuuguaagagaaggacugugcuaggcuguacuuagccauaacuucaagagaagaccuguauugggcuggaaaccucuuuuaaagauuggagaauucagaagaaaucuugucaaauaaaaacuuaugaaaugcuaucaguuucuggggcugaggcagggugccuggcacaaggggauucuaccagguucaagcugcuuagacauggcugacugacaccaaauccuguacauggcugcuguuuauuauugccagccucuuccuccuguucccaucacuaauucuugccuugcuccaaugcccauuuaccaccucugacacuuugaagcugcucuugcccugggauaaguuaggaaagccagagugggagaaaaguccgagguagaagugaggcgagaucucucuauauuuuuggcaguauuuucuaaaagccagggcugggaucagaauucaggcugccagcuguuacuacuuucacacuacuaaguccuuaaaguuaaaaauaaauuacaaaaucauucaaaaccauuaugaagucaguccaagacacagcuucaccaacgauuucauuaaguuuaaaaauucucucaucauucagucaacuaaugauuacuaaaugucuuacuaaagcaugcagaguugaaaaauguuaaagaaagaaauucucugcccucuaggacuuauuaaucuaguuguaagaaaaauguuaggacagaaauaauuggaaugcaauacagcauacauaagugaaguguaguaguugucuguugcugcauaacagauuacuaaaacuuaguagcuaaaaacaacaaaaaacauuuaugguuacauacacuuucugugggucaggaauuugagagcuacuuagcugguugguucuggcuugaggucucccauaggauuguagucggugagcuggccaggucaacagauaucugaacauucucugcggcuggagaauccaguucuaagcugguucacuuaugcagcuggcaagugguagucgcucuaggcaggaaaucucacuuccucaauauguaaaccucuucacagguuuauuggaguguccucaugacaugguggaugacucuucuuagagugagugauccaagggaacauaagguggaagccucagaugucuccuaugaucaagcuuugcuugaucuccauugcuguuggugugugacuuauugguuacacaggucauaugggaggggauuacacaaaagaaugaauaucaggaggugggaaucauugggggcaucuuggagacuggcuguaugaagaggcgaagaucugcauaauaauggaaagaaguguugggaugccucaaaggaaggaggcagaauguaaaauugauggauuuucaguagcugagguugagggaaaggguguuggcugagauagggcaucaggagcaaagcagggcggacagcagcuggugucaguguguucaagggacauuaauggagcaguguggcuggaguaaagccuggucagguaggaaggggucagggccuguagggucuugcaugccaagcuaaggaguuuggacuuucuuugauuauuagugaugggucuuugaagguuuuugagcaggcaacugacauaaucauuggcauauuuuagcuuuaguuuguguaugaccuuuaggguuuuggugcccuucucguuuguuuccaguauuauccagguagucagcucucuaauuucuaaaauuguguaacacuuuugcccaugucccuugaucacauacuaccuuguacuauuuaacuuuucguguauuuaucuuguuaucacaaguagauagcaagggcuauagggccaugucuuuaucuguuucuauuuccccugcuguaucuagcacacugggugcccaauaacuaccugcuagcugcuuggauaauagcagccaauugcuacauguguguacagccacuguuuucggccugucaugcauaauuuacaguuaagcauuuuucaaaagagggagcaauugcaguggauucgauuuacguaaguggaaaaaaguguucagaaucaguucugcgugcuuggcauuugccauaacauuuuuaggaaauuuggaauaauaauuuuauuuuuaaaaacucauggauuauuuuuagcuucaaagaguguucuuauuuugcguaaguuaaacuaaugaggcaguaccagccacggagugcaggaagggcugcuuucaucuuugaauagugaaaggcagccucuuucaugcauauguuuaugggauaaaauuccuuuuuaggauuuggggcagaguuuuuucccucuuaugccccuuaguuugaauggaauagucauucauuguccuuguauuuucguugcccggguaaguauuucacucaagagauaguuucaagaaaguuggagauuucuucuuucaaacuagcaaagacauuuuugcuuuugucucuugaaaaucucccucaaacuaaaagaaugaaaaucaggaaugcagacuguauccuuauaaaccuuggagacaucuguaacccugacccauacaggaccuaaagauagaaagcagaugaagugauggcaaaugcauuugcagagaggagaagugaagucaagaauaaaaugccugcagggcucaccgggagaggaccggaagcgauugauuugcucacagaaugccaggaaggcucagaaaugagaguuccccaguuccccagaggcauaggugaagcagaggcuuuaggaugggaguaggggugggaaagucugcaggagguaaaggggagccccagaaggacuugagaagggaaguucccuauugcagcucuggcccaaggagaagagcccaucuagaauagagcugaaggaggagggcuccaggaggaguguuucugggaggagcaggaaugaaacugauuagaaaagaagaaaaaaagaagaaugggccguacuggguuugaauucuuucucugucaccaaugaacugugaguaugaggaaauuaguuaaugucuuuggacuuuucauuuccuuauuuauuaaauaaaacauuauaucauaugguauuuuguuauucuguuggguaaaagacaguacaaaacccagcaagucuacuuccagaugucuaccccaaaaaaugaaaacauguccauacaaauacuuauaagcaaguguuaauagaagauuauacauaagagccaaaaacuggaaacagcucaaauauccaccaauuagugaaugaauaaucaauguagcauauauauauauauauauauauauauauauauauauauauacacacacacacaaugaaauacuauuuagcaauaaaaaagaacaaaguacuguaccugcuacagcaugggugaaucucaaaaacauugugccagguaagauaaaccagaugcaaaaggcuacauacugugugguucuguucaugugaaaugccuggaaaaggcgaaucuguaaacagcaagugauuaguggcugccugaggcugaaguaagaaugggaauuaacuaaaaauggcugcugugggaugaugaaauguucuucuucuuuuuuuuaaaaaaauaguauuuaucuuuaucugucugacuuuuauuucacuuagcauuauuccagguucaucuguguugucaccaauggcaggaguccuuuuuaauuuuguuuuuaaauuuuacuuuaauugacaacuaaaaacuguauauacauguguguacaacaugauuuuugauauauaugcauguuguggaauggcuaaaucaagccauuuaacacaugcauuacgucacaucccuuuuuuuucauauguggugccaauacugaaaaaucuacucuucuaguaguuuucaaauguacaauagauuguuauuaacugcugcuacugugauguacaguagauccuuuugaacuuguuccuccugucuaauugaaauuuuaugucuuuugagcaacaucuccccaucccccaaccuucaaccucuagucaccuccauuuuacucauuucugaguucagcuuuuuuacuacacauacgagugagaucaugugguguuugucuuucugugccuggcuuauuucacuuaauauaauguucuccagguucauccauguugucauaaaugacaggauuucuucuuuuuuaaggcugaacaguauuccauuguguauguguacuauauugucacuauuuauuccggaugaggaaauguucuaaaaauuggauugugguaaugguuacgcaacuguauacauuuacuaaaaaucauuuaauuguacacuuacaaugauaaauuauaucucaauaaggcuauggggaaaaaugguaacaaaagaagagucaagggguagagagguacaaaugaaacaagauuggcaaaauacugguuauuguugaagguggguuacagaugagaguuuauuauacucuuucuacuuucaugaaugcuugaaaauuugaauaauaaaaaguuuuuaaaagggcagucacaugcauguuauuguauggaugucagauaacacuugcagcgcuuuacagugguggauguucuaggcacucuugggacauaauuuuaccuucauuggaaccaaauccauaguauaucaauucacuuuuaacguguuagcucuucccaauaccuucuuuuuuuucuuuuuuuuaaauuuuauuauacuuuaaguuuuaggguacaugugcacagugugcagguuaguuacauauguauacaugugccaugcuggugcgcugcacccauuaacucgucauuuagcauuagguauaucuccuaaugcuaucccuccccccuccccccaacccacaacaguccccagagugugauguuccccuucccguguccauguguucucauuguucaauucccaccuaugagugagaacaugcgguguuugguuuuuuguccuugccauaguuuacugagaaugaugauuuccaauuucauccaugucccuacaaagaacaugaacucaucauuuuuuauggcugcauaguauucccugguguauaugugccacauuuucuuaauccagucuaucauuguuggacauuuggguugguuccaagucuuugcuauucugaauagugccgcaauaaacauacgugugcaugugucuuuauagcagcaugauuuauaguccuuuggguauauacccaguaauggauggcugggucaaaugguauuucuagaucuagaucugaggcaucuccacacugacuuccacaaugguagaacuaguuuacagucccaccaacagugggacuccacauccucuccacauccucuccagcaccuguuguuuccugacuuuuuaaugauugccauucuaacuggugugagaugguaucucauugugguuuugauuugcguuucucugauggccagugauggugagcauuuuuucaugugucuuuuggcugcauaaaugucuucuuuugagaagugucuguucauguccuuugcccacuuuuugaugggguugauuguuuuucucuuguaaauuuguuugaguucauuguagauucuggauauuagcccuuugucagaugaguagguugcgaaaauuuucucccauucuguagguugccuguucacucuaaugguaguuucuuuugcugugcagaagcucuuuacuuuaauuagaucccauuugucaauuuugaauuuuguugccauugcuuuugguguuuuagacaugaaguccuugcccgugccuauguccucaaugguaaugccuagguuuucuucuagggauuuuaugguuuuaggucuaacguuuagucuaacguuagaccuauaggucuaacguuuagucuaacguuagaccuauaggucuaacguuuagucuaacguuagaccuauaggucuaacguuuaauccaucuugaauuaauuuuuguauaagguguaaggaagggauccaguuucagcuuucuacauauggcuagccaguuuucccagcaccauuuauuaaauagggaauccuuuccccauugcuuguuuaucucagguuugucaaagaucagauaguuguagauaugcggcguuauuucugagggcucuguucuguucuguugaucuauaucucuguuuugguaccaguaccaugcuguuuugguuacuguagccuuguaguauaguuugaagucagguagcgugaugucuccagcuuuguucuuuuggcuuaggauugacuuggcuaugcgggcucuuuuuugguuccauaugaacuuuaaaguaguuuuuuccaauucugugaagaaagucauugcuagcuugauggggauggcauugaaucuauaaauuaccuugggcaguauggccauuuucacgauguugauucuuccuacccaugaacauggaauguucuuccauuuguuuguauccucuuuuauuucauuuagcagugguuuguaguucuccuugaagagguccuucacgucccuuguaaguuggauuccuagguauuuuauucucuuugaagcaauugugaaugggaguucacucaugauuuggcucucugucuguuguugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaagcuuccaguuuuugcccauucaguaugauauuggcuguggguuuuucauagauagcucuuauuauuugaguuacgucccaucaauaccuaauuuauugagaguuuuuagcaugaagcauuguugaauuuugucaaaggccuuuucugcaucuauugagauaaucaugugguuuuugucuuugguucuguuuauaugcuggauuacauuuauugauuugccuauauugaaccaggcuuucaucccagggaugaagcccacuugaucuugguggauaagcuuuuugaugugcuguuggauuugguuugccaguauuuuauugaggauuuuugcaucaauguucaucaaggauauuggucuaaaauucucuuuuuugguugugccugugcccggcuuugguaucaggaugaugcuggccucauaaaacgaauuagggaggauucccucuuuuucuauugauuggaauagcuucagaaggaaugguaccaguuccuccuuguaccucugguagaauucggcugugaauccaucugguccuggacucuuuuugguugguaagcuauugauuauugccacaauuucagagccuguuauuggucuauucagagauucaacuucuuccugguuuagucuugggaggguguauguguugaggaauuuauccauuucuucuagauuuucuaguuuauuugcguagagguguuuguaguauucucugaugguaguuuguauuucugugggaucgguggugauauccccuuuaucauuuuuuauugcgucuauuugauucuucucucuuuuuuucuuuauuagucuugcuagcagucuaucaauuuuguugauccuuucagaaaaccagcuccuggauucaugugucucuguuuccuucaguucugcucugauuuuaguuaugucuugccuucugcuagcuuuugaauguguuugcucuugcuuuucuaguucuuuuaauugugauguuaggguggcaauuuuggaucuuuccugcuuucucuugugggcauuuagugcuauaaauuucccucuacacacugcuuugaaagugucccagagauucugguauguugugucuuuguucucguugguuucaaagaacaucuuuauuucugccuucauuuuguuauguacccaguagucauucaggagcagguuguucaguuuccauguaguugagcgguuuugagugaguuucuuaauccugaguucuaguuugauugcaguguggucugagagacaguuuguuauaauuucuguucuuuuacauuugcugaggagagcuuuacuuccaacuauguggucaauuuuggaauaggugugguguggugcugaaaaaaauguauauucuguugauucaggguggagaguucuguagaugucuauuagguccgcuuggugcagagcugaguucaauuccuggguauccuuguuaacuuucugucuuguugaucugucuaauguugacaguuggguguuaaagucucccauuauuauugugugggagucuaagucucuuuguaggucacucaggacuugcuuuaugaaugugggugcuccuguauugggcacauauauauuuaggauaguuagcucuucuuguugaauugaucccuuuaccauuguguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacaugagaugcauuuccugaauacagcacacugaugggucuugacucuuuauccaauuugccagucugugucuuuuaauuggagcauuuaguccauuuacauuuacgauuaauauuguuauaugugaauuugauccugucauuaugauguuagcugguuauuuugcucguuaguugaugcaguuucuuccuagccucgauggucuuuacaauuuggcaugauuuugcaguggcugguaccgguuguuccuuuccauguuuagugcuuccuucaggagcucuuuuagggcaggccugguggugacaaaaucucucagcauuugcuugucuguaaaggauuuuauuucuccuucacuuaugaagcuuaguugggcuggauaugaaauucuggguugaaaauucuuuucuuuaagaauguugaauauuggcccccacucucuucuggcuuguagaguuucugccgagagaucagcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcauucucuguauuuccugaaucugaauguuggccugccuugcuggauuggggaaguucuccuggauacuauccugcagaguguuuuccaacuagguuccauucuccccgucacuuucagguacaccaaucugacauagauuuggucuuuucacauagucccauauuucuuagaggcuuuguucguuucuuuuuauucuuuuuucucuaaacuucccuucucacuucauuucauucauuucaucuuccaucacugauacccuuucuuccaguugaucucaucggcuccugaggcuucugcauucuucauguaguucucaagccuuggcuuucagcuccaucagcuccuuuaagcacuucucuguauugguuauucuaguuauacauucuucuaaauuuuuuucaaaguuuuuaacuucuuugccuuugguuugaauuuccuccuguagcucagaggaguuugauggucugaagcuuucuucucucaacucaucaaagucauucuccauccagcuuuguuccguuccuggugaggaacugcauuccuuuggaggaggagaggcgcucugcuuuuuagaguuuccaguuuuucugcucuguuuuuuccccaucuuugugguuuuaucuacuuuuggucuuugaugauggugauguacagauggguuuuugguguggauguccuuucuguuuguuaguuuuccuucuaacagucaggacccucagcugcaggucuguuggaguuugcuagagguccacuccagacccaguuugccuggguaucagcagcgguggcugcagaacaguggauuuucgugaaccgcgaaugcugcugucugaucguuccucuggaaguuuugucucagaggaguacccggccgugugaggugucagucugccucuacuggggggugccucccaguuaggcugcuugggggucaggggucagggacccucgugaggaggcagucuguccguucucagaucuccagcugugugcugggagaaccacugcucucuucaaagcugucagacagggacuuuuaagucugcagagguuacugcugucuuuuuguuuguugugcccugcccccagagguggagucuacagaggcaggcaggccuccuugagcuguggugggcuccacccaguucgagcuuccuggcugcuuuguuuaccuaagcaagccugggaaauggcgggcgcccuucccccagccucgcugcugccuugcaguuugaucucagacugcugugcuagcaaucagcaagacuccgugggcguaggacccucugagucaggugcggguuauaaucucuuggugcaccguuuuuuaggcccgucggaaaagcgcaguauuagcgugggagugacccgauuuuccaggugccgucugucaccccuuucuuugccuaggaaggggaacucccugaccccuugugcuucccgagugaggcaaugccuugcccugcuucggcucgcgcacggugcgcugcacccacuguccugugcccacuaucuggcacucccuaaugagaugaaccugguaccucagauggaaaugcagaaaucaccugucuucugugucgcucacgccgggagcuguagacuggagcuguuccuaaucagccaucuuggcugccacccccaguaccuucuuagcaggaacuugagaaaaucaugguaaucacauccucagaaagaagguuaaauuugguucagcguauucucuuuaagugugguacauuuuagaaaggguaaaauuacaaugagcuuuacugcuuuacaggagaaucuucaaucuuuaaaaaguagaccaucuaaaacaaauguuauuuguaaaagcacugaguaauggaauuuuuuugcauguccuugcaacuuagaaacgauauugcauuccugacucagucuauuaucaaagcauauaaaagagugauaguuaccauuuuuucuugcuuacuauguacuucucuaaggaucuguuuuccagucucauaauuaacauucuuaaaaagguaguuuuuuguucccguuuugcaaugaggaggguugaggcacagagaaacugaauaacuugccugagauccagcagcuagucacuguuagugcuggcucugcuugacucuacaggcuaugcuguuaccccuuuaugguugcauuggaacauauuuuucauuaaaagccuuuuccccacaaauuucaguuuaaccuauguguuaugcuuucuuuauggaaucuaugugagguaggugagaaagaggaggugauauuuuccuagagggaagaauugcaggugcagaugggaguuaaaggcagugaccaucuccgaggcacaguuuuagggugccucacacuaaaagcauuacaagugggccccaagcuuugauuugaagguaguggaaacaguuguuugcaauucagaauucagauccuuauucauuggcaagauuaucauaagucuccuaaccagucucccagcuuccgguccauuccuggacuugccacccaguugcauuacuucuuauguaaaaacccucaaugaaauggccuuacguuccuacagauuaaaaucugagcuucguaguuugguguucagagcucuucaugucuuccuucaugcuguuuuucuauccucccuucuauuguuccccauugggcacucuaugcuuaugccaucuagaauauuccacaauucuuaccccucugucaguuggcuuguucccagugacuauaauucccuuguccgccuucuuuacuggccagauccuauucagucuucaaagccccaaauaaaaaaaaaucaucuccuaugggaagccuucuccaguccucucucagcagcagcagcugcuucuuucccuggguuuucaugacacuuucugcacaccuugauuauaugugguuuugccauuauuuauaugccauagcuccuucaggcuggagacauuggagucccaucuguaucucauuacucaggucugagucuagcacgagguaggcccucagggaauauggguggaauuaacuuuuuuguagaacugugauuuaugauuuuugaaaugaacaaucuuaaagauagaaaauaaaaauacauuuaacaagucaucuuuaugugaaaaaaacaaccaggaaucaaccuggaaguauuaaggcacauauuuguaguggaccagaaacgcaguccuauuucuuaggauaaaauauauuccaagugccaacccagauacugaggauauucccacuauaccuucccuacuccaagaucucauuuaacuuuuuuguauuggggaagauaugggagaaaugaaagucuaggaacuagagaggugugaaacagauguuccuaagaauuuucuaguuuaucuucaggaaugaagguaccacuuugauuacauaauuuccaagguccugucaugcucugaaauaguuuuaguuguuucaguccccaucucuuagcaaauaagggaggaguugguuauucacucaccagauauuuugaaucauaggaccauuauuuaguuguccuaguuggggucaggcuaacuggccagugcauugaacuugaccuucaaaccaccuguugaauuugguuuuaagguauagcuucccuguaacugcucacugguacuuuaugagauagaagaucugugcucucaagggugacaaccucaagaaacuuacauuccaagagagagaauccagaaauauggacauccuuuuauuagagaaaaugauuucuagagaacacuaaauaguuuuuuucuccucuauuuuuaguauguuuccugcuagaaucccauuuucuccucugcuucuaguauguuuucagcuagucacuggguaaauguaaaaguaaaaauucaccugucuuugggaaggauguuuugaaaaugauuuauuuuucucuugagaauuggcucugcugaacugucaaauuauucaccuuuaucauauugaauaacaucaucuucugccacuccuuuuaccccacagucuuucaguggacauuucgugagcucaucuggaggguguugcucacuugaccaucaucuuuucauuagguuagcuggaucagugcguuaauuuccauucauaauuaacacuuaaagcuuaugaccuaagaucguucaccugccaaaacaagcaaaaacaccaaacagcaaacucucuuaucauaugcugagaugaaaaggagaaugcuuuuuauauauuccugggcuuucucucugcccuaauuuugcaucauuguugaaggagagaugcuuccuaauugagauuucccauuccugaguggagacauuauugcgaauuguuacgcagucagccauuagaaguacaauuucugccgucauucauuugauuuuaucauguguuagaacuuugcuuggaaggaccuuucaugucugacacacucuucagcuccuccucccuguuagaaagacucccuucaugugccuagugcccugaaaaaaccacacacuaggaaaugaggaaaccagagccugguuuccccacagauuccuuuaggggagcagcuaugcagccaguguaaacauuccaauucaauuagagauaacuucuugguuuuccauuacccaugccagugaggucaugaagaauaugcuuacuuuaaugaguacuguguuuuguuuaaaguguaugucaucuagaaaaugcucagaguuuggaagucagaggcuugggucccaguuaauguuuugccacugacaacauguuaugcagaagguguuucaccuccuuccuucucccucugcugucucauuccugguacaguaugagcagugcugugugcucuguaaugggcucaguuagauggaccugugccucuugugggucaguaaagcuacauaccuugacuugcaccucagagcucucaaagguuggugacagggcuuuugcuucccuuaucauuuggguagaaguggguguaguagauccaaaaagauguguaauggcauauuaaccggaaagguugaaugcuugcuucagacaaguagaacauaaaauaaaaacaaguugaauucaaguagaaguuucaugcaguaaccaugagcagcaacacaaacaacagggagacagagagagccucuuccaagcagggccacacagauucaugagaugguuccccuucccaguucuuuagucacauuguuuaagugaacccuauaguaagaaguaaauaugaaacagccacacuuaguuucuagaaccuugugcgauagcuccccacuauuguaaaggggugaaauauuuuaccuaaguaaacauacccgguaagugaguucuaaaugucaguauuugaauggagguuuucucagccuuuucucccucugucuucugaguauaaauggagugacugcccuccugagucuccuuucuuauggcuugagcgaucuuucuacgauacagaucggauccugucauuccccagcuugaaauucuuucugauuuucuuuuuuccuuuuuuucaaauuuaaguuuaauuuuuauuuuuuguagagauacggucuugcucuguugcccaggcuggaguguaguggcaugaucauagcucacugcagccccaaauaccuggccucaagugauccuccugccgcagccuccuguguagcugggauuacagguggcuuggcuaacccagccugaaauucuuaaaagugcuccuccugcuuucagaaucaaguucaaacuccuucaccaaacauauuaaaggccucuuuaucugguuccuguccagcuuugcagccucauuuccuccugcuuuuccaaaggcacucacucugugcuuuugccauucugaacuguuucuuaccucuaaacuaaacacacaauucccuauaauggucccucagugacccacagggaaaccugauccccuucccugauaccaugcacacaccauaggcaaaguccuuaaaacuugcaccuuagaauuaccugaauaugaugccuaguccucacaguuacucucugguugggaauguugugcaaagaccacgauugcaugagcucacuucuaugagaugaaaguaacauaacuguuccuguuuucuuuccagaggauaauuuccugucagugaaacugauacuauccuuuuagaaauuauuuucaguuaucuucuauaucaacuguguagcacagguuucccuuuuggaugcaucaggaagcaaaucagcauauuucuguuuaauacaaauugauugaagugauaaauucuaacucuguguuugaagcugcauuguaccagaacagaaaagucccaaaagaauggugaggugaaaauuaucugaaaaaugauauauaauuaaaaucauuuaugaaugagucaguguaaucugcauucugcuugacauaaagagaaaauaccacauuccugggagggaggagggaggugaacgucaaucuguaaacuccaagcuggaauaacagaggaagagcuauuggaaguguagauuccagugcugugaacucccaguuauaagaucacucuguaagcagaaucuaaauaagcugauuuacaaaggaaaauaaaagguuucagaaaauaugggguaucuuaaaaaaccucuuugauagucauuuucgggcuuucuucccucaaaaaugaacugauuuuucaaaugacuauuuucuuaauugaauauguugggaaagauacauauuuucuaguucucaaggaggagaugaaauuuccaaauaucuguuucaguuucuaacaacuauuaaaauguauaggcuuuaaucugagaauauguagaugcauuuuauuugaguggucauaucaauucuaauuuuaaaggucauuugggccuggguguggugguguacaccuguagucccagcugcucggaaggcugaggcaggaggaucacaugagcccaggaguucaaggcuguagugcacuugaucacaccuuugaauagccauugcacugcagccuggcaacacagugagaucccaucuguuaagaguuuuuuuuuuaagucauuugaaacaaaguuuguuaaacuccauugccucaaaucuacuuuuugcacuuuauaaagguuaucuaaauuucuagaccucgcuuuauaaaugacacauuacaaauacccaaaucaugauagcucagguauacuguuggaauguuuauggaaauuacuuugcugagguauggguaggccagaggaaccugcauguuaauaagggucccuuguucauucuuggauggagggccacagggugagcaacacugcccuaaaaucuccauccucugagggcucuugaggguucccacuuaccugugccgugcaccuggcuccggauccuucuggccacccuccaguguugcgugugguuggccuuguaauggacugccugcgccgcccugcccucaaccccgcugcccaccaccucccagauaaggagacuauauugcuguuucacaccuccauccuuccagaaaacaggacuuccuaugaauuccucugaauuaccaacccccucuaccucuagcguggagaacaagcuauaccuuuuggcaaaacuugccuaaaugaucagaaaacagaaaagaagcagaagagcuaggugcuuaggaucuccuagugaaugucuucuuucuuugauccuuacauuuccuucuuugauccuugcuuugcuuugcuuuucucuuuucuuuuuucuuucuuucuuucuuuuucuuuuuuuuuuuuuuuuccaagauggggugucucuauguuucccaaacuggagagcaguggcuguucauaggcgcaaucccacuacugaucagcacaggauuuugaucugcucuguuucugaccugggcugguucuacccuccuuaggcaaccuggugguccccugcuccugggaggucaccauauuggugcugaacuuaguguggacgccugaucgucauacagcccagaacuucugggcucaagcgauccuccugucuuggccucccaaguagcugggacuaugggcacaugccaccgugccuggccuugcuuuucauuuuuuuuaugaaauauguuuuuuaaugaauaaaaaauuuuccuaggagugauuuucccaaaagggauacccugucccagugauuauccaagccauuaccuuuuaggagccuagaaugguuuauacuugguugguugguugguuuguuucagaaguaauauguauucaaggaaacaccucauacuuaaauaaaggcuauaggguaaaguaaaauaaaacaaauaagacaucuuucucuuuuucuacuuuacaguuaaaaguagcuucccagaaauuuccuaugcauauuaaggcaugcacguuucauacauauauguacaaauaggaucaaacuacuguuuuuuguggacucuuaagaugcuauugauugguacagcccaauuucaaauauguuaaaauaugaaaugauguacauuuuauaguugaugacauacagaaaauuacucuuugggacucgccuuuuuuccacauuaaauacuuugaacaucaguucauauuaggaaggagagaaaucuacuucauucuuuuucuuucguaguauuccauauucuaaauccauauuaagauauguauucuguauuccaaguccacaaauauacuaugguuuaagaauucgcuuauuguugaacauucuuguucuuuacugauuuuuauguuauaaauaaugcugcaauaaacaaccacguuuauaugucauuacauacaagcaauuauauuuauaaguuucuggaaguguaauugcugagucagaagguguacauacaguacuuuuuuuguacaacuuaaaaaaaucuuuugcuagcuucuguguuuuucaguguuagaaagaaccaaacacacaaaugagcagcuucugccaagguuccuuguagagaaaaauuucuggaaagauggauagaugcauauaguuaagcaucucuauguauccauucauaccaucguguuucaauucuaaggugcauauuuuucauuuuuuaacaauucucaauuggagauauguuguauaaugcaggugcacagauaauacuacagucuuuuccccaaaaaauucugcguuaaauugugcaucuuacaaccaaugguauuuuagaaucauggaaaugcaaguguauuuuaguaagacuguguguauauauguauauguccuucaagauuuauuuggaaauuauucuaauuuaauagugagaauguaguuuuaauuguuuucccauuggagcaaucuuggaaacaagccagaguuuugcagacaccccauguuuaucaguagcuaguacuguccuuuggagucugcacaugugauuuaaaagccagccuucauuugcuaaagagccucauugcaaggaaaaaucaaaucacaaacagcaccuugaaaaauacuaauaucauguuacuuagagaaguuagaaguuuauucuaaccccuguaauuuacagaugagcaaacuucuuguggugcaacauguggcauuuugcaccucuugcccaacugauaauugauauuaaaauaauauuauuagauaaauauuacaggaaggcacacuaguugugaacugauagcguucuugcaaaugacagcauucccucuuuccugcagguuuuccagaagucugccgccugugaacucuccuaggggaaucuguaucauuucccaagggcuugguguuggcaaguuuugucccucacaucuguuucucucuuucuguuuaauuagcuuugaaaucuauauuuuucucucuucuacguuucccaccuuuuuuuuuuuuuuuuuuugguuucccagcugugugugcagugcaucauguaggcugugccuuccugccucuuggcacugaaagguuuccauugcaucaggguuggccuugggaggaggucuuaaacaguuggcacuuaauaaauggucuugacuguauaagcuuuuuuggucuuucuuaagaccauucuaggcugggcacaguggcucaugccuguaauccaccacuuugggaggccgaggcggguagaucacgaggucaggaguugaagaccagccuuucaggacggugaaaccccaucucuacuaaaacuacaaaaauuagccaggugcaguggcaggugccuguaaucccagcuacucgggaggcugaggcaggagaaucuuuugaacccagguggcagagugagccaagauugugccacugcacuccagccuggguugcagagugagacuccaucucaaaaaaaaaaaaaaaaaaaagaccauucugauauugcacuggaagagcaucugagccagcgugcuccuuguugcuccauuugacucaugcucucuccaguuaucuaucauagccugguaaaaaggcaaaagcaguugugcauguaugugauaaaauugcuaaacuguuucuuguuaacugucaaguggcauugaaggagacaguuauuuacauuuucaguugcuuuuugugaaauacaaagaucaaagaccuuuacugcaguuuccuccucuacucaaaccacaacuuccuuccucuguguuaaaagccucugcaacaugcauugguauucuacuuucucaccuucagugacaaauaauaauuuuauugugccaagaugaaauguggucacuugagggcuuuucugugggugccucugcaucucugaauggacaccuuuggaagacacuuaccauacuuucagcagcauuuuuaguuuuuauuuguuaaaggaaaaaaagacuguagaaguguuccugacuagauuucaauccuuuuuugguuucuggacccuuuugagaaucugaugaaagcuugaggguggugaugcuugucacaggggcagcugccacaggggcagcuguggcucgcuccagcacauucuccaaaagggauucccuuucaacaguuguuuaaauaagauggcaagaagauggcucucaagacuauaaugaaaagauaacaauagaggaaauggcagaagagcaggguggguaguucugcacgugaucgaagcaucgguguucagacuaugggaggagcaggggaggcaaugugggagcauucagagugacuccccacucacaaaagacacaucaccccagucucaggacauucugauaaccccaaagcccaucuaggggcugcuagggagucugugggccucagguuggaaaauucugcucuugucuuauuggcauuuaacaugcgggcucaagaagucuggggcggaccauuaccugaauuucagcucuaaugcuucccaagcgugaggcuuuggcuagucaagucauuugcuucuuuaagccacuguuuucccacugaaaaugggaagaaauaaaaccagacacacaggacuguggagggccaacugggaugaccugaauaaaacaucuggcacauugucacuuaguaggaucucaaaaaguggcuguucuuuucccuucuucuguccaucuuugauuucuuuuauggggagagguuuucuuccccaaggagaugguuuuuagagcuguggaaaucagcuacauugaggcuaauuguaucugucagaacucagaugcauuugcugauguagagguuaggaaacagaugucacucuuucgcucccuggacucccuccacaagaugagguacuacggcugguagacacugggcugaggcuagaaacaugguaaggucguccugggagagcccugaguggagggaauucugugcuaauucccagaaauugaacuucuccuaggacaguuaccccagcagggauacuucgcuggagaaggccaaaggcuguaggccaaggcagcgcccacuggaggacuacagggcaccucucacgguagggacaaggaagaagaucucagaaaacuuugagaggagagagagcgaaaccuggucugggccaaagccuaguccugaaggcuuauuaaaaugcuuugaggccaggugcgguggcucacaccuguaaucccagcacuuugggaggccgaggcagguagaucacuugaggucaggaguuugacaccauccuggcuaauaugguaaaacccugucucuacuaagaauuagcugggugugguggcacgugccuguaaucccaguuacuugagaggcugaggcgggagaauugcuugaacuggggaggcggagguuacagugaguggagauugcgccacugcacuccagcuugggugacagaucgagacuccaccaaucaaucaaucaaucaaucaaucaauacauuucucugagagcagggguuggcccuucucuccccugucugguccccuucuccuuccccauacucuuaaaaccuacuuaagaguuuucaaacaaaagcauuauacuccaaagccuuaaauauuccuagcuuuguuuugguguucauuuuaucuguuuuuuguuuguuuuguuuuguuuuauuuuuugagacaaggucuugcucuguugccuaggcuggagugcaauggcaugauuauaccucacugcagccucaaccuccuggccuugagcgauccucccacuucagcccccaguguaguugggacuauagguacacaucaccacaccuggcuaauuuuuaaaauuuuucauagacauggggucuugcuaugaugcccaagcuggucuugaacccuugggcucaagugaucuuccugccuuggccucccaaagugcugagauuacaggcaugaguuacugugcccggccuugguguucauuuuaaaggaaacaaaagguugaaauggcacugugaauuuugaacagucaaauaaauauuaaaaacccaaugaaugggcugggcgugguggcucacaccuguaaucucagcacuuugggaggccaaggcagguggaucacaaggucaggagauugagaccauccuggcuaacauggugaaaccccgucucuacuaaaaauacaaaaaauuaacugggugugguggcgcaccuguggucccagcuacuugggaggcugaggcaggagaaucacuugaacccagaagguggagguugcagugagccaaaauugcgccacugcacuccagccugggugacagagugagacuccgucucaaaaaaaaaaaaaaaaaaaaaucagugaaugaacucauaucaauggaacgggcaaauaaggugauuagcaagagcagaguaaaauuauuaggaagugcugaugaagggacauuguggguguucacccgugaaggagggacaaagcucugguuuauagaguuugaguguuaagcagaggaaugaaaguauccauagaccuguggugcuuaacagccuaaauguucaucaaauuuaaccaaaccuaguuuaacuaagguuaacuuuguugcaguacuaccacaggauggacuaguguggaaccaugacagaaagaaaaaagagcuuuauauauugacuaugaaagauacacuauaguauuaacuuuuaaacuaauguauauaauaugguccuguuuaaguaagaaagaaggugguagggcaaaggauaggcaugcuuauuugguauuuaaaacuuugggaaaaaaaauaaccaaauuauuaucugggauucuagcugggaauggauuggggaggagucugguuugacacagcaguuugagccagaguuuggaaacagagcuggauucaaauucugacucugcucuuucugcuauuguaacuuggcaauuugcuuaacuacuuucuuacguaaaauggaacucaucaaagcacugaccucauaucacgaggaugaaaauaagauuaaaaaauacuuaguucaaugccuggcucauaguaagugguaagugcucaccauauuuuaauuuuuacauagaacaugucuuacuuuuucauuagaaaaaaagaaaauagaguuauuucagugggaaguagugguugagguuaagaggcuuaaugacauacaccgggacucaaaugacaccgccagagggggcacauuuguuuaaagggaagagugugaacuuguaaaguuuaggaaauaagaauguagcugggcucgguggcucacgugugaaaucccagcacacugggaggccaaggcaggguggaucccuugagcucaggaguucgagacuacccugagcaauauggugaaacccugucccugcaaaaaauacaaaaaaaaaaaaaaaaaaaaaagaauaugaagaucuacauucagaaggaaaauguuggguaacuacagugaaagaauaccaaagggcagagguuagcucucagaucaugcagaauaggcaaaugugguaauuaaaaguucuguagauucugaauagaauguacauuuuuaaaagggaaaaugaaguucacuaggauaaucuguacuugggaaaauaggcuaucuaauaaaaaccgggacaaauacuuguuuugauuauuauuauaauccuuacuuggcuuaauauuaagaaggguuaaauuauauuaaaagaaccucaaugaagauggggaagaauuacacugagaagauauuauaugcagugaaaaugguugacagugcuucagaaauuuccagaacaauuggguaagaguggucagcuucguauuugucauuuuuguuauagauaauuaguucaaagccaagaaucuauauuugaguucaagacuacuuaacagcuccaaagaaaauucuucugcuuauuuuaaaagcccacuuuuugaaaucugccacaagcucaaaggaguuuuacagaaaccuuaaagguacuuggaagucugagggcacucagcuuguaaugaaacaugaggcuuugggggccaggguggagggagagaaggaaggggaguagguuuugcuuucacuuucuugagaccaccauugccagagcugccaaacccccaaauccagagauguuauacuguuccuaagggucucauaauaggcacgggcuuugacauuuucuuuuauuuuaaagaugcccuacaacagggaagauaugcauuugcuaaaguuuaguacuugccaaaauaugauagccuccuuuuuaacaaaugauguuuauuaauagaauugucaguaccuuuaauaauuucauggaaguacaaauuaugugugcuuauuuuaaauucugggacugguauguugugaagcagccuuaagauggaaugcuuuuauuugguacauauaaacauaaugugauccuugugcuuaagaaguuuauacacuagcuggagcaacaaggcucaagcacaugaaacauuuugcaucucacuuagcuuuugaauuaagugcuaaaguguaugcugcugaccaauucauuuauucagcaaauauuaaagugcuuauuauucacuaggcauucauguguggguuuugagguuaaagggacaaacaaaauuaaguuaguuuuccuugcuauagacagaguaaaugcaacuagcauaaaaucuaguagaggcagcauaauuacugguuaagaaugaccugugucaugacacaugccuggcauuacaaucccagcuacuuggguggcugaggcaggaggauuacuugagcccaggaauucgcaucuagccuaggcaauauagcgagaugcugucucuaaaaacaaacaaacaaacaaacaaacaaacaaacaaaaaaaccaugucugucgucuguuuuguucauuugugaaucuccagcacaugggacagggucuggccagugguaagcacucaguauuaguugcugacugaauaaaugcugauagaaauagucccuguccucuuggaacuuacaaacuagugguaagaccagguuuucccggauauguucauauguucugugaaauguuuccucucucugucauauacacaugcacacacacacaaaaacagacagauucaaagacauacacggugcccuguggucuuguugauggagucuggaacaaaauuuguguaucaugcauccucuccauauccacaaacuuuucuucuaaccuuguccaacccaaaucaguaagaacuugaaacacucacaggugguagaguugaguucauaucacugauugggauuuguuuuuuuguuuuugagaaccagagagacaguacuguguagugguuaaaagcaucagcuuuggagccagagagaaauagguccagguccuggcuuugccuuggauaaauuucuuaagacugcauaagccucaauuacuuuaucuauaaaaugaggacauuaauaggaccugcuuuucagugcugucaggaguuaguaagauuaaagcauguauggcgcauaguaaaguacuguacucauccuaaccacuuacuacaaguuaccaauuauuuauuuuuuuucauuauuuucugucaccuaggcuggagugcaguggcaugauuucggcuuacugcagccuccaccucccggguucaagcaguucugcugcuucagccuccccaguagcugggaucacaggcacucaccacuacgcccggcuaauuuuugugugugugugguuuuuuguuuuguuuuguuuuguguuuuguuuuucgagauggagucucucuuuguugcccaggcuggagugcaguggugcgaucucagcucacuacaagcuccgccuccgggguucucaccauucuccugcuucagccuccugaguagcugggacuacaggugcccgccaccaggcccagcuuauuuuuuguauuuuuaguagggacaggguuucaccauguuggccaggcuggucuugaaccccugaccucaaaugauccaccuaucuuggccucccaaagugcugggauuacagguauuagccaucucaccuggccauaaguuacugauaauucuuauuccugaaaugggagaagaauccuuauuauguguguaugcaugugugugucuccuuacuuuuuucuuaucaaaaaaacaacagacaauguguguuggcauaaccaguagauuggcacacauuugaugagaauacuguagccacagucuagcucccaggggaacagugccuuucaggggcagugcugugccacugucugcagaaguuggagucaggcccaguguuguugaacacacugaggaagcuggcagaagaccccgagguguaauggacaggagggaagcaugugggcuguucaugaccuuggagcuuuuuuacaggaaucaagcuuugcugucagcuccugacagguuccugguagugucgucuaucugaagaugaaccccaccuccaccacccacacacacagaagucuugauugcaguuccuguguggguccucugggugucuucacacacacagauuuguuuauuauuuuaaaugaacuuggcauuucucugaggcugguuuaauggugcccauuaaagagauggcagcuccagaguuucuucauuguagagcuggcauuuuaccaugugaggaaguaauucugucuuccuaccugugaggcuuauuuucuaaaucuccaaaacuggaguguuuuuaguugcaauguuaaagcugaaauaaauuuuuaugcacuaguuccuguucaccuaaaaggguaaagaacuuugcagauuagaacuacaguugaccuuuuucuaguucuuccacuuuuuuuuuuuuuuuuuugagacaggaucuuccugugucacccaggcugaagugcaguggugagaucauagcucacugcagccucuaacuccugggcucaagcgauccucccaccucagucuccugaguagcuggaaccacagguaugugucaccaugcccagcuaaguuucauauuuuuuguaagaaacgguuucgccauguugccuaggcucuuuucgaaccccuggguucaagugauccucgcaucucgaccucccaaagugcuaggauuacaggcgugagccgucacaccuggccuucuccacuucuuucuauguccccuaaucauguugauucugguaccaagauaaagaagacccuaguguggagagauacaaugcauuuuugaguuggguuaaauugauuaaaugacuuacuugaugguauugauaaacucuaaggcagagauucucacacuuggcugcacauuagaaucucuuucaaaaauccaggugccucaggccuacuccagacuaauuaagucaaaaucucugagggugagacucagguaucaguauuuuuaaaaccuccucagaugcuuccaacauguagccaauuuaagaaccagugcucgagaacauggcucucaacugggggcaguuuugcccugcccgcaagagacauuugguaauauccaaagacaauuuuagcaaacugggagggguuugcugcugguaucuaguggguagaagacagagaugcuucaaagcaucccacaaugcacccaaaagcuccccauaacaauuaugugggccaaaauaucaguagaaccaaggcugagaaacaauguucuagaaaaaucaggcugaagaaaugccagagcaauguauaugccuguugugaggaaauaauagcauguagaacuuuacauuuuuagccacccggcaagauaauaaaaaggaaguaguuuugccucugcccuuugagccucuucugcgucugccaucauggaggccuguccuuguggcuggugcaccuccugguuccgauuucuuggguaggacuucuuccuguaguccauaaauuuauuguacuugaauggcuuggaagaagacccaaguuaagaacauuaaaccaauagaaauuagccaaaauaaauaauuuuuaaauaugcuuuuaaauuguuuggccugauauaaaguuuucuaaaauuacagaaugaaccauuugaaagugauuauauaagaaauuauauaagaaaucugauucuaugugcuguagagacuuuuuauucuuucuuccuuuugauuagauaaggggaggcuaagaaaggcauuuuuuaauuguaucaaaaucaguuuucuuuaauuuugagauauucaggaugcuuucauagcagguuauauugaccuauauuuaucaucaaauauuuaccuuauaugauaauaauaauaauaauuauuauuauuauuauuugagauggagucucacucucuugcccaggcuggagugcaguggcgcgauuucggcucacugcaaccuccaccucccagguucaaaugauucuccugcgucagccucccaaguagcugggauuauaggcauaggccaccaugcuggcuaauuuuuuaauuuucguagagacggggguuucaccauguuggccaggcuggucuugaacuccugaccucaaguaaucugcccgccuuggcucccaaagugcugggauuacaggcgugagcuccugcacccagcccuaccuuauauaguugauaucaugaucuuuauuuccuuuggacacauccacuuuuccagagugugggacacauaaaagaucuucgucauaaauaaguuguguuuuuuucuuguaugcaguugucaaauuuagucuuuaaucaagguggugaauuuaauugacuuaccaccuugauuaauuauauuaauuaauuauagucaaacauuaauuauagucaaacuguuuucuuccccaaaacugaucaaaguagucacagcucuugaaaugcucugaauucauugaucuuuugcaggugauugauugacacuucuuuuuuuuuuucaguuugucccuuuaaacggggauuucaagugguaccuuuagugcucuauaucagccuuuuguucuagaauggauuucuuuuugagacaggucucccucuguuagccaggcuggagucuggagugcaguaaugugaucacagcucacugcagccuugaccuccugggcuccagcaauccucccacgucagcuuccugugucgcugggacuauaugcaugugccaucaugcuuggcuaauuuuuuuuauuuuuuauuuuuguagagacgggguuccccuauguugcccaggcuggucuugaacuccuugacucaagugaaccucgugcuucagucucccaaaaugcugagauuacagacaugagccacugugccuagccuagaacuaaauugauguacauaugaaucuggagugauaccuguuauaguuuuucaguuuuuuuucuuccuccccccgcauccuccugcccccuccccucuccugucccucuuccugccccuccuccccuuccuccucaccaucucaugaacccuugacuccagcguaaugcaguuuauuaauucagaaaacauuucagaaccuaccaugugcauuuugcauuaauuacuauacugguuuuaaaaauuguuuuagccuauuauaggguuauuugagacacuaagccaguacucuuacguguuugggucccuuucacuuccagugguuggaauguuuuaaaauaagacuagaagaauaacagcucauaugauauuuggcaugaauacuccuucaguuuuggaacaacauaccuguuucuucauugaauauuagcagugacuccauaauucaagggauacuuuaauuguagucuaauccuggcuuuuguaacugugcuuuuaacuuaauuuauaauugcauuaaaaguauucuuggccaggugugguggcugacaccuauaauuccagcacuuugggaggugaaggcgggagagucacuugaacccaggaguucaaggcugcagugagcugugauggcacuacuacacuucagccugggcaaugaagugagacccugucccugaaauaagauaagaugaaauaaaauaauccguuuggauauguaaacauuuagguuuuucuucuggcuuuggaguuuguauuccaacaugagguuucgagaaaauaaucaguuaauacuguagagacccuuuccuaaaaacuugauuuaaugagaacauuccaacgugugcuuaauaacacggcagcuguugauggucaaauuuucuccuaucugagagucugagugaaugugcauauguugagugugugguguguaugcguacacacauguugugggagaguucucugcuagaauuggggaacaagauggagagagagauaauuaaaugagugcuuaaggauugaguggauuaaguccaacuagccuggaaccucucugguuucuugguaaccaggauuauuauggguuauuucuauguauauuggugcaccuuuuauucuauuaugcuugacaguaccuucuuuauguuaaagaacgccgagguggauuuguagcccaugucuagauauuuucuagaauagaaucuguuuguccauacaugugaaaagaacuggcuugguuuaggaaguacauaauuaacaaggugggacaggaguuacuaguuuucguuuguuugaaagaugugaaagagggauuagacauguucuguguaucccgaaggcacagcaccagaaccaguggauugaagcacaggaaaacagauuucuguucaguucaaggaguguccgaagagaucaugaaccauggguugguggugggguggauggaguguagaaauugccuuucaguggagguugucaagacgacuacugggaggggacacaggggauucaaguaguggacugggaguagacauuggacuagaugauuuuuaagguugauuucaaucuagcgacugugauuuuuaggacauauuacaucucccggaaaaugaaaaaugaagauacaucuggcaguuggggaauuucagauucauugguucagggucccuaaaggcuuuuucucuccaacuucuucaaguccuccugcaauuauauucuuucucuugcacaucaauuucuuuccaguuauggaaacaucccuaucaccaucagaacaugccuuuuuaucacccuucuuaaaaaacaaguuaaagaaauuucucuauucaauguagccuuccagcucuauggcacuucucuccugcccauucuggcagaacugcuagaagacuugucuccugggguguguacaaucuccccuuccugcugccccuccccacuccacuacuccucaaaaacccuuucuguuaaggucaccaaagaccuccauuuuaacaaaucccauggccuguucuaguccucaucuuuuucagucucucaguaguaguuggcaucauccaucccggcccccuucuuuuucuuuuuguaguaugaccuuguaaccacccccacccccucacuucccuuugaagcacuguccugacuugacuuccagggcaucacauccccuuuuuuucuccuaccugaauaacuguucucuccaagggccucuacagauggaauugccccagggcuuaguccuugacuuucuucuucauacuacacugucucuaggguucuuaaccugcuaaaaaaaaaacaaaaaacgaaaaacaaaaaacuaaaaaagacuagacuuggcugggcacgguggcucaugccuguaaucccaacacuccgggaggccgaggugggcggaucacaaggucaggagauugaggccauccuguuuaacacggugaaaccccgucucuacuaaaaacacaaaaaaacuaggcgggcgugguggccggugccuguagucccagcuacucaggaggcugaggcaggagaauggugugcacccgggaggcggagcuugcagugagccgagaucgagccacugcacuccagccugggcaacaccgugagacuccaucucaaaaaaaagacuagacuuggauaccaagucuaguuaauugagaaccuuuggggaagacuugugggcaucaguuuuuguuuuguuuugguuugaauugguuuuuuuuguucauauuuuguuacuggguauaccagcauacagccaagauugagaaucuggaugauuucuaguccuggaggauaaauacaauacuaauaacuuccaaauuaauguauuuaacacauuuuucccaaacuccagaugugauuauucuguugucuguuuuacauuuccacuagaaauaggcaucuugauugcaugcccuuuaccccacacuggcuccuuccuggguuugccuuucgugcaugcagcucucaggccacaagcccaggaggcauccugauuccucuguucacucaucacacagcucaccuggcagcaaguucuuuccacuugcccuagcaaauacgcacauccuaaaucucacugcuucucccaccaucacuucucuucuggguagccucagaagccuccuaacuccccugugcucuugcacugucacucucagacaguccuugugcaaugagaauggucuuaucgcugaucacagucauucccuugcuccaaccccccacggcuuuccauuccaacggacaaacuccccacuccuuaccaggagcuacaggcuccccuucauguggccucugcccaauucugcuaccuaauuuccucccacucccuccuucccugccucagucaggccacacugaccaccaugcuguuccucaaacuucccaagcucuuuccuccuacuucagagccuuugcacacaccccucccucugccuggaagccccuucccuauagauuguuccuuggcucucucucuaauuuuucucagguuucugcucagauguuaccccaggagaaagccuauccaaaaugcuccucucucccacccacucucuagccccugccucugguuuguuuuuucccuccacagcguuuaucuccacucaaaauccuguuuuuccagcuauuuuguuagaacuuuugucacugcucuauccccagcaccaucagcagugcucacacgcaguaaaugaccuauacauacuuguggcugaaugaugaagugcuacuccuugaggaguggucccaggaccuuggccccuuuuccagccucugagcagaccaugcuggcuauggccaggaucuccugcuaaguuuaucucagaaccugcucucuucuugcugccucccauuuggcccccugcuguuuaccaauaacuccagaaauacacaggcguggagaaguugagcagccucuggcauuuuaaugcuagguggggaccuuucacuucucuuccugaccauuccaaacgaguccaugcugcucccauuucuguagacagacugguccuccauaauccacuuuccugauuuuccuccccguuuucucugugccccuccuuggucuucuuugcaggcuucuuccucuuuguccaauaucaaaacguugguauuucuuaggcuccaccuggauucucugcccuucuuauucgacucucucccuggugaucccgcccauuucuaggguuucagauucucuacaugccggugccucccaaacuuacauuccaggcccaagcucuugucuaaguucuagaccugggugucuagcuagaaaauguucuuugaugucucauaggcaacucaaauuugaugugaagaaagcugaacuugccuucucuuucacuuuuccccuuagucaaugacccagguaacuaucucgaaacuuggaaggcugcugcuucuggccuuaccccuaugcccaaucaguugucaguauagucaguucucccgugaauagcuguacacucuauauacugccugucacugugcacugccaccaacuaagaccaagccacugcugccaucucuuuccuagguuacuuaaagggcaguugcacccccuacacuuucuccagucuaacauccuaugcugcuauuggccucauaaaauguccaucugauugcaucauccuuugcuuaaaaugccucauuagaguuuugauaaaaucuaaacuuuuuaacagggcuuauaagauccuuaauaaccuguucccaagcuggcugcauuucuuggaguuucucggaaauaucugccucccucaagcacauucccaccccacccugcauacauacacaucucuggccacuuguuugucauuuacccuagagucuaacauagggcacaguaaggccucaauaaauauuuguuaaauaaagguaggaaggcagugguccuggauuuuaauuguauguccucacauuuuaauuuaauuuaccuuaaaaauguaaaugauuccagagucaaaaguugcuguuuuguuuuauagugcucuguauguuucccuccacucuguaguuuccagaggguuauuaaaaauggacuaaaagaagcaugugggcuucuguuagcaaaucaguuguaaucuguguucuuuggcugagugcugagcuuaggaggcugccagauggggacacaggaaccaaaucaucuuugcuucccaguggggaacaggggcauaaauuggcugaaugggcuucugcaguaaaacuccuucaauuugagcuuguguaagccaggaucaaaauaccugagacuuguugagacuugucuagaauguuuguuaaacuuucaaaccuguuugggaagaaggcuuggaacaacaguggguuugggucuugugaaguaaaucuuauuuaaaggaaauagacaaaagcuuaaucauguuuaauuuguaacauuauagguaagacuguugguugcuguuguaaugacucuaaaaaagaauagagaauauuuuuuuccuuagaaguuccagguucaaugaugaaaccccaucucuaccaaaaauucaaaaauuagccagguguguuggccagugucuauaaucccagcuacucgagaggcugaggcaggaaaaucaccugaacccaggagguggaggcugcagugagccgagaucgcgccacugcacuccagccugagccacaaagcaagacgccaucucaaaaaaaaaaaaaaaaaaaaaaaaaaaaaaaaaaaaaaaagaagaaguuccaaguucaacauucccaacuucccccucggggcugggagcuccugggugagguuucuaagucuccauccucucagaacuccuaucuuuaacuucuucgugcauggaucagaggggccuccagucacugcugagucacagggauaagcaaaaagggaaugacacacuuccugccccaaguucuagggaguuuuuaugguuuguuuuucuguuucgcuuugaaaauucccugaaaagacagaagauugccccagccgccuccugauuggcagccucuauuuauuuauaugauuucaugggauauccucucugcuaugccuuguaacucacaggguuuuugaaaccuuuuuuccuuaucacagcaguauuacauguuuguguaguguauuuaucaacuacaauuugaccaauaaaaaaaaaagaggcacuccuuauugucacuacccagaaaaaaauauauugugcauaucaucauuccaggcgcuuuucugugugcuuauaguuuucucuuuaaaaauuauauauggcuuaauauaauuucuuugcuuuuauauauuguuuuguagccuuugugaagaguucucauguuauuaauacucugcaagaucgguuuuaaagauugcauuacuggccagccgcaguggcucacaccuguaauccuagcccuuugggaggcugaggcaggagaauugcuugaggccaaugguucaagaccaacuuggccaacauagcaagacccugucucuuaaaaaauaaaaaauaaaaaaaaaaagacugcauuacaugccauauauggaugugccauaauuuacuuaaucaguccccauguggauaguuaggcucuaaaaguuuucauauggggucauugucauaaccccgcgcaguuuccuugcacuuguccacacuucugucuauuucaugggauguauuccuguaagugguucaaagggccuguggaguuuuaagguuuuugaucuuuauugucacuuugccuuccagauguuuguccuguuuuacauuccugucauauaauauaaacuccuuaccauguccuauauggucuacauauucuggccuuugccuaacucccagcugcucuauuuuauuuaauuacuuaauuuguuuauuuauuuauuuauuuuugagacggagucucacucugucgcccaggcuggaguguaguggugcgaucucagcucacugcaagcucugccucccgggcucacgccauucuccugccucagccucccgaguagcugggacuacaggcguccgccaccauacccggcuaauuuuuuuuguauuuuaguagagaugggguuucaccauguuagccaggauggucuugaucuccugaccucgugauccgccggccucggccucccauagugcugggauuacaggcgugagccaccgugccuggccucccagcugcuucuuacagcuuuccuccccuugcuuccgucacuguagccacaccagccccuguccccuccuuccccugaagcaugccuggcuuguccugucucgggcuguagcacuugcucuuucugcugcccagaccauuauuccuguggcuuucagcauauaccuccaaugccacuucugcuagaguggucuccgucagaaccuccuguuuauuuuugcccuagcaccuuucacaauccguccuucauuuauguaugugcuuacuggucugcugccgcuuuuucccacugaaugucaguuuuguaacacaggcaaccccuuauguuucauuucccauguccccagcaucuaagucaaugccuaccauucaguagguacuagguaaaugcagguggauucauucaugcugaaugaaugaagaaaucacccugucguuuaggaaugugugguguaauagggcugaugagguguguauagugaugguuaccucuuggagccaaacauggcuaucucuuggagcaaaaugugggaaaugcuguaaguguccaaauaucacggagaugcaggagugggagcagugacuggcuacagugucaugaaaggcuccaucugagcugagccuugggagacuggcaguguuuugcagcuggugaugauggaaagaauccgaggggcugaggaaagcaggugagcagaggcccagaggcaaaacagugaagcacggugggggcaggacuggggacugcuuuaaguccuauguugacucauggacucagaccccugagcagcagggaagcauugcgugcuccucaucagaggguaacauggugagagaggauauggaagugcuuuuuaaacuuaauucuagguacacauggcaguguuaagggugaucgggcugugcuuugagaaaauguaucaugaggacaacuaaguaagaagcacaggaaguucaggccagaggaugagccugaaggagguuggggugauggggcuggaaaugaagagaaagcagaggaguguuuugaaggugaggaagagggagagugggacccacgaugacacugagccagagaguuuuaguuugaaugacugaugggaagaugagauauggagcccuagaagagaagcuguuuggaaguaagaacauuuaugaauuuaguuuugacccaucccuuuacugaauuagugagccucuuccagauuaaaccagcccgugugcccuccauuguccugaaggggcuugggugacaagaagauagaggagacagaaguauauaccacaggauaggggcucgggcucccauggccucuuccuccucuguaagaaaaggacugcauuuguggaaaggggaaaugaggcuccaacuccuuuccaggagaugagauguuguuuccuggaaaugucuguucccagacccccauugggaaugauuugcugccagcccugucguugaguaaauuucuucauuuuguuaggcugaggcggaugggggcggauguguguugacuguggaguacaugaacaugugggcucaggguacagaugggaagaggcccagaacugggugacacaucauauuuuccccacaaacauucaaaaaugaugugugcuuuucuuaggggaaaaaaucaaaaggaaaauacucaagacguuauaauucugauugcucucuaaauuggaaaagguuuuauuguuuuggguuuuuuuguuuguuuguuuuuugagacagagucucgcucuguuacccaggcuagagugcaguggcgcgaucucugcucacugcaaccucugccuccugggcucaagcgauucuccugccuuagucucccaaguagcugggaccacaggugcccacuaccacgccuggcuaauuuuuguauuuuuaguagauacgggguuucaccauguuggccaggcuggucucgaacuccugaccucaggugauccgccugccucagccucccaaagugcugggauuacacgugugagccaccgugcccggccgcguuaucuuaagcuuuacagcaacccuaggaaggagguuauuauuauauucacuuuacaaaugaagugacugaggcacagagaaauuaaguuacuauuucaaggucauauaguaaguggcagagauuaacuugaacucagauauguccaacucuaagcuguuacauuauaauacaugagcuuaagaaaagaagcuucugcuugaaaguaugggaagaucuaauaaugucuagcuaagugaaguaagaugaaagaaaagaaagggaccaggucucccugcagggaagaaacagaccauaaggaagaucaacccagcugggcuugaaauggcuuccagggaagaaccucagcaguuuauaaacauuuuaaaauauaaucuaaaaugacaauauacuuacauuguucaaaagucagaauguaaauuuauagagcagaaacgcucuuaucuuugccacccacugcaguucugacccucaacccuugcccuuguuuccaagagacaacucggccucccaaagugcugggauuacaggcaugagccacuguguccagccuggaaaaguuuuugaaacuuacuucgcaaaaaaaauuugguuugaaaauagccacauggguaaaacuacauaaugagaaagcucucuguccucuagagagggaauggagaauagaagugcuuggcuagcauucucuggauuguugucuuuucaagaaaccaccuucugcuaccuuaaaaacaaaaggagguuuaacagaaugcaaauggaagugagaaugggagacacacagaugagaagacagcagaacuuggugaguaagugaccacccaaaccaagggaggaaucagugaugacugagugacaagguugugaagggagccagagagguuaaaacagagagaaaaaaauaacagguuggugauggagggaggaugagaaauuuaacuugggaaauaucauauguucccuuauuagccagaauuucuagaaauuuacagagaaacuuaccuuacaauuggauaguuuuucuuggcaaauugagaguuuaauuaguuuaguauuuuauuacgagggaucauguucaguuuuacaugagguuuugcaauggaagaaugcuauaaaaugucaggccucuguuuauauucaguucaguagagaauaaaccacauucaagugccagcauauuuauugcagccagcacucgguguuucuuugcuuucuaaaugcugauuuaguguuuucauuggugcugcaagugugaagagagacuugagcaugaaucauaggaagacagacguagaugcucauucugcaggccuaggacccagcgagugccgcagcugugcugcucacagcuaguggugggauucugggcgugccuuucagccuccuuggauggcccuguuuuccucgcuugugaaaugagguuagaugguaucagcggucuugccaacacccaaguuaucugauucuaagagaaauuagaagauagucuucuuuuuuugcuucuaacaacauuuuuacacaauuuauacuuaaaacauagaaacaaguacuacaugauaaaaaggccuaccuucccacacuuaccuuuugugcaacccauuugggcaggcaacgugaauggcagcuguggugaugacagaccugagcagucucugccccugugcuggcccucagcagcagcuguucacacugcuuaacucacuacucuaccuggccuugugaggucuuuugccuuucuguuaaauagaaagguguucuuccuauuuuccacacaguuugcuuuuugugcuuucugucuggugaaucauggaugcuuuugcgauaugauaugaagagaaaaaagccagcagauguaggcucauaucccagcauucugcugaacagauauguuaacuuuauggagcuggguuuccacaccuguaauccgaggauaaugacgcccaccucccaggguuuuggcgaggagugaguggaccacagugagagcaccaugcacacuguggacaucuccaggugcuuagcagcaggauuuccccagccuugucuagacauggaccaugcaaguccauguccagacaagguuuggggaaauccugugcugugcaaggccuccuuuaugugagaagugagucugaccauccgccgucucuguuaggccaucuggaaaacgcuucugagcauauuguuuaucucagucccugagucuccuggaauaauuccuucucagccugccuuccucccugcuucaccaaugacucuuuccucuuugaagaagaggagagagacaaagaggaguaaguugaauagaggagggggaagcuauaauuagcgccaugguuuaggcacgccauugaaagaguuagcaugggcaggauucagcauacgaggaggguacagagaggacugaugggaagagaggaagguugaacagaaagaaaaugaaauuaaucuuggcagccauggcauuaagcacuagggauuagggaacguccugggaaugccaaagcauaaaggccaagguguuuuguagacauuuccaguucugucugaggcuguagaauuagaugaaauaaacaaaugaaaguaucuuuuuaugcagacacaaaugucaucacucuuuugaugauuuuguugaaugugcuucugauaaggauguggguagcuauaaaggaaauauuuuucuugggguaugugauaagcaguugaugaaacuaggccagcgagagcaugugugucuagagauuguucugggaggguagggguuaggccucauggccucuccucucagcccuguccuauugugcaggguccugcugaauaugcugcuuaaccucucugcucugacacucgcuuuggaaacugggauugccacccacuuucgcaggguguggggagagugaaaugauguaagugauagucucuugcucugagaugccgagauaacguggaguacacacacacggaagggaaggaucucauuuucucauggccaccaucauguguuugcagagagauagagaagaaguaccagauaagguggccgcagacuucccuaaugacagcuuauuugguauuacugugacacuccaggcuaccuccaugacugccaaugccaguugcacucucaggggcuggggguuagggguuaggguacagauuagcccugcgcuucugcugcagaguugugcccaccaagaaaaaggccaagagccaacuauauuccugagcacaaauugcuuucacgaagcuaggccuggacagauucuucagccacuaggccaccaggcagggcuccuagggcuggaaguccuggcugccuccacucuccuccuugccuugaagcaugggugaugcauccacauugggcaaucaucacaauguugaucccugaaccuaccuagagugucuuaauucacaaguccuagggaagcauggaagugcugugcauagucauaucuacaaagagauauuagcuuuuuuuuuuuuuuuuaaacauaaggcuauucuguaagguuugacugcuucacaaauacuuacuugagaaucucccugcucucuagccuaugucugugaugacucuucuuuguucccaaaucaaguaggauaagcaggaugcuaacugcugggacugguuuaaacagcacacuuugaauagauccggggauaucuugggcauucuagucucaagugagagaaaaggagugucuuagggaaaugucugugcagaugcuuugcuuuuuguucuccuguuuuuggagagcucucuccaaaaccaggaguuuccugcuggguguagaggugcccacuggauacaugaggcuaccauguccucugcccuugccugguguugggaccuugcuggugccuccccgacugggccuggagcauguguaagggcccugaugccaugaaggcaguuguuuucacauaggacugcaggauucuuccuccagccuugucuuccugcagccucacugcacugccccauccuccccuagcagaacuggaaagagugguuccuagugaccaccuagccaugcagccaccacugaggucacauuuuagggaaaugugagaggccuguuccacuguuuagaugcaguauuucugcucuuuguagcuuacccuuggaauugccagugagucacagccugcgaaguccuugugauuuaggguccugcacuuccaggaagagcuuucucuugacaucuucuuugacccuuagucccugauguuuucauggcaugaagggccagucagaauuuggggagauaacacaaaagaacacaaaaauaugguuucuaagguauaagugucauaucgcuaugaguuagucacaugauaauguaggccaaagaaaauaagaaauacagagauauguuuguaaauugauguugauuugguaucucuuuuggccuccuucccaaauuaguauugggcauuugauuuuaauuuaggucaauaauaaugcucauuacugcuugagaacucuaugugcaucaggcaauauguuauuugcuucacgugguucucguuaaaucuuaauagcaauucugugacauugaugauguuauucucaucuuacggaagugcaaaauuauucagggguguuaaauaacuugcacguauacacaaccagaagguggcauaaauagacucugaaccagaccuuggagaguuuguccaucaccuuccacuuuuuuugcuaggugcuugguaguuucaagguagaguguuauugcuacagaguauagaaauaaaaucaagaagcuuaccauguagggagaguaagauagauaaacaacugaagauaauauaaggacagcugugauagauaccaaaaaguguuaccaagaaaggucaaccaaggugcaguaggggcuaaaggaagagauugagaucauacauaccuaauagggaucaccaaagaaaagccuucuuagaagugguacacuugaaucuuacuugggggaguggauaaggaaagauuuguggguggcaaugacugccaaaugcccacguaaauaaacaggcuccuaaagaaacuauuagauuguauaaaugcauguauguguauguguacauguguguauuguguaugccuggauacacucacacuuacauucauuaugaaaaccuuauauacucuuccaaagcaaaaggcugaugauuuuaaguagcaacauuguccaaacucuauucuuaguucuccugagaacagaaacaccucugagcaauacguauuauuaauagacguucauguuuauacagguaggaaugagguguuuuuuuuauuuucuuuuuuucaggcaucugugaauggggccucucccuuuuuuuuaguuuuuuuuuuuuucuaaguaucuguuucuauuuucuagcauguugaaacguuagacuuccuguuucugcuugauuuugaauauacuccuguuugcuugucacagguaaucuugcauuucuauguaguuguaguuuacagggagcaagugcaggcagcaaccaguccaucccuguugugaauguggagaccucucuggacucacaauuaaaggcuaccuaaugcauuccacuacaagugacgaaaccuagcucccagaauaacaagcaagacaacuuucaaagugacuguaguugaccagugccuucugugcauuuaugugguaagcuuaugguagauuuuucaaaagaauaguauaaauuauuuugaauuauucuugagaaggacugagucuccccgagggugaugcagguuccauaguguacacgucaacagggugguugcaugcauuccucaagucuguaugacucuaccaagauacugugaaguuguccuucugauugcacacggggagaaaaugcugaaacuaggugaguuaaaacggccuucagaauauguuuagauauaaugucuuuguugaaaucugguaaaauguucagaugacuaacauaguauugcugucuucaaggaaauaauguuuggucguggcuuuagagcuacuguguucaacaaaucacuguuuuguuuuguuuugcuauggcucuggguguggggaaccaguguuaagcagggagagguaugaguauuguggguggaaaaaugacauuuaaaguuugcauguagacaguuucauuuguaaacagauaaagauuugaaauguuucagagaugggacucugaaaagauuggauggcuuuuucacucagaguuucucuuuuacauuuuccaugcguuuauuaacuguaggacaccucugguucccaguggucugguagcagugguaacaccguggggcaacccguaaacacaaggcuguuuauuucuauucucuuauuggauaauuguuugaauauugcuguugccauuuucucuaacaaccaaaaaaaaaaaaaaacgguuuaccuuacauauaaagcauuuuguacuuuuaaaauaacaccuuagguuuguuuuuagccauacuuaaugcucccacaaguagacuuaauuuuauuuuuaaaguaaauugaaaaaguuaucaaggauuagaauagaguguuuuaaauagcccuuaaaguuauauugguauuuauacacuuuuguucaaguugauauauaauauuugcuuagguuuacuuaaaauuguucugcucaacagauuuuuuggagcuuaaauuuaauacuagggaaaaacuagaauuuggaagacauagguggguguugguauagcuaaucuuuugguccauuauugaacccuuggcagccaauaaauauuauuucauagaguccugacuucucuuguauggaauguggucaccugcauaucauuuauaguaaauguacauucgucuacuagaugccuagagcugugcaugugauccuuucguguguguguguguguguguguguguguguguguguauaccugggagucugaggcaggagaauugcuugaaccugggagguggagauuucagugagccgagaaucgcaccacugcacuccagccuggugacagagugagacuccgucucaaaaaaaaugguuaugugucugugacuguaugucauugcauauauagaguugagaucagagccagcuuugcuugggaggauuuuguggaagaagugaguuuuggguagaguuccaaagggaggguagguagcguacuuuggcagaaagacguguacauaaagcuuccaaggcuggagugauuaagucauaagcauucaaggguaagcaugaaccauuugagaacgaacuguaaauucgugguugaaaauagccaggcuagaagugaaggggaggcaagguugugcgugccaagcugagaaccguaguggcagaguggcgcguaggagcuugucuacucuguuccugguaaauuucacucuuggauaucagcacauccugaccauguugccaucuaguggaacuggcugaauugccugugggagcaucaccaccuuuucccaauucaggauaaacucuagugugauauccuggcaauagggaaacguacuucucuuuugccuaggaauuuuaaaugaacgagagagaggaggugagugcucuccccaaaucacauuaauuuaaggaauuucucauagacagugucuggaguccauggcaugacugcugagaaugcuggguguaaauguccaucagcuuaagguauggagcgagcaggaagcagugcuugggagguucugcaguggagugaaagcauaccgcaucucgcucugggcccuuuauguuucaccugggcuggcuuguuuuugucaugugguuacagaguccaucccaauggcagagagagcccucugaccauaagcaccacaccccacagaccccagaccaaagacauuguaaaggucuguaauccuucugcccucccuuccagccauccauggacauaucuauucagcaaauacuucuugaauuaugucccaggcaccuuccagguacuaaggcagugaacaaagcagauagaaaucccugcucuuggagagcugauauucuaggugugggcaauaaacaucaacaaaauaaauaaguaaaauauauaauaaguggagaaccgagugcuaaguagaaaaagauauuuucaagcugaagagggaaauagggauuguugcagggggugaggggguggagguggguaauugugguugcaauugugagugaauccucacugagaaugugauugauauuagacucaccugagaagugugaggaagccagauguggauauccugggggaagaacuuuccaaacagagggcaagcggcugcaaaggcccugaggugagaaugggcugauguguuccagaaacaguacagaggcuuaagggagggggagagaugagucagagagguggugaggggcuagauggugggaccuuguggacaguuauaaugaauuugacuuguacugggcaugagaugagaagccauuugauuuaguccaaucuucucauuuacaaaugcaacguaggccaaagaaaucaaggcaggugucccugaucauccagccucauggugugagagcugggaugaaaaccugccuccugccucuggcacucuuccggccacccugccugcccugggggauacauaaccacaugcagcuguagacuuccaaguacaguggucugagaggaagaaaagugcugugggcuccuccagcaccuguguuucaaccugguucaucuuagauauuccccugcugugucucugucuaccuauagaggccucauaacaaacacagaaagccuuagacuucuuauacuucuuauuucagagaaauacucugcugaauauugccuugcuuuguuuugcuauggagauaaauccuucagguuuucccaaugguauucugcccauuagcugugaagcacaagaaccuacagucucauaaagccuccccuauuucuuauuugcauucauuuuuaagcuauuuggauauaauaaauauaaaauuucuacaguccuaagaaguuugaucaccccauucucaguaucacccccucacccugaaaguugguaagacugaauauuaaauguuauuuaaaaugaauuugaaaacaggauuacuaguugaggagagaaugugaacucgccaccaaguacagcuuaacauggaccauuuuggcccaauacucauugucuucuuguuuuacuuugaaaaagcucaagccuuuuuuuccccuucuaucuccuuuagaucuuaugaccauuguccucuggacacaggccaaauccucuaauaucacuuuaugaugaaagucuggccagugcuaaguauagaagaaaaugacuuugugcugucaucggcauugucuccuguuuaauugucuccuagccuguauccaguggacaaagugacaugaaauauuugcuuguggagagaacucauccugaauucucuugccucauucuuucccuuccuguuauagcagagcucccauucuagacuauaugagauuuaccucaucaucauaucuugcacuugcauuuguuuguauagcacuauuucuuuuuugccaaccaaggugauuucauguuuauuuguauauguugucuauaaaugagcuugacaucccaccagcuugagccauuaggguuagcauugauuugcuuccuuugguaucauuucuccuuucaguaaaauugccugucacuagaaccugagggcauagaccucuguggucuuuugguuucuauuuuuaggagaguggugcuccucagggagcuaucugagcuggauuugaugagaagcuaagaaugagugcuugcuggagguaauuucguuaucaaaacucagggucaugugcuuggaaguuagcagccagaaaaaaaaauaaaauaaaaaaugccaaggcuaauaggacaacaaaguacaugcagaaaugcagauauuaaugcggggcugccgugagcaguaggccguaagaaagcuugacaagaagcauuucuccaguuccuguuuaccaucuaaacuggagcauuacagcauuugcugcaugugggagauggagaaugagagugcucaguuaaaguugccaccaaagaaagccucauuaacacccuaacugauuuccccagcuuccagaaaaucuuucuguuggaauucagcaucucagcuguaagacugccaaguagaagugcagaaaugcaguuugcugucugcggagccgcagguggacuuugagcacauucuaagacaaaaaucuggccagaccuuaauaggccagggcuuuccgcugauuugccccucuccugcuaacugcugaauaauguuccuccccuucaccacaugugccccugagcuccucaccacaccuucagcuccugggagagaucccagggcagaccugacauccucauuccuggcuccuuauuccagauuggaaucuggaacuuugacacacacacacacacacacacacacacacacacacacacacacaccuucucagcaccuagucacacccuacaagucuuguccuuuuugcuccugucaggcaggcagccacccccaguaugacaaggauauucucacauggggauuaucaggaagccccgucaggaaggguagggcagcaucaagcugugagucggagaggaagaucagggacccagguccuaccuuacagacccccuaccccaucugugccucuguggugucuuagcauccacccauuuuuccccagccuuaggacucugcucucugcuaucagucaccagacaggccagacauggcccugcuggagaggaggcuuucgggcuacccucuggccuuuguuggacagcaggcuugaggaaaugggcaaaagcauugaucaguugugcauccuugggcuccuucacucacuguccuucagguguugggaauguuguaaagccagcagcaagauuagaaauuuucaugcacuauuccuccuuagcugcccaggauguuacauccguuguggcuuuuacuguacaagaaagagaaaccccaaguuagacuuguucauacaaaagagauuuuuuuguuggcucacauaacuggaacaaaguuuugauuuagcaguucagugaugucaagaaccuauuuucuagcuugggcaacaucgugagacugagacucuauauauacaaaaaguaaaaaagaauuagccuggcauggugguguguaccuguagucccagcuacucaggaggcuuaggcgggaggaugucuugagcccaggaauuugaggcugcauugagcuaugauugugcuacugcacuucagccuggaaauagagcaagacuuugucucuuaaaacaaaaaaaaaaggccccauuuucugccuucugugauugagcuucauccugaauuggcgucucugauguugauaaaauucuacagcaauucuagacuucauauccaccauacacuguccagaaggagagagagaacuggcuucuuguaguugugucagagaagcaagugacuuuuuccagaagcccccaacacauuucugaugccucagugaccagcuuauuggcuauggcaucugcugugaugauuggcuuaggcuuggguugccuaaacucgucacucuguggcaaggggguaugggauuucugugauuuauuuaaaaugaucaggauugcuacccagggagagagaaauggacaugcuguugggucagccacgaugucuacuacacaggucuccucuugugguguuuuuuuuuuuuuuuuuuuuuuuaaacugaguuucucuaauuuggugacuggcuaugguauguaguaaauggggcccuguauaugggauugccaaccccugaugacaaaugucagaugcuaucagggagagcaagaacacagauuuugugaaccacaguagcacugcagaucacaaagggauucucagaggucgauaaagcaucaccaagguacuagaagguuugguaaguugaacaaugagaauaagaaguagagcaaauuaauuauagacagcucuucaaucuaugguaauuacaugcuccgauaaaacacugaaguccaauauaauuuguauuuaaaaacuguuuaauaaggccauauguuucugcaaagaauggccuuacauuucauaacuaugaccuuaaucaccauauuugauuaauuauuuuaucuauuuuaauggaaauaaaugggcuguggauaauguaaagcuuuggaagcugcacacaaauaaaugaaauggggcaaucagucauagagaguuucauuuaguuuucucuagaugagugcuccaggaggauggcugucuagagcaggggaagggucuggggcaacauucagaaggcuggugaaaaugaaagucacagugacacaagaaaacaccaucuugugguaagucaguuggagcagaagagguagccauuuaucuuuuagaugaaaucuguggcuggaguaucggauuccaaacuccacagcguugucccuagccagccaaucuuccccaccacaugaaauguguggaaauauacgcacagggggccagccagagcagaggaacccuuuauuaccaggggggcuuucacccagacccuaacaaggaacuugagugagcuagacugcccaugugggucacagaaauucgauucaggaacauugggcuaggcugcagaggaccacugugcccaaaggcaugcccugcucccgggaggcugguugcagaaaggagcucugagcuccugaggccaccauggagguccuggagauuuaauucuauuaauaguuccucuuaagauacucaccauaucaacuugcugggccuguuuucucauuugugaacaaguuugaggaauggggagauugaauaagacaaccucgaaaccuuccuuugagcauuagcuuuccgauucuuggguucugggcaggguguggcaggaagugucauggagagcugagguggggguagggguggggacuuugguccuccauauccggacauaugaacagacaggugauggcacaguuucugugguaugugcugcagaugucuuaaauagccaccaaguggcuggacuggcugaguggcgguuugaauugcaccaaguugaguauuuuuaguuggauaccacagauagugcauuuauggccuuaguucaccgaauagaggggucguuuccuuugccgaaccagaauuggauguuggcugccaggcuuguguucugggacauccagaugucgggguauugugggagcggugcacaugaaggaagcucagugacuccuggcagguacuucuguuauaaagcgguuucaaagccguagacaccuuuuauucagggcugguaagcuucacugguguuuuuggucuccugcuuuuuuuuuuuuuuuuuuaaaucugauuacaaugguguugcacacuguugugguuuaucguuuuuuagugauccuguugcucaauaacccuccagugcucugcucugaaacagcaccagaacuccaccuaagcgagagauugcuuauuuguuuuuaauguuagucuauauaagucaauggucccaaacucaaauguccacaggaaccaggcaaguaauaugaauguguaaauagugcucuaugugaacaaucucaagucgugagaccugugguaaauuuagaaacaacaggucucaucuaaaggcauugaaguucaguuaaaaaacuuaaaacaaacaaagaaacaaaaaacuacaugagguggguucggucccaaggcuaccagcuuacgauccuugggcuauaagccaucugacuucaacuaucacugcuguguuugcucagucucagagguaccguauuuauggaugugagccuuuuauaguuucauuuauauacuugauuucagcuuuugccuuagaugagaagacuggcuaacucugggauaagagugccaccaaaauuuucacccacagauuggaagcacaucaaaagaaaucauaucuucacggaagucauuuuuuuuugguuccuggccuuuaggggcugaaucuguuuagagaaguagagauggaaaucucaaucaaaacaguucugaguauuuuacaucauuuaaaaaaauuugcaucacugaagagaaggaacccuaaucauuugaaacucucacuucugcuuugcaaguugucugcuggcuauauucaguccucuuugucuucuuggucuuaggcaggcaugggguuaguggccagggcagaacugggaaugggacaaguuuguguucauucuucucccuacccuuguaacagccuuaauuucuguaucucuguuuccuaucuggggugcccucuaguccucaucucugaagggaaggaacaaagagaugagugaauucuuuacucuuagcuguuagucauccaccggcuuuuccuccaagggauguuuaguguuuuuaaaagaaccugaugguagaacagaaaaucagaguuuaacccaagguaucacccuucuaaugauaguauuuccuguacugcuaagagcauaaucuggggcuugguagccucucagagauagcaccuuguguuguccccuuuagguuagagcugcggaaccagcaccagccacugaacaugaagaagguuuugacuuuaucuuuuuaaauuugcauuauucagacccaugucagaguccacgaaaauucuugcaaauguguuuuuguaagagcugggugucacccugcuuccccguauuugguguuggccaaugggagaguuaugggaaugucauauuccuuccucaaagccacuuaaagcugugcuaaauuugcaggguuuuuuuuugauaaugcuuucuccucaggguacucucucaacuuacucccuucaggaaaauuucuugaaugaauaguccaccagugcugucucugcuuucucaacaccagaucauucugcaaccucuugcaauuuggcugcuaucucuagucauguuacuaaguuaucuuucucaaagaaucuccauuggucacccaaccaucauagccauuggucuucagccuucacuucugacugguuauucucuaccugggggcauuuuucuuucuuuucucccucucuuccucuucuuuggcuggcguuacuuuuuucagucucugaagggaagcucacuccuaggagacuugcuuaauagaauguuuaucgccugcaugucuuuagcaaagaggugucuggaauucccaucugggauuuauuagucuaaauauucaggugguccagugccggauguuaguucuuaacuuaaaggaaacaaaguuuccaauccgaggauggugagauugcugcuguucuacagugggcagccgcugcuggugucuugcuugcccuggaaaugccaucaacugaaauggaauuuuguucaauccaucuuauuaauaguuccuaaagcaauuguggugggguugauagguggcuaguaagguugccucuguaaagauaagcacaauccauuaauuaagucuggaguccacuggacuucuaccggggauguuugcauuugcucggcacucuguuuauaaggaugucgaaggaagugcguccauucugugcauguuguaaaacagaagguuugcagcugucagauuuauuuuuuucuuggcuccuuuucugacagaacuuuuguaaacuugauaguuuuauagauugucgaaaauuacuaaccucgguucugcagaugccaugcagauuuucuugucuuguuuucuuucuuugaagauagcagauauuuauguacauaguuucuuguaagguacuuuuuggggaagaggagauuaagauuauucuuauaugcuaucauaauucaguauuaugaaauuauuaaaugauuauuuuauuaguuauauagugcuuugaaaguguccagcaugcauuguaugcucuagaaaggagaacaaacaaaugcaagguauaaucuuguguuuuaaauagcuuauggagcugccucaaagacaacuaacaucaagauuaucaacuuuaaguauagcacaaguucacuguagaaguauagguccacugugggcuucaguaggcuuuuaagaggaguugggaccugaguauggcuuuggguaggguaaaaagcggauauaacagcugaaaaaauagaccagcagcagcugcccccgcugugugaccacacagggugucaugauucaucauaagguuugucucaaguaauuuccaguuaaugaaaacaagugucaaaaauuucugaaugauuccuuuucaaaccacucauaucuaugugugugugggcgcacauucaugauuuugccucaaguagcaucauucacacucacuugcauugccauugcuuucuuugagagugagaaguugguacuucagcugguguauuagucuguuuugcauugccaaaaagaagaaccugaguaauuuauaaagaaaagagguuuauuuggcuccugauucugcaggcuaugcaagcauggcaccagcaucugcucaguuucuguugaggcuucaggaaguuuuuccucauggcagaggugaagaaggagcagaugugucacacagagagggagcaagagagaggggaggagguaccaggcucuuuuaaagaaccagcucucgcaugaacucauagagcaaggacucacucguuaccauggggagggcaccaagccauucauuaaggauccaccuccaugacccaaacaccuccuaucaggccccaccuccaucacauuucaacaugaggcuuggaagggacaaacauccacacuguaauagcuggcauccugggaauggggccucacccacagccuguccuauugguguugccuucaugggugcaaggacugaggcagccaauucuuguguggcagguaugaauuaacauauuucuagccucagugagcauuugaauuuucaacccacugucuuguuuaagggaaacuagcuuaaaaucuguuaggcaacgcuaacuagagaugauggcuuuacugacugcugcaggaauggagagaaaaaaaggccaauccaggaaacauuuugaugugagauuagaaauaaggggagacagagcagcauaagucaaagauaauuguaagguuuguagcccccagugccuaagugagaaaaauuuauaaagaaauauaauauuaaguacgguuaauauuaaggcuccaucugugccuucagggauaccccuagauagggcgagccuaaggaaccauucaagcagacagguccuaauggcagcuggaaacauguaggcuagagcagagccuuccaaauguucuuggcucaugcacccuuaguggucucaguaauuuuuuucaugccauuucuaggacaaaagaaauacuuagcaguuucauuuguuaaguacuuaguuccaaacaacuuaguauuucuguauugauaacuuuguaguuguacaaaauaauacauauauauugaaauauuuaaaaauaauguuuuuacguuacucuucauuucuuaauggaauguauguaccuguugggcauugcauauauuggucagggucuaaugagaauauaaaguacacaguaauuuaaaggaaaguuuaaaauaaacaaguauuagcuaggaaaacaauaugacaguuccuuuaaaaaugaaaaauagaauuaccauaugauuuagcaauuuuacuucuggguauauacucaaaagaauugaaaaggcaucucaaagagauauuuguaaaccaaaacccaaaaggugguagcaauccagguauccaucuacagaaggauguauaaacaaaaugugauauacacauacaauggaauaucacccagccuuaaaaaggaagaaaggaaggaaagucugaccugcuaccauguggaugaaucuugaggauguuaagugagauaagccaucacaaaaagacaaauacucuuuaauuccacugaauguaaguuaccuggaguagucaaauuuauagagacaaaaaguagaauggugguugccaggggcugacaggagcagagaauggcgaauuagucuucaguggguacagaguuucaguuuugcaagaugaaaaaaguucuagagauggauaguggugaugauuguacaacaaugugaauguacuuaauucuccugaacuguauauuuaaaauuauuaagaugguaaauuuuauacuauauguauuuugccacaauuuuuaaaaaauacaaaagaaaacuguuaagaaaaagagaaguaguucacuauaauggggacuagcuaacaggaaguaaagagaacuuuaaauaacagaggaauagcagauauaaggagcagccccuacccgugggccgugggucugauagagcacccaaacacaugcuucucucugcuccagaccuugcuggagaggucauggccugcuguggcuccugggcuggcagagaagucacuggggugcuaugcuggcagaacuugcuagaaaucuacccucuaagaugcuaaggaaagcuauucauguggaggucuuucacuggaugcauucugcugcaaaaucaaccgagagggaugccaguggaagcugcuggaggcugggaggugcugaccaucauguucagcaggagccaguugcugaagaagguguggauacucuaggagccaugcguguuugcagcagccugcagaaagaguguaccggaaccaggaaggaaaacugcuucuuucuguaaugucucuacaguacucuccacugaugaagcuuagaaugguaccagcuaacaaaagaaaaaauauguaaaggucccuucugugucuucacauagugaguaaugaagggugaauuucgagcugugaggcaguaaacuuauugcaguuccucaaacuuagaaauuggguugaaucccaauacccuaauuuccuguuccacaucacauuucaacuaauacuugccuuuuaucacagcaaccaccaacaaccuagcuuugcaaagaaaugacaucaucaaaaggaaaauaacacaauauguuaaacugugaauucgcuugaaauagucauucaugcaagcaucugagaaauguuguguauugcuuuguuucccucaaagacaaaauauccugcacaccucugugaauuugcuguagugcccugagguacacuggcacauaauuuggggaccucagaacuaaaaucaugucuuuuucagcaacucuugaccgcaucacuguaacauaugagauuguaagaugccaauuugguuaagacuacgaguaauguguaaagugaaaauuguauggggucaguauuauuuuaaaaauccucuuaggaaguuaccagguuggaggcugauauaccaucuccuauuaaguauaagacuuacugccacuguuuccuuagcauugaaacagguugcuauuucuuuaagaccagauacuagaguuagcuugucuuugaggcauuuugcuaagaaacaauaccuugccuuaaacacaacauucauuaucagugugugagaugcucacaguguaaaaguccaugcagagacuagagggagaagagggaacagcaaauucccagcuccuucucaugcuuacucugcagcauaaaaucauuagggggaaugguagccaauguacccauuuagaucauuucuuucuaucugauaugggcugauuauauaucacugaaauugagaaaauuaaauggcauaugauggggcuuugcuaaguucaguaguaaaaugucuguugaaacagacuucagauugaaaagguuggugaauuuuagaucuccuguuuguacuaggaaauuuauggacuuaauaucaucuuuuuuagguaggcuagcacauuguucaggugagcaguuucucagaaaaugcauucauuuucaugaugccuacaacuuugugaaucauaacuaguauauauuucugcagcucuucuuuaaggagaggcugaguaacuuaaauuuuguaaccugaccuauucaagaggaaaaacuucugaugcaugccuuucacugcuaccugcaaaaauaaccucccauuuuuccugaagcccuguuuggguaaguucugcuucaguucacauuuucaccaccugcugaguuuuucuguugagugucagccuuggcuacucgcaacugcaagccuaugucagccuuuucugucuccuaagcagucaucaguuggcacaauuguuaauagauucuacccaugucagaaacucaaugccaaaaucaaauuauggcaacuagaaguggguuagacuuucaaauagaucucagaccaggagucugugguccagauuccacaaauggaguacuacauuugucuucuuugugcauuucacauuucaaauuuuguucagaaacuugaauaaagcucuuaacugcucaaauacagucaaguagggccccuuacucaaccugucuuggcauuguuuucugcccccuuggagugagcacacugaggagaaagauuaucacugggugucuugagcagagcugcuugcuucugaaugcucacgauaaucaauagcagaugugugguaagcacuggaaaguugcauaacugucucacacugaauucagcuacaucagccaggcaaugugaggggucuccacuagguuguugaaaauaaaauuuaguuuaaaaccuauguuuaucucaucacaaaauuauuuccuugccauaaggaguaaaggcagugguuagaguggaaauaauuugacaauuacugcccuuagacuugaauuuuaguuuaguauacacaggaacuuucuaacgguuaggauggaaauggaguuguuuuuucaaggaggcugucucugguaauaaaguuugucaaggcaauucuggaugaaugucuguugccggugaugugauaggagauugcuucaccagccagguagaggauuaaacaaucucuggcugggcacggagucucacgcuuguaaucccagcacuuugggaggcugagguggguggaucaccugaggucaggaguucaagaccagccuggccaacauggugaaaccuugucucuacuaaaaauacaaaauuagccaggcaggguggcacaugccuguaaucucagcuacucgggagauugaggcaggagaauugcuugaaccugggaggcagacguugcagugagcugagauugcaccacugcacucuagacuaggcaaccaaagcaaaacuccaucucaaaaaaaaaaaaaaaaaaaaaaaaaaagaauagacaacaucuaagguuucuuucaagccugaguuccacacugugauuuuugauaccuuuuuccuucugcugcuuuucugaaggaaggcugaggaugccuuggucagaugugaugucgugcuguccuggccaccucagccccaccuuuccucuucuuccuggugaaucccuucuguggccccucucaugcuguuuccauuuugaccccauucaccugagcacaggaaagaaauucagcccuuuuguuuuccuuuuccauugcuagaccacacacauuaaauugccacaccuaucuggaauauuuacagagccagcauuuagggccuccauauagacacucuuaaacaaucugggacaaucuggccuuaaucaugauuauauuuggaaaagugaagaggggaaccucaugauuuucaguguuccaucauguucuuuacucauuucaucauuauaacaacccuguuaaauaagugacuucauucuuauuguacagaugugcaaacaaaagcacagagagguuaaaugacuuugccuauuuuuagaggaaaaaugaagaaauaaugaauaggaagaaaacccaucuuaaugcaaaugaggcacagccagugcuugcuccgcugaugcgggugucaguaaucagggccaggucucccaaauugagucugguguucuuuuccuugcuccuggcagcccauauccgaugaggcuuacugaacuuuuaauuaagguccuuacugaacuuuugauuuaaaaaaaagauucauaguuucaggcagcugaauaaauagaagcuauugaauuuauagcauauuuaaagcauugaauaucaggaauugaauggcuucaguuuaaagcugugaucaagucauuugaacagagagauuugacgaugguucaaugcuagaaccauggccagccauaaacucuauggggaccucccaauauuagcaaucuuugaguuacuccucugcaaaauaagggacuuggauuuuauaggaacaguuuaauacagugagaaagucuggauauaggagacaggaggcuuagauugcauucauuguggucuaaagaacauuauuacuuaguuuugugaccuugagcaaaucauguaaccuccauuucuuuaauuacauaucuguaaaaugaguaugaugacccaagggggcuaauuugggagucuaaauaaaaccuaauacaagacauuacugcuaaguacauccagcccuccauaucugugcguuccauauucauggauuuggcaucuguggauucaaucaacagcagaucaauaauauucugagggaaaaaaaauuccacuaaguuccaaaaagccaaacuugaaugugccgcuacuauguugaauuuacgugaaugaagugcuauguagccauuguauuaggaauuauaagcaaucuagagauaauuuaaagcauaugggaugauauauguaaguuauaugcaaauacuucaccauuuuauaugagacuugagcaucuucggauuuugguauccucaagggucuuggaaccaaucucccacagaugcugagaaaugacuguguuauaaaagaaggaccgugggucauaaauuguucagauaauauuuucugaccugauuuggagaguaugcuuguguuuuaucaucugcuaaaagcuuuuuaacaaggaagauuucuuagaagagaaauacaccuagaaagccuaggaaacaagcacaucccagauguauuauugucucucugugugugcucaucuccgaugucagcaauucuucccauucucucagaauuaggcacucacauccagagcauuagugaauguguagaauuuaugggagaagucacugggcagacugaggagagggauuacccauaacuucaaacucccaggacuggccaccaguggcuuucuccuucccucaucuccacacucauccucagcaucuuccucucacaugguucugccccagcccacaucagccuccccagucuuaucccagugcagauggucccugacuuacaauuuuuuaacucuauguguauuuguguguguguguguguguguguguguagagagaggggucucacucuguguguguguguguguguguguguguguguguguguagagagagagaggggucucacucuguugcccaggcuggaauucaguguaugaucauagcucacuguagccuugaacuccugggcaagagugauccuccugccucagucucccaaguggcuaggacuacaggcaugcaccaccauacucgguuaaccuuuuaaaaauuuuuuuguagaguuagggucucucuauguuguccaagcuggucucaaacuucuggccacaaacaauccuugcaccucagccucccaaagugcugggauuaaauucaugagccagugugcccagccuuacucuauuuguauuguacuaaaagugauacacauucaguagaaacuauacuuugaacacccauacaaccauucugcuuuuuuugcuuucagugcaguguuaaaaaguuaccugagauagucaacauuuuauuauaaaauaggcuuuguacuagauaauuuagccuaacuguaggcuaauguaaguguuccgaacacauuuuaggugggcuaggcuaagcuaugguguugaguauguuagguguauuaaauauauuuucagcuuaugaugguuuuauccugauguagccccaucgcuaaguugaggagcaucuguacucagcacuuaaggcuacuugaggcacagagcuugaucuucugcaaaaguguauaaaugacuccacugucauuuuagcauucccuuuuucaauucuaguauauacaauuuucuuuuuucuuuuucuuuucuuucuuuucuuuuucuuuuuuucuuuuuuuuuuugagauggugucucacucuguugcccaggcuagagugcaguggcacgaucucagcuugcugcaaccuccaccuccuggguucaagcgauucuucugccucagccucacaaguagcugggauuacaggagccugccacugugcucaguuaauuuuuguauuuuuaguagagaugagauuucacugucuuggccaggcuggucucgaacuccugaccuugugauccaccugccucggccucccaaagugcugggauuacaggggugagccacugugcccggccauaaauaccauuuucuuaaggcuaagagagccaaauaaccugggccagggagaggccauggagagauacccacuuaggcuuacuuguguuauggaaggguaaauguaaaugugucugaggauaauaggaagaacucaaagccuacaggccuaaccaggugagaccaagacacagaucucucccgcauauggggaaacaggagugacagccaacuuuuuauauagaucacggaagccuucgaaggcuuucaaggguguagacaaaaaugauacaagagaaguugaagaaggucucaaagugaaauugaaggaagcagauucagccucagcagguuagaaaaaaaaaugaccauuuuuggugaccugaaguuuuugcgaacuagaggcuauagguccauaacuaguuuacagaggugcuucauauuuuucacugcagagaacauauaacauucuugaaugugaguggaauauuugauaccuccuaauuaaaagguaccuugucuucccaguucugccggcuggccuucuaauuugugugagucugaaaacucacugaucuccccuuuucuuaacagacaucuggggagcugugagcaaaaggccuaaaagucaggccuuuaaaaaaaacucuuugaacagcuuuauuuaaggcauaauuuggaaagagauuuuucugcugcccugugauaaaguucagucgagaguugguguuaauaaaccuuccuuagaaccaaggugacuuggaaaguugaguucuuuaggucuguggucaaauuaacaaaauuaugucaauaagccccaggugaguagggucaauuuacauaugacacacacaaauauuugauuauaccucaaugaaugaauaaaccuucagaaucuuagcuaccauuuucauucuuccaucuugacacaaaaggugggaguuccauuauuagacacuugcaggaguucaacauaguauuuaaauuuaaguacaguuuguuauuaaaugagaaguguugcuaacuuaguugcaauuuuguaucaggcgggcgguaauaguuuguugguaugacuuccauacauguugccaugugaaggauguuugggguguuucuuaaacauacaagaaucaacaagucccaccuacaggagauaacaaaucauuaugauguacuggaccauuauucacuggggcuaagaaguaaauuauccccuuuugaauaaaagcacagcaaaaucaaaaugaccuaguacauaucugagagcagcagaaggccaaggggagcccuagagaaucagcugcccuuugucaccauguugcaggguagggguauggggcaaugcagccugcccagagcagauggcuuugagguuauacgggagacugaggaauguacuuauucacauaaagccuuuuaaaauaagcugagcauucauugcucuugagcuaaaacagagcauucuuccccaaggugacugcuugcuugcauuuaaauacaaaagaaguuucucuccaggcuuccugaggccgauggugaauguucaaagaucaacgaagcuaacaugaaucuaaaaugaauuauaaggcugacggagcgcuugaacuauucauucagcaguuguaaaacaaguagcacauuaaaggacauguauuuuaacauaucuuaugugguuuguccccaguuggacuugcaaaaugacauuuaauaaauauuucuuguaaggguacuuucuaaaagaagagagugaaaguaauucugcuguaggcagauugggccugaaauuuggguugucuggauuugcauaaucaucaccuugaaaagguguugcuuuaccccaauuauagaucaguggaagcucucuuguguagcacacggcccuggugagaucccuuaagaucucuuguggacuaucuguggacaucuggguugcagugaggaagggcaaggauagaugguauagggagagaggggcagaauguugacuugggcaggacaggaaaagccacuugugacuggugagggagcauuucuuuggguucagaaucauccucaucucaguguaucuccccauaagucugagauuacugagugcaagguauacauaucagcagcuccugacucaggauguguggcagaggggaccaugaaguuaacugugacuuucggaagggugcagucuguuacccuuucgguggcgaggucaguuuccgggaggcucugcaacacugauauuuuccagauguuucuccucuucucccuucucuggcuggcuauaucuuccucccuucauccugcucuuucagugaaauugagauaacauguuagaaucuuaggcagguuagaaucucucagcaguaggaugugauuuaauaucuagaccucuuacauuaauauuuauaauagccuucacugcuugugaauagcauaagcacucuuuucuguucaaagucaauacugaaauaaaacccaagaguauguuuuauaaaaauuuacuuuuaauggugcaaugguaauaaucuauguaguccuuaugguuuucaaaucccuuugugcuuauauuaccuuauuuaauacagacauaaaucugugaaguaaauaauacuauuuuuaucuucauuuuacaaaugaggaacuggaggcucagagagguuaauuugcauaaggucauacaaaugauagauggcagaacuggauuuaaguucagacuccuuaaauccaugucuuuuguacguucuuuucacuaaauuugccauaguguuucuauugguuuuugccuauauaaaaucggaaacgaagaaaaagaaacgaacuggaaaauaaauuugucaaaagaguauauuuuuuucucauaauuuccaagcggaucuuucagauauguuauuugaggacuuuuugccucagacuggcgauaaaacaaguguucuacaaaauaccuccguaagacaggccuaucaguggcagcucuuguccccgcuuugcagaagggaaaaccaaggcuccacagagcuaaggggacuuccucucagccaauuuguaggggccugugggccagacccgggggcagaauugagaucuguugugaaggcuguccggcuucuuuauucuaucagcauuucaaauccugaaaaccuccccuuuggcauuuugaaggaauucauccccaguuuuugcugguagccgggagggaaccgugcucucccccugaggaaggcccuuuggaguaacugcagcaaugagugcccgggcugugcuuggaguaccagugcucgcccggggcuauacugaaugaguaagcagccccgucugcuuuugcugugcaaagguaaggguggaggccgcuccacuuucuucaaaaggccccgcucugggacuugugaaauugugcucucuuaagcugguccuugcaaccccauggacgauauccaugcgacuuuccuacaaaaauaacauaccaaagccgcuuuaaaauccguaauuuuuggguugcaagacuccaagacaaagucaaaugggcaucaaaaaauguaauccaaaaauacagaggcauugguucuacccuauaugcauuugcuauuuauguaaaacuacagugugcucugagaugagacuuuuuuuuucuuuuuauaccuuuuuuuccgcccgucuggugcguuugccgacgguucuucucggcccugugucucgggagagucggcugccgucugggccugugccccaccugcgugcgcccgggccgagccagccccgccaggucgccuccgcccggcugccggcccgagcgcgcggcuccgggggcggacucccgccgcccagcugacacgcgauucgucacucuugcagaacuuucccccugaaaaucccugcaccagaacccgcucucccgccccggggagguuuugauuuuaguggcuuucuuccuuuuauuuuccgucgugugcggauuucgcugcagagcgaacuugcggcucguccgaguacaugugagcgguaaucgccccugcagcugguuauccugacauuaugcacuccgaagcagaagaauccaaggaagguaggauucugguuucuccugggggccggccaaguucugcggaggaauuuggaggaaggcagugguagaagaggaugggaguuuuaaagugagcggugggcacuuuguccgcaugcccugcgccuucgaagccaagucggagcuggauaagcggagcccgggucucaucuugggcucccuucuccccccgcagccguucagaggggaggggaggaaaagucggaccuaguucagccagcccacuaagucugcuuuuuagcuuucucuggaaacgaaagagccccacuuggacuccaagaaugcaaaaugugcuuggaaaagggcugccugccugcaucagaaagacugaaagcgggaucccuggaagagcccugaguggagggucccuugaaaagggguuugagaaauuagaaacgcuauauguuuccggcuaaaaggggaagcugagugaggggaagcgaaaaucuguauuugagaaauagauuaauuuuuuuucauugcuggguuuucagcagugaguucauuucguuggggguuugagggggcugaaagauaugaggggguccuugugcagcuugaaacugagaagaguuugucuguuucuaacuucgcaaaagcaaaggguuucauuuacuccuaacagagaacaggugacagggcuggaaaagcuccaaccaaaacacaauuauacgcugguguuaguuuggggaguuuauuugugugugaguguuuguaugcuuuguuccuugaaacuuuauguauacaaaaguucucuuguaaguggggggugggaguaagggugguuggggaaaauuagagaguaagagaggagacuauucaagauugugaaauacucuuucuuuucauguagucucuuggaaagcugguuaauuucaagucaaucacagcaguucuggcagaggagcagccccaucauuucuccauuugguagacaccaguuaggaagagcccuugaaacuuguccucuucugccuuuuacugauuccccucccagaggaaagcuuuguguuucaccauguagucuuugugggcucacguuuaccuuauuaugcugugugagggaaauagucaauaaaaaggagguuuguuuaauagaaauacggggcuggcaugaaugaaaaaugacagccaggagcauuguuuuugaguuugauguggaguauggggggaguaaugcuuucuugccguguccuguguucugauggagcugugugcugauagaugcuuuucuuuucuaugucuuuauaccagcaguuuauucaaagucaaagguaguugaaggcaaauaggaaccaggcugagagaacucaagggugaacuucugugugaauuacaaguagcacuuaagcuggcguuuucucucagguguguuuucccugucuuuugagaaagagagagugggagagaaaguggaaaaacaguaucccaaaguguguauuauacauucccauagcaacauccacagucuucccuccucgagggcccagcucucugguuuuaaguuuggaagcagccugcaaacuggccuaugaagagguuaauggggccccuucugcuuguuccucaccuucccuccacuugucaucauuuacauucugcagaucggccacaaaugauauggcgcucugcuuuuuaaagaaagcccagaauguuucuuuuaaaauaaucugagguaguagaauuuuaaauugauagcaauuagggugggauacugaauaacucuugagggagauugaacacuuuauuaaucagauagaaucauauagcuucugccaggaaaugaaggauaggugucuguguguuuuggguguguuuucuccaaggcugguucauuggcuguaaucuagaaccuucugguuagcuaccaccacucagaugucgaugaagcgagcuauguuguguaaauaacucaguuaucuucucuaucguuacuaguccuuuuccucuuauacguagcuuuuuuuuuuuuuuucauccuggugaacuuauguaucccauuuagugugagaucaccaugaguucuuaagaaugucuguauugcaagaaaacugccuuuggaugcuucaugccugauacgcuguaagaggagauacuuuuaagucauuuuucucaacuguagugagagacuaguauacuuugggguugaaucuaaguccuuggaggccagcauauuuuugcauaugcgugaauguagaagcaaaugacuggggauauuguuaagccaucagagcuuaaaacauacuugacucugugccaggggugcuggauauuuguccccagccuauagccaucuccuaaauaauugauuuaauuuuuccugcuuaacaaugaauaagugauugugcuuggguauuaaacagagaaaaauaauccaggccuugcuuuauuaaaaacugaaugaguuuaaauuauucagacauagaauaaauaggaaagaaggggaaaugaaagaagaaacucacuuuuuuaaaaaggugacuaccauuaaaaagaggauaucaacaguuuccaguggauggggcuuccugaggagauaggcugauagccguguauuuggcauuuaguuguuuccugaguaaauugcuuaauuaugaaguaguuaaagugaguggcaguugagaucucugagaaucuuucuagugcuaagcaucaaggcauccagggcuccuuugcucuggauguugaagcauugauaccagaaauugagaaagccauuguuaaggggugggcgaggugucacuuuguggggacuuggaaaagagugaggauugaguggugagugagucuggcucgcuccuccauugcccauaguagccauuucccaccaccaccucacccaguucuuacucucaugccucaccaggccugcuauuucacaaagaaaacaguagccauuagauaacucccucaacguccuguucccagacugacagacucaucuccguccacaucuauccucccugugucuguggaacaggugucauuccuacugcagaaugccccgccuuccaccuugggcuccuccuacaccagucagcccauauccuuccuggcuccuucuuuucugcauauagaagaacucaagcuccccauucuaggacauuggcacuugcuggucuuccugcccaaaauauccuucucuccaccugaccuccuuuucuuggucagcucuuuaaagaggcuuuuucugaaccuaaacucagauccccugucgcccucucucagagcaccuguuccuuuccuugcuggcucuccccacacugcuuaacaucucuucuagaccacaagcucugcagggaaaaacaaugucuguuuuauuccccgcuguaugucuaggaccuacagaguaaaaggugcucauuaaauguuguagauugagugaauggucuccauucuuuaaaguuaauccuuggcaaaaaaaaaaaaguuuaguuguuccguaguggugauuaauauccucuucuguaauaagaaucccaaugauauuuuauaagcuaccacacuguguaguacucuguuuuaaccucacaugguguggcagcuuauauaauaucauucaucacuaaggacuauuuuguaaguuuucuccccuauuccugcccuuccccagccuuugcuuugcagagggaaugaagagaaaaggagguuaaagcagugguucagcucugaugaaaccaagggguauagcugaccuugaugucauacauaauguaaaagguacagcauaugcucuuaaacaccggacuuugacgugcuuaucuguuuccuuuuauguagucauuaggcuuggaguguugugugcugacaaggacuaaaaguggaaaauccauuuagagaucuaucauacucucuccucuacaguggacaucacuugauaacuuggcauugccagacaccuccagcucuguaaacuuaaaugcauuuggagcuuuuuuccccucacuucugaaauuuuuaucauauugaauaugcauccuaccuuucuugcccccaccuuacgccauugaacagucaggauuauauggaugauuaaauuuccugcuccugacuguuggugauccaggaaguagccaaaaagugggugggugaaagagaaugcaguagagccagaaaaacucaggacccagcgauugcauuucagaacacugcagaauugcuggauuuaccuauaaaucauuuauuugucagcauuucugucuuuaugcuagcaacuuguaagucagugagauuagugugguuauagaccugucuucauuuagagaagauuguucuuuaaaacauaguguaagcugaauuaaaacaaaaccaaaugauauguauaucuuuaauguuuaaggaaggucuguaguaagaagucuucuguaauuuaaagugcccuucucccaccaaauacacauagaaucaccaugauuuagagcuaaaagcgacuuugccaauccuucuuucugaccucuucauuuuagaggugaggcacugaggcccagcaaggugauugccaagcccuuucuauccucuuuaauacauguucugcaagcaaggauuuuugcaaacacagguuuuagcauccuggguauuuguaugcacucuccuugaaguaggacagaccuagucuguuuguauaguugucauucacuaccucuuggggggauuuauaaaacgcagaugaauguuuaaacaaaugaagauuuccuguuucaccuucuacguguaacucaagagaauaaaacaugagacauugugaaauaaaauuuagcucugcaaguagauccuauuagaucccggauuuugaaaguuguagaccaagugagaggcagguaaacagugagcucacuuguuuucauuccuuugagaauaucauucaggaaaaauuagcuauugaggguguugguuggguacagacacucuuccuuggggagaagguauguaugugugugggugggaagggagucagcauucugacacagaaugugcuauugcaaaagcagacaucccacagccucucuuucucuggagcacauugcagcaggcccggugcacucugggagucaggacaccuuucucaggaagcauuugcggggcugcagcgcacugcccccccagccgcugaccaagauaucugaaagagcaauugcuuaaauuuuauucuaaaaguuuauaagccuugaagaagagguacagggauguaguauguccugagugacuaacugcugaguugggaauaaauugccuaagggagugcugcccugggaaucuguaagauugaguaaagccuguuaguuaagcugguauuuauaugguuuugaagaugggggaggggaggaguuguguuuauguggacuuaaugauaauacauucuccagcuuuguagugaauaauaguuaauuuuauaaguaacuaggaacagaguuucuucuaagaaggugaugaagcaaagagacuauaagcagaauucccuacguggcucugauagcuuuaggugccugaagccuccagaccacauuuguugaagucaggguugacugucaagaagugaauaagcagcucaugaauuuuccuuccaguuugaccugccauuuaugcuuggugccagcucaccuggcuucaauauguguuuucauguggccuacgcagccaggcugagaagcuggggaccagggguguccccagaggcacaggcuguucugccugucauggacuguccaguagacuccugcuuccagggugcagccccucucccuugccugcugcugccuucuuugagccucagauacuccuaacaacaaauguuaacugagauagcaccuccucugcagggccuggagaagcaaaaauguguguguagauaaccccaucuucagagaguuuuugguucagggcaucacacacagcacaugugcauccauaguacaaaaauacaugauggagagggaugaguacagcucagaggaucagacaguggacccuaugaaagucuagaagaggggguauucaccaaaagucaugauggacagaagugacuucaaagagggguaacuuguauuccagcuaguuccuuuaagcaaauggagaagagaaaaagaaagagugagugacagggaaccuacuuaugcugugugcugggaucaggaagaaugucuacagaaguguggagagcagugaucauggugggcauucguggugauguuguagugguacauggggccagucuagaagcuggacuuucccagggggacauuguauguagguaacagagauaagacccugugagucaggagacugauccuacucaugacuuuguuccugguugucugugcaaccuucaauagcuacuuaaucuuucugaaguucaguuuccccauuggaaaaauuaaggcuaggcacaauggcucacaccuguaauuacagcacuuugagagguugaaggaggugggucaguugaccccaggaguucaagaccggccugggcaacaaagugagaccccccaucucuacaaaaaaaauuuaaaaauuaggcacaguggaaugcaccuguagucccagcuacuugggaaaaucaggaagaucauucgagcccaggaguucaaggcugcagugagcuauggucgugccauugcauuccagccugggugucagagcaagauucugucucaaaaaaaaaaaaagaaaaaagaaauaggaugguuuucagcuggauggaggagggcagaugcaaaguaguguuuuaguaaugccaagcuggcaagaaccaugaguuggucuggagggcaagauugaaccugaguauaaggagccucgccaagaaagugugagaguagccagucacaaagggagaguugauuccccauauguagucucugagagcaagacuguagggaaaggaggggacugggccauggauuuagcuucugagaauauccacuuuuacaaaggagagagguagauggaaccaauaaaggaaauagaaauggaguagcucaagagguaggaagaaacaaggagagcauggggccuuggaagccagaaaggcgagagccccguggaggcuguggucagccugucuguagagaagagcugcugaagauugcuucgucuuccuuuugggccucagcuaaaaccaggagccuggguuugaggagcucaucuucuaagggaugggaauauaucaucaguauucaguuaguauuuagcaggugaucaagggcaugaaagaaggcauguggggcccaggaggugacugcccugccaagagcaagugccccagccuccugagaagcuggccgucuccauuucugcaugcuuuccaaguccuaguugccaguagauuccuuuccagauugucacaccaucaccuccaaccagcauuuggaagagcauuugccuacaggccucuuccuguggcaucacacaaaauaugcagugguacaugaggguaacaagugaauaugggcaggaaauuuaauucaucuuaaaaagaaaaguaacugguuuccuauacauucacaacauugcugacaccgaaugugagagggucuuucuuacaccaaccaguuuuccaaauuucagcggacguugacuagacguccuauaauuuaacucauuucugacacuaauuguccagaguuagggcagaccccacagguuaagggcucagucccacaagacuguccuccaacuugagacagcaauugcaaggccaggcaucccauacuuuugaccaacuggguauaaauuggggauuugcaugacagccccucagguucaguaauuuccuagaacagcucaugaaacucagggaaacauuuacugauuuauucuaaaggaugcaacucaggaagugccaacuggaagagauguguaggacaaaauacaguagagggaugcaagcuuccaugccuuguccaggcaggccacccucccagcaccuccaggugggaugaagucauuggccauuggugauuaaacucagucuccagcccgucuccccugcccagagugggggaacugaaaguuuuaaaccucuaaucaccugauugguucgucugcuaaccauuccccauucugguuuaugagucaccucauuaacauaaacagguaaguuugaaagaggcuuauuaugaguaacaaaaggcaccccucucacaacuaucacucaggaaauuccaaaauuuuagaaacucugugccaggaacuagggaccaagaccaaauauuacaacaaaagaugcaccuaucacucuguuguuuuagagauagucucacuccgucacccaggcuggagugcaguggcggggucauagcugggcucaagcaaucuuccuaccuuacccugccaaguagcugggacuacaggugcauaccaccugcccagcuaauuuuuaaauuguuuuguagagacaaggucucacuuuguugccuaggcuggucaugaacucaugagcucaagcaguccucccaccuuggccuaccaaagugcuagaaucacagggaugagccaccgcgcccaguuaucacucuuaucauuuaggaaauuccaagaguuuugagagcucuagccaggagcuagggaugaagaccaaauguauauuucuuacuauauaacaguaucacacagcucuucauacugggggaaagcuuuggccacucaaaauuagauaauuuuuuuaagguaaugaaggguuuuuuccccuuuuuucuuuucaguuuuuuuuuuuuuuuuuuuuuuuuuuuugagauggagucuugcucugucgcccaugcuggagugcaguggcgccaucuuggcucacugcaaugucugccucccagguucaacugauuccccugccucagccucccgaguagcugggauuacaggcguucaccaccacgcccagcuaauuuuuguauuuuuaguaaagaugaaguuucaccauguuggccaggcuggucucaaacuccugaccucaggugauccuccugccuuggccucccaaagugcugggauuacaggugugagccaccgcacccagccaaaaucagagaauuuuuauuugcucccuuuggccuucacuuccucucuccucguauuuuuuucuuccugugacaggagugcaugucuuagaauaccacugauguuucugccagggguacccuagauuuggcauauaauuuggaacucuuaggacuuuagucuuauacauauuaacuaggauuugggccacacuaguaagcugagccauuuugagaaauuuuagauucccucugagaugguaagcaguuguuacaccaguggaaauaugcuagauggcuuauuccuugugagaaccaaugagauaauguuaguguaaagcucagugcucagacagcuucacucaggagguacuguauaaauaaggaggcuuauaaucacaccaaaagacagaacccugcccaggccugccucuucauucaguuaagaaguccucauuucauauucucuaaaaagcagguaagaguuggcuugcuccaauaaacuuuuuccuccuguaaaguuguuugauagcaaaauauuagugcacugaguguucuuauuauuaagcacuuacaaaaccauuuucaccuuucaaggauuaauaugagaauugcaucaguuaugaaauaucuagaaugaaaaugcaugccuccucaauaucacaagucuaaacauucgacucaacaucuucagaagaaaagagaauuaaagaggaaaucucucaagagaguuuuccaagagguagacagaauucaggggcaaguagcacccacuguaagggaaaggaaauaauuauugggaaaucaaaauagcaaagaaaguuaagggaguggcaguuuggcagauuucacaguucugcaggaacaaugagggagacauagcaguugggagcgauggggaguaggagggugugagagcaacagggugggugggauccaggccugaugagagccuccgagggaagaaguaggaguggagagagagaggaagggaggaguaaggaaauaacucuaaaaugaaaaaaaaaaaaaguaauaugugcaaaacuuaagaagugaccagcaguauaauaggcaagagaccauuguaacuggguuaagaaguuuuggcagcuugcuuauuuuguuugauuuugcaguuaacaggagagaaaguggggugcugguguccaaagcacugugcagacuuggagccaaugaaauguggcauuuggaggacacagaagcucucuagugcuucugaggcaggauuaaugcagaggcccauaaacaaggaugugacauugaggaaugcugccccucuuccaacugcuaaauuggggccagucggaagccagggcaguguuauguuggcuuggauuucuagcaacuuucuuacuggguuauaaaaaugauuuccucaaaaaagcuugaaaauggcaaaugaugaaguagaaaagcaguggugucugccugugggcaucauuucaaagcugccugugacaucgugaugcccauuucuggagggccaguggugagugguuuguuggaggguuaaagccaucacuuccaaccagugaagcuguaccuaacuucgggggguuucccucauuaacaagucugaugguaagcaggccuccugaaggauuucaggcagaggauuuuuagggguagaacugguuuaaauuauuuggcuuacuuggccauagcucugacuuggugauuaggcugaugacccuagaaguauaggggugauuacuugacauuccuguccuugccaccuaccuauuccagcauacuuugggguugccucucugugcaaauggggagggacaugagggagaggagauguugauuguaggucucagcagugaaacaagcuggcuaguuucaacauguguaaggguuaaucggguaaauuauaauugcugcuaggagaggcagccuagcugagcccacccagcccucaggguugcuggggaaagggucauucuugcaauccuuaauuguuuuccucuuucccaaagaugaguucuuaauguaacaucaugguccauugacccauuaauaaaguuuacauuccugauuuguuuuaguccucugcauuucuaguucuuuaaauucucagauaacccuuccuuuaaaaaugcaauucggccaaauuaagcaaagaaaggaauaauuugauuuuuuuguugcuguuguuuaguuauuugagucauucuauggucuuaggcaauuuucuaaaugaaacguggaaugucaacuggacuauuuugucguagaggaugggagggagagaacuguuauauuugguagugguacuagaauaguauagaaccuaccagcaaaagugucucagaguaauauugucuguuguuuccuuucuauuuuuuuaaauggcaccaucuaucccuaucuugugaacuaguuaaacauguuuuaauuguauaucuuuuaaagcuucaguuagccagauuuuuaaaaaaauguuugauguuguuuuuuauuccaugaaugacucaauugacuacauguaggcagcuacuaaacuuggcaguuuguugccauuagcaugcccuuggacaggaaguauucaguauagauaugacaaaccaguuuccaggcuuaaaaauaaagcggggauuucuggacagaauaggucuuugucacucauuucaacaugucugaugaguguuaaaguucaaagccuaucccuuugcuuucucauuuuuuuucaggccaucacuuuaccugacauauucuauuauauagauugaaauuuauuucaugaugcugguguuuuguucaguuuuuaaaaaugaaauaagaggauauuugaauagucaugagaaucagcuagagucaguauucucuccuuguuaucucuuucauguuuaguuccuuuuaagucaucuccccacugagguagguaauggugaaauaauguuucccugccuguaaagcagcuuaaauuaaaaguagcaagugugugccagguacacuacaugacuucucuucuugaaucugugguccacuugaaauagcauuuuuuuccccaaaaguugcuucccaucagucuuguaguucuuaauuucauuugucagguagucacuuagcaacuugggaagaaucauacuauuuugacagauacuaacagguuuuuuggcaucuuguugccuacaguuauugcuuuaugacuuaaaaaguaaguucauacuuuuuuugcuaucucccgaaauaauauaauuuucccuccugucuguuaaaaaaaaaaacccacacuuucucuucuuucuuucacuuaccuauucuaagcagcgugugugugugugugugugugugugugugcguguguguguuuguguugggguuuaagaagccuugacaccacauuuccuggaaauacuaaauuagucacagcauuuauuagaugagagugucuacaacaacaaaaaacuuucuuuuucugaagacuuaacuccaugcaagugucaaucucugagcgucuauuuguuuuucaaauaagaaacugugccagggaaagaugauuugaaauacaaaaugcuugcaaguguuuuuaguuugggguaagguaaagucaauaaugauucuuugggacauuuuucgggacccaacuaaauuucauuugccaaacuuagcaauaaaccauguuuauaaagaaugagguuaaguucuuguucuggggcaggacauggcugugacccugaggugcuugugcucuggagcuccuugacucuucuuucaugaugggagcaggccugaguagccccugcuaugcuguacauugagcuugauaaaacuccggccuuuugaaaauacuggaauccucuacccuaaauacccuauaccuguucaaauaggaugcuuuuagggaaaaaaagggaacuguuaacauaagccaaacuuucuuuucuuuucuuuucuuuuuuuuuuuuuuuugagagggaaucuugcuguguuacccaggcuggaguacaguggugcaaucuugguucacugcaaccucugccucccagguucaagugauucuccucccucagccucccaaguaggugggauuaugggcacccaugaccaugcccagcuaauuuuuguauuuuuauuagagaugggauuucaccauguuggccaggcuggucucgaacucaugaccucaagugauccgccugccugggccucccaaagugcugggauuacaggcaugagccaccgcaccuggcccaaacuuucauugaguuaaaugaaucccuggucugaaacuguaauuucuuuagcuuuguagugcucaagacucuuggaccugaaaguggcugguaagcgucuucuaguuuuuaugaugaugggcacauuguaggcaaacagaaaaugccugauaaccagugaggugugaggacaggcauaugauucagaguguaaaauauuuugcagaauuaaaacuuaggcaguuuuucaugagauucauaaaucauccauacauugauauuuuuugugccucuggccucauuguuugguuuuuaggcauaggacuguguuuuacucaauagguaguuguaucauccaugguaccacagucugucaaaaccacaccagacauugauaauguauugugcauauggggugaccuuuaggaaggcuugguaggaccuuuuucuugcuggcucccuucgagccagugugagugauauuccaucuccuagucuguguuuuggaucacuguucucacgccuaaagucagaacagacagacccaugggagggacuuaaccagguuugucuaggccgauggagggcucuaauggggucacuucuuacucuuuugaaaagugguggaaacugaaaugaauugucuuucaaauuugguccaaucacacuuuauugucugaaaacuucugucacaucuuguggcagcaauggaaaagggaauguuuuagguaacccuuguguuugaaaugccugcuuuucuuuuuuuuauuguuuuuuaaauggauuuuuguuuauuuugccacagaagcagcucucuguuuuaauuuguuggaauuuaacaucuuuggaguucuuccuggguucuagccacuggaacacaaaucaguccagaagcuuauuacuaguuaacucuaauuuaaaauaaaaaucaaauuucagcagaaagauuggagaagagaaagauauuacuugauugagcaacagagaaacaaugcaugaauccacacauaaaacucuuuaaguugaguaaaggaggcuuucaaacccuaauucaugcauuuaacaacuaaaaucccagcuuuucccauguugaguuuacacagagaaguuaaaagauaaauagacuuuaucagacuuugacaguaaauuaaagacccuuuaucuuccugccuggaaguucuauaaaauaauggguaauaaaggcaagcuauuagucaaaauggucugaauuaagccuggaaagaaaaucuugccucuaagagcagaagggugcaaaacacuggccccuccugggcuugggcccagagacaaaggaauagugguuacuaugacccaacaucagucugcagccagaguuccaagcaucuucucugcuaucccuaaugauuuaaaaauauauaaaaauauuucacauucuuuacccuccaucagaaugcagugagcaguaagucagcucaagaaaauaugacccagugccuaacccguugauacuuuauuagaugccauuaaaacuuuagagagcugggagauuauuaaggccuacauuuggaaccuggaaucuuuuccuuugggaaccuggaaucucaacucaaggauucuguagcuugcuuuuuugccuguaucuaagauugcucuauuuugugauaauguaaacuuaauggaagaaaauuacuucauagaugcuagacauucaagaauuaaauccccuuuucauguuagcuagugucaaaacauuuguuuaaacaugguuucuaaauuuugaugggguagcauacaugguuuuauuuuauucuguagauguagugaaaaaauauuuuauuuugauacauuaacaaggaagauaagacagcauucauuuugaguauuugcuauagaauauacccugcauuggacugugcguggagucugguauuuguauguuucaaggaaauaaagguacagagaagcacuuguucguugccuauauaaagacuaacuguacagcugacagcuuaaaaguacuguaugacacugcauuucuuguccaacaguagcgucuguuuccuucauuccaaaaccaaaaaaaaacauuaaagaugaaugcugaaaaugugauagaaaaagaccuuccuuuuuggcauguccauuaacugcccucaccguucuuuuccaagcauaacugcuagacuggauggcauaaauuaaacaauuaacaggauacuaguucaaggggaaacucuccaguuaggguagauuuaauuuucagauuuggaaaaugaaucaaauuacacauucaaaagacuugaauucauuuuuuucucuaagcauguacuuuuuauaauauacauugucuaacaucggagagauaaauucaguauuauuuuccuaagauacuuucugccuuuuguagcagugagaauacuagaaaucagcgaggcgugguggcucaugccuguaauccuggcacuuugggaggccaagguggacagaggugguccaagaguucgagaccagccggggcaacauggcaaaaccccaucucggccgggcgugguggcucacaccuguaaucccaucacuuugggaggccgaagcgggcagaucacaaagucaggagaucuagaccauccuggauaacacagugaaaccccgucucugcuaaaaauacaaaaaauuagccgggcgugguggcgggcaccuacagucccagcuacucaagaggcugaggcaggagaauggcgugaacccgggaggcggagcuugcagugagccgagaucgcgccauggcacuccagccugggcgacagagcaagacuccaucucaaaaaaaaaaaaaacccaucuccacaaaaaaaauuauuuuuaaauuagccaacugugguggcacaccuguaguacuagcuacucagaaggcugagguggaucaccuaagccuggaagguggagguuguggugagcagagaucgugccacuucacuccagcuuagcaacagagugagacccugucucaaaaaaaaaaaaaaaaagaauacuagaaaucacaucaagaagaaaaguucaauaaaauagguugucuuucuucauagaaaugauguuuuagaguuuauuauuuauaagaacuuauaaaauaacagcuagauaugaucaauaauauaauauuuuccaagaacaaagauaugaccguaaaccuugcuaaucauuugacuaaguaaaauaaauuccuagcuuuguuaaauggccaccgcuaugugugcagauuuuauaaaggcuccagucuuuuagaaaaaguagcccacauaccauaaaaauacaaguugaccaucauaaauuguaucuuaacauuuuuuuaaaaaauuauguuaguggcugggcacuauggcucaugccuguaaucccagcacuuugggaagccgaggcaggaggaucaccugaggucaggaguucgagaccagacuggucaacauggugaaaccccaucucuccuaaaauauacacaaauuagccaggcaugguggcgcacaccuguaaucccagcuacucgggaggcugaggcaggggaaucgcuugaaccugggaggcagagguuucagugagccaagauggcgccacuucacuccagccugggugaaagauugagacuccaucucaaaaauaaaauaaauaaauaauaaaguuauguuaguuaacacugcauuuauuuuuuaugaucuuuguccuauaucucuaccaugcugaccuugguaguaugacuggauucuucuuggguauguauuacaccugaagucauuacagaagacacucagucccuucauccaccccagacacaaagcuuaauaaccauacccaaccccuuuucgacagccugcuggccacacugacuuuccuauaagauaaaaacugccguaugugggauagcucuuguuaguacaccaagaaugacuucccaauaguaaaauuacucuuaccccaaaauguaagagagagugaagagaugcagauauuuucccuauguuaggcacuucauguacuaagacauuuuucauucauuucauuuagaagcuuguuuggaauucuaaaaagucacuucaaaacuuuccucaccgggacgucaagacaggcauacaacgggaaagugacuagggauaaguuaauacugguaccuucaccagaggaggaguaugcaauguggaagaccuguugcugcuguugaguaguuuucagucuagaggaguuaacaugcauacaagaaaguacauauuacauggggguuagagagguuucagaagggcugucuguggcugagaucuuugaggcagaacuguugagacggaagggauuggcaugaagcuuuggaagacuggacgugugguuguuucccaaauaugguacguaugccacugguaguacagugacugauuuuaggaggucccagguauaguauuaaaucaucuucagucauaucacaaaaaaauuaguuccuuuucaguguccuuggaguccuugacaucauucacagagaaugccugcguuuugggcuaugugaucucugccagcucacagaagcuuaccucuuuuugugccauguagguagauggggauucauagccuuuggcaggcaacaauaucuggcuagaaacuaauaguauugguguuuuuuuuccucauugaauuauuucuuaugguuuuaaacauuuuuuaaugauuuuuaaugauauauuuaggggaguaucaguuuccauucacauaguauauaggguuuccuuuuaugugaauuaauuuuuuuaauacaaauacauuaaguaaccauaaguuaaaguaaaauacagguagcguaucgcuuauccaaaaugcuugggacugaaguguuuuagauuuuggauuuuuuuuuucagauuuuuggaauauuugcauuauacuuacugguugagcauccuauauccaaaaauuugaaaucugaaaugcuccaaugagcauuuuguuuuagugagugccauaucagcucucaaaaacuuuccaauuuuggcauauuuuggaguuuggauuuuuaaauuugagaugcucaaccuguaccgauaguaaauagaaaacaaggcaaguggguuaggauguuccucacauagauacagcaugacuuuucaggggaagagagauuccagcaaagauccugggauggagaagguaacauuuugagagaaaggugaguaagaaguuggcagaagcccaggggguccuguugaagagucagaguuggacgccuucuagcucagcuugguugccagcgcagggaacagagggcuguagcucuuugcaucuuauacucaaggcugucugcaaagugauucagaaugguuugagccccugaucauuucaaugcgggguagcuagggcauaugccuacgggagccaggaaauuacccaagugcuggaauggccggggggcuaauuggagaggacccuguguuucccacucuccucccucaguauugccagaaggucagauuuuuuucugagaagccagaaaugugaauuuuuauugaaaguucccaacuucuacaaguuuuuuuaaauacuaauuacagaaauaaaacuuagaaccuuuugggggccaauuuugggggugauggacauguccuggaguuagauagugguaauaguugcacaacauugugaauauaguaaaaaccacugaauuguagauuuuuaaaaugcuuacaguggugaauuuuaugugauaugaauuuuaucuuaauuagaaaaagaaaaaaacacuaugagggcccagccaaaacauguugccugccaaaaguuuguaagcuuugcuucaaauggaggaauugcuauuugcugcuuuucauaaucccaacagaaagcaccuuuccacaggggagcaagugauugggaauuaaugggggucauguugugaucccuacguuaaccucuaggccucuguuuuucuuccuguggucuccacggcuucuucuaucuccuaaaauaggacccaugauagaaauggugagauguggagugguggacuuucuuuuagaguaacgagugaguaggugaaaagacacagcuacgaaaggugggggcugcucaaguauuuuagagaagaaauuuauuuuauuuugcaacuacuuauaacauugauugguuguguuauguuacuugccaaaguuuauuuuacccagauauuaaccauuagagaaguaauuaaucuucaagacagcaaguucguauauuuuggaaaacguuuuucaguucuuaccagggaacgacuauaaugaucuuuuuaguuauuuucuucaaguggaaaaugaguuuaauauagcaaguauaugucaucaacaucaaaggauuauauaauuauuuuaauaaaacaauuugucuuuguaacuuuugggaggcucuauuaaauuuuaaauauaauuuuaaguuugccgauuucaauagaggcaaaauguucaauuuaggaucuuaaaguaaggauuauauccuuaguuaaucuucagcuuuuuuucuuucguagcaaacuagcaaagaaagguagaguuucugccuuuuucuuaugacuuaaaccuaaagaauaugacuuuuuaaaaaucuugaaccaacauuuguacuaaaaacaauuauuauuuuucaaaguguggguuauucaguaguuuuugccaguuccaaauguuaucagaugacuuuuuggaugccuaucuuuagugaugaaaugucgcauuuagaauaaacacuuuccacccaaagaacacugaaauuaaaaugaaaaaauauauauaaacuuaaauuuucuuuuuuguuuuuuuuuuugagaugaaaucuugcucuguugcccagacuggagugcaguggugcaaucucggcucacugcaaccuccccgucccggcuucaagagauucucccaccuuagccuccugaguagcuaggauuacaggcaugugccaccacagcuggcuaauuuuuguauuuuuaguagagaugggcuuucaccaugcuggccaggcuggucucgaacugcucucugucaccucaggugauccgcccaccucagccucccaaagugcugggauuacaggugugagccacugcacccggcaaaaauaaacuuuuucaaaaggacugcauuggaauauuuauuucauauguaagaguauuugaaauauaauuaaaucuaauguuauuuauuuguagccucuuauuucgguuguuuuauaaaaaucaguauucauugucuucccaccccccccgucuuucugcucccccagaaacaaccugagaaugcuuuuaauccagcagauacauauuaaagauuaauuggucauuuauugcaaggaauaaacaauaaauuguaaccaaucacuaggauuuacuuucagggaguacggaaacaaaaguaugauaagcaguuuccaacagcaguuagagacaggauagagcauuucugaauggacggucaaugaggacuuccugauauuuggaaggugauauuugggagggacugugggagacuucaccaacucaagacaggucccccuugauuccuucaugccucugcucaaaugucgccuuuucggaaaggccuuccccaaguacaucaaguacccuagauaaaauaacauaguucccccucccauacacacauuucauuuuucuuuuagccuauauugcugcuugacguauuuauauauguuuguuuguuuguuuauauauuagguguccuagaaucugugcuuccugagaguaggcacuuugccuggcacauaacaguugcuuaauaaaauaaaaguguauugaaugaggcugggccugguggcucauccaguaauccagcacuuugggaggccaagacaggaggauugcuugaggccaagaguuugagaccagccugggcaacauagcgagacccugucucuaucagaaaaugcaaagauuaaccaagcauaguggcaugcacauguggucccagcuacuuaggaggcugaggugaaaggaucacuugagcuuaggaggucagagugacauugcacuccagccugggcaacagagugagacccugucucaaauaaauaauuaaauaagaaguaaaaaaaaaauaaaaaauaaaaauuuguuggagaaagagugagggaaugaaugggggaaaguuuuucugccauaaggcucuugacuguguagagcuccaaacugguauggagaauccaaguucaguuuucuccugggaucauuguaaauuugucaaauuuaccaccgcucugugacuuaguugacacauucuauagaaauaaggagauuuugguacucaaauguagcuuccugaagucuaugaacaaguguuaugaaaacaaaucaugaucacucuuaaccuucccaccacuucaccuugcaaaccccucguuagaaccucauauaaguuguguuuaaauuauuucacaaauccaagaccccacacaugccccucaguuuccaacauacggguacacugcugggccagauuuuuaauuccugacuacccaguaggaguuguuccacugaaauauaaucacauuuauuucuguaaggcagugauuaccuacgcaaaugccuacagaacccaggaaaugaacagaaauguguagauggccaggagggaugugguaagcuggaaaggguagucuucuaaaggaggcagccauaauuuagcucaaauccauuguugucauaugagaacgugggcccauuuggucagaucugauuguucaaagaaaaucagacacacacauguugaagcuaaauuucccaauuuucuaacauggaccacuaauccuaaaguacaauccuggaugggccaaauaauaugauauccagguuacaacuucugcaaggcauccugaucuaaauaaaacggggaugccugggcaugcggagaggaaagguuagaaagggguaacaaccacuucacagagaauauaaaugcugugcugguggugagcaauacugcuucuauagaacucuggguuuuuuuuuccuagaauuucagagcuucagagugucuugauauuuaaaaugagaucguuuacaugaaagccuagcaaauuccaucuuacucuuuguuuaccuuuaacuggaucuagccuccugacauuaacauggcuaugaaaugccuaacaacauuuggauacaguuauugaggaaaaauugugacaagaauguugagagguugugccaagaugcauauuugagagaugcccaagcugaggccaagagguuacugcuccuaaaauauucaaacagauggguuugggaucuuugcauggaagauuccagaacauuugcuguaaggauugaguuaacuaaauauggucacuucuccaaacaaaaguagcugguuauucuguauguuuuggcaaagggcagggaagaaaagcaauagauuaaaaaaaugaaaaugcauuucuuuuacacagcuuccuccccuuuaaagcaaaagguggcugggcgcagugguucacgccuguaaucccagugcuuugggaggcugagacaggaggaucacuugaggccgggaguuugagaccagccuggccaacauagugauaacucaucucuacaaagagagccuggcaugguggugugcgccuguaauccuagcuacucaggaggcuaagguggaggaucucuugagcccaggaguucaagguugcaguaaguuaugaucuggcuacugcacuccaaccuggaugacagagugagacauugucuuuuaaaaauaaauaaaacaaaagauaguuuguauccauauuuaggguuauguguuuauucauggaguacagauaaauucauuuauuaagcucuaaauagaagaaauugaguugauuuccugauacaccuucaugaauugcuguaaaagagagugaaggguuccauggaggcagauuagagcauaggguuuagugcaccccaugcuagcuggagggcacguguuaagcacuuugaacaauacagagaugaaaaggcauguaccuguaccuuacuugucaaggauucuaaauagauaagagaggaauuuaacucuuucacaagacagaaaagcagguuaggagagauuuauucuggccauuggauuuggaaaagcuuuuuggaaggggcggcauuuacauugagcuuuacaggaucaauagcacucuuucaggcagggaugaagggggaaggugaaggcagauauauagcuuuucuuuaguuucuguucccugauguguuugaccugugcuccuucauuugauuuguuuuauuuuuauuugauuugauuugagacagggucucaucugucacucaggcuggaguggaguggcgugaucugaguucacugcagccucaaccucccaggcuugagcaauccucccagcccagccucuugaguagcugggaccauaagcauacaccacaacaccuggguaauuuuuuuguauuuuuaguagagauggggucucuccauguuggccaggcuggucucaaacuccugacuucaggugaucugcccaccucagccucccaaagugcugggauuauaggcaugagccacuguggcuggccugugcuccuucuuuuuaguucgaggaguugcuuuaucugggggagcaggcaggcucuaagaagugggauucugcagcuggcaagcagcuucauggcauuugguaggcaauuuauaaacaaugaacauuauccuaauuucacuuuucuuauagagcagcugugugcuauaguaagaaguaaugggccucagcucugccacuguuuaugcacccuuagauaagucacuugacuucugagccucacuucucuuaucugggucccccaggguuaaguaauaacaggaccaaaccagaaauucauuuaaaaguguuagugaaaauaucuugcaaacuguagaguacuauacaaaaaucaacuguaaguuuucuugucuuuguuauguggccaggagcaaccugaugaaaccagaaaggguguguugaccauugaugccagcugugggucugguucaguaacuucacucuagugugcuggauuuuaaaauguuacugguuuucuaagcccugcaugaauauaaauauucaucaagagucagggccucuggcaggacgggagaauuuagggauggaaaaguguagaaaaucacggagcuguugagaggauuauccucuacauucugguagaugauuggauuauaucaacaguggaaagguuuuaugucuucaagaaaauauguaaauaaauccagcuuaauugaaaagucuuuagaaagacuaauguauccuaauucaacauaauaaauaaggaagauucauuuaauuucaaaagacaaaggauaguucacuaaguucaguuuuguauaaacaauuguaggauauuuuaauuuaauuucaaagccauuuuguagccuagcgguagaguuaggcucuguucaaacuuugguuuacaguauuaucuagaaugggcuaacuuuucuauucucuuggauacuuuaucaaauuuuuuuaaauguuuaauauagugagcucuguuuagaaaacauuuuaucuauauuccuugcacaagcugacaucuguauuuuugugaaaaaaaucuugagagggaauuaaaucuguccauaaucuacucacagcaugccuuuauagccagaguacgucugaaaauuuuaaguauggcauucuaggaguacagcucagagcaggcguguuccaacuuuacuauauaucagaaucagguagggugcuuccuacaaaugcuggcucucagacugcaauccuggagauucugauuccguugguuuagccauuucuaagaggccuccggcgcuucugugguggacggcccaugacacuaagaauucuuccucagauaccugcuauaucuauccucucccugccaaacaaagccuucuugaaaaccaaguauuggcugggugccgugguucacgcuuguaaucccagcacuuugggaggaaaaggauggcagauugugugagcucagggguucaagaccaucguaggcaacauguugaaacccugucucuacccaaaaaaauacagaaaauuagccaagcaugguggugugccuguuccuguugcucaggaggcugaggugggaggauuaccugagcccaggaaguugaggcugcagugagccaugauugcaccacugcccuccagcugggugacagagcaagacccugucucaaaaaauaaaaaauaaaaauuaaaaaaacggaguacagagacuauauaccacaguauagaggccauuccccugucucuuuuuccuaggauguaguaagaagguccacuccugugagcagucccagggucccggguaagauuucuugguuauacucccaauaaggguggcacuuuggccagaggaguuuuaccagggacagaguggccaauauggugaaaccccgucucuacuaaaaauacaaaauuagucgggcaugguggugggcaccuguagucccagcuacucagaaggcugaggcaggagaaucgcuugaacccgggagguggagguugcagugagccaagaucgcgccauuguacuccagccugcaagacuccgucucaaaaaaaauaaaaaaaaacaccgaacaaaaaacggaguaccuuuguaguauuuccugggucuuaacaagcuauauauaauguuucaauuuuuucuaaaauucauaggagacacauacauccuuggguuucugacauauagguacacugaugaacaaaauuuuuuaauuccuaauuagccaguaggaauuccacagaucugcucugaaauacaaucauauuuauuucuauaaggcagaaucuucuuuuucuuugaagucaaucuccuuuugugaaacuuuccucaaaccuaaccucccucuaucaccccaucagcaaaaacuaauguuuccacucuuugcuaccauugcauuuuuacauguuccuguuacacaauuuauggugcauucugccuagcuguguacucaucuauccccggaccagucccugggagucuugaguggagaagagggauaguguuauuuaucuuugaaaccacaguaucuuauacauuauacacacucaacaaaaguuuuuguugacugacucaugucuuuggguuuauguucucucuuuucgccacacuccuuucacaagaccugaucauaagaccuguggcauccuauaccagcagaacguuuacaguaucuaccauaauaaugauaauaauaauaauaauugcuuacaucaguugacccaauuauuuuauauuuggugcuguucuaagcacuuuauauggauuacuuucauuuaauccucuugguagucccauuugcagaugaggaaacugaggcauagagagguuagauaauuugcuccaggcacaugagcacucaguagcagggcaaggccccugacccagucugacucuagagccggugcuugcaauuaccauaaugccuggguuuaccugacugccugucuuguacuccccuauuugcaucugauaauugugaauucauuccagaggaauaccaagaacccuaguuaauuuguuagccaauuauuuucacugacuuuauucuacaaauuuguuaugguauccuuugugaaauuaauuugcaaaacuuggguaagcaaaguuaaaaugguucuuuauugcacuaauccucaaagccuuuaguauuauuaaagcauuuugugcaucuccaaaggggaccuuuguguacacuguuucccaaacuuauuuaacuagagauaauuuucccccauaagacucuuuuagcuuauugaagaauuaagguuuuguuuuuuuaauguaguuuguaagagaagcuagcuaaugcccuugggcgguugccaagaaauuucucaggucuugaauauuuagguaaauccuuauuuuugacacuuucuuauuuagucauaaauagggugaccacuuacauucugggucagucacagaucuguugucaugguguaauuacuaacagcacuguuuccaaaaguauucccuuuggaugauaaauuaucugaucacucuaaucauaauacuugccccccaaccauuaaauaaagaccuacuuuacauacuugcuaccuucucaucacuuacugaaggauccuuacugauaaugugugugugggaacaaaggucauagcccguauuucuccagcauuuuaccauuuuauguccuaguuuuauguggaauuauggacacauauacaguuuauauucuuucaucacucaaaaguugcauuucuuaagaauugcaagccuccaagacuucuuugcacugcucaguaucuauucauguauuugcuuaguuaugcagggagaaaaaaaacaaaucuaaguugucucuuggaagcaagggcaaggguugagggucagaacugcaguggguggcaaagaugagaaagagcuuuuccauucuguauauucugacuuuugaacaauguaaguauauugucguuuuagguuauauuuuaaaaugcuuauaaacugcucaaguucuucccuggaagcuauuucaagcccagcuggguugaucuuccuuauggucuguuucuucccugcagggagaccuggucccuuucuuuucuuucaucuuacuucacuuagcuagacauuauuagaucuuccuauacuaaaagaagaggaagcuucuuuucuuaagcucauguauuauaguguaacagcuuggaguuggacauaucugaguucaaguuaaucucugccacuuacuguaagaccuugagauaguaacuuaauuucucugggccucagucaccucauuucuaaaaugaguauaauaauaaccuccuuccuaggguugccguaaagcuucaguaagauaacguggcccggcacgguggcucacgccuguaauccuagcacuuugggagaccgaggcggguggaucaccugaggucaggaguucgagaccagccuggccaacauggcaaaaccccuucucuacuaaaaauacaacaauuagcugggcgugguggcaugugccuauaaucagcuacuugggagacugaggcaggacaguugcuugaagccgggggguggagguugcauugagccgagauugugccauuucacuccagccugggcaaaagagcgacacuccaucuuaaaaaaacauaaaaaauaaauaaguaagauaacacaaguucuaggcgguuccagggauaauguaguacaaauucaaaaaaugggggcugcuguuauuauuguuaucacuguaaucauuauugccuagggcaaccaaugagucuuguggauauaaaccucuggcucugacuuuggguaaccacaaaauucauuucccauaaccucuauccuaauauuuugagacugacagucuuugagguccaaccauacugcuuuauacuaacaucaccaaacuuucuuccauuacugguaucagaaaccuagaagcagcagggauauuuugucagaguuuaugccauaaagaagguaucauaugauuccuggggcaaauugauagaaaaagagcagagauggggucugauaugaaguuagaggaguugaaacucaggaaaugacauuuucaaaaucgucauaaaacuaagccacaggaauaaaagauacacgguugaacucaaaaucaugaugaagagauuccagaauuaaagccugagaucacagagggaaaggcuucauccuguuuucuucaaggcaucauuuuucuuguccacgaauuuggcaaauaagggauguaaggagaaauggccuaguacacugcuggaucuuuucagauuuauaagucauuaaaucucauuuaagccacaccaacuugaaaugaccuccaguguagaagaugagaaaacuguguuucaaauaaauugcacccaaguuuacaaccugggacucuugacuuugagccuuuuguuuccauccaugcuguucuuaauuggcuucacgcccugcuguuggaucucugguucucugggaggcuucagaaacugcaugagaacgcugugacuucuaaagugaccuugucagccccuguggcuuuuaacuguggcuuuauuuuuggcccauuaccuuugcaucuugcugcuguugcauagcuuuucauggauguugacuaggcuucuccucuugucuuguaguaggcucucauucuguucgugauaggccaguuuucucuaggcagaauaccccuauuuuaacuagcagaguccucguaguacuaaaucuauugcuaacaagaaaguaagcaccuuaaaaaaagagaaauucccuucuaaagaaaguuuuuaauauguuauauauuuuaaauaucauuaugaaagagaagauguaacuccuuauuagcugaacuaugugaggucuccguuuucacccagccaucuggcauuuugcauuucucaguucaugauacuaccagaaggaauuaauuuuggccaaaugugauucuguacuaaagagcaucagaauguauuugaaguuuaauuuguuguguucuuuaaccuaugaagaaggcuguucugugauagggauugugugaaacacaucuaugugguccauguccauuuaucucuggaacaacuccaaaaaguggggaucauuguacuuaucuuacagaugaggaagccgaguaccaguaauaucccugagcaguguggcaguucauggaaccauuagcuacagaguauuuggacuuuuauaaguauacuauaguuuuccaggacccuggggaaauaaguugccacagaaaaagaacacuagugcauuaaagguucauacugcagucuuuuuaaaaaaaauguuuucgguggaaaacauucuaauauguguuacaagguauguuuuuuaagaggauaaauucaugacucucauauaaauacaaauugcacauauugaagauuuuacuuaacucauuuauuaaugagggaaccaguaagcucuuauauuugguucaaggaggaucuuaagagcagucaaacaagaaaaucaggaaucaauugcaugcagcuccacugaacacauuuuauuugugucuguauguagaagagccauuugcaauauuaucaguuuucuacaauuuacagaguauaaaauagcuaagcgaaggacaauaaagggaaucuggaagagugccuuagacaauuccuaauacucccgucaaaagaacccaguguuuuguuuuguuuuguuuuguuuugcgggggaggaguauuucaaagucaccauuuucucugacaugucuucuuuacuauguugccuuuuaagguuagcauguauuuuucuggaguauaagaaacagagugaaugacuuagcuugccacuguaauggugccugucacugguucuuaaccacuuggggggaugugcauauaccccaaaaugugcauuccguaucagguuaaggacuucagauguauugauucucccaagacuauguucugugugacagccuccaucuguguggcauaaggccaauuuugggauuaaggugccuggcacuugucuucucucucuaguugauaagauugccuccagcuugcugccauggucguugcuucugacccuuccagggcagcccccuuuagaguucauaucugugcugcuucuacugggucucccucccucccucccucccucucuuuccuuccuuccuuccuucucccucucucuuucccucuguuguuucuucucuaugcuguugaauuucugacuuugggauuuugaguaugaaagcuggugacacugacacaucacuagcuacuccgagcguucauugcuuuucucuggagcacugccaaaucuccauguagggaggucaacucuucgccugcugacuucuuaugacaggguucguuguuuguucuggccacuuucuuaucaccaaagcugacuuuuuacuaagucccauuagauuuagaauuauuuagauacaagagagcuaagguuuuauauauuuauuuaaagaacuuuuauuaacagacaacagccagacaugcuuuccaaauuauuaucuuuucuauccuuccuaauauuggaaaccuggaucgaguuuuaacuaggcaagaauuugcaauguauguacaucuguugucaucacuguuaaagagucccaaguauaauagauuugaggggaaaaaauuauguauuuacugguaagacuguaaagaaaaugauuugaguacuuuauuagaaaauucucagugggaguaguuauguuauggggcauuuuuguuaauuuucauaaaacuaaguauuaauaacaaaggacuuuuuuuuccuucugagcauauuuuuucuugaauauuugggucaguauauuuuaaccauauuuaucucuaacuuuauaauuuugaugcuaaagccagaauucccuaaauaucacuuugccuuacagcaaauguugcugaaauggccaagggaggagauacagagacagagagggagggagguaagauaaguaauguaaaauaacauuuacacccuauuucuagaaaauaaucuuaaacaguuuuaauguggugguaaugcuuuguauuuuuuuuuaaauacagcauuauucuucauuaaugaacaauuuacaugucuguuuccaaacacaagugaauugaucuuaagaggcaaaaaacugaaugaauauuuucagcacuuucuccuuggggaacaucuccuguuuacaucuuaguugcuucccaggacaugccuuagguaucccucuggcacaugucuaaacauagauccagccagaaguagaggugggccuguguuuaaucuccugcuacaguucaagucagaacuacaccuugcuuuuacucuaaauauuugcauuauuguccuuggauguuuucccauuaugcacaacaaaucucuccucuuuaaaagaacugguugaugacaguaagagaaaucauacucuggagcgcacuuagagggaagaaaaaccacauguuuagugagguaaaacaaauaccuguuuuucuaccuuuuaauacaacaaacaaaaacacccacuaauguauuuacaacucucguuuuacaggccaacauguuuucauagaaaaguauuugaguauauuguggaugagauaggggaaauugauugcugcuucuggaccagccacucucuaggccugcaaguugacacagugaacaugauacacagaaucuuugcucucagaguuuaaauccuaguagggagaggcagacaauaaaaauguaggcaaaugaagaggauuuaaggaacaaggaggugugauaguuagcaaagaacuuacaugaagcaucuuuuuuuuucuuuucuuuucuuuucuuuucugagacagggccuugcugugucgcccaggcuggaguacaguggcaugauuauagcucacugcagcucuguagccuugaacuccugggcucgggcaguccucccaccucagcccccugagcaaauaggacuacaugcccagcuauuuuuuuuuuuuuuugaguuuuuuuuguagagacagggucuugcuauguugcccaggcuggucucaaaguccugggcucaagugauccucccaccuuauccuccuaaagugcugggauuacaggugugagccacugcgcccggccccauuugcaaauuucauuucuugaaacucuggcugauaugugaaaagagauagaaagggguuuggacuaggcugcuguccguggagauggagggaaauggauagaauucagagaaaugcaggaggaagguggaauggaaagaacuuaauaauggacugggugagggagagaaugguaugguggaugauccccaggucucugauuugauugagcaaaagguuggaagggaugcuauuaauugagaucauaaagagugaaagaggagcacuuaguagggaggcaggagagaaucaaagaucaguuuugcauaugguaaauuugagaugccugcaaaauagucaaggaaagaaaaaucuugaaugcacuuacaaaaugaguccagaaaagaggucagggcugaguuauggcuaugggagucauuggcacaugggugguaucugaagcuguggcaguggaugagaucacacaggggugaggauagacugaaggagaaaaacuugauccaggacuagcucugagauacaccagacuuuuaagggaucugguagagcauguggaacugacaaaugagccugcacaggaauggcuaacagcaguuaauuugcaagaaaaagaaacaaacuucaugagcacagaccacacaucccuggccagcgacucucagccacaagccccaguuggcuucaaaaaaacuuucucuaaugcuggaaaauaaaucuacucaugcaugucuucuugguggagggggagaaagagcuucagaugguggaggggaacaaggagcuucaaccucauuuaaaaagacgacuucacuggaauaacccaaagaauaaaaggaaagugugacacagcugcuguguuucuggagcgggguuugaaguuccucuaggauaaauaugaaagccucagagaucaacuucucuaucuugauucauacuugauuaccaguaaauggggaaugaucuugcuuaguuggcaguagauuugccuguuacacacucucuugcaggaaguugaagugcuguaucauagaguuuuuguuuuccauguuugaaguuaaaugggauauugagauuuaaucagaaaaguagcugagaagagguguaaacaugaaaguccagucuuggauaaaggagaaaucuuaugaauaccucucccucugguuucaauauuucacaacauaaaguauguccaacugauagacuuguaguaaaucccagguaagauauuuguagacugugccauguucuaaaacauuaaaaaaaaacacaauaacauuucaacuuuauauguaauauauuacugaaauccugguuaucugcugaguagcugaaaaugguuggguaucccuauauaaaucaaguuuauugauuuuuuuugaggucuauaucaggaguucuaagaugaaauauggucccugguuuuaaugugauacuguuagcuacauggaugccauuucuuuugacauaaauucuuuagugugaauuaaucuuuauacucuuuugcaaaucauugaagaauaggaauagaaacagauuucugcuuaaaugauaaaaacauaaaacauuaaaugauggaaacuucuccauaaaguuggcuguuucucacacauuuucacuuuccuucucuuuuucaaaauauauuuuaguucuucugcaguuucaguucauguuucagaaguuuaaauuucgacauuugugaggggacccuuucuuauucaaucaagacauucuuugaguggauguauggcacuguauauuuauaaaugauguucaggucauaaggaaccauuuugcagcugccucuacuauauaccacgaacuacuuugguccaaauuucaaaucuaauuugguucuucuuuuccucaauuuuauuuaauuuuaauuuuuucugagacagggucucacuuuguugcccaggcuggagugcaguagugcaaucacugcucacugcagccucaacuucccaggcucagauuauucucccaccuccaacucccuaguaacugggacuacaggugcaugccaccacaccuggcuaauuuuuuuuuuuuuuuuguaguuuuuuguugcaaugggguuuugcuauguugcccaggcuggugucaaacuccugggcucaagugauccucucccuaccugggccugccaaugugcugggauuucaagugugagccaccacaccccgccuuuccccaauuuuaaauccaacauggcaguucuggauuaagggagucacucuuccuauaugucuucccagucuggauuuugaagcagcugccuuuuugcuuccuaaugaugcuagccuauccaaacuagaaauaaucuuauauaaucauugaugccuugacucauuuguauguaucuguauuuuuaaacuuuuuaucuuucauuaccaaaugacugcuuucugauacccaggccuaggcuuaaacacuggcauauauggagagaacaguugccacucgacucagagauugaguagacacccaaagaacugcaguucuuaagccuuaggagaagcgagagaaaugggccaggugcgguggcucaugccuguaaucccagcacuuugggaggcugagaugggcagaucaccugaggccaggaguucgagaccagccuggccaacauggugaaaccccgucucuacugaaaauacacaauuagccgggcaugguggagggugccuauaaucccagcuacucuggagacugaguugugagaaucacuugaacccgggagguggagguugcagugagccaagaucacgccauugcacuccagccugggcaaaaagagugaaacuccgucucaaaaaaaaaaaaaaaaaaagauugcuacaugcauggaguggggaaaauugugguagaagaaaaguaaacuugguuuggagaauaaacauuuauugagcauuuucacuugaccagcucuaaggugggaagauuacauauagugucuguuuaauauuuaauauguauagccauuauuauguauauuguaaacaucugucagaaguuauaauuccaaaaguaaacucuaagcaacagcuuuuucaaaguauauuuuucauguagcacauuucauuagcucaugaaaagguuauuuccccaaaauguguaaaaauguaaagugaacaauggccauucaucagaaauagcaagugacaaugagcucuccaaggagcacuucuuuucaacacucgacuucuggaggcugaaauucaagguacuuaggacagccaaauugguaggcacuggccaaugucuugggaaauuugacuuuuugcaaccggauuauaaaacaaggcuuuccuuuugauuugcuuaaucugccauuuuacucaauauuauggcuuugccauuuguucuucuuccauuuaaaugaauuucuuuuaaaucgcuugugguugcuguugcccagaugacagguauagaguugauuuuguauuuuuuuuuuuguuuugagacagagucucgcugugucacccaggcuggagugcaguggagcaaucucagcucacugcagccuccgccuccuggguucaagcgauucuucugccucagccuccugaguagcugggauuauaggugcccaccaccacgcccauguaggccgggcuggucucaaacuccugaucucaaguggucugcccaccucagucucccaaaguguugggauuacaggugugagccacuccacccagccaaaaauucuuuucugaacagagacuaaugucgguagauguaagacaaaccacaaauggugggaaaaugaggaaaaaaagugcucccaaauaccuguuuuuaguucgcuucacuugcugauauuuacuaauuguuaauucuuuuccucucuuuuuuuuuuuuuaguggccacagaugucuuuaauuccaaaaaccuggccguucaggcacaaaagaagaucuuggguaaaaugguguccaaauccaucgccaccaccuuaauagacgacacaaguagugaggugcuggaugagcucuacagagugaccagggaguacacccaaaacaagaaggaggcagagaagaucaucaagaaccucaucaagacagucaucaagcuggccauucuuuauaggaauaaucaguuuaaucaagaugagcuagcauugauggagaaauuuaagaagaaaguucaucagcuugcuaugaccguggucaguuuccaucagguggauuauaccuuugaccggaauguguuauccaggcuguuaaaugaaugcagagagaugcugcaccaaaucauucagcgccaccucacugccaagucacauggacggguuaauaauguguuugaucauuuuucagauugugaauuuuuggcugccuuguauaauccuuuugggaauuuuaaaccccacuuacaaaaacuaugugaugguaucaacaaaauguuggaugaagagaacauaugagcacaugaguuaagauugugacugaucaugauuuauuugaagauggagcacugcugauuuaugaaggaaaaaagaagaauuuucuaaagauuacacauauuucagaaagacuuuacccaauucaguugucagacauaaugauuuauuugaaggcuuguuuuauuugaagaaaagcauauugccaaaaauucugguuaaaagcuuccuaacggguaacagaccaugggagagauaugugguuggguaaugcaaauguaguuauacaaagaaaaauacagaugucuccagaccugaggacuuuuuaauagggcaguuguuguguugguggcacauuggauauuucuaacauguacaaagcuauguauuuugauuuacuuucauuucuugcuauguauauguacuuuucuuaaaaugccaagaacuuucucuugcuaucauugcuccuuuugaaacaauucaauuuucaugucuacagcugacuguuuuguuaagauugagucaucgacauucaggauuuaagucugagguagucaacccucaggaaaaaaaaaauggcuuaucugaaaucaguacuguggaaaugaacuauauuagcuauuaugaauaauguccaguauaagaauaugcuucuggaauugaguucuccuuuuaaguaccaaugauacuuaaauuucucagaaauguaauggugugucauugccuugaaaugcuugcuuagggcuucuuuuauguuaucuuaaaaagugcuggugaauuuuccauuuuuuacauccauuucacauguaagagacaaaaaagucuagauuggucuugauauugagauaauaaaaaguaaguagcauuaagaaagguaacaaucuucauucuacagaugaacucauugaaacaauuuaggggaaugaggggcaaaaggggagaaauacugcuaaagaacaugagcauaaaaaugcgugcguuucaguguuuaagaaggcuugauaaagaaugucacuuuuuuauuuaacugauaagauuuuuguuauuuuuuacuuugauaaguaaaccaaagaauauuuguauuucaagcaguuugugugguguuucuauauaauuuucuguguauaaauaauaaaguaggcauuuguuuauuuuguaaaaaagaaaugaaaaucugcuggccagcuauguccucuaggaaaugacagacccaaccaccagcaauaaacauuuccauugucacugugucuaugauuuuuuuuuuuuuuuuuuugagucucgcucuguuguuuaggcuagaaugcaguggcaugauuuuggcucacugcaaccucugccucccagguucaagugauucuccugccucugccucccaaguagcugggauuacaggcaugcaccaccacacccagcuaauuuuuguauuuuuagucgagaugggguuucaccauguugcccaggcuggucuugaacuccugacuucaaaugaucugccugccucggccuccgaaaguguugggauuacaggugugagccacugugccuaugauuuaguguacucucuugccuuaaauuugccugccucccagaauauugacauuaaaauaauaguuuaccaggaaagguuccacaacuaaaaauuccagaaguugagaucugcucuaacccauuucagccuagagaggguggucaguuucucugacacccucauuugcuuggcuaagacaagcagcaaagguguagaguuucuuccuguuugauauuaaauccugacacuaagauuugaacugaaaguaucauucucacuuccuagagccaguaggugaucaguauaugcuguaacaauaacacagugacuacagaaaugacccuucuagcuucauaacuugcuaaguggcuuauaaauggaauucagcagccuuccuugaccagcuguuuuccucacaugugaaggcugagaaugugauggggggugugagcuacugacuggauguguucuguucuccagaucucaaacagcagagguaugggaaacgaaagcccugggcaguccauggaugcuucuugcucaucuguagcuauagacaggaccaaccagagagagaaaacguacggagggagaaaucuggaucucucuggacacacuggaucauaggguugugccagcaggcuagcaaucaaaugugcaugggauugggggagcaaugcuucaucucccacagag

SEQ ID NO: 18551 - RNA, 15527 nt, Homo sapiens
cuugacaaauccauacuaagaaagaaaaauaagcaacauauagugcaaagaaaagagcucauaauucuaaccaagguggcaugaaagacuucaagaagaaggaggcauuugauuuaagcuugaaggauuuagguaggcaugccauuaauuggaauaggaaacaucagaagaggagugaguuuauggagggcaaugaguagaaaaauugggggaacagagauggagucaauagauuucguuuaacauguggauuuuaagaugcaaaugaggacuuuuuguagacaacucagaaagcaucuggaaaauuaguuuuagaaauuaagagggaaucaagaguuuaagauauaaaagagaacaacaugaaaauagaguuggugucuuggaaguggacgaaauuauccagccagaauaugcagagcaagagaaagacagagaaauagagagauacacacaaagagagagacagagagaggagauccccacauuuaagacccaguuagaggaaaggcaacaauaacaacugaggaaaagugagugagagcugugacagugaccagaaaaauauagcauucaccaaagggagaguagaaacugaagaggucaauagugucgaugcugcagauaauauaauuagaaaaagugucaucuuaauggacuuaucuuacuuggggagaaggagaaauuuucugcaucuuaggccaugauucaaccuuggcucagugaggacagacauaacuagccccucuuuuguauggccccacuuaguaucucuccccagaggaaggaagaaagaccaaucugacugaagagagccagagguauucgcugaaccacauuuacuaacgugaggauaccaugcucuaaaggcaguaacaagccccaccguuucuguuccacuuccuacaccuauauggugggcuuccuucugcuuccuuuauucugucgcauggauuaucagcaagcugaucaagacuguuacucagcuaguaagaggcuaagccaucuccuuucuguucuuuaucuuccaguauggcaguuucguccagacuaucacuugaaacuauggaguggccagccuagaccugccuggcauugggcacuggaacaagcauacuccuuuuuguaaucuuauuuguuuucauuugguuccuaugggcauagauuuccuaucucugcaguuacagaacuugagguaugaaauagggagaggcccacacugaauccugaacauuuuggugcucaauguggcaacaaaugagagcuaccaucugaaaccaaaauauggcaaggagagaugaaaacuuuuguauuuaccauggcugauuugagcugucacugagcugcagcugucuuuagauggcagcuaugcaggccaaaaguaugcuuuagcauuuuuaaaccacaguaucugaguuuaauaagaaaauggauccaucuggggaucaacauaggcuuuccaggaacucauauugcauaagucaggaucaagucuugaauggagauagaaauuccuuuccuggggucacaagaagcuuucuaaggggcucuauacugcaacggcagcuggauuuugcaugaacuguagaaccauugcuagagccaggaacagagcuuagacuugcucuuuuucucaagcucagcuuacuagguggaaaucucauagauuuuuuuuucugauuuuuuucuccuuuaucuuauuccuuagccuuggacagaugauccagguugaaccugcuguagcaagaaaauguuagcaagaaggaaauuuuuaagcauccuuuggaguagcaaagucaguguuacuaaucgaugccuagcaaaugucauugcacccuaacugggccucugaaaccuuguuauguugguaacaaaagguacaacacagugggccgggcgcgguggcucacaccuguaaugccaacacacugggaggccgaggugggaucacgaggucaggagaucgagaccauccuggcuaacacagugaaaccccgucucuacuuaaaaaguccaaaaaauuagcugggcaugguggcaggcaccugcggucccagcuacucgggaggcuaagguagaagaauggggugaacccaggagguggagcuugcagugagccaagaucaugccacugcauuccagccugggugacagagcaagacucugucaaaaaaaagaaaaaaagaguacauagaaacacaacuagucuuauuacacaagauauuucccaauugaguuuaggcucacagacccuggccaacuggcacaguaugacugguaaccuggcaagcaaccugacaagcucaaacaagcuuuucuguuuucuccauucugcaaauuauccuaaaucgcuuggcuggcaacugcaauaaagaucuaaauugugcugggaucugggaaauaucauuuuugcuugugauaacugcugcucauguuuccuaaguauuguggguguguagcugcugcuacacuggucuuaugcauccugugcucuuuggaaaaguaagacaagugagagaauugcaguugaguucaucccacuuuggaggugcaagaggagcuagcauucauucuaguauaacagcacaagauacggugauagcauccaguggugacuaguguauaaaagugaugcuuucacugcauauucucacucauaaguagaagcugaacaaugagaaaacauggacacagagagggaaacaucauacacuggagccuguuggggcauggggggcaaggggagggagagcauuaggacaaauaccuaaugcauguggggcuuaaaaccuagaggacggguugacaggugcagcaaaacaccauggcacacauauacuuguguaacaaaccugcacauccugcacauauaucccagaacuuaaaguaaaauaaaauaaaauaaauaaacauuuccacauuuuuauaaagugguguuuuuaauaaaagcaguaccauguuuuccauuuuaaacuuaucucuugggcacacagaucccuaugcaggagguaagauuucaucaugcauacauucagccuuuauuuauuaagggcuuguauuagucuguccucaugcugcuaauaaagacauacccaagacuggguaauuacaaaggaaagagguuuaauugacucaugauuccacaugucugggaaggccuuacaaucaugguggaaagcaaaugaggagcaaagccacaucuuauaugucggcaggcaagagagagcuugugcaagggaacucccauuuauaaaaccaucagauuuugugagacuuauucacuaccacgagaacaguauggggaaaaccacccccaugauucaauuaucucccaccaggucccucccaugacacaugggaguuauggaagcuagaguucaacaugagauuugaguggggacacagccaaaccauaucauuucacccguggccccuuccaaaucucauguccuuacauuucaaaaccaaucacaccagccaggugugguggcucacaccuguaaucccugcucuuuaggagacugagguagguggaucgccugaggauaggaguuuuagaccagccuggccaagacggugaaacccugccucuauuaaaaauacaaaaauuagccaggaaugguggugcaugaccguagucccagcuacucaggaggcugaggcaggagaauugcuugaaccugggaggaggagauugcagugagcugagauagugucacugcacucuaaucugggugaaagagugagacuccaucuuaaaaaaacaaaaaacaaucaugccuucccaacagucccccaaagucuuaacucauuucagcauuaacucaaaaguccacaguccaaaaucucaucugagacaagcaagucccuuuugccugugagccuguaaaaucaaaagcaaguuaguuacuucccagauacaauugggguacuggaauugggaaaauacaccuguuccaaauuggagaaauuggcuaaaacaaaggagccacagaacccaugcaaguccaaaauccagaggggcagucaaaucugaaagcuccaaaaugaucuccuuugacuccaugucucacauccaggucauggugaugcaagagguggguuccuauggucuugggcagcucugccccagcuuugcaggguacagccccacuccuggcugcuuucacgggcuggcauugagugucuguggcuuuuucaggcacacagugcaaagugucaguggacuuaccauucugaggucuggaagacgguggccucuucucacagcuccacuaggcagugccccagugggggcucuguguggggccucaaccccacauuuucucuucuguacugcucuagcagagguucuccaugagguccccaccccugcagcaaacaucugucuggacauucagaguuuccauacaucuucugaaaucuaggcagacauuccuaaaccuuaauucuugacuucugugcacccucaggcucaauaccauguguaagcugccaaggcuuggggcuuacaccuucugaagccauggccuaagcuauacuuuggccccuuuuagccauggcuagagcgacugugugguaggguaugaagucccuagacugccuacagcagagggacccggggcccaguccacaaaaccaguuuuuccuccuaggcugccaggccuguggugagagacgcugcugugaagaccucugacaugcccuggagacauuuuccucuuucucuuggugauuaacauuugguuccucauuucuuacacaaauucugcagccagcuugaauuucuucucagaaaauggguuuuucuuuucuaucucauugucaggcugcaaauuuuccaaacuuauaugcucugcuucccuuuuaaacauaaguuccaauuucagaucaucucucuuagguucaaaguuccacagauuucuagggcagaagcgaaaugccaccagucucuuugcuaaagcauaacaagagugaccuuugcuguaguucccaacaaguuucucaucuucaucugagaccaccucagccuggauuucauuguuuauaucauuaucaucauuuuggucaaaaccauucaacaagucuccaggaaguuccaaacuuuccuacauuuuucugucuuccucugagcccuccaaacuguuucaaccucugccuguuacccaguuccaaagccgcuuccgcaucuucgugugucuuuacagcagugccccacucuacugguaccaauuuacucuguuagucuguucucaugcugcuaauaaagacauaccccagacuggguaauuauaaaggaaagagguuuaauugacucacaguuccacguggcuggagaggccucacaaucauggcagaaggugaaugaaaagcaaaaucacaucuuacaaaucggcaggcaagagagaguuuguucaugggaaaucccacuuauaaaaccaucagaucucgugagacuuauucacuaccaggagaacaguaugggggaaacugcuccugugauucaauuaucucccaccaagucccuuccacgacauguggaaauuaugggagcuacaauucaagaugagauuuguguggggacacagucaaaccauaucagggcugcuaugggucaggcacuguucuuggugcugcaaacaaaauagacaaggucccugcauuuauagaucuuauauucuagagagaaaagaguugauaaacuacaaauaaauaauuccagauaacuguaagugcuaagggaagauauuuauuaauuuaacagaugucauuauuuucuaggcacuuucuuaguauuuuacaaauauuaacuuaucugauuucauaacgaccuaaaaaguagauuuuauaauuauccucauuuucagaugagaaacccuuccacaaaaagguuaaauaacugcuagcauagagugaagugagaauucaaaccccagugauuuuugccuaaaacuggauaauucuauucaaaagagacuggaagcagagacagggaggggagguacaaaucuacagaagguauccuggaaaggcuuacagggaggugaauuuugagcugagaccugaaugucaacaaggaaccagucaagcaagcauuaggacagacccuucugggcagaaugaaaagcacaugcaaaagcucuguggggaaaacaccuugacuuccugguacaugaggaggucaaagaagugggcaaggaccagauuguguggagccuuguaggcaauaguuacaaguauggauuuucuucuaauuauaauagaaaucccuugaaaagccagggaguaaaauaaucugauauguaaaaccacaaauuucauuacauauacuuauaagaauguaugugccuagagaaaagcccagggaggggcauaccaacugauaacggugguuaguucuggagauauguucgggaucaugacagugaugaaagagacuuucacuuuaucuuuuuuuguucacaugaaaauguacuuguguaauuauacaaaugaauaauuuuaaaaaaacaauuuaagcuccuuaaaauaccauguauugcauagcguaaaaccuacucaauuacaagcagaugcaccaugcuaaagaaaacacaauauugggcagcuuguguagccugaguuguaugauguguaucucccuuagagaaaccacaagcagccauguguauugcauaauaagcuaaucagcuuaggaagcagagaauuugggaguacugaggagaagcaugcuaaauaaagcugcaugcugaggcugagaaaaugcaauuuaggaauaagaacuuagcugguuucucuaacuggaaagccguggaugaucugugcguuguauaaacuaugaaaaccacuuucaguguaaaguugagcuacugccagcauuugucucucuuuacagaauguacccagugaaauguuaauuaggaguaaaacuggcuuaccucauucaccuauuccuuugacacuuaagccacuugggauuuaccacccacuuucacauuuuguuacguucagucuuccaacuuccuguucacaaccccucuuuuaucacuuaguuuauuuccugcugucuugcgcuccaccucaacugcuuuuauucugcuuggggacuucagaaucaaugugcauuggacccacugaauuggacccauccaauacuuuguauccuaguuaaugcucucauuuccagugacuuuuuaaauuuaacaacugcuagcacucucgcccauacucacaacccugaauguguucauuaccaagaaccuuaccacuucugaaaucucauguccgaauguccugccuuucuagcacaagugcucccacugcagaagucuccagcaccaugaccuccagugcauccuuggcgcuccuaauacccagacccuuuucugucuuacuuucuugucuugcuuagacucuaugacccaccauuacaaucuacagccuugcuucucuuuuccuucuaucaugcuuuccuagaaaacuuugcaguuuuccaguuuaaaauguuuucuaacuucuaacauuucuuucuugaugcaugaguuauuuacaaguuaucuucuuaaaaucaaacaaggaaauuuccuagucaucuuuuugucaaugauuuugagcuuaaugcauuauuaucaaaaaacauucccugauuucaagccuuuuaaauauagggaagccggcuuuaugauccaccauacugucaauuuuaacagggauuccauguauacuugaaaagaauggguauuugcaguuuggggcucaggguuccauauguggucauuaggucaaguuuguagaucauauuguucaagucuucuguaucuuuauggauauuuuaucugcuugcacuaucaguuacugacagaaauauguuuaaaauaccccacuaugauucaggguuuuucuaaaucucuuguuauucuuuccauuuuuuugcuuuauacguauuugaagguuugcuauuguccugugauccauucuauacuauagaagaccagaccccaggaaacuaucuacaacuucccgaggaucaugaggaccuuagcagguuuacuuuuuuaaauucuagagaaauugucuguuuagugucucgcuggaauacaaucacuauggccaaggagugucuuggcaagccaaugcugagucauaagcuaauucuuuuuuuuuuuuuuuuuuuuuuuugagacggaaucucacucugucgcccaggcuggagugcaguggugcaaucucagcucacugcaagcuccgcuucucagguucacaucauucuccugccucagccucccgaguagcuggaacuacaggcacccaccaccacaccuggcuaauuuuuuguauuuuuaguagagacaggguuucacuguguuagccaggauggucuugaucuccugaccucaugauccacccgccucagccucccaaaguucugggaauacaggcgugagccaccccaucuggccgucauaagcuaauucuuuagggcaagaucuaagacugucagcuccuacaaaaacguggagaaauuccucaaaaaaaaaguggacuacuguuuugcacagacaauacauuugcacugcaacuagcuuuuuacaauuguaaauagacagcaugacaacucuuuggaguuagcauuagcaacucagauucaaagcaguagcccauccacuguagaccgugggaggggccuaaguauuuaacauagaugagcaaagaauauagaaucagaaaaugcaagaaaauuucuggaaagagugauacaaguuacuuuuacuuaaaagucacaccucaguuugaauuucaacaccuucccuaucuauauaaacguguauaaauuauugaccuacucuaauccccuucugaaagauauaauuuaagugccuaguaaauacuaacugcucaauaaagguuaauuuccuacauaaggagggagaguuuacucuagaacaccacagugauuauaacuuauauucauagaugauuggauauauuuaugcuuaauuaugcauagaguucauaguauaaacuaucgguuuagucuuucucaucuaaaucucaguuuuaaagaaucucuucaacauuuggauaugagagguggcuucacagguauauuaguuauuaugcuguuuaacaaaucacuccaaaaccuagacacuuacaucacaaacacuccuuuauuaucucuguuuauguggguuggaaauuugggcauagcuuagccagauaccuaaagcuugcagucucucaaaaugugucucacaaggcaaucaagguguccacuucaacugcaaucauuucaagacucaucugggggaggacccacucugaguucacuucuguggcaauaggcagaccccgggucuuuucuggcuguuggcuggagacaucaguuccuugccaccuggaccacuccauaaggccacucacagccugcaacuggcaacucaaggugagaaaaugagagagcaagagaagacuccccccaaaagaagccaccaucuuaaaaaaaaagacuuuauguuuuagagcaguuuuagguucauagcaaaauugagcagaaaguacagaguucccauauacacucuguucccccaacacacacauaaauucccccacuaucaacacccuaucagagggguacauuuguuacaaucagugaaccuacacuggcacaucauuaucacucaaagucugugguuuacauaaccccuaauguaaacccagaaacccagaaacccaucaguguacauucuauggguuuugacaaauguguaaugacauauauccaucauuauaguaucacacaaacuuuuucauugcccuaaaauucuucuuugccuauucauuccucccucuccccaagccccugacaaccauugaucuuuuuauuuuauccauagguuuuccuuuccagaaugucauauaguuaaaaucauacaguauguugccuuuuucagaugggcuuucuucacuuaguaauaugaauuucaguuucuuccaugccuuuucauggaagugcauugacuccauuggcucuccuaaugccagccucuuuucugucuuacuuucuccucuugcuuagauucuaugauccaccauuacaauccacaaccuugcuucuccuuuccuucuaucauucccuccugguuuccaaagaaaacuuugaaguuuuccaguuuaaaauguucucuaacuucuuuuuuucccccuuuggcaguuuuuuuuuuagaaaauuauuauuauacuuuaaguucuaggguacaugugcacaacaugcagguuugauacauagguacacaugugccauguugguuugcugcacccauuaacucaucguuuauguuagguauuucuucuaaugcuaucccuuccccaguuccgcaccccacaacaggccccggugugugauguuccccaccauguguccaagugaucucauuguucaauucccaccuaugagugagaacacaugguguucgguuuucuguccucgugauaguuugcugaguaucgggggaaucugcccccaauauuucaauguaguuucuuucuauuuuccauaagugucagcuggcugagaaauaaagagaaagaguacaaagagaggaauuuuauagcugggucccugggggugacgucacauaucgguaggaccgugaugcccaacugagccucaaaccagcaaguuuuuuauuaagcguuucgaaaggggaggggguguaagaacagggaguagaucacaugcuucaaagggcaaaaagcagaacaaagaucacaaggcaaaaggcaaaagcagaacuacugauaagggucuauguucagcagugcacguauuguuuuaauaaacaucuuaaagaacagaaaagaggguucgagagcagagaacuggucugaccacaaauuuaccagggcaggguuuuuccccacccuaguaagccugaggguacugaaggagaccagggcauaucucaguccuuaucucaaccacauaagacagacauucccagagcagccguuuauaaaccuccccccaggaaugcauuccuuucccaggguauuaauaauauuaauauuccuugcuaggaaaagaauuuagugauaucuucccuacuugcauguccguuuauaggcucucugcaagaagaaaaauauggcucuuuuugcccgacccugcaggcagucagaccuuaugguugucuuccuuuguucccuaaaaaucgcuguuauucugcucuuuuucaaagugugcugauuucauauuguucaaacacacguuuuacaaucgauuuguacaguuaacacaauuaucacagugguccugaggugacguacauccucagcuuacaaagauaacaagauuaagagauuaaaguaagacaagcauaagaaauuauaaaaguauuauuugggaacugauaaauguccaugaaaucuucacaacuuauguuccucugccgcagcuccagccagucccuccauucggggucccugacuucccgcagcagcugagaaugaugguuuccagcuucuaacauuucuuucuugaugugugagcuauuuacaaguuugcuuccuaauaucaagcaaggaaauuuccuaguaaucuuuuuauuaaugauuuugaguguaaugcauuaucaucaaagaacauucccugauuucaagccuuuuaaauauagggaaacuggcuuuaugauccacaauacugucaauuuuaacagcgaagaugaagcucuuuuuuuuuuaaguguugaauaaugauccauucuguggaugugccacaucaguagaaggacaucuugguugcuuccauuuuuggcaagccauagucuuuuuguaaccuaaggaaaugauaucccauaacuuuugcaauauucucuucauuugaagcaagucaauaaguccaccccaugcucaaaggggagagauuguacaagggcauggauaccaagagggaaagauuguggggacaauuguagaggcugcccacccuaccaggaaagacaaauguuuacaguaccuugaccacgcccaagcagccaggccaguuaaagaaugcccuguacagaguccauaccugugaaaaaaguauaguauuuuuguuuuaaugucgcauaauuuaccaaaguacugaaaacuuuaagccacacugcagauguacuuggcccuauugagaauaauccuaaagcaaugcauagcacuuuaaaaauugcugccagcucauuuuccuugaaaaacagaaucuauuucuaguacauuuucuuggagagcugcccauccuauucaaguuuucaaaaaagggaccuuucaauuaaauugucauuuguuccacuccugccugugcugcagaggagagcauguuacagagaauacaauaugcaauaaguaaaauaauuccaaaaauauuacaaacauacauuacaucgcugagauguauguaugaauucagauccuacguuuuaauucuuguagggaaauuuuauauuauuuacccucagcugaaguaaaagaguaaaauucuuuugcuuucuuuccuucccaagucguauaaucccuguacuaguccaauauuuggugaaaaagguguuugugaagcuauauauuggcaggaacaauggaucuacgugcuaauuuacgacuuuuuacgacugaauucuuuaacucucugagaaguguguccagaugcacauagacccucuuugcuuuguguccuuagauuauuacauccaaacuaauuauauucucacguuaaacaacagagugauugaugcaaacauggucugugauagaaaacacuggcaccauauggccacaagagggaguaaagagccacagaaacauuagcgucuucaaggcuaggcucuaccauucccgaggaaauagagaacuuuuguuguuucuauuucccccacucucuuuuuccuucuaauaauucagagacuuucuucugaccaaaggcagagcuaguaucuacagaucucgcuguuacgaugaggcaaaguuagcccggagcagcuucuucucccgcugcuguccuggcugacuuccccaaggaacacuuuccaauaccaaacuaccagcagugggcuccugucuccgugcugagggcacccuccggugccugucucugcucuccgauuugccaccagagcccaaauagcugguuuaugggaagacuuguuauguugaacgcuucaaucgcuucuuaaauugauuuaucauggcacugaagcaauuagaugauauacagaccaaugaaucccuuguaaaggcuacaguaagcacucaguaagaggagaaaaaucagauugagagccuggggaaacauacuuuccuaggaaugacauaaauggaaaucccucaauuacacuccccaucauuccugaguccuuggcaccgggcgggggguaggggguggggggacguucuaaaacucagccccauaaaugguggcauguuauauaccaaauuaccauacgguuguuuggggauuuguuuuuuguuguugcuauuaguucagcuugaacaaaggagugaugaauagagcugaguaagauauuuagucccucagcagaauuacucagaagcugcaggcaguaugucaggcaaaaaauacagggaggagucaacacaaugggagauaaguuaugacugagacaauagaaauacaauuccuugaauccuggcugucgcuuauucaugcacauggauucaucagaacagguugccaaacuacaagggaaaaaacugaaaauaaauugccaaauguuugccacagaguuuauuuuccuauuacauuucuuugauaaacucuucuccaaaggauucaaagaguugugcugaauggaaauuucuuuuaaacacugccagagaugaagugaagucucaccuugauggugggagaaaagaugggagaaggaaaaaacaauaaccaagaugccuuaaagcagagaggacuggagaaagagcaauggcuaaauucuucagugugcaaacaugcagcuggcuacaggaaggagggugcagccaaggcucuucacuacagagaucuugaaagcuuggaggagcauauugcaauuuuggagacucaucacauuccgcaucuuggaauccuccagcagaguucagauccagacuccucaaacccgccagaugccccucccuaacacccuucugcucuuaacacuggucccuccuacacaaugcuuauuuauuauggagaaaucugugccuccagcucaccauaaacuuguauuccugccaugguauauguuccuucccagcuugagaccugcuugaaucaauaucauuuuacaccugggccccaaagcucagggacuucugagaagcaggccagccuuguacucuggcugagaagucucugugucaagaagacucaucucagaagucucagcaaaagaggaggaagucccgguggccugucauuauccaucucugauccaaucacugcagucaagggaaugugaagcuuugauggucaaacauggucacaugccacccuuagagcuggaaaucagcuccacuggaacccccagccuugagaguagaagcguagacucccugagaagguuggaggcuauuuuaaguagaguaaguggaugcugggcugucaggaagcaagacaaauccaccucaaucacuuuucagcccuucccucucuguagucuagcacagcccaggugacuauggaaccuuguguauuugaauagagagcaaauggagcucuugguguugugaagugugguggcccugacucucagcaaucaugugcugguugaccugugauaaggaucauuaguauucauuugcucaguacuguuucagucucugcccauaucuuucauuaauuucuauagucaccaagucacauacacacaaaucucaaggagacaagccaagacaaugacaacauuugaugacaacaacacagaucucagauaauaacuguuaaggugauaagggaaacuucaggaaucccuggggugauagaagauguuuauuagcacugucuuuaauucaucguaguacaaggcauguuaucaauacaaaauuuacaugaaguaagucauuuguuucagguguuuaccugaaacauauugaguucccucuuugagcauugcaauaaaguaauuaccuuuugcucccaucugguucuuauauuaacuacauauaaucaaaucaauuauuaagugguucaucagaaagaagcaauuguccuuccuaaugagacaucguccccaaacuugcagagcaacaagcagaaauaaugaaaauauaacaauucuucccaggaacaacaucccuuuuccucaaagugaugcaguucuguccuguccucugcagcuugccccuggaaaaucccacugucagccuugugagugauucugggaguacugacuccugggaacuagaucuccugaugagcucagacuuucagugaacuacugugagcacaggggccacgagcaggggcuuuggacucaaauccugcuagacuugagugugcacaggga

SEQ ID NO: 18552 - RNA, 92739 nt, Homo sapiens
cgcgcucugcgcucaucuuccuaccagaaaucggcaagucacugacccucgucccgcccccgccauuccccgccuccuccugucccgcagucggcguccagcggcucugcuuguucgugugugugucguugcaggccuuauucaugggcucaccgcugagguucgacgggcgggugguacuggucaccggcgcgggggcaggugagcaugcgaagguuggaggccgcgccccuugcugaggcgcagcuggcugcucuuuucgggccggcauacgcgcgcagccgcagcugaggucaccccgcugaggugguggggaggggaaugguuauucuugaggcaccgcaucucuugaggaggaaagagccggaaacaccuggucucucaagcagguacagcccgcuucuccccagcaccccggugugggcuucccaagguccugccugagaggagaggccaggcugggcugcugauugcaaaacugggugaaaguucucccugacccuuaucugugggcaucgauuguuacucuuccugcaauuaacucucuuagaucuuugccuagucuuuuaaaggacugaaaagccgcgaggggcgggggcuggaauucgcccccugaagcgcagagaugucagcuccugaaaagucauucggucguucaguguuuguuucccucugucguaagauuuuaaguucgugagaggaccuucuuuaaagagggcgucugauaagagcccuuccccguuggaguuuguaugcuuagcaagucacaaucuguucucgaaauccacuggagucuuggcagagguuguaagcucaaaugcgcacaggggucaggcguaugauggagaaagaaaaugggaguaggaugggcacaucugaggaacuggagagcagagaauuccgaaguggaccggccagugggaaaguugccuguauuucaggagcggcaaaauggaaaauuguuaugugaaauagccccauuuuuuaaaguacaaaaaauuaaaacaaaccauucauaccaacauagaugcugugcagugagauuuuacauuaguuucucaccagugggugaccucuguaaccuccaagugcagggaucuugacauuaugcaccuuugauucuccacugguaguaccuuauaccuggaaaggcccuaaugcaugaauuauuugaguuauauauuaaacguuacaaacuggaauucugucaauuaauuccuauguacuuucauaucuguauugauaaaguggcuucuuaugcugccuuucagaaaaugcuuucaguguugaugaauagccaaguauuuuauacccauagcugucugguuaucucugcaugggcauguauuuggguguagucauaccuucuaaauguuuuuaggaaaacauuuuguuuacacuuugcuuuuauuguaaauaauguauuuuacaacgcuugguguuuuaaaucuuuuuugacagcucuuggauaauuuucaugcaggagguccagggauuacauucuaagacguuuuugccaucgcuaaggagacuuuccuuuucaggggcuauaucugaaaaucauucaaggauagggacugcuucuuuugacaccauuagcauacuuacacaugguaugcaguacauuuuacaccaguacucaguacacuuacacaagcacauacaucuguauuuaaaaccaguucaugauauaguguguaguacaggcaaugcauccugaaauuuauuuucuauucuguuuuauuuauaaauuguaauuguaacccacaaaauugauuuugugaaacaaugaguugugacuagacaguuaugaacuuagcaccugcuguucauaaacugguuaaauucucucuuacccauucagaguugauuaaauuuuuuuuuuuuuucagagcuaaagguuuuacucuguacccaggcuggagugcagugacccgaucauggcucacuguaaccuugaacuccugggcucaagugauccuuuugcaucagcuuccagacuagcuaggacuguaggcaugugccaccacgcccagcuaauuuuuaaauguuuucaagagauggagucucgcuuuguugcccaggcuggucucaaacuccuggccucaagugauccuucugcuuggauuaaauucuaaaauaaguuauuuggugaaauuuccuaguuuuggaaaacuguauauuuuugguucuuuuuguuuuuguuugagagggaguuuugcucuguugccgaggcuggagugcagugacaugaucuuggcugacugcaaccucugccuuccggguucaaacaauucuccuaccucagccucccaaguagcuggggguacaggugcacaccaccaagcccagcugauuuuugugguuugaauagagacgggguuucacccuguuggccaggcuggucuugaacuccagaccucaaaugauccgcccaccucugucucauaaaguguugggauuacagaugugugucacuacuccuggccuuggguuguuuuuggaaggggcuaauaauuuauguaucucaguuuguuauuuguauacuuauugauuaauuuauacuaaauauaaauuguuaauuaaauuuauucauuugucaaugaaauuuaucaauuaacuuaaaauguaaaaaauauacacauauuaaaaaauguaaacaauacagaaaaacaauccagaaguaagccuuccaccccuuauugcuagccacauaguucuguccuccagagguaaccacuaauugccaguuucuaauguguuuuucccgagauacucuaugccuauaaaacuucucucuuggcuggggauggugguggcucacgccuguaaucccagcacuuugggaggccgaggugggcugaucacgaggucaagagaucgagaccauccuggccaacauggugaaaccccaucucuacuaaaaauacaaaaauuagcugggcgugguggcgggcgccuguagucccagcuacucgcgaggcugaggcaggacaaucaccugaaccugggagguggagguugcagugagccgagaucaugccacugcacuccagccugggcgacagagugagacuggaucucaaaaaaaaagaaaaaaagcaaaacuuucucucucucucucucucucucucucuauauauauauauauaauuucuuuuuggauauauaaauuuacaccuuguagcuuugagucagaauuaaauauuuucuguauuugaugacuguguagucaggguucacugugggauacagaaaccacuagauauuuuaagcagcaaaggauucaauacaggcaauuagguuuuaggcaggucuucuuagaauaacuccugaaacaauaggaaauugauccauuagaggaggcaauaccucugaggcugucauuggagcugugccacagcccaaguagcacuggcacuagggaccugaaguauggaagcugccauccagggauuagggagcugaaugaagaagucgcugcuauagucaguuucugaauaccuaggaacuuucaagaaaacuagcuucuuaacaacaacagccagaacucccaguaagguggucucugucucacuuacaccuucuaaguuuuaugcagaugcaucagaugguggaacccaauucacagcauccuagcagcuaaguagaaugguaggaagugguaguagaauagguggaaaaauacaguuuuaagcuuuccagccucugcaagcagaagagaguggauagguugagaaugucagugauaggauagguugagaguaucauuaaaauguaauuaauuguucaccaauuucuuuaaauggggauugaguugagcggaccaaaaaaauuaugcugacauuucuucaacuuucugauuauuuuguuuuugauuaggauugggccgagccuaugcccuggcuuuugcagaaagaggagcguuaguuguugguaaguugguguguuuuucuuuuuaaucuguagcugauaacugaaauacaaucuuuacaagcuaucuuugucuuucuaucaaauaauuugucaagguugaauuuuauuauuaauuuuuacuuuugccagaagguuuuuaccccgacuaaggcugucugucuaaauuacuuuuaaaagggaaccaguuucacagaauucccagcuuaacagaauugauaacgaagggcuaggggguaggcaugcuggcuuguggcuauaacuccagugacucaggaggcugaggugggaggaucgcuugagaccaggaguucgagccugcagagaacuaugauuauaccacugcacuccaaucugggugauggcgcaaaaaaaacccuguuucucacagaaaaggguggggacaagcauuuauuguauaaaaggaaauucuugacuucaguaaauuguaggcuguaauuuuuugagacaggagguuugucuacuggugcgagaucaaaagagagccccuguaaguguauugauaaaaguaagaaauaacugaauuuugagaacuggaaguuuggagucaaggaaucuaaaguauggguuucuugacucuuucaucaaaacuuuucagcuggaaguguuuuaaaaaaauuuaauugagggggcaguuacaugaguuuuuguuuguggaggggucagauggaagauacuguauugaagaauccuaaaggugggagguuuuaguaaucugcaugguuuggacugaucuaaugugcuugacaguugguguggacacagaaacgaauuuguccacaacugagccuuucuggggaauaacuaaaugggugcuaagugcagggggauauguaggacccaguacuuauuagcauauuuccugggauaaaacugugggcccacaaugaucuucuaauuucagcuuucugacaucuuaacgaggcaauacagagagacgaauuuucaucaguuuguucagggagacacauauaacaaaagaguaagcaagcaaccagguuuucuaaacaagcccuaagcagagcacuugauacacuuuucuccuucauuguggauguguagcuuaucuuuauggaaggaacacugacgcuuuggauguuccuuguuuaagaucauaggcacugucugcuaauccaaucugcuucuucuggcagggaugaauuuugacauuguauuauuuggacagcgaguauauauuucaggcccacuuugucagauuuucccaagaauagcucauguugaggccuaaagacacaugcuguuacuauuuuuaauuuuccuuccuuuuuauguugcuauuuaguucuuaauauuuuuaccuuauauguuuuuauuuauuuacaucuuuucugcucaauuccauaacggcaaggaucuuguuuuaucuuuuguaucuacuaaaggaccuagaauauuucuuugugcaaagaagguacuuuguucauugguucuuuuauuguugauauacuuuucugggggaaggguguguuugagauugguugaauacauuucuuuuuuuuguucuugacuaagauauaaacuuaguuuauaaaccuguuuuguaaaaaauuuuauaacaguguguuccugugcaucaauuuuccuuuauuucccuguucccucucaauuucuuaaauucagauuaggaguauuugaauucuaagaaaaaauuaaacagagaugcugugucuaucuauuuugucauugcauuauuauaguagagaugauaauugugucaaguccugauaaaaguccaagaauauagaagaaaaauauuucauaaacuugaaugaagagccagauuuaguuuaguauuaaggaggagaauucaauccauguggaagugcagaaauuuugacugauguuuucuauuccuuuuuaaagucugugucuuaccuguuagccuuuuuacauguacaccauagacaccguguuuccaaguugcaucacacacacuaauuuuuuuuuuuuuuuugagauggagucuugcucuguugcccaggcuggagugcaguggcgugaucuuggcucacugcaacgucugccuccggguucaagcaguucucugccuuagccucccaaguagcugggauuacaggcgccugccaccaagccuggcuaauuuuuuuuuuuuuuuuuuuaaguaaagaugcgguuucaccaucuuggccaggcuggucuugaacuccugaccucuuuuuagaaguggcaugucacuucuaccgacauuucauuggccaaaggaaaucauuuggcuaagccaaaaguuaggggcaucauuuaagauagucuccaauuuuguguuaauaugauugcuauguuuuauauuccauaauauaaagcuuaugggauauuuaaauuugguauaagaacugcuaagccuuaggcugauacuguaaaaagggacauuugcuuuuguguaaauuacaucuuucaggaaaugcuugugcauuucuuaaguagguuauugggaauucaguaguuuugagguuuccucaguaggugagcuauaucuaguucucugaauaguaaguuuuauuuugaggacauaaacacaagaaggacugacaaaaaggagcaaaaagaacuccuuaguaaaagaaagggaguucuacucuugaacugaaguaacaccuuuggguaaauugaauuacaaucuuuuuaaguaagauugacaugacuuuuccgugcuacaguuacauaauaaugguaaagcugagucuuaacuuccuguggccugaugcuagagccauuguuuuuaaccccuaugggaucuugacagcuggaaggugaacuguagugggcaaggugcauugccuuugaagucaggccaaguuuuaaauccuggcucugcugccuaauuauaugaccucucuguuuauagcugucuuagcuaacuuccgggauuauggugaggguaaaugacaaaaaauuaaagacuuucggaaagggaagagaaaggaaccaauaucagucccugcuuaccauauaugacucacucugcucaagaacuggauauaucaaagugaaggucuuguugacugaggucuuguugacucaaggcacauccuagcccccuuauacauguuucuccuagaugcuuaaaggaaaagcucugugucuuagucuguuuucuguugcuuauaacagaacacuuaaaaccggguaauguauuuuaaaaaaggaauuuauuucuuauaguuauguaggcugaguaggccagugcugaggggcuacaucuggugaggagggccuccuuucugguggggacucuguagagucccgagauggcacagggcgucacagggcaagaggcugagugugcuggcucucgucucuuuuccucuucuuauaaagccacuagucucacucccaugauaaccuguuaauucauuacccgauuaaucuauuaguccaugaauagauuaaugcauuuauaagggcagagcccucacaauucaaucacuuuuuaaaggccccacaucucuuuuuuuuuuuuuuugagagggagucucccucuuuugcccaggccggacugcaguggcgcuaucucggcucacugcaagcuccaccucccggguucacgccauucuccugccucagccuccuaaguagcugggacuacaggugccugccaccgugcccagcuaauuuuuuuuuuuguauuuuuaguagagauggaguuucacuguguuagccaggauggucucgaucuccugaccucgugauccgcccgccucggccucccaaagugcagggauuacaggugugagccacugugcccggccaaggccccacaucucuauacugucacaucagggauuaaauuucaaugugaguuuuggaggggcuaaauauuuaaaccaucccaggcugcuuuaggcacugauacacucuccgcaacgguaaguauaguacuuaguaaucaagaauauauacugauugaauaagugaaacugauauaauacagggagaaagaucauaagaaggcacaugugaauuccagcugauaauaaaugagccguacaugaaauacccacaucucccuuggauaccuccaugacuaucaccaaucuggauuaugggggaaaaccuuugaauaaauuuagaguagcucuuagcuauuugucauuuuaagagcuagaguaguucuuagcaagucguuauuuugucauuugccaguuuuaaaaaaaguaauaagguuaauagacuuaacaucaaauagauucauuuauucaucuaacauguauuuauuaagcgucuauuauguagcaaacacuguucuagaugccagaggaauauagugggaauaaaacagagucccuacuuucauggugcauauauucuaguggggaguaguggagggacagauaaucaagaaauacauauguaaaaauauaauagauguaggugcuguggagaaaaaaaugagugaauggaacagaaaaugcuuuaaggagagacugcaggaagugaaggagugcgccuugaggagaucugcugucgcggcaucccuggcagaagaagcagcugaagccagguuacugaggcugcagcaggcaugguauguuuuaggguuaggaagggagccagugugguuauauagcgagcaaggucauaagggagacaaaagugagagaugagggcagagggguccuagaaggccagaucacauaggaccuuuaguucagaguaaggacuaacuuuuacccugagaugggguaaaaagcaauguacauaauagucaucaaguaauauugaugcucagauaugaacuuuauuucucucucaacauuucaguaaaggaauuuaugauucauaucuuauguaacaaagaauuaagaucuuuuauaaauaaaggacauuuacaaaucuauaagcaaguaucccaaauaaaaugugaacuaaauaggcaaaacaauaauaaauauaaauauaagccaugaaaauaaaauauuacuuuacuagugcucaaaaaaauguagacuaaaauaaugagcuacaaauuauaaucauguaauugucagacugaaggcaaugauaauaaccaauguugugagaaugugggguaacaggcauucucacaaacacgugguucuauuuucaggcuauugaugccugauaauuugguaccuuguacuuaguuaucuauuuaccuacuuauagaauacuuuuuaucggaucuaaguguguuuuagaauuccuuggauccuggcugggugcaguggcucacgccuguaaucccaacaguuugggaggcugaggcaggaggauugcuugaggccaugaguuuaagaccagccugggcaacauagcaaggcccgcugucuuugccaaaaaaaaaaaaaaaaagccacgugugguggugcaugccuguagucuuagcuacucaggaggcugaggcaggaggaugguuugagccugggaguuugagacuucaaugagcuaucauugugucacugcacucagccugggugacagugauacccugucucaagaaaaaacgaaaaggauuucccaauauucguacauucccaauauagcacguauuugacaaaauuuugggaaugcuuuuuaggaaaaaucuucuguaguuaauagacuguccgagucacugauuuauuuaaaaugacagaaacaaggaaaagauuuauguuaaaaaaaacccuccaggguuaugaacuagauuuuauauggaaaauguacaaauguaucacacuuuggaacauuuugauaguuucagcugaaaagacuugacccuugacuaucauagucuuaccauuuuuugcuaccuauuugaaagcuauuugaguugggugguugauuuaucuuuugcuucauauccucccccaacaaaugugauuuuuuuuuuuuuuuuuuuuuuuuuuuuuuuuuuugcuuaguggaacuaaugaucuuuuuaggguaaaagaaacuugcuuaacacauuugaggagcagagugguacuguaguagguccaauuucuaguguaaauuuugccguuucuuauagacuuagggacccgugguaggauaaucuuuuccaaacuguuuucuuaucugugaaaguaggaacaauuguuacugccacucucuuaaaaagcuaucuggagauuaaaugcaucaguguacauaguaguuuuauugaaaugugaaguacacacauaucaguauaaguuauuauuauuacuacuagaauuuuagcuauacguuuaagugguaacagugucacauguuauggauacaauucucuuuguauauaauugcaaaaaguauuuuuaauguucuuucuauaucuaagcuuuucagcauguaccaaugauuuucuuuucuuauuauuuuuaauugacacauacauauuuaugggguacagugugauauuuucauaccuuuauacaguguguaaugaucaaaucaguaauuagcauauccaucgccucaaacauuuauccuuucuuugcauugggaacauucaaaauccucucuucuagcuauuugaaaauauaguauaaauuauuguuggccauaaucacccuagaguacuauacaccacuagaacuuauuccuucuauuuaguuguaauuuuguauugguuaaucaaucucuuccuauuccccucuucccugcuacccuucccagccucuaguaaccaguauuauacucuguacuucugugagaucaacuuauuuagcuuccacauaugagugaaaacaugauguauuuaucuuucugugccuggcuuauuuuacuuaacauaauuuccuccaggcucauccauguugcugaaaaugacaggauuucauuuuuuuaauggccaaauaguauuccauuauguauugugugccacauuuucuuuauccaugcaucuguugaugaacgcuuaggccgguuccauaucuugacuauugugaauagugcugcaguaaacaugggaaugcagauaccucuuugacauacugauuuccuuuccuuuggguuauauauacccagcaaugggauuaauucauaugguaguucuguuuuuaguuuuuuugaauaaccuccauacuauuuuccauaauggcuguacuaauuuacauuuccaccaauaauauaugagaguuucauuuucuucacauuuuugucauccuuuguuauuuuuuuuuuuuuugccuuuuugauaguagccauucuaacuugaaaugaucucauugugauuuugauuugcauuuuccucaugauuagugauguugaacauuuuuucauauacuucuuggccauuuauaugucuuuuuuuuuuuuuuuuuuuuuuuuuuuuuuaagaaagaguguuacuccguugcccaggcuagagugcaaguggugucaucuuggcucacugcagccuccacaucccggguucaagcgauucuccugcuucagccuccuuaguaacugggacuacaggcaccugccaccacacccagcuauuuuuuuuguaguuuuaguagagaugggguuucaccauguuggccaggcuggucucaaacuccucaucucaaaugauccgccugccuuggccucccaaagugcggggauuacaggcgugagccacugcaccuggccauugagaaaugccuauucaguucauuugccauuuuaaaaauauacuguuuauuauuuauuuauuaggauuauuuauuuuuuauuuuugguguugaguuuuuuauguauuuuggauauuaaucucuuguuggaugaauaguuugcaaauauuuucucccauucugcaaguugucucuucacuguugauuguuuuuuugcugugcagaagcuuuuuaguuugaucuagucccauuuguuuauuuuugcuuuuguugccuaugcuuccgaggucucauuuauaaaaucuuugcccaaaccaauguccugaaguguuucccguauguuuucuucuaguaguuucauaguuucaggucuuauguuuagguuuuuaauaaauuuuguguugauuuuuguauaugaugagagguaggggucuauuuucauucuuuugcauauggauauccaguuuucccagcaccauuuauugaagagacugucauuucccccacauauguucuuggcaccuuuguagaaaaucaacugguuuuaaaugcauggauuuauuucuguguuaucuauucuguuccauuggucuauguaucuauuuuuaugucacuaccauugcuguuugaguagcuauagcuuuuuuuuuucuucuuuugagacagcaucucgcucugucgcccagguuggagugcaauggugugaucucggcucacugcaaccuucaccuccuggguucaggugauucuccugccucagccucccgaguagcugggacuacaggcacccgccaccacgcccagcuaauuuuuauauauuuuuuaauagagaugggguuucaccauguuggccaggauggucucgaucuuuugaccucaugauccgccugccuuggccuccugaagugcugggauuauaggcgugagccaccgcgcccggccuuugguagcucuagcuuuauaguauauuuugaagucaaguagugugauacuuucagcuuuguucuuuuugcucaguauugcuuugguuauuugggaucuuuugugguuucaugugaauuuuaggauuuuuuuuuuuuucuguuucuuugaagaauaucacugguucccugguugucuaguggcuaggaacaacagcaaaaagaaugccacuggcauuuugauagagauugcauugaaccuguagaucacuuugggugguauggccaucuuaacaguacuaauucuuccaauccaugaauggguuaauuuauuucuagguacuuuauuuuauuuuucuggugauuguaaaugggauugcuuucugguuucuuuuucagcuaguuugguauugguuuauaugguauggauguuuuucuccuccaaaucauguugaaaugugauuggcuuaacaccaacccauuggugauaagugaguucuuacucaguucaugugagaucugguuguuuaaaacagucugggaccuccuucucucucuugcugccacucuugccauugugaugcacuugcucccccuuugccuuuugccaugauuggaggcuucuugagggccuuacgaggaguagaugcuggagcucugccuguacagcccacagagcuauguuccaauuaaaccucuuuucuuuguaaauuacccagccucagguauuuccuauaacaaugcagaaguagccugacacauugguguauagaaaugcuacugauuuuuguauguugauuuucuauucugcaacuuuacuguauucauuuaucaguucuaagaguuuuuugauggagucuuuagguuuuucuauauguaggauugugucaucuguaaacaggaacaguuugauguccuucuuuuuaauuuggaugcccuuuguuucuuucucuugccuaauuguccuggcuaguacuuucagcacuauguugaauaagagcggugaaagugggcauuuuuauuuuguuccaguuuuuagaggagaagcuuucagcuguucccuguugagugugauguuagcugcagguuuguaauauaugaccuuuguuguauugagguacauuccuucuguaccuaauuuguugagaguuuuuauccugaaggaauauugaauguuaccacaugcuuucucuugagaugaucagaugguuuuuuucuccuuuguuuuguugaugugauaucacauuuauugauacacauaaccaucguuacaucucuggcuaaaucucacuugauugugauauauuaucuucuaauuggauucaguuugcuaguauuuuguuuaggauuuuugugacuguguucaucagggauauuggacuucaguuuucuuuuuuuuguuguuuuguccuugucugguuuggguaucaguauaaugcccaccucauagaaugaguuuggaagaaaucuguucccucccccuucaauuuuuugaaauaguuugagaggaauuuguauuaguucuuuaaauguuugguaaaauucagcagugaagcugucuguuacugcucuuuucuuucuugggagacuuuuuauacccgcuucaaucuuguucuuuguuauugaccuguucagauuuucuauuucuucugaguugaaucuugguaguaggucauaugucuauguccaguuuuccuccaguuuguuggcguagaguuguuguaguagucguuaaugaucuuuuuuauuucugugguaucaguuguaaaugccuuuuuuucauuucugauuuuauuuguguuuucucuuuuuuucuuauucuagcuaaugaauugucaguuuuguuuaucuuuucaaaaaaccaacuuuuuguuucagugaccuucuguaauuuuuuagucucaauuuuguuuauuucuucucugaucuuuauuaauucuaucuacugauuuuggauuugguucuugcuuuucuaguucuuuuagaugcauuuuuagauuguuuauuugaauucuuucuacuuuuccaauguaggcauuuauugcuauaggcuuuccucuuaguacugcuuuugcuguauuucauaggcuuugguauauuguguuuuuauuuucauuuguuucaagaaauguuuacauuuucuucuuaauuucuuugcuacccguugguuauucaggaauauguuguuuaguuugcauguauuuguacuguguccaaaguucuuguuauugauuucuaguuuuucuucauugugauuagaaaaccaaaaucauaucaaauaaaaaauuuauugaggcuuauuuuguggccugacuuauggucuguugcggagaauguuccaugugcugauguguaucugcagcuguuggaucaaauguucuguuaacuucuauuaggaccauuucauuucuagagcaguggucuuuuugguccauuuuguuuauagagcaguuuaaguccaaaguuucuuuguugauuuucuuucuggaugaucugcccaaugccaugagugagguauugaaguucccaacuauuauuguguugaagucuaucuuucucauuagaucugguagcauuugcuuuauauaucuggguguuccaguguugggugcauauauauuuacaacuguuauguccucuugcugaaaugauaccuuuaucuuuauauaaugaccuuguuuuucucuuugcacuguuuuugacuuaaagucuauuauaucugauguaaguguaucguugacucuuaaacaacauagguuugaauugugcagguucacuuauacauuuauauuuuaaaaaccaaacaucaauagaaaauacaguauucauaggauaugaaauuugcauauauggagggccuacuuuuuguauacguggguuucacagggccaacuucaggacuugaguaggcacagauuuugaugcacguggaguguccuggaacaaaugccuuguauauacugaguuaugaauguaguuauucugccuauuuuugguuucuauuuguauagaauaucuuuuucuguccuuucauuuucaguccaugugugucuuuacaagcaaagugaguuucuuguagguagcauauaguugaguauuuaaaaaaaucuauccagccaaucucuuuaucauuuaauugggaaauuuaauucauuuauauucaagauaaauaggcaagaacuucugucauuuuguuaauuguuuucuguuuuuuuuuguauguucuuuguuccuuucuuugucuuuuauugucuaucucuucaguuuggugguuuuuuuguagugaugaaauuggauucuuuucucuuucucauuuguguaugugcucugccagugaguuuuaagcuuucauauguuuucaugaugguaguucauccuuucacuuucaaguguaggacucccauaagcauuucuuuuaagacgggucuaguggugauaaauucucucaguuuuuucuugucugggaaagacuuuguuucuccuuuauuucugaaggauagcuugcuggaguaguguucuuggcuggcagguuuuuguuuuuuuuuuucuuucagcauuuugaauguuaucauuccauucucuccuggcuuguaauguuucugcagauaaaucugcuguuagucuaauaagucuuauaugugacuugaugcuuuuuucuugcuguuuuuaauauucucuuuuugucuuugacuucugacaguuuuaggagaaugugcuuuggagaggacauuuuuggguugaauccauuugaagaccuuugaguguccuggauauggauguccaucuuucuuucaggacuugggaguuuucagcuaaaauguuuucuaugcccaacuucgcuccuucuguaacucucaauauguaaaaauuuguuuacuuaauggugucccauuacuaccauaggcuuucuucauucuuuuuuauguuuuucucuuuccuuuuuuuuuuugucugacuggguuauuucaaaaguccugucuuugaguuuaaauauucuuucuuuugcuugauguagucuguuguugaagcuuucaauuguauuuuuaaauuucauugauugaauucuuguuuuuuuuuuucuuuuuccuaucaguugggcaaugugcuuauuucaugacaacguuugagggaggcauaucuuacacgagugugaacacucagucaucacacuuuauucauuguauucuuaagcucuguuuuuuuuaaugauauauauaucuuuuuguugaauuucucauuuagauaaugaauuguuuuucugauuuucuuguauuaucuaucuauauuuuucuuguaucucacuggauuuccuuaagaucaucauuuugaauucccuuucaggaauuucguagauuuucuucuauuuagguuuguuacuggagaguuguguuucuuuggagguguuguguuucccuguuuuuccauguuucuuuuuuuuuuuuaacuuaaaaaaaguguuuaaagaaagguaucuauuuuuauuucuuuauuuauccaccuagagacagggucucacucuguugcccaggcuggaguacaguggcgcggucucggcucauugcaaccucugccuccugguucaagcaauucuccugccucagccuccuuaguaguugggacuacagguguccaccaccacgccuggcuaauuuuuguuauuuuuaguagaaauguaguuucaucauguuggccauacuggucucaaacuccugaccucaagugauccaccugccugggccucccaaagugcugggauugcaggcgugagccacugcaccuggccuguuuuuccauguuucuuuuguuccuacauugauauuugugugucuaguagaacagucguaucuuccccuuuuaugaauuaacuuuuguagggaaagacuuuuuucucuauguaucaguuagguuagguguuugguuuagcuucugguugggcacagauguguaauugccuugugauuucuuuggcuguaaucaacaucaacagugucuguaugugccucaguggccuugacuuugggguuuguggagacaguggcaugguuuugcugggaacagggauugccagauggguuaguugucugucccuggugggugagcauggugcaugguagauccuccaugggagggggaaggguugcugguggugucaguugucuugguccauauggggcacauguggcacaugguugcucuacugcuagauaggucaugguugcuugaggugauagaugcuggccaggcuaauucucagucucuggggaaugcguaugucagccuuucucuuccugguggcagcguccccauuguacuugaaugucuguuuuuuuuuuuggaguguagggugcugcauggacucaggugcugaggucauagugguaccacugaaacuagcuggggucaugauccugcagccuucugugugggcauggugggaugauggcagauggcaccccuaggauguggaggugucugggcuauuggccuccaggucagaaugcacaccagcagugguuccauuaccaaaauggugucauacuguaacagcuugggucucaugggauagggaggacucagcuuguguuucuuuucaggagcaauucagcuguguauacuccaggcagguuccuauacugagcucagggucugugauuacagguauuugugaugguaauggcgacucuugggugucccccacuuaaccuuuugcccacaaugggaagucccugucagcucuaagcugauuccaucuggaugcuucacuucccccucuaagcugccaugcagaguuucugugccucagaggguuuuugucacuuccuugcugaauuuucauguucucucuuagacauucuaccugaagugcuguuauuuguuguuuugauucuucucugcggaggagacaaggauugggcaccucuaguuggccaucuugaugacaucuaaccaguauuuucuaguuaagauuuuaauuucugugauuucgcucuggugauaaugggauugcugagugggucagugucaauuuaguggucucuaauguagagauuuguuugagauaaauuuaccccaauauuauuuaacuacccaugauugaucucaauaaauuauuuauccagcuuucaaugcuugccugccugguugcgcuuuguaaaauuuccacuuggggguaguguuucauugcacaaucaaacaaugcuuucuucacuuaaguaucacguuuucuaauuugcuuuugaacuuucuugugcuuaaaaagggucauaaaagacuguuaacugucuuaaaaucuugauuuuuuuaacugguuguuuccugucauuugaauaauugcauugaaaugaacaauuaauaagaauucagucuuuugagaauccuaacacuuuuuccaucucuugagggauaauacaagccucuuucuauuauuuugugucuuguaacauuuuuauuuucaguaagacuuaucauauuauacuaucaaaaaaaaaucucaguccacauuuugaaaaacucauuuccuguuuuuaaaaaguuaagugaaaauauauaugccuuagcuaauuuuaggcauuggcuuuuucuccauauuaucccauuacuuauuuauccaauuccacuuucaacucucaccccaguuuuaaaaagagcaguuuuucagaagaaaaaaaaaucuuguuuaaaaaaaauuguguuaaucauaacuauuacauuuucauguauaccauuaugcuauuuauuaauuaguaacuuuuuuauuguuacagcuuucaaaaucuaugcaauaacccuauggagaagaucauuucacaaugcagauucuuuguuucaaguaauucucuuaaguucuguuuuuccaaguuauuuggcauuuaucuauguaucuuuuuauuaguuuuugcauguuauuuuguaaauuuuuucauaaauuauuguguaaauuaacuuugauauuuguucuuauuugauuauguuggcuuggauauacacuuuaugcuaaaaucuguguauuacuguggccaucgcauacuuaacuuucaauagauuauaaacucuuugagggcaaacaccauucuuauacauuugugugucccucuguagauuuuccugcaaauaguaaauuaucaauuaauguuuguaaauauauaauuggauauagggagauguuuuaugguaagugucaucaguuaaacauaugaacauggaguuaugguauaaauuagugacuaaacauauauugguucuguauguaauuuuugaccucuuuugagaaauaguuuuuauuucuuucauuuuagacacuguguguuguaaaaacuuaaaauaugauuuucuaauauuuuaagcucaugcguguuucuuuuaaaaucaccauucuuauacauaaagacuuucuuauggagaagauauuucaacauugugugcuuaaucuuuaaaaacuuuuuuauugugguaagaauacuuaugacaucuauccucuucacaagguuuuaaguguacaauauaguauuguuauagguauguuguauagccgaucucuagaacuuauuuaucuugcauaauugaaauuuuuuuuuuuuuugagacagaguuuccacucugcugcccaggcuggagugcaguggcacgaucucaguucacugcaaccuuugccuucuggguucaagcgauucuccugccucagccucccgaguagcugggauuacaggugugcaucaucacgcccagcuaauuuuuggauuuuuaguagagacgggguuucaccauguuggccaggcuggucuugaauuccugaccucaggugauccacccgccucgaccucccaaaguguugggauuacacgcaugagccaccgcgcccggcccaacguaauugguacuuuauacccauugguuaucaacucuccauuuccagcaucucacuaguuccuggcaaccaucauucuauuuugugauucuaugaguuuugauauuuuagauaccgcacauaaguggaaucaugccaguauuuguccuuuugugacucacuuauuucguuuaacauagugucuucagaguuuauucauauuaucacauauugcaguauuuuauucuuuuuaaaugcagaauuacguuucauugcuuguauauaccccauuuucuuuauucauucaccuauccauggacauuuagguuguuuccacaucuuagcuauugugaauuguguugcagugaacauuggagugcuaauauccuuuguuauuugaagagaauuucaagucaguuuuucuucugauuucaguucuuuuggauaaagauguggaaguaggauugaucgaucuuauaguaguuuuguuuuccuguguauuuaaucuuaaagcgauuuucacauuuuuucuuuucuuuugcugaaaaguggaugaaucuuuuuuuuuuuuuuuuuuuuuuuacuuuucuucccugcuccuuuuuuuuuuuuuuuuuuuuccuggaaagggucuugcucuguugcccaggcuggagugcaguggcaugaucauagcucacugcagccuugauuucccagguucaagcaauccucccaccucagccucccaaguagcugggacuacagauacaugccauaaugcccagcuaauuauuuugguuuuuaguagagaugaaaucuugcuauguugcccaggcugguggucuuagacuccugagcucagguaguccucccaccuuagccucucaaagugguggaauuacggguauaagccaccaugcccagucuucuuuacuuuuugaaagaggaaaaacacugcacaguuaaaaauuucaugagaacaaccuguauuuaaauaguuuugcuguuucuuuaugucuguauucaaaaaugaagaggaauguuuugaaaauggcuguguuguguuuaguaagaugggauaggguaggaaggaacugggcagaugacugaagagaugugcuaguaauuagaauuucauuuuccacacacacacacacacauuuugaaagucuagaauaauuaauuguuguuugcuuguuuuugcauuacagugaaugauuugggaggggacuucaaaggaguugguaaaggcuccuuagcugcugauaagguuguugaagaaauaagaaggagagguggaaaagcaguggccaacuaugguaugguauuugagagaacuauacuauuuauuuuccuucaacuaaugcuauuugucacauuaauaaucuuugagcaaauaucucaguauuccaguauaauuaugauuuucuaagucugccaaaguuuucugacuacauauuuuauauaugugagaauuguuaaaacuuuugauguagacuauuucaugauucuaagcuuuguucuauuguuuacuauuuuuauuagugagcacaugauauaauuaguaaauuauuguagauauggauauguucuucugaguucuguugggugaauaguauuugucguguacucugacccacagaauuuagaaguccuuuggaagggagguugccgaaauuucauacaaauuuuccuuucccucagauucaguggaagaaggagagaagguugugaagacagcccuggaugcuuuuggaagaauaggugauguuucuuuguguuauggcucuuguggagcaacuucuaccuuccuaaugaaauauuuuuaaguugacuuucauuuacuaaacagauaccucuuuccucauaaucacauuuuaaaauuugauuuauaaguuaauuauuguacuuauuucauaaaggguuuaauugagguggcaauuuuauggauauaguguugaguuuguuuuuuugcaccuuaagugcuuuaaaaaacuuacgagcguuuacucagugcccuuuuuaaaauaauucaguuaaaccucaaagauguuuauaagauuaaaaaauaaaccaauauuuuggcaauagaguacccaguggauucuuuuggauaauuauaauaauuuggauuaaaauaauccaauaucuugcaaauuacuuaagaugauuucucuauaauaaaaaucuuaauuuuuaagaaguauuucaaauaaauuguugaguuuguuauuucuguagcuaaucuucccaguuuagucccacacacucuuaauaaaagauuauuuaacuacuagauggagacaucacggaacauaagcccaacauguuuacaaucugaaaaacauuacuuauucuuaauugaaugugcucucccuuuuuuguuuggucuauuacacuuauuuuucuaauuuuguuugauugaacucauaagaaccauguucacauaucgucugacagggauagaaaccacaaaaaugugaaaucauagggugaaaauagccacaagaggguugaaccuuaaaaaauaauuauuuucuuucauagugagaaaauaauuauguaucaagauaaggcaucaguuuguaacucuaaugguuuucuuuuuggacuuuuuacuuuugaguggcaagggaaaaauguaacuuuaacuugcuaagugaauuuugagguuaaguguagaauggcuuaugguucugauuccuuagaaccuaagaguuguaaaauggcuaauucuauaauuaaguggauagaauuuugauagagaggugggaaaauuuauagauguuaguuugagaggaaggugcuugauauaaugugauacuuaggcuuuugugagucaacuuuuuuugauauagguauagacuuuuguuuugaaagcacucuuuaccuauuauauuuacuuuuucaugguuaaaaaacgccaguuuugagagaaaugugaguuguaagcaaaugcaaacuaauaugcuugcuuuuagauguaacuuguaucuuuuuauauuguagauguuguggucaacaaugcugggugaguauuucuuuuucauuuuuagugauguguguauaauuuuuuuaaaaaguauauacuuuccuccuuuuacccuauacaacauugauuuuuuagaauucugagggaucguuccuuugcuaggauaagugaugaagacugggguaaguuguuuuuaguauuucucuggggaacauacuuauccauuuagccuuuuuaguauuugauaaauuuauacauuuaaggaaaaaccugcuucuaucuacuuuugcugcuaauauaaaugaugaguaaacuguauacugaagacaaugaauaguuagaaguagccucuuuuagaaaacauuuaauacuuuuaaaaaauguuaaaucauuuguuuagaagauaucuaaaaggauuuuauuucuucagguuucccucuccccuuuuuuucuccuuaagagguugucagcauuuucuagagguauuaacucuuaacagccuuuaacgugcuuauccagcugugugaaucuuuuucaagaacaggagcaggauauuuaagggagucuagugcacuaaaaaugauggagauuuuagaacagguuaggacaaaaccuggauauaauuuugaagcuucuaguaaauaggaaaguuuuccauucuuucugaauuggaaagauugaguuuagauaaugaacaaaucacaguuaagaauuuuuuuuuucuuuugcuccucuuugugcuuacuuucauuggccaucagaacuaaaaugaacagugguggcugagacagagggaagcauggcaacugaggugaaacaauuguaucauuguuuauagaguguguuuugggggaauagugccugacugucuuuuggaagaagaguuagugucuuugauuuagaauuaagcuaagaagagcuuuuaguuucugcuucccuuguaacaacugggguaaaaaagaagcugagaaagauaggauuugcuggcaaagggggccuauguuggugcuuuucuuggugcugcaacgggacugagguauuuccuucucugauuccauccuacuaagccacuacuccugacuacccuucucccucucuuucuuuuuuuuaguuccuuuuuucacucuuacauucuucuucuaauauacacaugaaaacauuuguuuuaccaaaaauaaguaagaaugcuuaaaaaacuugacaauuaaaaucuagaauugucugucugaauguuucauaaguggucuguucguuagauugaaauuugugaaaacaggccucucacuaacucauuugcaaaugguaacaauagggaucuagugaguauuuuguaaauauuucuuaaugagcuaugugauuuaugauuaugccuuaacugauguuaguguugggugccaguuauauuuauaaaaaucuuggauuuuauauuagcaaaauuuuuauaugaaguaggcauaaaauaagggcguagcauuauauuuagauguguauaggcauuacauuaauuuuacaaauuaugaggagagcuguuguaguucuaagugugaaguauugauuaguagcauaacuggaauaaaggcaaaauacucauuggggugugacaguaggcaauuuuauacauuagguauaaaaugaacaucuuuguauaaauacaacauugcuuauguugauucuuagacaugccuaaguuuuuacaaaauauuuaauaaaaauaauuuauuguuuuagauauaauccacagaguucauuugcgggguucauuccaagugacacgggcagcaugggaacacaugaagaaacagaaguauggaagguagaguugcaugugguugucaagggggauuuaagauguugugucuggggguucuuguguacagggaaagauuaugugaaguguugugaaaugauuuaugacauugaggaauauguacaaccuuuuaacauaugguuuuggcacauacccucauuaaauugguauaauuuagucacagauuggcugagcuggaaagcuuuauauuuauuuuuuaccucuuuuuguuauuaaagauuuucuugcugcucucuggcaauuuuuauuuuauuuugagacauaguuucauucuuguccaggcuggaguacaguggcaugaacauggcucacuguagccuuaccuccugggcucaagcaguccucccaccucagccucccaaguagcugggacugcagguaugugucaccaugccuggcaaguuuuuuaauuuuuugguagagacaguaucucguuuuguugcccaggcuggucucaaacucuugggcccaaguaaucuuccugccuuaguuucuggcauuuuagaagauaguauacacauugaggauucgguuauaccuuauucuguaacccgaauauuauuucaugucuuaccagcuggggagagaugaauggcuagucccugcuggcuggugcuagucagacgugaguuagucuuuauaaacuguuuaggaacuguaggaccccucaugauugcuccuagauaaguaacucauuguggcagugcuaguaugcuuuaguccauguccucuguugcacucuagugcugaggucauuccuguuaauuuaggauucauacauaccuaauagaagcaaauugcuugugaugccuguuuuuguuggagauuucuaguuuauccugguccugacaguuucugaaaauaaauaauaugauuuauuuuacuuagccuaaguagagugagugagguugggucagauuuugagauggcauuguuuuaaugaggcauuuaauauuauucagaaagggagagaggcaaagugaugaggacugaaaaauuagaacuguucgauuuaauauuucuugcuaaaauuuuaacuuacauguuaccagguuauuuuaugguuguaaagcauaagucuaagaucauuugguucuggccagagaaucuuuuuaaaacaguuaaaucuuguaguugaauuuugagagauuacuuauauauuaauauuauuuuaguuacauaaaucaugaucguaagaagcuaaugacaguacacauaguugcuuuugauaggugcaguaguaccaaaacagaguuagaguugcaauguuaucaaauuauggaaaagaugauauugagagauugauuuucuuuuuaggauuauuaugacuucaucagcuucaggaauauauggcaacuuuggccaggccaauuauagugcugcaaaguugggucuucugggccuugcaaauucucuugcaauugaaggcaggaaaagcaacauucauuguaacaccauugcuccuaaugcgggaucacggaugacucagacaguuaugccugaagguaaguaagcaagcuuauauuuuucagugcuguuacuuacaaaccuauguggaaugagcuuuacaaaaguauuuaauuuucugaauacuuaaaaauuauuauuuuuuucaauuucgaaagcauuaucuguaaauuguguucauuguggaaaauuuagaaaagcacaaaggaaaaaauaaaaaaugacccauaauucuaccacaucgauaaaaacuuucauucuuuuucucugcauauucauaauuuuuuuuuuguuuuacacaaugggguaauauucuuccuguuucauaauaauuauuguaaaaauacauuauuuuuuagagcaguucuagauuuacagaaaaauuguacagagaauucuucuauacuuuaccucccacaguuuccccuguuauuaacaucuuuggucagagugguauauuuauuacaauugaugaaccaguauggagccguuaugauaagcuaaaguucgucguuuacacugggauucacccuuuguguuguacaaauguauggguuuucacaaaugcauaaaguuauguauccacuguuauaaugucaugcagaaugguuuuacugcccuaaaaauccccugugcuucaccuguuugucucuccccuuuucuuccugaauucucagggauugaagcucauuucuuuuuauuuuucaguaauauuccgugguaugaauguacuacaauuuguuuauucauacaccuauugggggagaucuugguugcuuccaguuuuuggcacuuauuaauaaagcugccauaagcauucaugugcagguuuuuguguggacauaaguuuuuaagucguguaaauaccauggagugugauugcuggauggaugcuaugauaagacuagguuuagcuuuguaagaaauugccaaacuaucuuccaaaaugauuguaucauuuugcauucccaccagcaauuaaugagaguucuuguugcuucacauccucgccagcauuuuuuauugucaguauuuuggauuuuagguuuucuaauagauauguagugauaucuuauuguuuuaauuugcacuuaccuagugacauauguuauugaacauuuuuuuccuaugcuuauuuggcauuuauuugucuuuuuuguugagaugucuauucacaucuuucacccauuuuuaaauuggauuguuuguuuucuugaauuuuaaggguucuuuguauauuuuagaaacaaguccuuuaucagauauauguuuuagaaauuuuuuuuucagucuguggcuuguuaucgggguccugccccgauaauuacguagguucuuuucuauuuuccuaagcaucggcuggcuugagaaauaaagggacagaguacaaaagagagaaauuuuaaagcuggguguccaggggagacaucacacauugguaggaucugugaugccccacaagccacaaaaaccagcaaguuuuuauuagggauuuucaaaaggggagggagugugugaauaggugugggugacagacaucaaguacuuaacaggguaauagaauaucacaaggcaaguggaggcagggcgagaucacaggaccacaggacugaggcgaaauuaaaauugcuaaugaaguuuugggcaccauugucauugauaauaucuuaucaggagacaggguuuugagaucaaccggucugaccaaaauuuauuaggugggaauuuccucuuccuaauaagccugggagcgcuaugggagacuggaguuuauuucaccccugcagucucaaccguaagagacagguacgccccgggggggccaguucagagaccuaccccuaggugcgcauucucuuucucagggacguuccaugcugagaaaaagaauucagcaauauuucucccauuugcuuuugaaagaagagaaauaauggcucuguucugcucggcucaccagcggucagaguuuaagguuaucucucuuauuccccgaacaauugcuguuauccuguucuuuuuucaaggugcucagauuucauauugcacaaacacacaugcuguacaauuggugcaguuaaugcaauuaucacauaguccugaggcgacauacauccuccucggcugacaggauuaagagauuaaaguaaagacaggcauaggaaaucauaaggguauugacuggggaagugauaaguguccaugaaaucuuuacaauuuauguuuagagauugcaguaaagacaggcauaagaaauuacaaaaguauuaauuuggggaacuaauaaauguccauaaaaucuucacaauucacguucuucugccaugguuucagccggucucucuguuuggggucccugacuucccucaacaccuugucuuucuauucucuuaaucuccuuuacuuuugaaggauaaguucguuggauacagaauucucuguugguggcuuuuuucuuucaacacuuuaaauacaggcauaucuuggagauguugcagguuugauuguagaucaccacaauaaagcuaagauugcaauaaagcaagucauauaaauuuuuugguuucucagugcauguaaaaguuauauuuacacuaugcuguaguuuauuagaugugcaauagcauuauguguagaucuaaaccauauacaugccuuaauuaaaaaccacuucauuguuaaaaaaugccaguauggauaaauggagugagcacaugcuguuggaaaaaugacacugauagacuugccugauguagaguugccacaaaccuucaauuugugaaaaacgcaauauuugcauagcaugauaaaguggaauauaauaaaaugagauaugccuguauuucacaucacuuuccucuugguuacaugguuucagaaaggaagugugacauaauucuuauccuuauuccucuauagguaaggcauuuuuuuucccccucugucuucuuccaagauuuucuccuuaucuuugguuuucugcaguuugcguaugauguauuuagguggagauuuuugauauuuaugcugccugguguccucugagauuccugugguuuggugucugucauuaauuuuagaacauucucagccaucacuccuucaaauacuucugcuuauucucuuuuucuucuucucggguucucauuguaugcauguuacaucuucuguaauugucccacaguucuuagauauucuguuccauuuuucucauucuuuuuuugcguuuccgugcaggaaguuuguauugacauaucuucaaggucacugauuuuuucuucauuucuuuuacgaugguuuugauuucuagcauuuucuuuuaauuuuuuuuagaguuuuaucucucugcuuaaaguaaccaucuguucuuguguauuauccacuuuuuccauuagagcccuaagcacaguaaucauaguuauuuuaaauuccuugucugguacucuccaaaucucugccauauaugaaucugguucuaauguuugucucuuuagccugugcuuuuucuugccuuuuaacauggguugcaauuuuuuuguugaaaguaaaaaauaauacuauugaguaauaauagcaagugagauuaauaggcuuuuagugugagguuuuauguuuaucucguuaggaguuaggccguguuuauuauuuacuauagcuauggguaucacaggcuucuguuuccucucuguucuuguuuuuuuauacucuguugucuuugaguuuccuuagaaacucuuuguuaaguagaguuuguaucuugcagcucucacuuguaauuguuauuauacuggagcccuguugauggagugguaagguauuggggaggggaaguguucuguacccuuauuauuaaaucuccauuuuuugagugggucagaguccuggguugggaccuucagaagacuuuuuuagccuuuuuuuuuuucuuuuuuucuuuuccuucccuuauuugagaugggaaagcuagagaaguuccaacugucuaaucacucuuccccuaggucagacaaggcucugguaaaguaguuucucuucagagcaggccuuaaguagaacagaauacucugggcauauuucaaaaugguuucuucccccuugucuuguccaaagcaugaggggauuuuucucugaucuucacugugugaugggaaauucuggagguaaaacuuauaaaaguguuggagucuccuccuaagauugggcccuccuaagaugaaacaaguccacauucagccucuagcaauuugucgguuacuguuuaaguguucuaacugcuugggcucugggggcuucuaucucaguaagcuggguuuucugaauuugccugugucuccaguuuuccugauggugguuugcccugugaccugaauucucuggugcugauaagcagaguuguugauuuuuagcuuguuaagcuuuuaucuugguuugaggauggaaguaacaacuuccaagcucuuuuuauguuggagugcaaacuggaagucuaauuauuauuaucuuuucccauaucaugaacauuuucccauuuaauaaaauagugcaggguaucuuuuaaugguugcauuguauuuuaccuuauucauguuccauaauuuuaaaaaaugcuuuuuauggucauaguuucuuuguguaaaaggaaagacuuuuuuguguagcuuuccaauauacauaagaguaaagaaaguuaagaacuguuuguacccaucguucagcuucagcaaauggucaacagccaauuuuguuucauuuuuugaucaccuucucccuuuucuucugcauuauuucaaaguaaauccuagacauuauauuuuaucuaaugaacacuuggaaaugaauaucuaacagauauggacauuguaaccauaaugccauuaucacaaccaaacaaaauaacuugcuaauauuaccuaccaaauucauauuaaaauuuucuaguugucuagaaagagauauuuuucgaguugguuuauuccacuaaggauccaaacaagguccacagacauuuuuguuguuauagcucuuaaguuuccuuuaaaacauaauaguucaucuucucuuuuuuuaaaaaaagucaagcuggacagggugguuugugccuguggucacagcuacuuggaaggcugaggugaaaggauugcuugagcccagcaauucgaggcuacagugagcuacgguugcaccucugcacuccagccuggguaauggacugagacccucccuuaaaaagaaaaaaagcuguucguuuauucaagaaucuaauucuuuuguucuauagacuauuccucauucuugauuuggguugccuuuucaccuuuguggaaaaucaaucgacugcuuacaccugggucuauuucuggcuucucuguucuauuccauugaucugugugccuguccuuucagcaauauuaugauguuuugauuacucuaguuuuauauuaagucuuggaaugagauagugugagucuuuccacuuucuuuaaacauuugaauggauaauugagagccuaccuuuauuuacuuaugcaauauauauauaauaguugacuauggagaacuguggcuuuugguacucuugguuuuuauauauuucugaaaagaaaaucuacauaauacuuuaaaaguagcuucugugaaaagguacaaaauaauugaugaaauuauuuuaaaauaagcuacuccauggaacacaaauacuuaugguaccauauauuuuccacauuugaacuaacauucauuuuagaacuugggauuuguaauacuacagcaguacuuugcagucuuugccaagagcugugucuaaccaauuuucuuuaguguagaauaccuauuuggaccugagaucuaauuuuuuccccuguuuccuugacagcagagccauuuuuaaagccucuuauucuuuaaaaacucuuuauguucucauagucgugucaaaggaauucuuguugaagaaucauauuaugugaaagauauauaauuuauuuguuucaaguaugauacuauauagacacaaaacaguauagguuauagauaagaaauaaagcaugaaaauguaaugaauauucaugaacucacuucucaacccaagaauuggaacauugccaauaacuugcaucuaacuuuguaccuucuuucuaccccccugcuucauaccaagagacaaaccacuaguuagaauuugugcugaucaucccuuuguuagauuuuuaccuuuagucacuuuuugccaucgguucuagacuuuuugggaagccguacguuuucaagaaaguacuuaaaacuucagauuuuaaauuuguuuuucuuugggaauaugguaucauuuauuugaacagaucuggaccacuaaaggcauuagguaaauguuuaauccuuuaugccuaccaugcucuaguaaaagaaguuuagaaaauaaagucuacuuuagacaaaugacuuaaucuuucuggaucuguuuucucuuccacaaaguaagaaaguuauagaucauuuuuaaauuuccuuuaauuuugggacuauuauuucuaguccuaaaauuccauuauuuuuauucugcuuuuuucuuacucuuuuauaguuuagaauaucugaaaauuuauuuugaucugaagcuuuucuucuccuccucuaaaauauuuccuuaugggcaauuaaaggaauuauuuguuaaagaaccagauauuaugaguaauguguggagacauuuuugcuauuucauuuccccuuugaaauacacuugauacgugaaaaauaauguguauaacuuacauguuucuuacaugaaauaaaauaaaacccuauaaugaguauccaggaacuaacuuuccaagcuguauuaguuauuuacugcucugcaguaaacuacucuaaaacuuaguggauuaaaacagcaaacauuuauuaucucacucaauuucuggggucaggaauuuagccuggcuaggagguucugcuucuaggucuuuaaugauguuuuaauuaagauguuugcuggcacugaagucauuugaaagcuuggcuuggaggauuuacuuccaagcucauuugugcacauggcaguugccaagaggccuccguuccuuccuaccuguugucaggaggccucaguuucucaccauguggcuuuuccauaggacugcucuugacauggcagcuggcuuuccccagagcuaacgauuugaaagagagggucaccaagacagaagcugcagugucuuuuauaacuuacuucagaagagauguaccaucacguuuguccuauccuguugaucacacagacuagccuugguacacugugaaaaaggacuacaaaaagggauaaauuaaaggacaugggggucauuggaggucaucuugaugacuugcugucaugcagcccccaaacuggagcauuuccauaacuugugucuauuuuuguuaccuuuuuaccucaccccauuucuucccccaggagguaaucacuuaaagagaauauucauucccuuaccuuuaauuuuuuuuaauaaaaauugcaugaauaaacacuuuauuguuugguuuucuuguuuuugaucuuuaugacauuugucauuuaaaaaaauuugggggaauuguacuuugucuuuccaugcaauuuuagggcucuaagauuuauauaaagcuguagcucauucgauuauauugcugcaagacuguuaugugaauuuacuuaauuauuauuaaugaacauaucgguugcuuuuuaauuaaucugcuuuuauucuuguacauguguucuggauuacaagaacaagaauuuuucuaggauauguacuucaaaguaaaauuguugagucaggaaggguacaaaugcuaaucaauaguuaacuuuucuuuauaauauauuuuaaauuccaacauuucuauuccauuguaguucaaaucugcuguuucuuuuaacuuuuacucauaguggcuucccuucauugugugcuuggugauuucuaauuaccagcucuuuaccugaucuuuuucuguauuuguucuguguucuaaauuggcaauguuuucuucagagaggaucugucuuugcuacugcugauuaccaggaagcauagccaauuuuguucugcuucagucuuccuuaaaaguugaaguucagcguagaacaguuuagguuuaggaccccaucuugaugcuggccuaucucugaguaccuagguaucaguauuguuauuuguaucauucucagggcaacccugccuucccuguagcauguagcacuagggacucuuuucuauuuuuuuuuuuuuuuuuucugguuggaggauaccuucuuuaucucaguaaugcuuuaaaagaaucucauuucuggaagcagaaguauuccucagaguacuuggcucacuguaaugcuagauauccugacaucuaguauuguggaagaaacacuggguugaguaaguaaaccuuucuauuuuugauuucauauaacuuuauaucuuaauagcuaugggacuucucugaucuuuuauuuacucucuuaagguugguuuuuuauuuauaacauugaguuuaauagaugcuggcuaaccuaggaguuugagaaugaacuggaaagcaagaauauuugcuuauauuauuagugauaauauauaaaauaaacugcaaggcagacguauuuuuuuguauguggcuuauguucuuuucuuuuuucucacguaagguaauagauacucuguugcauuuuauagauauguuuauuucucauucaguuugaaguuagccaacucaaauauccaaaucccuguacauaaauauccuuuaacauuuaguuuugucaauugauguaugggaaauuagaggaauguuauguauugagaugaauggauauuuaaguuaauaauuuguuuuaauguacaauuugagaugguuggagucuuccuuuuguuuuuuccucgugcauauaaugaaaaauggaagacagggugccauuggaaugcuuguguacuuuugagagcuuuuagaggcuauaaagugaagaguuuuugcaacuacuuuuuaauuuacaggacuauauacaccaucuuuuuuacuuuaacacauuaauacaaaauuguauuuugucauuucacaauuuuugcauuuauuugaucuuuuagauaaaauuguaugauuuguaagacacaaauuguaucucauuugagccuuggaacaacuugguggaauaggaagcagaagcauuuaaauuacuagcuuacugaugaagauacaggcccagggaaguugaaugaugggcucagguuccuaaguugcuugcauagcagguucaguaccaaaaucaaagucuucauguucuucauguaguaccuuucugcuucaccaagguacucacagaaaaggugcagugguaaagagaaguuggcuaagggcuacgaaaguaagcuuagauagaaggaauaaauucuaguauuugauaguacaauagagaaauuauagauaacuauaauuuauuguguauuucaaaauagcuagaagagaagauuuauaauguucucaacacaaagacaagauaaauguuugaguugauggauauaccaguuacccugauuuggucguuacacauuguauaagguaucaaaauaucacaugcaccuucaaaauauguacaacuauuauauauuaauuuuuaaaaaguucaaaagguaacauaugcagugggaaauuaguucuuauacuuugugcacucaccagugaugucuucaaggucuauuucaaucauuaucugccuacccugguggucuagugguuaggauucagcacucucaaucauuauuugccacuguaauggucuaggcuguuuugugauuuucuagauuguuguuaauagcugggagaguagaauaauuuugggaaugaaugguacccagauuucucauguuaaauacaguuuugcucaccaaucuuugucuaggcaguucuaacuuuucuucuucugaacaguauuaauauguuacucaucuuggaaaggugugucugauacuuacaauuuuagaagcuugagagcccuuuagaaauggcucaguugagauuacaaaaaguucuucgcaaagacuuaaauguuagacuaguuauauacauacuaauuuuguuccuauuuuaaaggucucugaauuaccuauaauuuuauaaguaagaaauucuuagaaaguaaaaugauugauaagauauguguauauucuuuauuucagaucuuguggaagcccugaagccagaguauguggcaccucuuguccuuuggcuuugucacgagaguugugaggagaaugguggcuuguuugagguauuugcaccuuccuguuuucucuuauuaguuuucuccaguugcuuacauuuguaaaaaucuguaccaguggacaucacuuguauauuuuuaaauauugugucuauguuauaauuaaaaguguugacuaauauccauuuuuuggaaaguaauaguaacuuuauaaauucuguuuuuacuuaguucuacauuuguaacauuccuaccaaaugaaaauguggcugguuugaucuguucggucaaaauguggggaauuucauuauuuaagaagcugaaugauaagguggaaagaugaagcuuggaguuuagagucaaccaggccagauuuugaauucuuauucugggaauugcagauuugaccuucgugagcuuuaguuuucuggggcuuucuugugacaacuacaagucauauuuuaaacccuuggcauaaggccuaauacauagcacucaaccaccaauuuuaauuaucaguauagcaggaauuuaaucuugugugauaggucaauaaauauaacauuauuuauuuuuacauaaaaaaugaacuuuucuguuuuuuuuauugcagagcuuuaaauguuuauuauaaaaauaauuauccacacauaaucccaucaugcagugagauccauuguucacucuuugaugaaaguucuuuuagaccuuuuaaagccaauuuauauauuuuugauuacucauuugaguuugaucucuuuuuucuagccuaaacuguuguauauuagacccccccccauuuuaaauuaucugugguaauaaugaaccuguuguauacagaaccuguuguaaaccuggcucaauuuaaagugagggauauauuagcuuauuucauuugaaugaaaagcugauggguaaguuaagacaaaaaaaacaguuugcauaucucugagcagauauaugcaccuccacuuuccuaaucacagccauugggugugaauuguggcauaguagagguagaaagaacuuuacaacucuguuuuauagaagaggaaaauuuaauaaucucaagccaucuguaauucagaauuuugccugcucuacuuuuaccucauuaaggaauuuuuaaaaacuauuuaucuuuuacaguuauguuuauuacuaacuuugugaacaaaaauaauaugugcuguuugugaaaauuucgaauauauaagaccauauaaaaaauaaaauaaaaauugccuacauuaucacuauccagagagaacuaguaugaauauuuuuauguuuuuccuuccagucuuuuauuagauauguguuuuauuuuuuauuuuuauuuuuuuugaggcagagucuuucucuguugcccaggcugaagugcaguggcgugaucuugguucauucacugcaaccuccgccucccggacucaagugauucuccugccuuagccuccugaguaucugggauuacaggcacccaccaccaaacccagcuaauuuuuguauuuuuaguagagauggguuucaccauguuggucaggcuggucuggaacuccugaccucaaauaaucugcccgccuuggccucccaaaguccugggauuauaggcgugagcuaccgcaccuggccuagauaggcguuuuauacacccaaacacacagacaauuaggauaaugcugcagaugaaguuuuguuauguugcuguuuucuuuuacuauauugugaacauuuuuagugaggaacauuuagcaugcaugauugauaaacuauacuaagagcugugcauaauauccugacuuaaaccuugaaaguaaauugccacuuuuugaaguucugauagauaucuagaguggcagauacaaauauuuuuuggcucagcuggagcaauuguuuuuagcaccugagaggaacuuguagcuuauuacuucgcuuccaaaauacaguaaaaagugguaguuauuuugccuguuaucaaaaccacugcugauuugucuaguguaacuuuaucaaggcugacugguuguaucauaaaagguguaggcauauuaauauagaggcaaaggaugaugaaaagccacacccuugaacuuagagccacuaagaugucugcugauacauuucuucuaucauaugcauaugaaauuuuugugguaaguuuggguacacuguaguugugguguuugaagugacaaacagauuuucuuuacaucagacucaucagacuuuuuuuuuuuuuuuuuuaggauuuuucuugaaugaccucuagaaaaaauuauagcagugaaaauuuaucuuucuggguagcaguuauuauuuggucauuugucuuaucucugcauaaagauguuucauuaaaaugaguauauguaguucacuaagucaaauacucauuuuauuuggcuuugguuuucuuuguaauucaguagguccuucaagagggacauuuauuuggaucucaugauaugcuaggcaguguacuauuuauauuguuugcuucaugguaaccacaugaaauauguacugucauuuuuauuuuacauuugaggaaacuuggaucacauaauuuggccaggguagucaguagacaaauuuguaucaagccuuggucucugacaucagauucauucuuuucuauuacaugcauuucuacuucauuguacuguuuuacguuugugcuccgauaacaugagcagugcaaagucaugggggccaguggacucuuacagagcuguauuauuuucaucuccuguugccuugaauucuaauacugcuaguagaggagcugacuuuuuucuaauuaaaacaauuguauuagugauuucacauuagaugguauaauguuuucccccucuuuuugguagguuggagcaggauggauuggaaaauguaagucucucucaguuuuugguuuguauagauuauuuccuuaucuuuaaaccuacauauccaguugagauggguaagauuuuugucaaaugccuaaccauuggauauagugcuugcauauucaaacuuaaacauugcuauagcaacagguauuuuuaaacauugugauuguccuauaggucuguggcccuuucaagacccuaucuauucuuccuguagguaguccuuauucaggacuuguccuguuuuauucagaacuggcuauuccuucagacagcauauauugauaaucauccucccaugucuuugacuucccacaugcucguucuugcuguuucagcagagaagugagugggagggagagcuguuuuggaaaaagauggguugagccuauucuagagcagcaggcaaguucuccaauuuucccauguaauuauuuucuuccaugaagcaggagacgucaaggggagugaggaaucacauuggacaacuuacugggacagaaauugcagcugaucuaugggaauuauuccgcuuuagcccaauaguuauuuuagauaguaaaauuauuuuaaauaguuauuuuaaauaacuauuuaaauuaaauauuuuaaauaguuaaauaguaaauuuacuuggcuucaacccucuccuaccccaucucucaaaccuugugaacuccaaauuugagaauugcuuuauggcauuaaaaaaauugugaaaauuucugugucucagcuuauauuuaguuggcuauggguaucaaaauuaauccaauuaacugaaucaguuaaaagguugcuaucucuggagggcauugcuguaguaguauaauauuuuuagaauuaauggucauuuucucuaauuguuaaaguggcuuauauucuugaagcauuuuugagugucuuauugcauucauuuaaaaaaggaacauaagguuuugcaguaaaagcuauaucuggcacuuuaucaauaggaaagcucuagacacaggcauuucugucauucccaaagacaaaucuucaguuuaacaaucaucagugucugacuauuauguuuaaauaagguuauuaguaguuguuuauaccucugguuuuuaaaaagaaaacaauguuaaaaauucuccuuaugcagcaguaaugguuuuuaugaaucugugcauucuaacugacuucuuguggaaauagagguagagcaaagagaagguaagggagaauuauuuggggccaccuguuacacuaaauuuuuguuaacugaagucuuugaccuauuauuuacuauuagucuucaguuugcuaacucagcgaagcucuauucaguuaucuucauuuuauaaacaagaagaaugaaguauauuacuuuggggaucuguggucaugaagucagucuuuugaugugauuauuauauaauuaaacuuuuucacauacagcauaacauucuaccuuuaguacugucuggcauagucagaggagaaauuuuucccuucagcuucaaauguuucuuuaaauugaccuuauccuaguggguuuguugggaaaaauucauuuuaaggcuuaugguaaaacucuuuaggaguuagaaucccuuuuuuucugaauuuccuuucucuuuaaaaaugaaaggguucuuaugcaucuuacuuucugucucucaacuaugugcucaguauguuaguuuuguuucuauaaccaguacgcugggagcggacucuuggagcuauuguaagacaaaagaaucacccaaugacuccugaggcagucaaggcuaacuggaagaagaucugugacuuugagaaugccagcaagccucagaguauccaagguaaagagaguccccgucacuuagcccugguuggggaaucagaggcagcaagcauuuucuucucuuauguaguugucuucuauguuaacuguaguguuaagacacuugaaucgucuauagcauauuuucugcucuaguagguauuagaauucuucacauuuaagauauuuauguuauucucacugucaguuuuucagcuuuauuauaauccuguuuuuuggguuuaugugugauugggggauggauggcauaagauguuuacucauuugugcugaaugcacuuacauccucacugaugguugguuucaaagucuuccauuaccuaccuauaugcucccaaucuuaccauauuuuucucuuucuuccuuucuuucuuucuuuucuuucuuucuuucuuucuuucuuucuuucuuucuuucuuucuuucuuucuuucuuucuuucucaaaaagauuauuuaagccuuuuuauuauuuaggcuuagcucuuuucuguuuagugcauaaauguggcuuuguuuuagcacuuugucuuugcuacuguuucuuugcuuuucuaacauaguucuucuaccuuugaucuccucugcuaaucuuaaugcuucuuuagaaaaacucaagccccagauguucaacaaaaccgcccagauauucuaggguauauugaucuuucuguuagcugagcuccuaccacuugagcaucuaauuuuaacuguucuccacuucuuuuguuucaugaauguaugguuucuuaauugccugguaaguuccuuugaggcagagacuguaucuuguuuguacuucuuguauauauuugguguuagcauagugcugaacucauagaagggacuuaauaauugcuuauuaacuugaauuauuuaaucuccuguuacauaccacagaaauagauaaccaaauaaaagucagauuauuuuuuucuaguauaacucacauauacauguaauauaugaaauuugaaguauuuuucugaaaagaucaugagucagggucauuuuguagaaaaacuuuuuuuucucauaguaauguaauauuuaaaguuugauagaagaauauauuugaaaaaugacuauucgguuuuuuuuuucuccuuaaugauacuuuccuaccuacuggaauacucacugaaauuuucauuaugcuuauucucaaucagaugauaacaugauuguuaugucauaaaugguuaacauuuuuguauuuuauauuuagacauuugagaaauuuauucuaugaauaacagucacuuauccaugaaaacaaaugaaagaaaaguauaggaaaaacuuuccucugauauuuaucucaaaaaguauuucugccucaaaaguguuaaacuuauuaaaaagcuaucuaauugaauuauuauaacuaauuguaagugaaaagauaccucuauuugaagcacaauuuuuaaaaaaugaucuuuucgauaagaauugacuuuccagagcaucucuucuacuguuuuuauuuuacagaugauggaacuaaaucccaggaaaaccuaaacuagccaguguuugagccaagaaguaauucauguugucuauuucuggaaggagguggcuuucaacuaaauagucuucccucuagauagcaauaugaaugggaugguagggagaagauuaauaggcaagaaaccucucuacuggugucaucaggaauggcagauaucucuggucuucucagacucuguaauuugguuauuuauuuauuuauuuuuaagacagagucuuguucugucucccaggcuggaguaugguggcaugaucucagcucacuacaaccucugccccuuggguucaagcgauucucccaccucagccucccaaguagcugggauuacaggugugugcccccacgccuggcuaauuuuuguauuuuuacaaaaauuaaaaauuuuugguuaugguuuugucugaguucagaaggaagcccaugucucuaagguuugugagaaaggucccagggccuucagaauaucuuauggagauguggaugccccaugagccuccuuuauuaaccuuuuagaccugcagaaaagcagcuuuugaucccugucuggagucauugguuaugaugaugauuuucucuggaagaauuuuugguacuaucuucagagcuauuacuuguacaaagaacugggaguaggggugaggagguaaucuuggcauucuuucauccugggaagaauggaaaucaguugagaggaggaaucagugaucucuccaucagacaaauugcaugucuauagacaaguauuucacuuuaaagguuguaaaauagcuuaaagacauuggaaagcccagugccgccuuagaaucagauaaccagggaaggauaugcuagacaaugucuuguauuucauugaagauguccauuuauuuuuggccuauuucagucuuucgcaauuuuuuccuucaauagccugacauacauucaguucaugaguggcaauggaggcucuguagcagguuugcugaauguuauaggaauaauuauguagcauauuguagcuuuucuuagucacaucuuuaacaaagcuuuauuuuuuuuguuuuucauuuuucauuuuagaaucaacuggcaguauaauugaaguucugaguaaaauagauucagaaggaggaguuucagcaaaucauacuagucgugcaacgucuacagcaacaucaggauuuguaagugggaaaaaagccuaaagcguuugccuucucuggagacuuucccucccuucuucccucccugcuuucuuccuccccuacuucuuucucuuuucuuuuggaugcaguuacuuucuuucagucucuaauaauggagagaagcaguggcagagauaauuuaaaauagaggauuuauucaggaaucguuuaugauugacuuuauaacauacagccugauuucaacauacagaguauucaggacaguugagccacaugaagagauggcucaggaugaauucuaacacuguccagaguacuuuauuugucuuuuuaguuucuccuuuucccucucuuagauuucucuggacuguacccugcauuucuuuucccuaaugggaaaggagaucagagcgauuggguaucaguuuccaagguuuugccuaguagccgaguggggcuuggagaauggagguaacccacucagcuucuucuccugguuggaaacagagcugcugaaagcuuaucaugaacuuuuuagagggauacuccuuacuugcauauaauuuuugguaggcuccauuggggggugugaugaaucagguuagcugccugaguggugcuuuagccaaccucauuuuuacccccugcaaugcuguuuggaaauugacucagggagguacugaauggaagaggaaaaaagggaguaguaccucaacuguugauaaaaugaacuguggcuaaacugauaucuaguccagauauguaugccugccuggacugucugucuuccauauacaguucucauucuacccguucauaguucuuuaucucuuuaaggauagcuuuaaauugacuuuaaguagauuugaguugugugggaauuuguauuugggaggggagacuaugacaccaugacuucuggagguuauaugcucccagguucuuuguuguguuuuuuaccccuuuaccuaaugcccauaaggcuuuaaaccucuauguugaaagugaagugccuauaaucagcaaaauuuuguuugaaauguaaauaauuuugaaacuuuuuucacauacaaaaaaauuauuuucuaagcuauuuauugcuaaaugagugaugauaaaacuguauaaaauauguacuaaauauugauagaauuugaacauaagcucagauauuaaacuuuugcuuuuucuuuuucaguaccauuagauuucuguaucuaacuguaugacaaguaucauuuuuuuuucuugaccaucaguaauccuacuuuaguaacauuuucugacucuuuagaaaaggauaucuaguuuagugcucuuuuggguccguuucuuuuaagggaagcaucgauauuguauuuuagaacuauuucaacauggcugcaaguaaaaugcuucccauugagucagaaauucgagaacaauugugauagcucaugugaaauuugccuauuuacuguuccuguuuguauucuuucuuaaaaaaacuguacuggauaaauaggaagaaguaaaucauaugccauauuagauucuguuguuuuguaaccuaugguaggcauugugauaaagaaaauuaaaauucuaauuuuaagccugagaauguggucaguauagaaaugugauuuuuccucaaaauaaggguuggcaaaccuuuuugaugaagggccauauaguaaauauuuuaggcucugugggcuacauagugcuucuauucuaguacauauucuuucucuuuuucuuauuuuuaaucaaccuguauaaaccauuuuagcucuuaguccuuguuugccaacuucuacuuuagaauaaaaaugauugaaaaauuggacauuauucuuuuauauguacuucacuuauuagcuacgcauauuaucacuaaguagaaaaagacaacauccaguuagacaaaggauauuccugggaaggaaauucaaguuaauuuuauuuuacuuaacauuaugagggacugggcgcaguggcucacgccuguaaucccagcacuuugggaggccgagguggguggaucacgaggucaggaguuccagaccauccuggccaacauggugaaacccugucucuacugaaaauauaaaaaaaaauuagccaggcaugguggcacgggccuguagucccagcuacucgggaagcugaggcaggagaauugcaugaaccugagaggcagagguugcagugagccaagaucaugccacugcacuccagcuugggcgagagagcgagacuccaucucaaaacaaacaaacagaaaccauuaugaggcaaucaaauuuacauccauuaagcaguguuuuacucaucuguuuacagugaacuuuauacauuagaucuuacaagcaauuuacuauccuuaauaacaaauucauuauuuuuuggauuuuuggguagcuaauaguugcugaauuagagacaggaaaguugaguaugaggcauacugucuguuagcaagaagcaagcaauaaaaaacuucuuaacuguaaaugaaguccuuuucuacacauuaccuaauuaguuucuauuaaaaaauaaaauauaauugcaauaauuaugcuccaucaaauucacuaacauucuagucacaucuauucaaaaacaaaacuagguauguaagaaguuaauaguuuugaaaaguuaucaaugaaauaaauuacuuuuuaaaacuguucuuaggcuggagcuauuggccagaaacucccuccauuuucuuaugcuuauacggaacuggaagcuauuauguaugcccuuggagugggagcgucaaucaaggauccaaaagauuugaaauuuauuuaugaaggaaguucugauuucuccuguuugcccaccuucggaguuaucauaggucagaaaucuaugauggguggaggauuagcagaaauuccuggacuuucaaucaacuuugcaaagguaugccuaauaaaaaaccuuuauuuugcuuuucuauuucuguaaauauuauucauuaaugucauaucuuauauauauguguguguaguguguguauauauauuuauauaauuauuuauagugguuaguuuagcauaucuuuugauuuuucuuuuuaagaauaaaagaggggagaguuaguucaaaaugccagcaaaaagaagaaaauaacaaguauguguagucccauaacccuggcauaauguuauucucucucugccauuuacuugauucuugaccaaggguaaauaacaucucuaggcuucaguuuccuuaucuauaaaauggauaugauaauccucaccucaugacauuggugaagaagcaagccagggaggaguauuuaaagcaaauagcacauacuugacuuguuuuuggaacaguaauagggccagcauagcuguagagugagcaagggggcaaugguaggagaaggucauggaguaauuguaaagauuucagcauauacuuugaugaacaugugaagccauuuguugaucugagcugaguagugacaugaucuggcuauguucacagacugguacaagcuuguugcuuuuggagacuagguuauaagggagucaagcaugaaagcagagaaaccacuuaagagucuauuauaguaauccaaguaaaagugcugcauaugaggguuagaaaagaggagucaaggaugaagauguuuguucuggauaauugggauauguauauauauauagagagagagaugggugcauauauauacauuguauauaguuauacauuguauauaguuauacauuacacauaucuauauguaauguauaauuauguauaguguauuuaauauguauaguaauuacauauggcauuauguauaauuuauacauacacauuuauuuuaaggugggguugaucaggaguugguuuuaaauauguuugaggugucuguuacacauuuaaguggaaauauaagauggacaguugaauauaugagucuagaguucagggaggggucuaacuggguccuuagcauuuacgugauguuuaaauacuggagauuagaugaagucaccuaaugugugagaguaaguagagaagaggccugaguuuagaggcccugaaauguugagaggguaaagagauacagaggaacuagcaaaaagagacugcacaggaaugguuggugagguaugaggaguaucaugagaauaggguauuugagaagccaaaugaaugaagugugucaagaaggaggagggaacaguggugagaaguucuuugagacaggguauauuuuauuucuuggaguaagauucagguuaugagccugguaauaauuuuugaaucauggggcuaugagcugguaucuguaacuuugacugauuggagaacuuauuuacugguggaucaguuagcccauugcugcucugaguugauggccacuuauuuuauuagaguguuucaugaaguugggaggaagacaagaaauaugugcugggcaguuugcuguuucauucacacucccaugguuaguuacuauauacucugaacaauguaaaugcaaaaaauuaaaacaaauguuucaaaauucccccuaacaauuggaaaucguaaaugguguucaugcaucuuggaacuugaauccuagucuucuuaaccuugacuuuuucaagccguaugacacaguaaagcugaccuucauuugucuucucaucaaccaccuccccuucuucuucuuccuuuuuuuuuuuuuuuaaaauccuuuuggguucugaggaagacugguaaacuggcccucugcagugaaagugggaucauuugaguguaugcuucaaguuuugguuuuccuguccuguuguuuuccuauauaccuuggugcauucuuuguuugauacauugagguuaaguggcuauuaaguuacacaguguccuuaguaucuacucuuuguagauaauuuacaaaguauuauaagaaagggauauucacauugacagugcuuucauuuugaacaugguuguaagguuuuucuuuguguuuuaguugugucguuuguauuugguauaugugaccugaaauuacuagcacuggcgcauuuguucauucuuauucaaugaauauuuauuggaugcccaauauguuccaggcacuguuauaaguucugggaauacagccuaguuuauugucucuuggcaaauaauauguaauuaacagucaacaaggcuuuaugaacgccaagaaagaacacaaauauaucuucucugcuccagaagagcugacugucuugagauugggggauugauuauuuuucaaucacaugauuaagaagaagccaaacagagauagauaacuuggagagaaaugugagccuguggaugguaaaaugucacuugcgaguaacaguauccauaggcagaaccuguggagcaagaaaguuugcuaauaaaauuuuguuuacccuaacauagguucuucauggagagcaguacuuagaguuauauaaaccacuucccagagcaggugaguuauugauauacuaauuccauaauaccauacuuuuauuuccagauuaaccuuuuaaacaacaucaguguguuaaacugguauagagugaccuaaugaaacauaucacaaauuguuaugcacaugugagccauuagaguagacugauguuaacuaguaucuguuuuggucaccuuaagcuuuguccuuuaauagucuuaaaaauuuauuucauaauuuaucucuguugauguauguguuauuaacaacugaaaggaacguucguguaugugcucuagacuuagugauugcauauaaucuguuaugguucuuaugauuauuguucuuuucucagguauuuaucuuuauacugauuuucauaaagcaaacaauguuaaaagauacagaauuucuuguaauucauuuuuuucuuuuuuuuuggagaaaauaaaaacaagucuuuaauaaucauuuuuacuuuucucaaaaauaucuuacuuguuuaguaaaucucuuuuaauuuuuuucacuauaauuggauauauuuauuucucuacuuugauguuugaauguugucuaauuauauacuggucauauaaggugguagaauacaaaaaggaauguuuuguuaauauuugucauuucauguuauacaauguagaggucggcaaguagcuagaauccuacuugaauauuuuucuuaaaccuuuuuauuuuucuaaaaaauguaugagauuuuuauugcuugaagcugaauagcuuuauuucaguguaaguauuauagcauaagguuucaaaacagcucuuuuuaugugaaacaguacacuuuguggugauugugcauugaucaaauaucugcuggauacccaguauuugcaaggcacaguauuagguaguagguaauuuucuaaccugucuguauaucaaaaucacccgaguuauuacauuauauuaucuguuaauuuaaguaaaauguagauucucaaucccaaccuuggaaauuguguguguguguguguguguguguguguguguguguguaugugugcauguauguauguggugggguggugguguuggugacaguggcuaggaagcuccuuacauguuucauauguacccagcccuauggguccacuuggaaaccauuguuauaagggaaguagaaaugugcaagauagguuucugccguuagggauuuuaaaauacgaaaagagagauuagauguauacuccagagugaugauaacugaacagugaugugaauaggaagguguagagaauaacuuuuucauuuuuuuuuaccuccuuagccucaaguuauauuucucaugaauuauuuuuucucagccugugcauuuucuuuaagcaguuuuaaaauuuacuguguaguaaaugugaauguucaaaauaugagauauuugugguuuggaaccuuuuaaacugcagaaaaccaaggucacgacuacuguuuauaaucuacuacuguuuauaaaacacaccaauugaugagacacagagugucaagcaucaggagacugauaacaacaucucuuaauggcucauuuguuggcuauagugguagugucauaggcugacuuacccuaaucauguuaaaaauaaccacuagaaggagugaaggaacgcagcaguacuuucuuuucugucuguuuuuuuuuuuugguuuuauauaaacuuuauuauuuuaaaaaagaauuuuaacuuuuauuuuagauucaggagguaccugugcagauuuauuacguggguguauugugugaugcuaaacuuugggauaugaaugaucccaucacucagguagugagcauaguacccaauagguaguuuuucaguucuugcucucccuacucuaguaguccccauugucuguuguucccaucuuuauguccacguguacccagaguucagcucccacuuguaagugaaaacacacaguauuugguuuuuuguuccugcauuaauucacuuaggauaaugacguccaacuguauccauguugcugcggagcacaugauuuuguucuuuuucauggcugcguaguauuccaugguauauauguaccacauuuucuuuauccauuucaccauugaugggcaccuagauugauuccaugucuuugcuauugugaauagugcugcagugagcauaugagugcauaugucuuuuugguggaaugauuucuuuuccuuuggguauauauccaguaaugagauugcugggucaaaugguaguucuguuuuaaguucuuugagaaaucuccagacugcuuuucaugguagcuguacuaauuuacauucccuccaacaguguauaaauguucuguuuuaucugcagccucaccagcaucuguuauuuuuuugacuuuuuaguaauagccauucugacugaugugacaugguaucucauugugguuuugauuugcauuucucugaugauuaguguuaugaagcauuuuuuuuauguuuguuggccacuugugugucuucuuuugagaagugucuguuauguccuuugcccauuucuuaaugggauuauuuguuuuuugcuuguugaacuacguuccucauagauucuagacauuagaccucuauuggauacauagugugagaauauuuucucccauucuuuagguugucuguuuacucuguucauaguuuaauuagguccuacuuguuaaucuuuguuuugaucguaauugcuuuugaggacuuagccauaaauuauuuccuaaggcugauguccaggaugguauuuccuauguuuuauucuagaauuuuaauacuuugaggucuuacaucuaaauauuuaauccaucuugaguuaauuuuuguauaugaugaaaggugggagucuaguuucauuuuucugcauauggcuagccaguuaucucagcaccguuuauugaauagggaguccuuuccccauucccuauauuugucaacuuugucaaagaucagaugguuguagguguguggguuuacuucuggguucucuguucuuuuccauuggucuuuucuuguaccagugccaugcuguuuugguuacuguaguuuuauaguauaguuucaagucaguuaauaugauacuuccagcuuuguuuuuuuuuuuuacuugggauugcuuugacuauucuggcucuuucugguaccauaugaguuuuagaauaguuuuuucuaauucuguaaaaaaugacauuggugguuucauaggaacagcauugaaucugcagauugcuuugaguaguacgaccauuuuaacaauauugauucuuccaacccaugaguauggaauguuuuuuccauuuguuuguguuaucugauuucuuucagcaguguuuuauaguucuccuuguagagaccuuacaccaccuugauuagauguauuccuagauauuuuauuuuuuugugcuauuguaaaugagauugcauucuuaauuuggcucucagcuugaauauuguugguguauggaaaugcuacucuuuuuuguucauugauuuuguauccugaaacuuuuacuugacucauuaucaguucuaggagccuuuugguagauggagucuuuaguguucucuagguauagaaugauaucauuggugaagagagauaauuugacuucuuuuccuguuuggaugucuuaacauuuuuuuuuuuuuauugccagauugcucuggguaggaguugcaguauuguguugaauaggaguagaaauuuaagaaagaaugggguaaacaguauugguuguaugcucaacaaauguuuguugaauaacagggucaaaagacaccaagaggaguccuugacauugccaaugguuauuuaaaaaaaucuaauguaucaaauauugauguuugaaauuuagcgauuccgguauucugacugcuuuuacuguugaauuauuuuuucuagugaguucaggaacauuauuauuauuuuuuauuauacuuuaaguucugggguacaugugcacaaugugcaguuuuguuacauagguauacacgugccauggugguuugcugcacacaucaacccgucaccuauauuagguauuucuccuaauguuaucccuccccuuguccugcacaccuugacaggccccggugugugauguuccccucccuguguccauguguucucguuguucaacucccacuuaugagugagaacgugcguuguuugauuuucugaucuugugauaguuugcugagaaugaugguuuccagcuucauccaugucccugcaaaggacaugaacucauccuuuuuuauggcugcauaguauuccaugguguauaugugccacauuuucuuuauccagucuauuauugauggacauuuggguugguuccaagccuuugcuauugugaauagugccacaauaaauauacgugugcaugugucuuuguaguagaaugauuuauaauccuuuggguacauacccaguaaugggauugcugggucaaaugguauuucuaguucuagauccuugaggaaucgccacacugucuuccacagugguugaacuaauuuacacucccaccaacaguguaaaagcguucuuauuucuccacauccucugcagcaucuguuguucaggaacacuauuucaaaccauaguuuuuuaguuuugcugagcuuacaguggaaaugcuauuaaauucuuucacaucuuauuauaguaaucuuugguuuuuaagacacuguauuucuuuuacuuuucuuucuaggaaaauuaaaaugugaagcaguuguugcugauguccuagauaaaggauccgguguagugauuauuauggaugguaauuuauuuacaauucuuauaauaauauuguuagauugauaggcuuuguguaugacauaauacuucaccauagaaguugauuaauaaguuaguauuugucuuccaauuuguuagaaaacaagauaagcauuuuuaaacucuuuaagaaaaauaaagaaggagggggagaagcauuuauuucugggcuuaggcugggaagggugaggcauuucauuggauuuaagacaacauaaccaaagcacaaaggugauaaauguggcuuguauugauaauguagaggagaauuaagcuugcuggaguauguuuuuggcaggaaggaauauuagauaguccucacuugacaauuaggcuguguuuuagguauucuuuaauguguuagcuauuuggaacuuggaacauauuugaacacuaaauuauucuuauaagugguaguuaggcuccuagacuugugcuuuuauaaguuucuagacuugaacuuaugaugugguuuaaacaccacagccacauuuuauuugcagugggaaaaaagauuguaguaguuuaauaaauguugaaauacuaguaauuaaacauaaggugaagauaugaugcuuaaaauuuguaaauuuuacgcugggugcgguggcucacgccuguaauccuagcacuuugggaggcugaggcgggcggaucaugaggucaggagaucgagaucauccuggcuaacacggugaaaccccgucucuacuuaaaauacaaaaaaaaaagccgggcaugguggcgggcgccuguagucccggcuacuugggaggcugaggcaggagaauggcgugaacccuggaggcagagcaugcagugagcugagauugugccacugcacuccagccugggugacugagcaagacucuguaccaaaaaaaaaaaaaaauuuguacauuuuauaaauuaaauuuuaaaaauuaaauuuaaauuuaaguuuaaauuuguaaguuuuaaaguuuaagaacaaaaaaguagauauuuguugucagugauuuuggaacccaagaacaguauaaaguuugacauuauuuaauauuuggaauauaaguuuaucauuuuucuuguaaauacauaggagguuauacuauauaugcuguuuuggaacuugcuuuauuuuugcuuaauaaucaauugagaacauuuuugaugcucuuaaauauuauguauguucuuuaucuuccuucuccuccuuuuccucuuccuuucucuucucuuuuuagguuuucauacuugucauuccagauguuggccaacacuuggcuacuauucucccaguucucuuuuagucuucucaccauugaaccaaauguaacauaccaaaaaaaaaaaguccugccgaaaccuuucuuuaauuuuuacuguucucucuugaucugcuccauuuauugaaauacaacuugguaaugguccuuaguauauuagaauuuguagacaaagugaaauugguuauucaguugccuaugugauaaaaauaaaaaucuuauuugaacuacauuggcaugccuuuccuuauuuuuguuuauaauuagauuuuucuuuaguaugcaauuuaaaaucauauuucuaguuuugcagagcuagauaugaaacagauaauaaucugucccuaguaaguuaguaaauagagggacagcugucuuauucauuacuugcucacuuauuugcuaacuugcucacucauaucauuuauucacugauuuauuaauuaauaaacacuuauuaggugccuuuuuuucuguacaggaacuauucuaguugaugggaaaauaagagugagcagaacagccaugauccugcccucauguggcuuauaccuucauucccacuuauuuccucuccaugcucuucuugacugcuuuggcagaauguuugaaaguucgagugugguuaccuguacuuucuagugggauuauuugaaauguuuaagguggaaauaauugggaucugaauagcaguuggagagccuuaagaaaagugaaagaacugcuauuucauaguuaagaaaggauuuuugaagcuccucuucucucugccuuucagauucugguaugaauggauuaaaaugaaugcuuuguaauccaaacuuggacaccuuuacauguuagaacucuuucaguaauuggauuuuguuuuugaaaccuugacaggaauuguugaaccuaucuugguuaacuaguuaugccuuuuggugguaacuucuuuuauuuuuucuuuuauuuacuuuucagucuauucuuauucugagaaggaacuuauaugccacaaucaguucucucucuuucuuguuggcucuggaggcuuugguggaaaacggacaucagacaaagucaagguaagccaugacuuuguaagcaaaauauauguguaguuaaggauucuuaccuauacaauugagacuugaacagcaugaguuugaacugcaugagcccacuuauaggcaaauuuucuuauacaucugccaccccugggacaccaagaccagucccucuucuuccuccuccucuuccuccuccucagccuacccaaugugaggaugaugaggaugaagaccuuuaugaugaucuacuuccacuuacugaauaguaaauauucuuucauuuuuuauguuuuucaugacauuuuauuuuuccuaguuucuucuuccucuucuucuuuuucucagagacaagugaauguuuauuuuugugccuuucuuccuauguguaugucaagucuuuuucaaaacaaggccccaggaaacuccagauuccauuauguccccaggcuuggucgacugcugcaggagucuuagggagccuuguacaaaugcucgauuugcucauuuaccaacauuaaacccuuggauagacgaugcagcaaagcaggacuccuuccuccauggaaugugcugauuucagaugagguggcagccaguguagaaaacguuuccuagcucauuuuauuguaauaaugcagaauauaauaacacaaaauauguaucaauugaugguuuauguuauugguaaggguuuugguuaacaguaggcuaucaguuguuaagauuuuagggagucaaaaguuauacgugaauuuuugacugcauagucagugcucccaagcugcacauuguuuaagggucaacuguauauugaucuuauauuaccauauauguaaucuuauagcauagagacuugguaauacguacuuugaaauuguguguguuccuugaauuugaagugcuguuuauguuuauauauucucuguacaacauauuuuauauauagaaaagccuugcugaguuaaguauaauguaucugagauaauuaugggaauauuuguuauuuucuuguacaaucuuugcagaccccaaaaguuuuuagaaaaauugaacacaagugauccuuguauagauuaaaaucuucauuuauuaaaggaccuaaguauuucucuuaugcaagauaauucugguuauucuuuuguucucaaauucuagaaacauauuuuuccuaaaaauauuuaauuuggauuucacguuaaucuggcuuuaccuuuaaguuacuugugguaauaagauuauacuguagucaauauucuucuguaguaaauaaaguauuauuuaaagcaguauugggaaaagacuucuggaauggugacguaagaagcuccuuggacuuucuugucagugaaacaaccaugacuuguaaaaaauuauuuuaaaacacagcuauuuaaugucucuggaaauuguucuaaggguauagagcaaaugaagaaacauuuauucaagaaaaucuauuauauuuugguaagaacagugagacuguguggcauuugagucacaaccccucccuuuguucuuccucuccuggcugagcaugacagaaacuguaccccaggcguuugcagccaagaacguaggagcccucugccaugcugucuucccaggaugggcagacuauuaacuuuucuuauccuucccacuagcucugaauugcagaugcucuauuccagguaaaagugacugacuugugagccucuauuucuccauccagcccccacuuacagaguggagacuuuacccuaccuguggcagguugagaauacuggggcccugauugcacuugcccuagcuuucccguagcguggagguuccgugguuggagagucagcagagaagaacagaagcuacuacaccugcccugcuuccuucuuguaaagcaaguguaucauuuggaaagaaguaugucacuacuccugcagaaauucugccuagagggagaggaaggcuguaauaacacaaaguucugacccucuucacaaggaaacagagucuuuuuguaacuaaguauuuggaaguucaagcauagggaugcccucaaaaacaaggugugacuguagugauaagcaauuaagagaaggcugguaguuccguaacagcagggagcuaaaguguagcccagcuagacauuuacuagaaagaaccagggaaagagauagcuaagaaaagcccuccugggauuguaacaaaccucaaagucuggccucaacgacuacccuugcaaagaggcuugaauuuaauuggaucagauuguugaacaauuuauaccccaggacacuguugaaaaaaauagaacaguaaucuagcaauuaguggaaccuuacaacuggguaugauaccaaaagaggcagacaguuuaacagagagaccaacgagagacagucaaagagagccugcuaaaaccagugucaucguagggugacugcaccuacucaagguacacucucugaggagcaauaucagaggcuguacacuauugggagaauagacucacauguaagagucuagcuaaguuacuaaauaaauaaacaauaacaacaagcccuggaaggggugggggauuagugucuagaguuguuauaaucuauuaucugaaaugcccaguuagcaacaaaaaauuauaagauauggaagaaacaggagagugugaugcauagacggaagaaacaaacaggcaacagaaacugccuuugagagaacuuaguagacagacuucacagcagcuguuauuuauguucaaagaacuaaaggaaaccaugcuuaaauguuacuaaauauauauaaauuauuacaaagacucaaauaggaaauuuggagcugaaaguauaauaacugagaugaaaaauuuacuguugaagggccaaauguagauuugacaaaagaaagaaucaaaaaagcuuaaagauagauugauagugauuauacaaacuaaagaacagagagaaccacagugaagaaaaggaaaaagaaugaagagccuuagagaaagauggaguaucacuaagcacacuaacauucauauaauggguguaucagagacagagaaaggaacagaaaaaaauuuugaggaaauaauggcuucugaugaaaaacauuauacauccaagaagcucagucaacuccaaauagauuauauaucuaaagaaauccauauucucuucauuguaguaaaaguguugaaagccagaaacgaaaagguugaaaauaaucagagaaaaaaugacucauuacuuacaaaggaacccuaauaagauuaagagcugaccucugacuucucaucagaaacaauggaagucagaagauagugggcuaauguauucagagugcugaaaggaaaaaaaaaaaauaccacaaggucaacuaagaauuuuauaaccagcaaaaugagcuuucuaaaauaaauauaaaauaaagacauuccuggacaacaaaaacugagagaauuuguuguuagcagucuugccuuauaagaaauccuaaauaaaguucuucagauugauagcaagugaccacauacuguguuuauaugaaauacccagguuaggcaaaucuguagagucagaaaguagguuagauguugccaagggcuggaggagaaaggagacaagggagagugacugcugauggcuauaggguuuucuuuuggggacaugaaaaugugccuaaguugauucuggugaugguuggacaacucuaugaauauacuaaaaaugacuggauuuuacauuuuaaagaggugaauuauauguguauugugucaguaaagcuguuugaaaaauuaguauugaucaauacuauaugaaaacaauguccugggcccgcauuuaaaaaaaaguuguccucacuuauugcuuggaugugaaaaaauuaccuugacagguauuaaauggguauuauuuacgugaaguuguaucuauucacagguagcaaauuaugaguuauuaagaacccuaaggcaaguugugcaaugcagaaacaugcaguggcauucucugaaugaaaagcuuggaaauguuauauucacucuuaaaacauccaagcuuuuagugaagauauuauuuuagaaaggguaaaauacaagucugaggcuauauuagaugaaguaaauauaacaugcuauuuguuuuuccuuuuuaacuguauguucuuuuucuuuguucuuuuuucuuuuugagauggaaucucacuguaucgcccagccuggagugcaguggugcaaucucagcucacugcagccucugccucccagacucaggugauccuccugccucagccucccaaguagcugggauuacaggugcccgccaccacaccuggcuaauuuuuguauuuucaguagagacgggguuucaccauguuggccaggcuggucucgaaauccugaccucaggugucccauccaccucgugcucccuguauguucuuuuuaauauugggcaauaaugaauuacuguagaccagaaaguaaucuaaacuagauaccauucucuaagcacuuaucacaaguaucacuuguugcuuugagaaaaaaaucagagaugaugucaagucauggugaagcccugugccauaaacgaguuucuagucuguuaacaguaaaacuaccaucgcggcacuguccaucuuaaaugcccuuuguauacauggcauacaauggauuuuguggaauaaaagguacucagaauuuuuuaauuuuuaauuuuuauuuguuuauuuuuaaucaggcagcccucagaaucaagacagguucagagaacucuugguacucagaaauuuuaaaagacugcucgggaccuauagauugaagucagguccuccaaaaccuaguagaaugcauugaaaaugaauuuguaaauaaaaccugcaaaauacacuggaugcaacugaaacaaaggaguguaauugaugcaaugauuuuugaaaaacggcagccugacuuuuguuugcuuuuagaagcagcaacuucccucaugaucuuuuuuuauguuuuggguguggcgggguuugugaggauaaguuugggaauauaucuaaguguggcauuuuaguaaugaaaaaucacuaauuucuuaacucucugaaaggauaaaagcuuacuuuguuguggaaaauuuacuuaaauuauucuauaauaaaauuuugccucuauuauaaaugauugagaaguagauauuagcuacuugaauuuuuuauguuuacuuugguuuaaaucaacccuaaacuggcacucagauacuuacuuuguagauguugcagacuuuucaucaaaaaggaauuuuaaguguuggcauuaagggaucauaauaauucaaauauuuuugguaaccaacuuuaaaauguauuauuuuguuaagauggcaaauuaaaauaugcaaggauuuaaaagaccaguuuuaaagacugaaucaauuuagaugugaauuauaugucuaauucuuguaguuguuuucaucuuuuacauagggaguaacuguccuuaacuuuuucuccauuguggccuggaggauuuaucugauuacauaauucuuuacauuuagaaaggucauuucaggcaaaucauagaguagaugaagcuaggaguuaugaaauuuuaaauaucauuauuuccugagcaugauuuuuuuuaaacccuuuuauccaauuugcagaguuuauuguauugaaacaugauuguguaucaaaugugaguuugguuaaagagaauaaugauaauuuguauuuaagauuuaacauguaaugucuuaauuuuagguagcuguagccauaccuaauagaccuccugaugcuguacuuacagauaccaccucucuuaaucagguaagauuguauuuuugaaaaaugauaaauccaccugguugaugacacuuuuuaauuuauagcucugauaccuuauaacauuaugcaucuaaugcauaaugaauaauauguuauuauucaacauaauaaacauacagacauguuuccugugauugcacguuauuuuuuuaauuuuuaguuauuaauguuuucccacuagauaccaaaauaaaauauaaaaugguuuuuuauuagucaauuuaaaaagcauugcauguuguugguaauggagugcuuucuuuggagaggccgcccacuuuaagagugaagaauuucaugaaagccucagaguaagugcaggauaaaaauuagguaaaaggcaaguaaguauuagucauccuuuccucuuugggaaagaaagcaaugccacacugcuuggaaacagauuauuuuauaccaacuguaaaggauaggcaaauaaagcaucuuagaagcaguaggugauuuaaucuuuuuuguuugacauaaagaauuuguuuucuggugaaggagauaaaauguccugucaguucacaaauucugugaccauagaaaaauuuguuuaagaaacaaaaggcaaccauaaaagugagaaaagcaaguuuauuuuugagagaccuuaagauucuucucuaagauggcuaguagacuaaccaugcagauauagcauaaaauccuuaaaccucuggaguaacgcagugugugugcauguaauaacagcaaauuguucagaaaggucacuuuaaaaaaauuuuugguuguauuuuagaagagaacaacacaguggggccuacuggaggguagaggauaggagaagggagaggaucaggaaaaauaacuaauggguaguagguuuaauaccugggugauuaaauaauaugcacaacaaacccccaugacacacaauuaucuauguaacaauccugcacauguacuccuggacuuaaaaguuaaaaaauuuuuuuugguauguuugauaugaaaacuucugcaggacuuauguuuccuagcaaauagaauuguaaucucauaagccagagagaauuaaaguugguacauauguauuuuuuuucuguaccauauaaucaggugauggagggaacauuguuuuauucuugcuuuuaaauauuuuuuccauccauuacuguuucuuaugaauuucuuaagaaugugcucauauuuauguuuacauaaggcuuaauugagaaacuaauucuguuagaguacuaaaaaacagaaaaggcucaugguuucaugguucagaaaacccaagaaaugccucuuuauuauacugaaauaaaaaauauaucugcuacaaauaaaagcugaauaguuuccaagguuugaauuucuacgcacaguaaguagugggguuuucuuucuuuuguuuuuuuuucagaugacuaaaacuuuuuguuaguuuuaagguagguuuuaauauuuugcugcgugacaaaagacgguuuuuaaaucaacaauauuuuugugugaauaaugggcacucaucauuuggcagagguucuuggccauuuuguauuguaugauaauuagagaauauaauggaggcuauauaccaguucccuaaaaaacauuuugcauaaaacuuugcauaaauuucagggaauuugugggacauuugaaauuggaugcaugcuauaagaaauacaagucaauuagaagaagugucaucuauugucaaggaagggaaggaacacuuggauacucaagauauagaugucugagauaacuagggcaccuauuccaagcaaugaauguuuaaauacaaggcuuugauuuguaguauagguguaacagacagucagagaagggauacuuauuagggaaugacauguagaagugagaggugacagcgugcuggcaguccucacagcccucgcucgcucucggcgccuccucugccugggcucccacuuuggcggcacuugaggagcccaucagcccaccgcugcacugugggagccccuuucugggcuggccaaggccagagccggcucccucagcuugcagggugguguggagggagaggcgcuagcgggaaccggggcugcgcgcggcgcucgcaggccagcuugaguucugggugggcgugggcuuggcgggcccggcacucagagcagcuggccggcccugcuggccccgggcaaugaggggcuuagcacccaggccagcggcugcggaggguguacugggucccgcagcagugccagcccaccggugcugugcucgauuucucgcuggaccuuagcugccuucccgcagggcagggcucgggaccugcagcccgccaugccugagccucccacccccuccaugggcuccugugcagcucgagccucccugaggagugccacccccugcuccacggcgcccagucccaucgaccacccaagggcugaggagugcgagcguaccgcgcgggacuggcaggcagcuccaccugcagcccuggugugggauccacugggugaagccagcugggcuccugagucugguggggacauggagaaccuuuaugucagggauuguaaauacaccaaugggcacucuguaucuagcucaagguuuguaaacacaccagucagcacccugugucuagcucaggguuugugaaugcaccaguggacacucuguaucuagcugcucugguggggccuuggacaaccuuuaugucuagcucagggauuguaaaugcaccaaucggcacucuguaucuagcucaagguuuguaaacaaaccaaucagcacccugugucuagcucaggguuugugaaugcaccaauugauacucuguauuuagcuacucugguggggccuuggagaaccuuuguguugauacucuguaucuagcuaaucugauggggacguggagaaccuuuaugucuagcucagggauuguaaacgcaccaaucagcgcccugucaaaacagaccacucagcucuaccaaucagcaggacguggguggggccagauaagagaauaaaagcaggcugcccaagccagcaguggcaacccgcuccgguccccuuccacacuguggaagcuuuguucuuucacucuuugcaauaaaucuugcuacugcucacucuuuggguccacacugcuuuuaugagcugaagccagcgagaccaugagcccaccgggaggaacgaacaacuccagacgugcugccuuaagagcuguaacacucaccgcgaaggucugcagcuucacuccugagccagcgagaccacgaacccaccagaaggaagaaacuccaaacaucagaaggaacaaacuccagacgugccaccuuaagagcuguaacacucacugugaggguccgcggcuucauucuugaagucagugagaccaagaacccaccaauuccggacacagaaggguucgauaguaagaaugggacuuaguggagaugguauguggguguuuucucuccggauauguagggcuugcaguguguugagaaguaaugauggaguguaagagaggagaagagcaugacguguguauaagggguaagaauuagagcauucacauuggagacuaguguaggaugauugugcaugggcagaucuuuaagagauauggaaaugaggaaaaauuaugccauuauacauaaacuuuaugcuagguauuuauauuaacuaaguaacuuuucaaucauuaagaaaacuggcaauauauauuuuuaacuauaccaguaucacuucuggaaugucuguuuauaaugucuucaggagaguuucuucaucuugaaacugguaugacaggccugcacaguggcucacaccuuaaaucccagcacuuugggaggcugaggcaggagagucacuugagcucaggaguuugagaccagccuggggcaagaacuugucuccacuaaaaguaauaauaauaauaaaaaaauuagccgagcaugguggcauacgccuauugucccagcuacucaggaggcugagguggaggaucacuugagccugguaaaucgaggcugcagugagcugugauuacaccacugcacuccagucuagguaacagagcaagacccugucucaaaacaaaacaaaacaaaacaaacgaguaugacaauacaaguguacuuuguaguuuuucauaauuauuaauagacagacaauuccacugcaauaaucuagacagaccaaacagcaaguaaauaucagaugucaggcuuuguauuugaggaaaaugagaacaaauauccauaguuuccccagauacauaucuuauacuauacauauccuauuaaguaaaguuaauauuuggcauaucaguucuaguauccaguaaaauauaauucuuuauuacaguuacugucaucuugaacugaaaacagacauaggcucaaaaacaugucuucuagugggagaucuuugcagauuuagaacaccccuuuguggggccacaaagcuguagagaaaucauggaugcuaguuggaccaucugagucacuugcauguaacugccagaaagugcuuacuaucugaugggaucaucuaaagugaacugcugaucagcccauguuuuagaugcagagacugauugcauuccagauuuugcaaauaucaagucauauuuccuggaguauucuuucucucauuuuuauuuggaccuuuaggaccauaaagaacucauguaaagucauuaagaaagcaacacaagcauucaucuuaucuagaagagucccagcauuuaauuuaguuucacuagaauauuuucauaauuuuuuauaauucugcuucuacuaaacgaucacaguaugauacaccaauugucaauuuuuaaaagaaaaaacuucuuuuacauccucuggucucauaaucugagauauuacugacagccacguucuaggucccacucgcagcuccagaaaagacuccuuugaacuuuuucucuaggcuaccauagcacccaucgccuuuaguuuccaauacgugucaccuucacuucacugauuauuugugggugaaaguuucagauaaaucacugggaaucaaaaauaaaucauugagaaaccaaaaaaauuaccauacauuuuauaacuacuaccuguuuuuuuuuuuuuaaacaaugauuuauuauuuuccaagacucuggguugacugggugaucuuucugcuacaaaugguguagcugcuuuuagauggcagcugggcagggcuggaagguuccaagauggcuucuuuugcauaucuggggucuuagugcuagcuguuggcuggggugcuucgaaucuucccuacauggccucuuucuucaugugguguaucaucuuccaggaccuuuuuuuauagcccucagugagacccccauuuagauuucuggaguuauuuuucuguguaacuuccuccucuucaguacacacaaauucagcugcaucauacuuucagaauucuaaucuauauuuguaacucauugagaccacuuugcuauauucgagauuucugaauugcagucugggaacugcugucagaaggaagcuguacaauuguagaacucaucuuguuuguuucuuuucuguaaagaauuguaguccugcauugccugcuguccaaugucuaggaacagugguaacccccaccuuuuuuuuucuuuauaauuuuucuaguuguuuaugguagaagaauaaguccauucgagguccuucauuauggccagaagcaaaagucguguauaccuuuuuuaaugcccuuaaugccucauuuucccauuuaauccaugacuaucuaguuuuuuaguuuugauugcuguucuuuggcuucguuucuuguauaacagucaaaagagguuauuuuacuuuuuccccucuuauuguucccauuuugggggaugcauuauuuuuacuguuuagagcauuuaacauuuauguauuauuuccacuuuucuguaucuuuuaguuuuagauuugcaguugaauaugucaacccuuuugccaaagcuucuuagucagcucuuaguuggaugaagcuccuucuguggaagguuucccaagaacggcuccuguguauaguguugccuugguuucuauaucuuuaaaacuauuuacccuagauacuugaagggacagcauuguuggauauaaaaucuuauuucuuaaaaauggugcaucauuguugucuuacuuuguauguugccuuugaaaagucugaugccaaucuaauuaucuuccccuguaaguuacuugaucuuuacccugaggcccucaagauuauuuucguuuuuaaagucuaaugguuuugcugggauaugucucagucuugcauguugcaggucagucuuccuuauauaccuggugggccuuuuuaauauguauauucaugucuuuuaguuuuauaguauuaaaauuuuaaauauuaguucucuuucacuguuuugcuuuucuuucuuuggguauccauuuauauguauguugaaucuuuucaugucuuucaacuacuuuucuucuguucuuuuuuaguugcuucuugaucucauuuucauucucaugguucauuucugcccuuucugccauccccuuauuuaauuuuuauuugaauguguucuccuuuggguaccuuauaauuuagucuucauuucuuauaugauuuugauuuuuucuuuccauuucuuucuugaauuuaaucauuacuuauuuauuucuucauguaugucauccauuuauuuucuuaguuuuuggauuuuggauucagaguguuuguuuuacauccccaaaugcuugaguguuuuguuacaguuuucuucuguuuggcaguuuguuuauuuggaggggggguggauuuuauuuacuaaaagguuuuguuuugcauuuucaguuuugguuuuuuuuuuuuaaauauauauguauuuuuauuauacuuuaaguucuaggguacaugugcacaaugugcagguuuguuacauacguauacaugugccauguuggugugcugcacccguuaacucgucauuuacguuagguauaucuccuaaugauaucccucccuccucccccaccccacaacaggccccggugugugauguuccccuuccuguguccaaguguucucauuauucaauucccacguaugagugagaacaugugguguuugguuuuuuguccuugcaauaguuuucugagaaugaugguuuccagcuucauccaugucccuacaaaagacaugaacucauccuuuuuuaugacugcauaguauuucaugguguauaugugcuacauuuuuuuaauccagucuaucauuguuggacauuuggguugguuccaagucuuugcuauugugaguagugcugcaauaaacauacgugugcaugugucuuuauagcagcaugauuauaauccuuuggguauauacccaguaaugggauggcugggucaaaugguauugcuaguucuagaucccugaggaauugcaauuuuaguuuuauguuaguguuguacagaugaagaauauuuaccucugugcguuuugugguuuggggugguuuccaagauucuuaguucaaaauugcccuuucucucuguguagcaacaugcaauuucuuuaguggguggcuuuaaagaaggggcacuguggggagguguuuuauuuuuaaaaauaaaauaaauuaucuuucaggaucauuaauuuccucucuugcuucuuuuuuucuucauccagucuccaaaggugauaucuuuguuuuauucuguucuccccgaaagugauaccuuucuggaauugccacuggaagacuaguguacuauuaauuauuuucauuguagucagugcuguaaucuuccaggauucauuucaguauuuuugcccuuaagauggauuuaucugggagugauuuuccuuuucccucuuccaugcacugcuuuugcaccccccaagcccugccacucugcaguagcuuucagagggugcucaaaaguuagcacugauagaaaagugguguuuauuuugagacuuacuggaauuugaacucugcaguguucucugucuucuaguuacacuguaggcuugagauuuguguaguuuuauuuguucucauuauuuguauuuuuuuuuucgaggauaugaggacuuaaaaagcacuaguuuccugagccuauuuauuuagcauuuaguuuaacuuaaugguacaauuuuaaaaaaucaaauuaaggaauaguuuaccuguaugcagauuauccucccaccuacuuuuaauaugcaaaauaauauauagcuauuuuucuuuuucuuauuuuuuuggugguuguuauuuauaaugacuuauuuccaggcagaaaugaaacgaaacaagaaacuuuuagcuuuccuucugaaauaugccauuucuucaaaauacguagaagauaagcuuuggcaguggucauuauuaauugaacaaugcuuauuuuguguuaugauugaaugggucaaacaucuagucaguuggcuuuugucauuucucauaaugaaccuuuuuugucuucguuuaacucuguuaucuauagaaagcaaugcuaucauugaaauaaugugagauauuucauauuaauacgauuucuucagaacacuguauucauuuauaggaaugauauaugugggauaagaauacuaguacuaaucuuagaaacuugguuguuuguauuguugcuauaaucuuuaaaaaauaacuaacauuuauugagguauuauuuaucaaagauaauaccuuguaagcuuuaucccaccuuuuuccaacuacucugugagaguaaguucuguuagccucuaaauguuucuaaaugagcaauugaggcuucgaauggugaagaaacuugcccauuaaugguagagcuggcuuugaaucuagaucugacuaguaccaaaucccaugaucuagcauguguuugauaauuuccugucacaauuucaggcccugaaauguguuuuucuuucauuuguauacaucaugauauauauuugcuaacauuuuauuauauaaagugcuuuuaaaaaauuaucauuuacuucucuuagcaucucauaugggaccuugcaagucaccaguauucaauaauuguuuauuugauuucauuauauuaagaagacauguaaaggaaagaauauugagucauugggaaaguaaauaaucuauagaaccauuauauggagucauggggaaggaaaagagcuuauuggaauuauacaaagcauauuaaaaagaaugaugcuuucuuaugaauuauagaauauuuucuauaaauaaaacuuguuaaaaauaaucaguaguuuaaaaguaauaaaagaucaguaauuuuaaaaagauauggcuagucuuuacacagcauuucaguagucuuuggaaaacagcacagcaauuaaugagaaagggaagaagucuugaggcugaccuaaaagggucggucaaguuuacagauacauuaaauacacuuacuauuagcuguuuggugaauuucuuccuuucagugcugguaagugcuuucuaacuuggaagaauguaccauuuaaacgccagaaaguauggugacuuuuucccuauuguuauccaggccacgcugcuaauccuacuuuaucuaaguaaacuagugauguggaaaucuggacucagcagaacuuuuaucauaauagcaagcuaucaguucagucaguuuucuugcagggugagcuaauguucaggauuuaguguaccagcagaaugaaaguuagugagaagucuuugauguuucuauguccgauauugucuuagaagcuucaauuuaaaacaccccaguaagaaaguuggcauaaauuuugcuugcuuagagcagacuauaaacauuuaccuuaucuguguauaaaugggaguagauugacugacuucuuuuugugaauuucuccuuagguaguaguaacaguguuuuaccuaaauauaauucuuggcuucccuuucuacauuuuuuucccucccacugauuuuaguggcaaguguuaaaaaaacauuucauuauagguaaucuuuauuguuaaaaauaauuauuuuuaaaaucagagccucagguacauuaugauacaaugcuuauaccaauaaccagccauguuuccuauuuuucauuuaauguauucuaacaaaacacugaguucuaguuauguuuaugcuuucuccacaggcugcuuuguaccgccucaguggagacuggaaucccuuacacauugauccuaacuuugcuagucuagcaggugaguugucuuuaauauguaucaaugaaaaauauuagcuauucgauauuuaauuaaauaauguaaagacacuacuacuuaugacugguaguuugaguagcauuuaaaaaaauguuauuuuauuuauuacauuuaugcaaaggauauggaaagguaggaaauguguucagaaaauagugcacuugaaauucagauuaugguggagggaaguucccgcuagugcgaggucuaggauaggaccacgagggugggugugugaguuaucacaaaggacaaggucauuggagagagagcaaggaacugaaagguuagggaaggaucauguaccuguguggauguugagaguacccuggaugauuucaugguuacaaccaaaacuaaacaaaacaauuguguuuccagaucucucacauucuuuuccuguuuuguuuuuuuuuuuucuuucuuucuuuauuucauaauuuccucccaggaaauacucuuuaaaaaauaucuacuguguuucuuaaaauagaugguauaauuccugcuaaugcagucuaaggacauuuuuaaaguccugaauuaacuacacuugauuuuuaaacuuuaaagguaccuguaucuaacucaguguucucucuuuuccuagguuuugacaagcccauauuacauggauuauguacauuuggauuuucugccaggcguguguuacagcaguuugcagauaaugaugugucaagauucaaggcaauuaagguaaauguguauuacuacguaauuugaauauuacuuccuuuuucuaucuuuagagaagaaaagggguuuuagugauuuaauugaaaauagauauuguacuacagcaauguacauuuuuauuauuucauugaccuggcaaucagcacacuuucuuuuuguagcuauaaauagcucuguugcacaugcaccaggaaggaugcacaguugcaauuuugacagauuaacuggguugcuuuauaaauuaauuaggugcauauauuauauauauauauaucaguacguaugccuugaaaacucaagauuugcuuuuuuuaacuguuuuaucauuuucauuaauuuaauuaaaaauguuaaguggcugauuaaguccaauaaacauacaucuacagcaauauaaugacugcauauuguuuuaacucuguacuuuuuaguugauuucaaauuuuuauccauuauaaauaacaaggaaaaauauccaugcccauauuauuuuuguguauguuuaagccaaaagauguacacuuaaaaaaguuuaagggguugucaaauagcuccaaaagcuuuuaauuuauccuccaugcaguagugaaaauauauuuucugaugcauugccuuugauaacacuaauuacucucaugcuuuucauuuuguuacaacuauuuuuuauuauccaguaauauauacacagagaaaauaauauaaaaaauuaugaaauaaaaaguggaauuauuuugcccugcauacucaccccaggccucauuccuuagacuuaauuuguaccacuuuuaacuguuucuuuaaguuguucugauguaccuauauaacucaccuaauaugauuaugguuuuauuucuugauuugucaagauaaaaaacacuauuuuuugauuccauacuuugaaagacaaagaauuggcuuacuuauauuaguuacaucuuuauuuuacuaauuuuaucauauuauacuuaggucuuuuaugaauuuaaauaucuuuaaaccuugauuuuuuuuuucuuuugugcucucuaguuuccuuuccaauuuuuuccuccuacaaguaaaagaguuuccuuuuaaaacauuuuuaaccccacaauucuuuuuuaaaggcucguuuugcaaaaccaguauauccaggacaaacucuacaaacugagauguggaaggaaggaaacagaauucauuuucaaaccaagguaugaauuuugcuuuuucacccuucucacaugcuuuaucauuguguuccaucuuaccauuuuuuuuugguuaguacuauggauagaaaguucuuuuuaaguaaugguaaauuuuaauuaaaaauaagauacagcuugucugguguuuucaaaauuuuuauuuaucaggcaacacuuaauaaaauagaaguguuuugcacccuguguuuuauuuucucuuuuauuuucaacuaaauugguagcuaucuauguagcaguggcccagcuauucugaaaacccagccaaccaugucuuuuuggcucaacuagucaaucaagucauugucaaaauaucaucuuaaaaaauuuaaaggcaugacucagacagauauacagugaaaacaugacagaaaucuaucugacucauuaaugaaggaucuugcaauaugauaaaacauguucgaaaaaaaauuagaacaacaguuuauaugguccaauaggaaaguuauucuaaaauaauuuugcagaguuagagacaaaauuaguuaauauccuauagaacaauaaaaucuuauccuuuaugaguuuucucuggacagaaaucauaugcaucuugauuacacaaaaaauccacaaauuaacaaguuacaucacagagucugggccuaacaaauaguaaaugagguuauuuuggggugaggcuguuagcaaugcuccaguaaaauacuaaaaggacaugcaaucauuguuuuauuugcaaguuauuaaaagacaguuuuuguuaacacaguugaccaggcuaauacuuuuuggcuugaucauuucaugcuauauagagcauauuaaacaacuccaaugauaauaggaacagcuuucauuuauugagaaccuauaaacuggcaauaguauuuucuuuaauaugcauaauaaaucuguauguaaauauaagaaaaucuagguuccuaagaaaaucuaaucuagguguccuaaauaacuugcucauggucacacagcaagugguugagcugggauagaaacccgaucagcauggcuucaaagcuuugauuacaggccccaaaugucuuuucuguaucauguuuucuuucacaaauagauaacugcaaaauucuucuuacaugguugcuuuacuccuaauuccuuucugcugguugcaauaucauuuuccugcuuaauuuguacauauuguuuauuuuacuuuucaaauuccuccuguccuucaggcuuaaguucaagcuccacuuugcucuuagagacagucucuuacuauuccccacuuuccuacccauagauacacucaaauugguguucucugaaagccuuugcagcuaauaucugugccacauauuuuggagcccucacauuuucuaauuuguuuuguaugaguaaguuuugcuuuuugauuaagauuaugaacucuaaaaguguuaaggaccaugacuauauuacagguuuuuauuuuccugcaauucuggugaugaauaguauguaaauaauuucuauggauacaaacuugaagggcugagaaaugauuaaaugucuaaauauaauguauucuugccauuuuguuaaauucuaagcaugcugucuuaucuuuucagcauauuugcuauauuuuucuucagugauuauagauauucuuuuucuauuaguuuuaggacuccuucucucccugccuccuuuucucacuuucucccucccuuccuccuuuccuuucuauucuuaagauauaagaaacauuuuaaaccaguguuuuaaaaugauuugcuugauuugguaacaauaaaguaauuuacugaagugcauuuuguucauuaauuaucucuuuccaugcuuuucaauguauguaauuugaaguaaagugaacaaauuacuugaaagaucuuuuuuccuccaaaauaugaugagauguagucaagagaaugaucuucuugauuguuaaaaaucaaaguuuuaauaaacgcuauguuaaacuuuagaaacuuauccuauacauuuguagcaauaacaauuuuuaugaaagaauagccauuggaauaauuugaaaugaaggacugggaauuagaauuugaauuccuuuaaugacuauuuugauaaaagccuauuuagacauuuaguucaugcuguguacacuuccucuugaaauaagaccuggaauuacuacuuaaaaaacacuauuaugauuuguuccuagccaauuuuauucuauauuagcagaacaaauguacuuugaguaccauuaccucauguggcuauugugcuaugccuuuuacuauuuauaaggauucagcauggacugaauucuguuuauaagagugcauccccugauccccacuucccccccaaaaaaugcccaaaauaccaaggcccagucucuaucaguguauuuacauuagaauuuugggggaugggaccucauaggguuucuuuguuuguuuguuuuaaagggcuccagcugauuauaaagccagguuuaguaacaguuguauuaaaucagaaagccuuuauguuuguucaucuugacauuuacuuuagcagccuuuuauuuuaucuggauuauuauauucuuuuucauaugaggcaaaaauaauaaauuuuaaacuuuguacuguuucacagugaaauuacacuuccauuguaaucagaauaaaucuuuuuuuuuucuucuccuccuaagguccaagaaacuggagacauugucauuucaaaugcauauguggaucuugcaccaacaucugguacuucagcuaagacacccucugagguagguuauaaaaauuaguauccaagccacuuccucauuuaggaauuucaguuaaggugacuuuaagagugguuaggcuacguuagaaaauuaacaaccaugaaacuauucuuaauucuugaagugaaaaacauuaauucaaaacagcuuggaauagaaggaauacucuggcaauuuaugaacuuuaaaaaacucguuuugcaggauacuaggauaucuuucaagagaacauaauuuucuaguuuuagaauaaauaaaucaguuguuuaaucagaaucuuaagcaaacagcguuuuggagaaaaauagauuaaaaaguugaauauccuguaccuuuuucuugauuuaaagguuuauauaaaguuuuguaugcaaauauauaaaccagcagcguguauaauuuauuaaaacauuguauuauuuauuagcaugcugagacuuuugauaaaaauguuuauauucuaucucugaaauauuaacuuuguaauguugagguuucgauacccaugaucuuuaauugucugucauaaaccauauaacugacugaaaauuaaaaucccuuaagaauagucuaagaaaaaaaaaaacuuagagcgggcucggugccucacgccuguaaucccagcccuuugggaggcugaagugguuaggucacuugaggucaggaguucaagaccagccuggccaacauggugagacuccaucucuacuaaaaauacaaaaauuagccagccuugguggcaggcuccuguaaucccagcuacucaagaagcugaagcaggagaaucacgggaacccgggagguggagguugcagugagccaagauugcacuacugcauucuagccugggcgacaagucugucucaaaaaaaaaaaaaaaaaacaaaaaacaaaaaaaacccaaaacuuaaguuuuagagcuguaaagaaauucagacuucauguaauuuaguauuauuuuauaaauaaaaaaaaugagaccauagaaguugauuaauuugaucaggaucuuucuaaaguuagcuaaaacauagguuguccaguuccuauuuuucuuuuaaaauauuauuucugaauucuaauaaaaguaaaauccuguuauuaagaggacugagguucugagugauguauacaaauaagaaaguaugaaagacacauuguaugaagaaaacugacuuauguacagaguuuuaaaaaaucuuuuuuuugcacauguuuuauaaucacuuuucuccaugaguuauuuuuacagaacuuuuaaaguuuauuuuguugucguuguuagggcgggaagcuucagaguaccuuuguauuugaggaaauaggacgccgccuaaaggauauugggccugagguggugaagaaaguaaaugcuguauuugaguggcauauaaccaaaggcggaaauauuggggcuaaguggaguaaguuauagcccugauuuuauaauauucuaagguaauucuuaguaaauaaaguaucuuuuuaacaauuaaagaccuuugaagguagguaaaucuuaccuuuuuagguaaguuuuuuuucuuuucccgugggaaugaauagguuugggaauguccaaagggggguguguguguguguguguguguguguguuuguguguguguguaagagauguagggaaucaauugaaaugaaaauaaccuguuuuaagauuucauuguaauccuugaaaguaguuuaaacagucaucuuggcuauaugcaucuuuaucuaaucuucagcuucuuaaacauaaggcaaauucaucaagucaaaaugaaguauuuuuaagucaugauauuugacaguuacaaaauuauuuuauucauaccaaaacaauaauuuggauuaucuuaauuaucaauauaaaaucacuauuuucuagauauauacagauuauggucaaagguguuuguuuaucuaaucuagggaaauuaucuauuagagugccaugcacccaauauaaaacaucuugccgcagaaagaaagcagucauauuucuuuucacugauguggagguccaaagagacccugguaccauuuugugaagaaagagaaauuagaggauaaaaagaauaaagaaaaaauauucugucagaucuuuugcaucugcuguguaacucacauccuuaaucauggcacacacuuuaauuauggaauauucuaaccucaccuuuauuuuccuagagauucuucaauuagguugaaaagaugaaaauggauaggagguagagcaguaagucccugaauucccuuucagcagagucuguugcuugucacaguuaucuuacuguauuauggucauuuauaauuguauguuuucucucauuugacuuugggcuuaauccugagaaauggcugcaguuugucuauuucuagcuucuaguauagucaauaacacauaauaacuagccugauucuguauauguuggaaugagugcuaaaagccauguagaaagcauaguuuuagaaaauaguauggcugccuuuuaaaaaaaagguucugaaauugaugcuuuaccuucuauuaaaauaauguuuauuguauggauagugauguuuauuuuuuguuuaguaugagugaaauauguaaguauaauaugauacugagauauuucauaaauaacuaacauauuuuauaguauuuauuacuauuaauuucuaaacccagccagaaguuguuguaguaaacccuuugaauccuauuuuauuguucuaagcaacgguaaaaaaucggaggaaaugaaagaugacauaaaggcauaagggagauaaagaaucagaggauuuauguggccuacagaauagucugcucuugaaaauuaaaacauagguacucuuaucugaaacuccagaaaccaaaaagcucuaaaaauaaacaguuuuuuuucucaugauucacugguggugaagugugacuugaacuuauaugaugcuguugauugucuuuaacucagcuagugugaguuagacaaguauagaaguaauaugcacguuuauagauuguugcaccauugggggccuuuuguaauauggaauacauguuuuauguauuauauuuccuuucuaaaaucugauuccaaauuccaaaacacaucagccugaagcaguucauucagauaaggacuuguggaccuguacauguauauaaauaauucuuguagaacacaagugauaagagacauggaaaaaagugcucucugcuuucagagaaugggaggauugguucauucaaugaacauuugaguauuuauaugccaaguucucugcuagguggagacuacaaauaugcauugacaggaugccuuuuuuuuuuuuuaaauccauagggauaauuauuuacaggcugugugucaggaaaggugaaauacugggguugaggaaacaaagguuguugcauugcagagugaaaggaagaccucaauuaaggaaauaguaauaauggagaggagagggccuauguggaacuauugcuaagauugaauuggcuaacuuagcuacugauuaugucuaaaaaucaagaggaaugagaaagagucaaaacuaauacugugguuuugagcuugugugcuugaggauguugacugcauuacuagaaguaugaaacagguagaggagggagguuugggagagaagaagguaaguugugguaccaacacuguagccaaccaagaucuggacuagauuguggggacugugggccuggaauuuaagaguaacuucauagcuagaggcagagaguuggaaagcauauuugaggaauuaguaguuggaaccaagaacguuggcuucauucaccaccuugcuucaugacaugcaggaagaaaauggaaggaaaaucuuuguugguccugcuguuccuguucacuuuauggaauaaugguucuaaaauuuccauuugucuguaaacaaaaugaauaucauagaauuuggcccacagguuuuaaauaugcaauuugucaguauuuuaggcaaagacaauccuauacuuucaaauagaaauauauuguuuguauguauccaauaccuguaaaauaauauuacugaaacuuuuuauaaagauuuauuuccauguguugaauacaauguugcugagcaaaaucuguuuuguuuucuuuaggaugauagguuuaagcugguuagcauugagcaguuugguuguuuuccuccugaauuuaaauuugguuuccuuucacauguuuguaaucauuuccauuauaggaacauaaguggaauuuacauuuaguuggcaagauacuauggauuuuuguuugaauauuguuuuuguuugaauaaauaauaaaaugagccgaguuuuaaaaggcacguacuauaauuaguuguguagaguuaagucugcauaucuggacuaaauccaagccuccauuauguacuauauauguacuguaugaugaugugacuggaugaggauguucuuugacuguuagagguuaucuauuuugaaucuuagacauuugccacaguauguaagaauguacagagguuugggaacuggcauucuuuugauaccagaauaauuaauucuugaggauaccaugugaucauuaaaaccucugagcuccuggguuggugcucaucuucuagcagucaaaccagauugccgcuuaggauucucaacuuggauauaaacuaaaucucaaggguguugguuccaaacauuggauuuggauugaaaugagugucucaugcauuuauagaaaagucuugaaagauuuuccuugaaaaggaauaugcucuccaguuaggaaugggggccuguuuguuggagguguaucugccucaggguuacucucuauucccaaagcaacagugacuguuucuucucuuacuaacagcagcuccugacugcgugcucauguacauuuaucuucaaaaguacacacaagugcacaaaaucauuuaaaacaauuucugacuuuccaucuucucuguguuauucaucuuaauaacaucauuuuguacuuuuuuuuguuugaaacaauuugagaauuauagaaaaguugcaaaaauacuagagaacuuuugucuuucauccaguuuccucaaauuguuaaaauuuguaucucaucuucuuuacuauuuuuuuccaucauauguguuuuuuucuucugaggcauuuaagaguaacuugcagacaugaugucccuuuaugccuaagagacuaugcuacuagcauuuucuaagaacaaagacauucucuuaucuauucacacaacaaagaucaauaucaggagauuaacauugaugcaguauguuagcuaaucugcagaucuuguuaauauuucaauugucccaauaauguccuuuauagcaaaacaauaauaauuauuauucauuacuaaaaugaagaaagaaaaagaauugaucagggucccaucugggauuauacauuacauuugguucuuaggucucuagucugcuuuaaucuggaugaguuccucagucuuugcuuuucccaauuuugagauauuugaaggcuggagaccaauuauuuuauagcuuguuucuugguuuguuuuuaguugaugcuuuuuucauguuuaguuuuaguuuaugaacuuuuggcaggaauaacacaaaaguaauaugcucuuggugugauuuuuaaaaacuuaauuuuuaaccuggguuuuuuucuuuguguuuguuauuacuaauauauauuuuauauauauauauauauuuuuggggguagacauccuucuuucaugugcuuuuccauuuaucaaauaauuccuaaguauuuucucuucaaggaaguauaggggauacaaagacaaaacauguuugugccagcaaagaccuaauauuaagggaagguagcauaaacaaaaacaguuccuucuuucuccuguagugacccuuugugauuuguaaaguauauaucuuaauaagauccucaggggucuccaaguuuucaaaugccauauucucaucuguuaccucaccccucccucauuaaaugcugugaaguaugacugaaauuguuauggacucuuucagaagcuuaguuauuaauaaauacagagcuaaaaaucaacaguaagaugccuguaaugaauucugccacuaagagaaaaugaauacaaucucuuucuucacuucugaaauaagauuagcugugaucuuauaggugucuauaaacucaaggugaugguggugguugcagaccaugaccugagccacuacagaacuggaaguuccacuucuuuaccucaaauuucuguauucuuguauuucuauauuuugcuuuuuuucuaaaugacagauaauguauaauugauagauagaauauguguagaauaagugccacauuaacauggaaacuauagaaaugucugcauuuuacuugguuuauuuuacccucauuuuguuggagagaaaaagauacacauugguuucuuccuauuuuucccagcuauugaccugaaaagugguucuggaaaaguguaccaaggcccugcaaaaggugcugcugauacaacaaucauacuuucagaugaagauuucauggaggugguccugggcaagcuugacccucagaagguaauguucucaaauguucauuuauucauuguuuuauuguuuccucuuuugacaauugcaguuuuuaagcugaugcccaaauucugauuuauaagccagguuucuuacaacucugaagaugacacaguugcuacugauacucugguugacaggucauauauuucuuuuuuaauggaguuucaccugacacuuuuuaagacugaacccacaucuagauuuuuuaauauauucuguuauguguucaaaggugaaaaaccauaugacauuaguagguacuacauaaaauuagacauucccaauaaauaagauuaagaaaucauugaauauuggaacuagaaggauauuuuaaccuaauagcccaugucuuacuuagggugaaucuuagaggcauuucaguggaaaaucaugauuaacagaagagugccuucugugacgauuauuuaguuaauauuauuaugaaacuuuugaccaauccacaaauauacaaaauuaaaguaauugauguggcaauuagaauggaggagaaaaauuuguuauuuucaauuugugauuauguagcuagaaauuccaagggaacuaacuuauugauucuuagaaugaaggaguucaaacaaauggcugagugcaguuauuuaaaaauagcuuucacauaggaguaauuugaauaaaugaggaaauauaugauuuuccuguauagaaagacuaaaaggaauuguaaaguaguauaguagguaaaaaguagucuuuggcaucagauaaaaucuaaauuugaaucuugccccugucacuucauccaaaaaccuuaauuuucucauuuguaaaaugaguuuaauaauuuuaauguuuacaaggcuuauuauaagaacuaaacccaauaauauguaugaagagcuuaguacagugcuuggcaaugcagugaacccucuguuaauuucuuuccaggaauuuauuuaguaccuauucagguuguagguauuggcugaauuaagacaaaacccuacuguauggagcuucuuuuaguguacuaaugcaaaagaaauaaaaucucaaguuagagaagaguaagccugaguauaguguuagagcaaugacuggcaaacuuuuucuguaaaggguuacacaguaaauauuuuaggcuuugugggcaagauggucucuguugcagcucuucagcuuugccauuguagccuuaaaguagccauagagaauauguaaacaauggagugugacuguguuccaauaaaacuuuauuuacagaaacacacagccacuagaucugguucuccagcuguuguuugccaacccuugaguuagaaugugacaggacaggggaacuauuuuaaauagguuguuuaaaauaccuucugggguuuucuaagguaccugaaaugccugacagagauuugaacagaguaucagaaugagucaucagacuaaggaaacaacuaauacaaaggccugccgugcgaggaacuuggcuccacuuagucuucucugagcuccacagugagagaaccaucccucuacuugaccacucugaugggaaacuuucuggcaugucaaacuuacugugaccaaaauagaacuugugauuuauuuuucucccccagucucuuccuucuuaauuaguggcaccaucaucuauuuacccaaauuaauaagcccagaaauguaaaaauuaucuuagauuccuucugcccuucuguauccuuuccuuccuuacuucugucugaucuuucuccaaaauauaucuugaauucaucuucucuuccucucuagggauaucacugugauccuagccucugucaucucucaccugucuuacuucuuccagucuugucucucccauucagucuguuguucuccacccaggagccagaguaauccuuuaaaaauguaaaucagauuagauuauuuauguauguuagucauuucuacuacuuucauuaauuacugguucauauuuaucaucccauuugauaaaaaaucuccagcauuuccuuuugcacguguauaaaauccaaguuagcuguuaccaugucguguaugauguuucuuucccuugcuccuuuuucaggcuucaucccaugccacuugccccaucaccuguaaugcuaauucuaguuauuuuguuguuauuuuguccuuccuuucaguuccuucccaucagcuuuuacuccuucaaugucuaugcauuugccuuuucuggaauuucuccuccuagcuguuugcauggcuggcuucauuucauccaaaguaguuucuuccuguuauauucugauaacauccuguuuucuccuucauuguauuuauaacaggcuuuaauuauuuguuuacauuuuacuuuuugacuccccuaguuuaauguuagcucugugagaacagggacagauauucagccuagccuagaauauugccuaguauacuguagacauucauacucagguagauuaaagcaaauauagaaggaaugaaaguucaaugucagaaguuuaggcuguauagaaauuagaaacuucugcaugucagacucuauaguauauuuccauaaaucgagggaaaaaaauaaaaugaugauacagaguaucauucuaaaaauucuggaaagcacuacaaccucaauagaaaaaguggacaaaaguccaucaaugauagacugcauuaagaaaauguggcacauacacaccauagaauacuaugcagccauagaaauggaugaguucauguccuuuguagggacauggaugaagcuggaaaccaucauucucagcaaacuauugcaaggacaaaaaaccaaacaccgcauguucucacaugugggaauugaacaaugagaacaccuggacagaggguggggaacaucacacacggggaccugucaugggguugggggagggggggagggauagcauuaggagauauaccuaaugcuaaaugacgaguuaacgggugcagcacaccaacauggcacauguauacauauguaacaaaccugcgcauugugcacauguacccuagaacuuaaaguauaauaauaauaauaaaaaagaagaaguggacaaaagguauggaacaauaauuaaugaaauaaauagaaaugacuaacauacaaaagaaaaaaauuuuucccaguauccaaaaauacaaauuaaagcauguuauuuuugccucauauuuucaaaguguaagaaaauaguauuuuuaagguugggauaagauaauuuacacacaacuggagggaauauaaaauugguauaggccagggacaaugucucgugccuguaguuccagcacuuugggaggccaaggcaggaggauugcuugaguccaggaguuugagccugggugagacagugagacccugucucuaccaaaaaaaaaaaaaaaaaaaaauuagccuggugugguggcacacaccuguagucccagcuacuugagaggcugaguugggaggaucacuugagcccaggaggcuuaggcugcagugagugugaucaugcagcuguagccugggugacagagcaagacccugugucaaucaaucaguaguugguauagccuuucuggaaagcacagugcuuccagaccuucuuccuuuauggcaguuuauagucuuacuacuuuuugcauggcacuccuaggccaaaccauauaccuaacaguuucauuuaugaaguaguucaaaacaauuaguuuuuuguguucaaccaguaugacuguauuucccucccaaauuaacaguauugggaaagugucccugagagaguuugcugugauguccggugcauggcagugcagaguuuggaaacuggcaauauggacguaugguuaagggcuuuaagaaauaagaaaauagauaggaggaaagauuuauguacaaaauucuucugcucaaaaauguccaaaauugauauuuuuacuucuaguaauuagguguucuuguuuuagguuguaaaucucuuucagaguuuaguacauagcaggcuggccuaaguacugacuccuucccugcaugaguugcagaccaucguuuuguuuguuuguuuuuuguaacugcauagugaaagaaaucuuaguuuugaaauucuggucuccuguuugaaugcauuugauugugacugaaugagcucucucugacuauuucuggaauaaaaaguuguugccuuuucuccaguucacgaggguuugcuucugagacuaagugcugcucguuaacaaguauuguuaacaagcauugcugagcaaagaacaccugaguuuaagcccuggcccuacuucuugcuggcucuguagacuugagcagguuauuuaauaagcucucugaaauucaguuucucaucugucaacugggguaagaacugcugaugugcccacuucaaauugacagcuguaauucuuaaaugagauuauauuuguggagcugcuuuguaaugcucaguguauguagguaucacuauuuuuuccauuuagcuagaaaucuagaggcuuuuucacuucauauuuuauguaagcuauaaaaacuaugauugauuauuuuuauuuuacugauagggaauuuacacugaaggagaacuuaaggaacuugcaccaguuucuguaucagguuagauacaaaacugcuacaggaacccuucguuuuuaacacaccagcuuuugcuugguaaugaugaauuaauacucucuuaucacaugucaaacuacuaagcuaagcacucuacacauuacuuuauuuaacacgcacaacagaguuguguuauuuagggacuguuguuaugccuuuuauagaugaggagauugaaacucacagaggccacguaucuaagcauuuucucaagcucaccuugcuauuaaggggcacagccuggauuuuaacucaggcauucugaugcuacagcugugaucuauucaacauuguguuauauucucuaauuugucauuucguggcuuucuaguucaugaaacuguaguaaauauuuuaaaucugcuuuuagaaguucugaauugaauauuuuuauuaggaauacaguguagccuuuuauuaauauggucucaaauuguaagaacauaaaguaaagccagaaacguagguugaaacagaacucccagauccaugaguucagauaaauuauuguauaguuuucuaaaauacacaggaaugauuuuucuuuuuuuuagaugucuaaaaaaaugugcuaucuguaguuauuaaauugucauugcuaaauaaagguugccuuuguuguccagaauuauuagcucaauuguauucagucugaauaaucuuaaaaaaaaaaaaaagaaauaaacuauaacaugguaacaguuggcacucuuuuucccuccucuccuugcaggcauucuuuaguggcaggcugaaggccagagggaacaucaugcugagccagaaacuucagaugauucuuaaagacuacgccaagcucugaagggcacacuacacuauuaauaaaaauggaaucauuaaauacucucuucacccaaauaugcuugauuauucugcaaaagugauuagaacuaagaugcaggggaaauugcuuaacauuuucagauaucagauaacugcagauuuucauuuucuacuaauuuuucauguaucauuauuuuuacaaggaacuauauauaagcuagcacauaauuauccuucuguucuuagaucuguaucuucauaauaaaaaauuuugcccaaguccuguuuccuuagaauuugugauagcauugauaaguugaaaggaaaauuaaaucaauaaaggccuuugauaccuuuguuuuuuugugauuuucuguuuuuuuauuuauugauaccccaguuuuuaugugaauuuccauguaugcacucauuuuucauacuuuguucugauaguauucucuuuuaaagcaagagaaaagucuuugugcucccaaauaguuuucuuucuucuccccuccccuuugcuggaaauucuuuacuacauauaauguuuauaaaucuaccaaguguagcuuucuugaagaaucagcagucucaaaacagaaagauagucacuagcaaguacugccacaucacuguuuuccucagcauuuagcucugaugaagugcacugggagaugcucuuuggaugaguuggcugcagaggugaccagcagcaggugguaugcuaagcucagagauggaguaaauuucaaucagguaacacagcugaggagaauauguguggguggcuaguaugggcugaguuucccaggaagcugacuuucagauggagauucaugugcaggaaguugauuugggaggugcuuuuaugagcagcaccugccaggagaagcaaaggaagcagagcugggcagauggagacauuaggcugugguugcaguuaccauaaggccuggacugaucuuuuggggagcucugaagcugggauggccauucagaauuguccugaggcaaguagucauugguuaugaccugcccugcaagggggccaugaccuuggucaaagcggcagagcaauuccuggaguuggcuugcccagcaguugggggaauaugucuuuuuuuuuuuccuuaaaacuuuuaaguucagggguacaugugcaggauguacugguuuguuacauagguaaacaugugccguggugguuugcugcacagcucauaccaucaccuagauauuaagcccagcauccauuagcuauucaugcugaugcucucccuccucccaccuucaccccugcaacaggccccagugugaguuguuccccaccauguguccauguguuuucaucauucaguucccucuuauaagugaaaacaugcgguguuugguuuucuguuccugcguuaguuugcuaaggauaauggccuccagcuccauccaugucccugcaaaggauaugaucucacuccuuuuuauggcugcagaguauuccauuguauauagcuaccacauuuucuuuauccagucuaucauugaugggcauuuggguugauuccaugucuuugcuguugugaauagugcugcagugaacauuuauaugcguguaccuuuauaauagaauaauuuauauuccucuggguaaauacccaguaaugggauugcuaggucaaaugguauuucugccucuaagucuuugaggaauugccacacugucuuccacuaugguugaauuaauuuauacuccccccagcaguguaaaaguguucuuauuuauucacagccucaccagcaucuauuguuucuugauuuuuuaguaaucgccauucugacuggcaugagaugguaucucauugugauuugauuucucuaaugaucagugauguugaacuuuuuuucauguuuguuggccacaugugugucuucuuuugagaaguaucuguucauguccuuugcccacuuuuuaguuggguuguuuuuuuccuguacauuuguuuagguuccuuguagacuauggguauuagaccuuugucagauggauagauugcaaaaauuuucucccauucuguagguugucuguucacucugaugauaguuucuuuugcugugcagaugcucuuuaguuuaauuagaucucauuagccaguuuuugcuuuuauugcaauugcuuuuggcguuuuugucaugaaaucuuugcccaugccuaugcccugaauguuauugccuagauuuuuuucuaggguuuauaguuuuggguuuuuaaauuuaagucuguaacccaucuugaguugguuuuuguauaagguguaagaaagggguccaguuucaauuuucugcauguggcuaaccagcacucacagcaucauuuauuaaaccuauuagagaaucuuuuuuccauugcuuguuuuugucaaguuucauaaagaucagauggcuguaggugggcagucuuauuucugaguucccuguuuaguuacguugcucaguaugucuguuuuguaccaguaucaugcugaggaauaugucuuucaauccugauggggcuuuguagaacucagcacacuuuauuugaggaaacaagaaugcaaauucagggaucaggggagaagguuucagaaauuuggaacugugauacuuagaacagugauggaacaguagaagaccucaauauguuacuuauuuuaaugagugaacagaauaaguagaaggcauaggaagaaauuauauuuuuggcaauuaugccuuugucucaugaacuguauaguauuuuuaaauuuauuucagagugaucuguuguuauaccaauugaauuaauugaguuaauuguuggacauuuggguugguuccaagucuuugcuauugugaauagucaauggcaguauuuuuaauguuggucuauuauuguacuaaauaguuguuuauauugagcuugggaaagcuuucguguccaauagaaauagcauauuaaaauaaaugccacuguauauuaaugaaaguguugauuauauacccuagauacuuaaaacuuaaggaaguuauguuuuaauuuucuuacacaucucugucaauauuuauggucagagaacuacucauauccaaauuuggcaacuuaucagucaugcuccuuaacccuucuguaauauuuaauauuaucaaaugccccaucuuccuuaauucuucuuaccuuucaaug

SEQ ID NO: 18553 - RNA, 15160 nt, Homo sapiens
aaauuugggagaagcuaaaacuucacuaaaaaccuaacaccaaaugacauguuacuuaguuuauagcaagcaguuuuauauuaauuaaauguuuauauaccacaagcuaagauuuaaugcauuuuacauucagauuuaaauaacucagcaccauuuuagcuuagaggauaaaugaaauguuuaguguuuaaaaguggcccaggaauuuugguagcuaggaaugagacuuaacucacugauugaauauguugauugugaauaugaguucaaaaaaauauguauauauagaaaaaagaguacuuuuuaguuaucaguuaauacacugauucguaucaaaacacauuauuuuuaaaacaaaauaucuccuuaccaggaauucaguauuuucaugcaaucugcuaaagauuaacucucagugccaggaaaauuuuaaugaauugcauuucuucuagaauccgaauauugggaauguuuauaagugugacuauccuaugagauuucaaagagaaaaaaaguacuacaaauaaugccuagugaguaauuggaugauagaaauuguaaauaaaguuauucuauaaaaauauacagauuuucuggaaauaggcaaguuguauucucauauauguuaugcuagccucagaggucaagacaucuuuaacccagacuguggucugaaucaucaugagaucgcuaauauggcauauuguaaacugacucauaaacucugaaauuauguuccuauuuaguccauuuucugucuuuuuuaguguaaaagccaaucuccugucaguacucaacauucuuuuuaucauugccaguuccuauuuuuuaaaauguauuuagaguuugguaagacuggucuguguuauuuuauuaauugauaaccuucaucaacuaauuauuaucuuugaguuucggcaguuauucagagaagagauucaaaguucaaaauaguucaaagaaguucaguaauacagaguguuaaaucaguacuugugaguuauuuggguguguuuagaggugccaggagggggaugaauguucauauaaggaauaaaguaguauuuuuagcuuccuaauugaaaaaaaaaaaucgucaaaauuaaccaaauaguagguguuauauuuaaaaggcagacauuucagggauugaacacauuuuuaauuauuagaaauacauacaugcauauaauuaaccuuuaauuuauuuuuaaaaauaaauuauggucaugaaaaacaauagugcuuaaaauugaaauuucauagacauguaauuuuauucccuaaaaaugaaauaagaugaaccuuauggguaauaaugggauuuuuaauacuuauugagguuauagacagucuuuuuuaugucucaaugcauaccaugugaguacuuggcauauauuaggccuucaaaugaugauggauggauagacagauaaaaggcccaaugaaugauuguaaaugugucuucuccuauguauccaugaugauauugccuaguuuuuaauacaagcuuaagaaucaauaaaaugauagaucugaaaucuguagaugccagucuggcucaguauuaauacugacaguaguuuuuuuguuuuuuaagaaagcaaguauauuaaaauaucucuguuagaaaagauuacaauuugaaaggaucauucuacaaucuuagaacuaaaaagcaauuuaaggcaaagagguacaucaaagaagcuauuccauagcucaguuacagcucaacaaaagcucugucuguauugucuacugguaagcuugugcccugguggcuaaggaucauauguaccgcuauauccgccaguugaugacuguccaucucuagccccucuaaccaugcuaugcacccagugagugcagaaugauuacuaguaauugauguugacuuuacaauucuaugacauguaauacaggaugccgaggcacuuuuaaaauuccaccuaacauguucuggcacuggaaaaucuuacuugagauuuuaauacugguuaauauaggaaaaauuaugcuuaagcaccacuaacuuaaaaguguaauuucauuuucuugaauuuagguaaaagcaaaauucucaaaauucuauuauggcacaugguuucacaguuucaaaugaaaucacagcugucucauuacgcagcacaguccuugguuuugcagaaaguauauuuuuccuuuguucaccaaccccucaaguauguaauacuaugugcuuugcuaauuuagacuauaucucagacacacacacaugugugacugauuccugaauaacccaggaugauguuccuguguucuagauaauauaaaauuuuuaacauuccucuaauagcugaacaucuuuuuaaaaucuagaaaacuugaaaaauccuaaaauguuuuucaauuuuuuuaagcuauuugagagacaguugugguuugggggggacuuguuugugugauuuuuaugucagcaagaaaauuguaucuuuggcaaauacuuuaauauguuuaaaugcauuuuaccucuggauguaucacaucagucaucaaaaugacuuuccaguuucacggcugccuuauguauaccagucccaagaauggugauauuaagaaucccacuuacaacaucucugcccaugggaaagauaaaaugauagagggcagccucaagaaauaucagacaggauugggcagcucccuuacuuaauuuguuccaaaacaaaaguugacucaagucaaaaugaaauugugcacuugaaagaaaggaaguuaucuacuaauuuuuuaaauguaaacauacuuuuuauauagggauguaacuaucugaguacauguauugccauuucucugcuauauaguaauauuucuugacaccaaugguaauguguuuguuucuuucucagcaccagauguguccauauguauuuaaacaguaggagcauuguuucuaaauucaucuaugcuaugacauauauaaacccauuauuauuauguuucacuaaaguuccagcacuuuagaaaaguuucaguucaaagucauuuuggcucauucauuuagauaauacugaccauuuugcacuacaauuucaaaaggaacaugagaaauuuggauuucuuugaaagagucaaauauguaauuacagaauugaaacacuguguuaauucacaaagugauguaaauaauaaacauuaaaaauuucccaaguaaugaugacuuaagcguucaaaauccaguuaugugcuuuguuauugaaaacaguccaaacaaaaauucuuuuguuguuuucuguucucuuuuucaaaauacauaaauccuacugaaguuagucuauuuuuucccacuucagaacaccaggcacugauuuauccauugggaguuuugcuuugccuucuaauaccuagauuaagaagacaaaauaagacaaauuauuaaccugauaauauaaugaaugaguacaacagacaaauuuaaagucaaccuuuuaaaaacuuuaugcaacaguuucccuccaccuaagcagcaaucauguugugaaauuaugcaguaguacaucauuuuaauaaugguuugaagaaagugacuaugucaacagcagagaugccugaugccuacacucuucacauuuagaggcaaagaaaccacuucugaaacacucaagaguacagcaggacuucugggaccagcaucccugaccaggggaauucauuccauggaacaaggguggcauguccaccaagaaguagagucaaggccucugcuccaucuugaauuaguccuucuccagcauggcuuuggauguagaauaauacauuaauaggcagaaacuggaccaaagcuaaucaaucaaauauuacugucuuuaaaugugaccauagaucuucauguaaggaagugaaaauucacuuauucaaaucauaaacuaccaauuuccaaacaguaaauucugugaggagaaaaaaaaaaacuuacauaguaucuuauaacugaaagaagccucagagucaccugguccguacauuuuguuucagugaggaaaaugaaggagagaggguacauuaacagcacauaccuauucaacuauuuacuggguggcuuuuacacaucaacagaaugcucuuaaauaucuggcaggaaaagcaaucagugaacugauacaugauaugucuucagagucacacucacugcugcuuacacagccaccagacugaccugauggccuuaggcaaguuacacuuccugcucaaaaagcuucagccucccacugccuccagaauaaauuuuagccugcucuucagggcugucuuccaucuggcucaacuuacuuuuccauccuuuuuguccaacucguaacuccacaaaauucaugcuuuagccaaacuagaagacuuguuuuuccaaacaugcccugcaguuuccuccugccaugcaaguugccugugacguugacuugcccugggcuuccuuuccuuaaugcuccccggugcauuccccagacuucaaggcucaauucaaauguauccuaaagucacuccugaaacucagcccaaagagaccucuccucugucugaacucugauuccuaggaaggaaggccugaugugaaagucaaaauguaagaagcaaguauuacuauccugaaggugugggguuuuuuucucaaauauucuauacuuuccccaauauuuccacucagaauaaguaugacauuuuauuaugaucacuaauuauaauuucacuuuucauauuuucaucugguuuauauuaguuauaaacauuccagcuucaaccacucuugaaguuuguuacagucaguaauaacuaguaaaaaaaaaaaaaaaaaaaaaaauucaacucuauaugagugaccacaucaggaaucccucuuguacagucauauugcuggagcaauacaacaauuuuuauuucuucuaaauaucuagcaauacccaauucaauggauucuacugauuaaaagcaagagacauucuaugcaacagaccucuccagaccuauuucuagugggaagucaguaagacauaguugggaguuaccaaacuuauagcaaagguccuucugaucucaccacauuuuauuuuaucccucaugaaacuucucauauuguaucucuauuacaguuauauguguaauucucucacuuccccuacucaaaaugccuuuacucaaauuauuugagaaagaaauucauuaagcagugagugagaggcugcaagguggcagaccuguaccugacaauggguauacaacaguggacaagagacuaaaucacagccaucacugaguagagcaggagacagacauuaaacaaagaaauucauaaguaauuaacugaaaauaguguaauaaggcuacagcaguauagagauuaguaguccuauuuauguuugcauuauucaguaauaucuagcucagggcaucaacaaacaguacaaaaaugagagugcaaaugaauaaauaaauggagaauggaugaauaaauuaaggaauuauaaaaauuaagaaaaaacuaaucuguuuauuuaagugcaaauuauuuuagcuuaaauuauaaugguguucuggcggugggggucggggguugguucuacuauaaccaacuccacacaauaugggccauaaaaccugccagguuuucugugcugugggcauguucagaagaauguaugugacucuguuuuuucagugcuauccuuuugcuaucacaggcuucaucuaucucuaauguugugacaacacuuguaaagcacagucucugcuucuuuauguagaaaguccuggguuuuuguaucaggcagaaauuucuauuaauuaugagauucuaguauagcucugcuauaccugucuguaugauccaguggcacuggugguucuccagugacaaagcaaagcugaugaguguugaguaucauuccaauggaaauaguauucucauuguugggaaggcauaacucaaguggcauauguaauuauaaucuagcacccagcaacacuuggggagguagugcuuaaggagauggggcaggacagacaggcaugcagucaaaccuacccaaccuuuuuucauuauuuucaucagagcaccucccugugaauagauaucuuccaguauuucauucuaagaagagucucaggaguaggaauauuaugaagaaaccuccacacaccucaaucuuuugcagaguauuuuccuaguaucaaugguucuagaacucaaauauaugacaucuugauuuguacagaccagagggggcugaacucuucaguugcuuacuuuauggcagugguuuucaaaauguacuuugaagaacccuagcaauucuuucagggacugcgaggaaggggccaagaagcaacuacuggggcuucuacaagcucacccacucuacauauugagcaauuugauauauugggccuucacaaaugccuucuggguaaacacuguggucuguuuaugucuucuccugaaaacuaagcuucuccugaaaacuaaaaaccuuaguacauucuccuuugccuuccauuauuuaaaaaaauaaaaucagacugcauaccauuuucugccuuuggucugcuuacaagaaagcugcuguaguagcagaaacagauacauucuauguauaauguuuggcaugaacaaaaauuauuugugacaacaauuacuuagcuaagcaaauaacacuuacggugaaauugugcagccugaggcauacgcaugauguccuguguagcgaaugucacagcgcacaacauuguugguauagucagauucaggaaccagguagcugggguuuacacugaccugggcaacacaaagaguuccucaguauuucuuuuuccauagggcuacaauaaggaaauuguuaaugaggacuuagcuaaaucaagcagggaagggauuuuaacuuaaguaagugguuaaacucuggagacguuauggaaagagacugcauauuuuccccugaaguucuuuaaaauaagacagauuagauuagauuagauuguuuauaaauaguuugaggauguauaauugcuuccaauaccaugauuauuuaacauuugaauccagagaagagggccuauugaucugcaauaucaauauaugauauauuuucaaaggucuuuaccuuuaggauauaguuuccagguuuuacaucuguaauaucaauccacuggcagucuaugucugcaccauagguaucauaacagccaggacucaaucccuaagauaaacaaaauaaaaaauuuaaaauuaugguauguggucagacuaugauaaauaauaugcuauuauuugcaaauuaaauuuuaaguuaguacuuacaagagucugacauaaaacuauacuuauauuucaucucccuugagaaguauuuauuacucagccuuauagcaccuccagcuaaaaaagauacaggacuaauauaaguaguaguacaccucacuucuuaaaagugucauauaucaccagagauaaaugcaaucugaaggaacaaaauaggccucuaccaaaguucuagaauuuuaacaguucaggaauaaaggccacauaauaauuaucuuagcucaaauguccucuucucagugaaauccuccccaguuuccccuuuuggaaauuaccuucuugugcuuugaacguccaugauacuuuuuauuguggauagcuuuuacaguguuuaucccuuuuugcucugcauuauaacaugcuauguaagaauauagcuaaccagaggcugcaaguucccuaaggguagaguuuacguuguaucuuugaauaacuaacauuuauuaaauaguauguggcaggaacaaucguaaacauuuauauguguguguguguguguguguguguguauaaaaauucaauuuucacaacuacaugaggggcuauuaucuccauuuuauagaugagaaaacuaaggcacacuaagaucaaauaacuuacccaaggguauccagccuaguaaguggcuaagcugguuuugaguuuagguaaucaagguccagagucccuguucuuaacuaccccacuauacucucucucauacagucacugaaauaugacauauuuuguugaagggguaaaugcaugacuaaauugaugaaugccacaucacuccacuugcuaaaauauucacaucaauaaguaaaugaaugccuucuacaggcugggaggagaaaaauauaacaaauacaauccuugcuuuuaagaauguuauagucuagagaaguuuccucagauuggagucuguagguauauucuugauuccauuaguucuucacaaaaaguuuuaacuuguauuuuuauucuaauaguaauuuaaauucaaaguacaugcuagauucauuuuaacucaauacugccauucaauucuagcaaccaauauugcuuugcuguuuaagaucacuuuggucacccaagagacaguaaaaucaccuuagcaugcucuaccaaugcugguuuagcuguagcuugauuugggaagagcaggggagaauugugcugucauagagcacacaauagcacagacaggcccaacucagaagggucagugucacagcagugagacucauauucuguuguuauuaucuagauuccuaccuugauccauacaucacuuaacaguauguugaguaguaaauauaaaaugaagaauuuuuggucugauuccagcauacaauucugauucuggcauauaauacauacucaauaagugcuaguuauuacuucuacuacuaccacaauguucaugacauuguaaaggauucacuggauuagauauucauuuaagauggguuuacauaaugcuucagugcuuaucuugccuucaaauagacaaaagagccuuaaaaaugcugaaauuggcacucgaguucauaagcuggcagaacuuaaguauaagcuuugauuauuugcacaagcaagcaaaaacgaguuacuaaggcaaauaggcauuucauguaggcaaagucaaaauauaaaaacagauucaauguugaauguuagcugaggcucucuaaaucagcaauuugaguuuuagcaauacauacuauuuguuacauuaaauuaauaaggugaauucaacuguuuuaguuucguauauauuuaauauguaaauuuuugucucagaacacaagaguuauuaauauguaaaaguauaaaucuaaagaaguuauaccuaguuuuaugcuugaauacauuuaagcagcauuacaauaaacuaaucugagucaucauuaggugauugagagacuauuuuuuccuuuaaaugaaguccaugugaaagagacauugaucuaaugaaaaaaacaaauauauaaaucgcucaaugcaagauuuggugaauaaugguuaaaaagaacauauauggaagaugauuaacaagaaagcuaccauauaaaaugaaauggggucaccccaaagaagggggggaaccagaagugcuauaaugucuacaaucccagcuucaaauauuucagagugagcuguccagagugccucuuuuuguaaauggggcaaauaaacucuaggucccuugcacaggacuugcagaucacugaaaagggaaucuguauaugcacacaugaauaauguguggguaaguuacaucuccucuuucuuaaguaaguacuguccuggggcauguagaaguuaaccuuucccccuccaauugcuaugauguucuaagcucagagaaaaaagcaaugguaacauuuaggucaccaaacagcuuccugccacagcccuggaauuugcuucccaagaugccaacugcugaucccuucauacccucaguuauguacauucacuaccccuugccaagaucugggcgggagucaaauuauaauguccuuuuacaaauuaggguuucauauggaaauacugacauagauuuuaacugacacgcauuuuccaaugauaaaacaugcaaacugcuuaguucagcacuacuuuaaaaaaauccauccaaacaacaucugacaucaauuauacuguagauuuaaauauauauguguggagaaagaaaugguguccuucugcucuuauuugcauuauuaaaagaggcaacuuuuuaaagugcuuuuaaagaaacuuauuuuuccuccauuugcuaaccgcaaccacuauucuauuuucagcauaaaacagaaggaaggaaugguuucacaggugaaaaaacagagauaucuuuuuuuacaguuauuuacuaagccgguuaaggaauacagaaugggugcauauguugucaaccauucagacuuuuucagagaguaaauuuuuguucuucauuguggacuguaacaaggacccacacugaccugugaucaugaauaggggccacaugcauaacuggaaauacuucaaaaguaauuuggaucaucaagccaucauuugccuuuucccaauuauuuuacaucuuaacaacauggaccucaaauugaaugcuuuauaaaagagaggugagaggaaagaaaauacuagacucaugggguauaucaucuacaguuuucuuugagaacagucucuguauccuuuugauaaaaaugugugugcucuucaugaaaugcuauuuaaugcuaacuaacgguagaugacccguuucucucugaggcuugagguucuggauuucagggugccaacauaccugugugugugcaguacaugcaaaucgccugugguagccauagucacaggaugugucuucaagacagaaacuugcuuuguggccuucagccacucuccucuggguguuggcaucaagcaggucauaguggcuaaacucauccauacugugguaaugucugaugucccacaaaacaaaaagaugguggucaguuacauacagagaaagcaaugaagauauuaaaugacuucccccauggcuucacaaauuuguuuucacauuaaaauugagaccaaauuuaucuucuaaaagagagauucaugcuaggguuuuuuuuuccccaggacauaagucuaucaaaauuguaagguuuaacuuugcuacuaggacaaaagacuuaguucaguauuuugcuuucuuauuguaccccauuuugucuuugaauauuaaauagaaauggacaauaaauuaucugugcuuaagugaaacuugcccuguguucucuaguguauuccccuuggcugccacugcugauguuucauuccgaaaagcagcacaugacuuuuucaagguuucuaugagauuuuaaaaaauugaguucucacauauuuaaaaucauuagugaaaagcaagggagaacucauggcauguuuuauccaccauuauuauuuaaauaguacacacuuuuauuuagaaauaaaauauuccuauuuuaucaggaaauuaagggacuuauaucuacuuuuguuauuucauuaaauggaaggugcugagcuguucaucuucccacauaaggaaaaaacaaugaggacuggcuuggauuucaggaaguaaguuuaaggccacacaugaggauuuccugaaaauaaacacccaggcaaguuacuaaggcaaaugauagaauuaccuuaugcaaaaauccuuaaauuuaggauagaaaaggcaaccaccuugggcuugauacaggucuuuuaaaagauggaagaagguccuucugagcugaugggauguaucaucuacaucuuucuuugagaaugguuucugaaugcuugugauaaaaaacguguggucuuuaugaaaugcuauuuaaugcuaacuaacuuuagaugaucuuggcuguaauggacuuuuaaagaaauccuaucuguaaugcauuggaguaaauuuuauugaagucaauugcuguauccuaucaacagcuuuaauaagcugggcuucagauuuuccauuucaaaagauaacaggaucuuguaguagauggguuaugugaaauuacauagagaaaaauucuaaauauaaguaauagcaauuuucucccuucagguaagaaauaagacuugcauuugugauaucaaaaaucaccugagaaaugaaaagcaacccaaaaguacccaggaggcccauuuacuuacugaugacaacugugccauucccaggaauaucuuggucggcuggguaagaaaucugaugucccuugguuuuucacucuuuggggaaaucugagcagcacccugugaucauaaucucugacaucugcccuguaugcuguacugugauuuugaaaaaagaaaaauuauuauauucauggaauauuaacuaaagacaaaacuacaaauaaaacauccauuauauaguagugacaauccuccuuucccaacuagacuaucaguuccaagagucuaaggcauuuuguuucuuuuuguucauugcugaauccaaagcuccuagaaccgucuuggaguagucagagcucaaugaauauuuggugaauaagugaaugaauaacaccuauggaaauccacagaucuuaacaguaaaaacauaauaagcauuaaaaaucuaaaugucagaaguaaacuuuagaaucaauucaaguuugaucauaugaaugagugaaacugaaguggaaauaaucccccaauaaaaaaaauaauucauagauguuuauuacaaacuucaaacuuaacaaaacuuuuaaaaaaguuaaugagcugcaaacugaggaaauaacucuaaaagagcauacccagauuuaaauuaauaauuuuguaacuucacuaucccaaaacaauggcaguacuguaaaaacaucauagggaguucaauggugugagugaugcaagacucaggaaugaaaaugagcuuggauuucuucacuuccuuuagccugacaauuauaaagggucaaaguggaagaaauguacaaauaaacaucacuguguuccuacuaauauauuuagugugucuauauguucaggugguauugaugaccuuauuuuacacuuuaaauuuuuauuaaaacaucuuuugcucccucugcuguuucccagcaguaaacccagagaaccccaaucccagaguuacuauuuuauuuuagaauaguggaaaaacaaagcucuugcucacggucuuauucuggcugaaguaauaccaaaacaaccaaguucaucguggucucaaacaaaagaggaaaacuuagucuuuaccaaugaggcuacgauggcaaauuugccccgaaucuuuuaaggggguauuaacacacccuuccauuacaauaaauuuuuugaauuacuguauaguuguuuuaugaaaagugauuggaacaauugacucccaaguuuaaguaucuuggaaaaagagcaugagacuuucagucuccaggauaaggguuuccuccaccucugugauuccugcugcacuuugagacagaacccacagaaaucuucaaaaauauuaacucuccguccaggucagcaugcccaggaggucacgucccacuucccagcucuugucccacuuccuaacacuugucugcgcgaagcaguagcagucagaaccaggcaccagagcgcccccugaagguagaccggggagcggggccucagacauaucagcccguaccuggccagacaguuuuccuccgccgcgcaucucagguuguacauggacaucuucugcacguacguggacgccuggauguaguaggggucggccaccaggucugggagaccuaaacgucagcaggcgacgggcgcagcagugaaacaacccggcgccccccgcuccaacucccuaccccucuaggucccuuacuccucacccuucgcccaccgggacugcagaguggagcggaggacagcaagagaacuggggacgcccgggacugcaaagcaaugugaaaaggaagcaggaggggccagacgcgcgguuugcacuggauuccagggcugccacugcaggcgcgugggggagggaucggaucugcgaggaccggggcccgccgcgcccaggcagccacgucgagaagccacauagcuggggaccaggugcacgggugcuuccagcggacuuggggguacuuaccguacuggaaguagccagugccguauccgggccgguaccugcccccaggucugggccuuucauaaguaucguaguaguuguaauaaggguugucgucagaguacuuguagggguuguaagggucgucgcccaccaugccguccacgcggcugggcggccgcagguuacugagcgcaggaacuucucccggcgcugucugguucuccgcgcgcgaggcgccagcuucgcgggcucuagaugucgaguagccagcuuggaaccagugacgggcggugggccuggggcggccagcggugacuccagaugagccggccguccgcguucgcgccgcggcggugcgguugucgcggaucagcaggaucggagugcggggcugcugggcggaggcguuggcugcaccagggacggcggcgcccgggucccggcggcgcugaggcugguacugugagcccaggcucagcaagcugaacaccugcccguuguucucccauuggaucugcuggcgccaggcgcccggagccgccggcggcucgcgcgggggcugcuguuggccggcggcgggaggggcgcagugcacuagcgcgcagagcugcaaaggcccgagcaggagcacgguccaggcgaagcgcaucacuccuuuugccagauugaccccgcucgaggaggacguggcucacagaaaauaaaaacggggcucaaaucacgugagggaaggagaaaucuucaaccaaggaggcgagcggagcacggguaucucagucuccaccaagcaaugccaagggugggauucagacccuuccccagucaaggcggcugcucggacguggcacccuucccuuuccccuuucucaguccuggaaggcaacggggagcggcgcggcagucccggagagcgggcagugucuggagugaaggaaggaggagagauuuuaaacuuucuggcacguuugcaaaguuacacaagccguucuggcccggccgccccucagcuauuuguucacguaaugcgauuggaaacgugcaaggcggacagcuccucgccucugccccucccucucucccgucccugcccuccuccccccagacacguugcacagggagcguuaaggggaaagaacaaaacggaacacacauccugagacacacuggcuuaaucuggggcgaacaug

SEQ ID NO: 18554 - RNA, 921 nt, Homo sapiens
cucaugcaaaauuaaacuugaguaaaagccuggagaaugcuaaaaauaguaaugagaagaggaggcuguagagcagagaguacaggugcauccuuucuuauagucaaucaaugcugggaguaauagguagaugugacuucacuugagcauugaagaagcaaaaagguugccuugccuuccuagguuaguggcagacuugccuuugcucccaaaucugggaguguucuuugugaggguggaacagacucccugugacagggaacuagaugaaggagucuugagaagcugaugaucaggaguggucacaggucccaguaaacucacuuuaauaucugguguugaaaaggcauuugaguuuucagugacauguagggggucaauguucucugcuccacuauugagaacugacuccaguacuccaggggcaaggaaggcaggcgcucgaccaccuuggguugacacuugauguccuguaacaucgucacugguucuggauugggcacagcaugggccacuauuguagagccaaagacuucagccagauuggcaacauucauuuuaguauauggacucugagccacucucugcaagugaaucaugaggaaaaccaaugugucccuguuggccuggggcaguucaccaacagccugguacauggcagauaugcuguugucuucaucugugauuucugcugcuuccauaaaggcuuuguuuaggcgaaaggucagaagagguucuuugaaguuucgaagaaagucuuuaagaaggcuacagauagcauggauaucauccacuuugcugacgagggguacaguuuucacucugaggaauuucucuuucagcuuuuacugugcugucacagcccaagauccuauacaggccugucucaguaagaccucucugcucaaucucauuuacaca

SEQ ID NO: 18555 - RNA, 677 nt, Homo sapiens
ggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaau

SEQ ID NO: 18556 - RNA, 1040 nt, Homo sapiens
cauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaa

SEQ ID NO: 18557 - RNA, 1804 nt, Homo sapiens
acuggcugcacaggagaaagacugaaugccaagaugugucacgaucgcagaaaugcacauguugucucucaaaauaacuacuucgaaugacaaaaacacuauuggcuauaaauucugucaaucuaggaaacgugcuaucugcaaauuugccugaagcaggucccaagaccaaacaaagaaacgagagaaugcaaaaacucucccaagcggcgcuaagcaccgaugggguaaccucagggaaaauaagcuuccuuucauugcagguccuggugugaugacucucgagccuccugggccucuccagggccagagcggccgaaauccuguuucaggagacagcggcuuccccucaggcucugccacgucuccaggccagacagggccgggcuaagguccgccggcgcucccgccagucuccccuaaagucagcgcccuggaagguggggccagagcgcuccugccuugguccuuggacaggagcaaagugucgcggggcgagacccucgaaccgcgcccaccgugccauccccagcggaaacugcucaccuugcgaugugcacuccugccugcugcaccccgcacgccgccacagcugagccuggaccacgggacuagggggcucgcaaacgacaucggcguccaguggcgccggccggcccgcccaccuuccagggacaccgucccucggggucuggcucuggcgccugcaagccaugccaugccaugccaccccccucauacacgccccucggagccaccuggcgcucaccuggggaccgggaaagugccugcguggucgcugaagagugugguaugauagggaggucgggacguagaacuacagcuuggagaagacaacgaaggcgcacccuggaaguuaccucggcguguccccgccuacaagauggccacgggcggcgcaugcuccugcggcugccacgucggccgcgcgccgcaccgcgccgcgcgucgccgccccgccccgcuccgccccgcaucgcaucgccccgcuccgccuccgcaucgccccgcccccccugucccaugcgcugugaacccggccgggacgcugcaaguuaaacuuuggagccaagaucuuccuaacuaccgagacuugguucugcccacacccucuagaaacaucuuccaaagggcuggccuccuuucuacuucgcagcccccuuacacgagaguggcacucuuguuaccaggcguagcucacucauccugugccacagcggcccaagggauaagaucaguuagccaaggucaucugguuggcggucaucuagccaacaucagcuaguccagucagcaccuccaggaaggaccucgcggcagauacaggggacuuagccuguauagucaaagauuuccagauaacagugauuauaucaggagagagggauuaggagaagagggagaggggagaagaguagcaguuacuguacugaauuuuuccccaagugcauguauugcacauucuuuuuuuaauuguaaaauagacagauuaucaacuuucuuauuauaugcugcaccuaacacaguaccugaaauaguugguguucaauaauguacauuaaauaaauuaauggagugcgauagaggaaaauaaggaacuucaaaucagaagucuugauuugagucugagacuacucuaaugccaguuguacaguugccugcccuuguacaggucacuuagucuccauaagucuucauauuucuaccugcaaacugagaauaauacuauccaccaucccuaaaucaggcaggugacagacucaaauaaaauagagcauaugaa

SEQ ID NO: 18558 - RNA, 38348 nt, Homo sapiens
ucauaugcucuauuuuauuugagucugucaccugccugauuuagggaugguggauaguauuauucucaguuugcagguagaaauaugaagacuuauggagacuaagugaccuguacaagggcaggcaacuguacaacuggcauuagaguagucucagacucaaaucaagacuucugauuugaaguuccuuauuuuccucuaucgcacuccauuaauuuauuuaauguacauuauugaacaccaacuauuucagguacuguguuaggugcagcauauaauaagaaaguugauaaucugucuauuuuacaauuaaaaaaagaaugugcaauacaugcacuuggggaaaaauucaguacaguaacugcuacucuucuccccucucccucuucuccuaaucccucucuccugauauaaucacuguuaucuggaaaucuuugacuauacaggcuaaguccccuguaucugccgcgagguccuuccuggaggugcugacuggacuagcugauguuggcuagaugaccgccaaccagaugaccuuggcuaacugaucuuaucccuugggccgcuguggcacaggaugagugagcuacgccugguaacaagagugccacucucguguaagggggcugcgaaguagaaaggaggccagcccuuuggaagauguuucuagagggugugggcagaaccaagucucgguaguuaggaagaucuuggcuccaaaguuuaacuugcagcgucccggccggguucacagcgcaugggacagggggggcggggcgaugcggaggcggagcggggcgaugcgaugcggggcggagcggggcggggcggcgacgcgcggcgcggugcggcgcgcggccgacguggcagccgcaggagcaugcgccgcccguggccaucuuguaggcggggacacgccgagguaacuuccagggugcgccuucguugucuucuccaagcuguaguucuacgucccgaccucccuaucauaccacacucuucagcgaccacgcaggcacuuucccgguccccaggugagcgccagguggcuccgaggggcguguaugagggggguggcauggcauggcauggcuugcaggcgccagagccagaccccgagggacggugucccuggaaggugggcgggccggccggcgccacuggacgccgaugucguuugcgagcccccuagucccgugguccaggcucagcuguggcggcgugcggggugcagcaggcaggagugcacaucgcaaggugagcaguuuccgcuggggauggcacggugggcgcgguucgagggucucgccccgcgacacuuugcuccuguccaaggaccaaggcaggagcgcucuggccccaccuuccagggcgcugacuuuaggggagacuggcgggagcgccggcggaccuuagcccggcccugucuggccuggagacguggcagagccugaggggaagccgcugucuccugaaacaggauuucggccgcucuggcccuggagaggcccaggaggcucgagagucaucacaccaggaccugcaaugaaaggaagcuuauuuucccugagguuaccccaucggugcuuagcgccgcuugggagaguuuuugcauucucucguuucuuuguuuggucuugggaccugcuucaggcaaauuugcagauagcacguuuccuagauugacagaauuuauagccaauaguguuuuugucauucgaaguaguuauuuugagagacaacaugugcauuucugcgaucgugacacaucuuggcauucagucuuucuccugugcagccaguguuuaauucagugaaaauuuauaaaauuuuauuucggggucagauuaggcucuaacuagcgcucacuguuugguaguagagacaaucuuguggcacgaguaggucagcaauaauugcucuuaaugcuuuaaaguuuaucagagcuucacucuuccauuucuuguaaacuuguaaauagacauccacuuuuuuuuuuuuuuuuuaacagaaaaaccaaggcacaagcaaauuggaacaacagggucuagccggacugagaacucaguuuuccaaaccauuuucuucacuuuuucuuuaguguugauauaugaauaguacuuuucgugacaagacuugagcccuaaaacaguuaccaacucugacacuucaguauuguuuuaucauaauagguuuuuuuaguagaaggcacuauguuuaugcauguaaaauuuaccucaguauugccauuacggcaguuuucauauaaaaagccauuaaagacaaagaaauugauuauuuauuccacuuaaugacuuuguauucauuguacaguuucuuuugcagacacauuuguuaauguuagggauucucuuacaauaggacuucuacuagucauuguaaggauuggggagcaucuguaguagagggugaaugaccaauaaaaaauuaaaugaagaaaagagggagcuuugguugaggagugguaaaaucuccaaaggggcauuucuaucucagguuauuuaccuucgauguauagguacugaaugaaaggauucagccuccccggaucccuguucucugcuuagugccauagaucuuuccuacguucacagccaaacuuuuugaaagugucaugcguguuagucucaccugccacugcucgauucaguuuacacuggaaucuuucuccacucuuuauaugaaaaccguucucccuaaauucaucuccaguuuggcagauccauugaacuucucagauaguauccuauuuggcuucucugcagcauuaauacuguugcccauucauacugcgaaacucuggcuuuuggacaccacagucuccugguuuucuuccuuucuuuuagcucaucucuuauucucugcaaacuugucuuccaucuuacuaaaccaauaauugguuuaacaucauauucucuuuucucuugguauucucuuacguaaucucaucucaaaacaugacguuagacuaucaguacacugaugacacccacauuuaugugguugcuaagcuccagaccaagucagugucucuacuuagauguuuguuucaaggaacuuaaacagcaugucaaagacuaaacauuuuaugauuucccccauccgacucccccagaaagaacaucaaacacauuggccuucugcaguguuuccuaucuuugugcauggcaccaccaucuaucuaguugugcaagucaugccuccuuucccuuccuccauacccagucacugaauuuugccaccuaaucuugucuugaacuuauuuacuuuucuccaucuccacuaucaucacuugagucuaggucagaguuuuucaacuuuggcacuauugaaauuuggggccacuuaauucuuguguguaggcugugcauuggaggauuuuuaguaguauuccuaaccucuucaugcuauaugccaguaguagcccucuaguagugacaauaaaaaaugucuuggacauugccaagugaccccuugggggcauaaucagcccuucccacuaugaaaaucauuagucuagguuguuacuuacuucugauggaacuacuucuauaucuuccuuaauggccugucugcaucugcucugucugcccaguggcccaggcugcauacuuuguucagaucuuuucaaaaaauaaauaugaauugcuaauaacuggaaucagccuaaauguccuucagcagguacauuuauacaauggaauacuauucagcaauaaaaaggaaccaauuugauauaugcagcagcuuggaugaaucucaagaacauuauguugaaugaaaaaaagccaacuucaaaagguuauaugcuguaugauucgauuuauguaacauucauggaacgagaaagugauagaaaacagagcaguguuugccagggcuuaugguugacgggaagguagauaaaggaacaacaugaggaaguuucuuuuuagugauggaaugguucuauguccuggucgagguggugguuauacgagauugugcauaugaugaagcuucauagaacuaugcacauacacacacacaguaaauguaaaaacaugugaaauacaaauaagaucuauaguuaauaguguuguaccaaugucaguuucaugguuuugaucauuguaguguaguuauguaagaugcuguuacugagagaagcuggguuugggguacucaagaacucugcuguuucuacauuuuuuuuuugaaccuaaaauuccuucaaaacaguuaaaacaaaagacaguuaugcuacccucagcuugaaugccuuacaguuguaggauaugauaaauuucucuucauagauuuuagccuguaaauuguuaaguacaaugaguucugagauccucuccaaagaaccaguguaucaguauguucagcuccccuguucuuuguucuucauuuuaaaguuuaaauuccuaguucuuuauuucuccuugcccccaguuucaguaaacaauccccuucuagccucuaucaacugcucugaccuuagucacccuuggucaccugcucugaccuuaguaauccuuggucaucugcucuguucuuagucauccuggaucaccuguucuguaaccguccuucccgccaaacuacucacccugcugcucuggcucauaccccugcucucuuuaaaauagccaguuggaauuagcuuagacugcgugguccaacccuagccaaugggggaaagacacagcaguagggacuagcugcguuaggauaagaaccccuuccccucccuuguucaggugugcucuugacauugcuccaucugugagacacacccuucuauagaaguaaaauugccuugcugagaaaauuaaauuuauguucgagugcuauuucuuuuguggcaccgaaaauuuauuucuaacacagugacacucuguucuuuaaaaacccaaguuuuuuaaccugguuuaugaggcugaacaccuucugggcuucugucugucccuccaguccugauucuucuuucucucccuucacauggauuuuauugaauguaucuuguucuucccagcucaguugguauauauauuugcuauauauucacuuuuucuggacucugccuuucuucccuugccuaauuaaguucuuauccuucaaaucucgguuuaucugugacuuauuuggggaacccuuuccuuaccuccaagucaaaaucauauuccugucaaacaaaacuguguucuuacccucagagcacauaauucagcuaccauucauuguaaauugguuuauuauuugauuguuucguguacuagacuguaaguauccuauuuguuuuugcuaaucauugucauuuccaaaggcaucaguauagugcucgucaagcaguugaccuucgcuaaaaacuuauuaaaugaauaaaaauauuaaaaacaaauauagcauauuuagaaguugguucuguacuugagauacacuucaggauuuguaauuuuaaagaaaguuuucucauauuuuauaauccauuguugucuauuaggaugcugcuaucuaauggcauuuuugcuauaguuaacuuuucuaaaaccucagauauacaauuuaucuguuacuggauaugcuuuaaaaugugaacuaggaaaauugugaauuaaugcuuuuaucaagugaagcacauuuuauuuuauuuuauugagacaagguccugcuuuguugcccaggcuggaguacaguggcauucucacugcucccugcagccucaaccuccugggaucaggugauccucucaccucagcauccugaguugcugggaccauaggcacaugucacccugccuggcuaauuuuuuaauuuuuuuguagagauggagucuuccuauggugcccaggcuggucucaaacuccuggucucaagggauccucccaccucuaccucccaaaguguagguuuacagcggucagccacugugccuggcuuuauuuuuuuuuuauguuaaugggguuaucuuauacacaguacuuuaugagagaagaggaagggcuucaaaaauacauuaaauauuuuauuuauuuauuuuuagagaucuugcucugucacgcaggcuggagugcaguggugcagucauagcucacugcaaccuugaacuccuggguucaaggcaucuucucaucacagccucccaaaguccugggauuucagacgugagccacugugcccagccucauuuuuauuuuaaauuuaauaaugacugaaauuuauauuauuuacuuauuuuauuuuuuagaaaugagaucuugcuauguugcccaggcuugucuacaacuccuagccucaaaugcuucccgucuuggccucccagagugcugggauuauaggcaugggacaccacaccuggcccagacauaacuaucucuaacaugcauucauguggcagaaaucaaauuaguaauuuacuauuugaaauguaguagauaauuaguuauauuguuauuauaacaugaaauuauuucccacuuauaaaguaucuacaugggaauguuacagauuguuugauauuaaauauucucauagauugcuuucuuagaaauuuggacaaacucuucgucuggaaauaaguugcauuauaaacaguaaagguggacaucuaucucuugaugauuuuuuuuuuagucguucucuauucaagcuuuaaaaauauacuuuugguuacuguguaauauuuguuacauuuuuguguuuuuauaguauaccauaauugaagaaaaaugauggaagagaguggaauagagacaacaccaccugggacuccuccaccaaauccugcagggcuggcugcuacugcuaugucuucuaccccuguuccauuagguacauguaguugucuaacaucucguguguuuugagaauagugaagauacuaucaucuuuucucagagucaauuaagaaaagaaugcauauauuaaaacuucucuauuauuuuucaggaugaaaggaaauagccuuuuuaauuuaaagaauagaaagaaagucuuguguauuuaaaguaagaaaacaucaguguuuugcuuuagguggacuuuuguucuuuauguucauaauuuuaccaucauuuauauuauggcagaaauauccuaaaaagcauguguuagcuuugucuucuguucuuuuucuuuuuuuugagacggaguuucacuugucacccaggcuggagugcaguggugcgaucucaucucacugcaaccuccgccucccagguucaagugauucuccugccucagccucccaaguagcugcaauuacagcacucaccaccaugcucagcuaauuuuuguauuuuuaguagaaaugggauuucacaauuuuggccaggcuggucucaaacuccugaccucaggugauccaccugccucagccucccaaaguccugggauuacaggugugagccacugcgcucggccuacugcucuaugacuuuguggugauuaaccuuucugagccuucagggcauagguuuuuaugcucaaacuagggaugaaaaaucgcuuuauuuuauuaaaaauacaccaaaacaaaccaaaaagcaaaaaugaacaaugccauagguucauacagcugcuucuuuuacuuaugggaguugaaagucauuuacacucaauuauauuuguuguauauuuuaaauuacacauuuuaaaauaauucuugggauaugcuuugguaaguuaaaaauuuugcaagaagaaaguaauuagacaguuugaaaacuaaauaaaaaacauuucuaauucugugcuuuuauccucuccacuuuuuucuagcggcaaccaguucuuuuucuucuccaaauguauccuccauggaguccuucccaccacucgcauacucuacuccucagccgccccuuccuccugugaggccuucagcaccauuaccuuuugugccuccuccugcaguuccuucugucccaccacuuguuacuucuaugccaccuccuguuucuccaucaacugcugcugccuucgguaauccuccuguaucucacuucccaccuucaacuucugccccaaacacucuuuuaccugcacccccuucggguccuccuauaucaggauuuucuguugguucaacuuaugacauuacaaggggacaugcugggagagcuccccagacaccccugaugccaucauuuucugcaccuucaggaacagguaauucuuucugauacuuugaaauacauggcuauuaauuaauguuuuauucuuuuuuaaaauaauagcuuuguugagauauaauuuauguacucuacaauucacccaauucaaagcauacaguuccauaguuaguuuacaucagaauugugcaucccuugucgcaauuuuauaaccuuuucaucacuuuaagaaagaaacccuauaccuuuuagcagucagccccuacugucccccaaauccucacagcucuaggcaacuacuaaucuacuuucuauguauauggauuugcuuauccuggucauuucauauagauggaaucauauaauacguggucuuuugugacuggcaacuuucacuuaaauauuuucacuuaaauauuuaacuuaaauauuuucaagguucauccauguuguagcauuugucaguacuucauuccuuuucauggcugaauaauauuccaguuuaugaauauguauaccacauuucauuuauucaauuaaucaguuaauguuggguuguuuuccacuuuuuggcuauuuagauaaugcugcuauaaauauuuguuuacagguuuuuauauggacauguuuuuauuuuucuugggugucuaccuaggcauggaauugcugauuuacaugguaauucuacaccaaacuguuuucuaaagcagguguaccauuuuaccuucuuauuagcagugggcggggucccacuuucucugcauuaauguucuucucuuuauucauuucuuugguuuccagaguuaccuauuucacauuuuugccauuuaaauuauuaaaauaaggcugguauaauuuaguauaugauuuuuuuaugugauauacaacucaguagaugauuaguauaugggaugucagaaaauuccaaaauuuuguccuaauauuugugcauuuauagagaaauuuaaaggugaagucugaguuuuuuuaaguuuuacugaaaaaauuaucaggacugacuguuccagggaguaguguuuuuuuagccagguaaaaagucagaaacaaauaaaaccucauguaugccaaaaguuugugauacugggucauuuccuuucccuaggucaguuaaaucuacuuguuuuguuucuuuggaauaauuguugcaaaugaguuaucaaaacuucguccuugucauccucugccuguuguuucucauuuuagggaaaagcaguagcuuugcugugcuuuuuauuaucuaucuuucccugucuaccuuuacaaaugaaaauuauugcagagugcaaguacuauauucaugucuauguauaugugaauuuucuuucugaguuaacaugaaguauauagaguauguguaauaauugugugcuuuuuugugaugaacuucagugcucaauuaauuuuauggauuaaagagaccugaacuacagccguucauauccaagugcugaauaggacagaccugaagaacuuuuggauauacgcuuuuuguccauuuucaggauacuugguuuaagacuauauaaagggaaauaaauuucuuuugaaauucuguuuaauuugcguuuuauaaagguuuguguuaaucuuugauuguauaacucagucuucaaaugccugaauauuaauauuaaaguuguuugagccacuccuuuuuauaggaaaaaguuuauggaauaaauuauacauaugaaaauuuuugccauugauuaggucuuuugccaacuccuauuacucagcaagccaguuugacaucucuggcacagggaacuggaaccacaucagccauuacuuucccagaggagcaagaagacccuagaauuacuagaggucaggaugaagcaucugcugguggaaucugggguuuuauuaagguaagacguguuuaaaaauuauguuuaauuuucuaauuauaaaacuaauagauauucauuagagaaaauauugaaaauacaggauggcacaaggaaaaauaaaauucuuuuuuauuagcaguuuucuguagcugcucucagucucuugccuaugcauaucuguguaaacguuccuuugaauuaaaaucaaauugaaguagugacaggucagauggauacuauuucauguuuucuggucuuuacugagcauauaucauggauaucuuccuggccguaaaauauuuuuuucagaaauguauuuugguuucucuuauggcugcuucaccauacaugcuguugcauuuauuucccguguuuuauuuugcuaaucugccuauuggcauuuucuaauuguaauuauuuuuuuuaaauuaguuaauuuauuuuaauugacaaaaauuguauguguuuauuaugcacaacaugauguauacaugaaguguguauacauucuggaauggcuaaauugagcugauuaacauaugcaauaccucacauauuuaccauuuuuuuguggugagaaaacuuaaaauuuugaaauauaaaaccuuauauuucaagaauauaauacauuguuccuaacuauagucacccuguuguacaagagaucucuucuaauuguaauucuuaucaauaaaucaucaucaugauuaggucuggcauggugccucaugccuguaaucuuaacacuuugggaagcccaggcagggggauugcuugagucgaggaguucuguaugagaccagccugagcaacauaaugagacccagucucuaccaaaaacuuaaaaaaauuagccaggcauuguagcgugugccuguggucccauguacucagaggcuaaggugguaggauuguuugagcccaggagguccaggcugcuugagcugugaucaugauacuacauuccagucuaagugacagagugagacacugucucaaaaaaaaaaaaaaaaaaaaaccaaaaaacuaugaugagcacuguuguauguaaaucuuuauggacaucuuuuuuuccuccgaauuaauuccugaugaacauuugagugaacauuugaagaaauugauaccuauuccacuucaggagguuuauaccaaaauacacugguauaacauuuuucacuugccagcaguaguuauuaauuuggacuaggguauuuucugauuugacaggcaaaaaauaauaccacauuuuaauuugcuuuccuuugcuacugaauuugaacauuuucucguaugauuuuuagccauuuguauucuucuuuugugaaauaucgguuauguucuuugccuaguuuuaaauugggaugauuuucuuuucuuaugaauuuguaagagcuccuaauacaguaagaauacuuuucuauaugcucucauauguugcaguuuucucaauuuuuaguuuacauuuucauuuuaauacccuuuuugacagaaaaguucaauuucaggagucaguucugucagucuuuucuuuucuuuuuucuuuucuucucuuuucuuuucucuuuuuugagacaaagucucgcucuugucgcccaggcuggagugcaguggugcgaucuuggcuuacugcaaccucugccuucuggguucaagcaauucuccuaccucagccucccaaguagcugggauuacaggcaucugccuccaugccuggcuaauuuuuuuguauuuuuaguagagacggggguucaccauguuggccaggcuggucucgaacuccugaccucaggcgaucugcccgccucgccucccaaagugcugggauuacaggugugagccaccgcaggcagccucuccuuuucuuuacauuuuuuuuuaaugcuaaaaaagaccuuuucucacuacgauacugugauaaauguucuucugugaucccuuucuaguucccuuaauguuuaauuuuuuagacacuuagcguuuaauauaguugauauuucuuuacuauaugagguagagaucaaacuuaauuuucuuccagcuacucaauggaguauuucaauaucauauccccauugauuugguaugaucccuauauuaucuuccuuaagaaauuguguguuaaaaucagcuucuggccucuguauucuaguccacugcuguuucccuguucuuguaguagagcacacuguuuuaauuacuuuuacuuuguguucauuguacuaacguguacugagguggggauguggaacauucagugauaaguaagauaggacaguucaagucugcauuuauaaauguauaucaguauuuaguuguguaaguuguauaagcuggcugauuuuucuuuuaaauuuuucuuuacucaucuuucccaauuuuuuuugcaaugaauuuugaaaucauucugccaaguuccaauauucugcuaaggguuuguuugcaauuuuauuauuauaauuauaauuuauuauuauauuaaagauuuaaaauugguagaugauuggcugauuuguaguauuugagcuucauguuucaggaauguggcauuuuucuaagcuuguuuauuuuuuaauaccccucuguacuuuuuuaaaaaguuuuuuuuugcauacagacuacaacauuuugucccucguuaagagcaugugucaguguguuugucaugaguuguaauacccaguucaacucuauaggucuuguaaauaguaagucaugauguuucagcauaugguugguuggcagucuuaaauuucaauuuuaugaacucaucuuuuccugagucaccuuaguuuaauggcagauuggaagauggggaaucauggcagguuagucagaugccaucucaggaggcacugcucccuggagugucuuuuacccuuugugaaguaucgcacaagaaggaauacucaagacuugguuccuuuuaguaguaacggcucuaagaauccagaggaauagaucugaauauaaauggcgaguuugggaauguacaaaacaagaaacaagaaguaggaaaaagaagaaacuaguagaagauagcaaaauguuguacguuaagguaauaaguaacuguucugcccccagacgagagguguuuuuacucuuuuuauuuuuuuuauuagggaacaaguauggacuuacguagacaccugauugggaccuuuauuugggacccuaagggacaaguuuugcccaaucuuuuauauaaauaaguagaagugaaauuauauauauguauauacacacacauauauauguauauauaguauagcauccuuuccauacccaugcuacucaaagcgugaucuguagauugcugcuggucuacacacugcugagucaggaaaaaaaauugagaguaucauuuagaaacuuaauagcaauuugauauugucaugaccuuauauaucuuacaaaaguacugguuuaggaugcauuggaaacuuuuaaaaaaguuuucuucacaaucaugaagaucaugguguuccucacuuagagugaauacuuacauauugauuuguuuuaugcaggguguggcugggaauccuauggugaagucugugcuugauaagacaaaacauucaguagaaagcaugauuacaacgcuggacccuggcauggcucccuauaucaguauguacauaaguuagaccgguaucugccauuuuuuuuuuaaggguauguccacaucagccacuaauuguaauucucuguucguuuccacugauuguguaaucaguggaaauucuuauuauauucuugcauuaauuuaauugucagucuuauuuuuugguguuacuaauucaucuuuuuuaaaagucauuaaauaaauuuugaaaaucccacagaaugauccuagaaggaguaaaaaccaugaauuauugguauacuugcugauuuuaauuuuaaauauagguuagcauugcuuuauaugaauuuuacuuuauucacuacugacauuugaagugauguuuguuucauacuuuuuuuuuuuuuuacauuucuccuguuaucuauuuuaauuaaauguuuguguguaauugagggauaauauuuuuggaggaagcaaaucuaguuaauaauaucuaaugacuggguauauugggaaagcuauuuuuaaccaccucugaacacuaaucauccagaaucauccagacaguugauagauacugucugcuauuuaauuuuuauguacauauccaauaugugaaaaaauaucacaaggcuuagugaccaauuauuaguaauucuguaaaagauaacuuuuaagucaaaauugugcagcagguaccugaacagcgauuucaguggcaauaaaaagccaauagcuuucacaagucuugacuauguugguaguuuacugucuaguaaauaucaaaagauaaggccuagcaauuguuaagugucuuuauugaaugcuucugccaggcacuuucucauaagagcucugcaagguagguauuuuccucaaguuuuggacgaggaaucuagguuuggagggauguaaguuaucacccuagaucacacaacuugguggagcuguauugaacucaugcucaauuuuuuuacacuuagccacuuugcuucccuuguaguagaaaauugaaucaagcauuaaaucaacugaguuguucuuuguguuuguaacuguccaaagaauucaaaauuggaguccaccauauauguucuuuucuuugcaaguacauauuuugaaugaaggaaaaaaaggaauuaauauuuuuggagcuuuugcuguuuuaauggcuguacuauguuagacuaugaaagcaauuaccuuauuuaauccuuagagcaaacccuaugaggugccagguguuuuuauucuucuucuucuuuuuuuuuuuuuuuuuuuuuuugagacagagucucacucugucacucagacuggagugcaguggcgugaucucagcucacuacaaccucugccuccuggguucaaguuauucuuaugucucagucuucugaguagcugggacuacagccgugugccaccacgcccagcuaauuuuugguagagacgggguuucuccauguuggccaggcuggauagcaggcauuuuucuacaaagaaacaagcucagugacuuccacaagguaaagaagcuaguaaaugauaaagguagagccaucaagaaaaauguguaacaccgaaggggaaaaaagaaagguacagaaaugaaauuucuauuauuagcaaaugucauaacuuuaucagcuuuaaaaaguaauaaaaucgaauuuaagaaagcugacaucuuuacugacagcaaagcaucaccauucugaucuaacaaaacaacucaaaguaaaucuuaagguuuuuuuuuuuguuguuuuuuuuuugagguggagucucacucuaccgccaggcuggagugcaguggugcaaucucagcucacugcaaccucugccuccugaguucaagcgauucuccuaccucagccuccugaguagcuggaccuacaggugcacgccaccaugcccagcuaauuuuuguauuuuuaguagagaugggguuucaccauguuggccaggaugaucucgaucucuugacuuuuugauccucccgccuaggccucccaaagugcugggauuacaggcgugaaccaccgcgcccggccaucuuaagguauuuuuacacaaauauucuagaaaucauuugauguaacaauuucguaugugucaagaaacucaaaaaguauuagaaauggcaggacuacucaucacaagcugaaaagccauuuugagcugaagcuuaauggagcaguacuuagcuaaggucgagagaugugucccauguggaggaaaaaagugaaaaaaaaaguauauucuucuucucuuuuauguccuaguaacuucugaaguauccaguacagaugugaucugugagacauuaugucagucaggaaaaagggauccauuauuuuuaaaacccaaauauuugaaaauaucuuucccuguuccacaugauauuuauuagggaaaaacaaccuuguuucuagggcaaaauguuuuacauuauaaacaauuuucaugaaaaaucucuuuugccggugauaacuauuaaugccaaauaucaaaaugugcuguguuuagaacaagggcuuugaauucauuauaucacagaaauguuugguuaagauuuuuaaaaauaaugaaacauuuggucaaauugaucugucuagaaauaguaguacuuagguuguuuaaguaauugaaaaauuaaaaauauuugaaaauauuuuuauuucguauuacucuuaauauuuuaaauuuuaaguuuuauguguuauuucaauuucauauaugcuugcauauuuauauuagggcaguaguacauguauaauugauaaauaucuauuugugguguaugcucagaacauuguggggauauuuaauaaaaagcuugaugaccccauauuuaaacuauuuucuagguuaaaaaguauauuucaugguagugcuuguuuaguacauaacuucucugcaacucauugacaaaucacuuacuaucaguaagucuuuauuuuaauuuuccguggaguauacuaaauauguaacuuacacuucacaagccagauaugugauuucuggcuugugauauguaaugucaguuuugaguccugacauuagugcuaaguagauacguuaccuugggcaaaacuuuguuggccucaguuuucucaagcauauaaaaaagauaaugaucuauaucuugcaugguuuuaugaaacugguaauaauuauguauauuagauguuagcaccugguaugguaguaauuaugagaauuucauuauuuuaauuugaaaguuaaauuuuccucuggucuuuuuagaaucuggaggugaacuggauauuguagugaccucaaauaaagaaguaaaaguugcugcuguccgagaugccuuccaggaggucuuuggcuuagcugugguuguaggggaagcuggacaguccaauauugccccacaaccagugggcuaugcagcuggauuaaaagugaguaacagaacaccauuuucaggacauggaaacuggcauuuaauuuuuucacaauucugauaaucuguugucucuauggagcuaauagacuuuuacauacugaaauaacaaugaacuuugcuuuuaguagacagcccuaucguauuaugaagauauaguggaguuuuaauuuaaagaaauuuaagauagguuuugauuauugugggagggaaagaaacauugagagagcacaaaaggaauaguuaguccuaaaagagaucuucuuaauccagcauuaacauucaaaucaauuacugagaugauaauaucccuugaaucccauaagcuuuuauuaucccuauugauaaugcuuaaaaauauguaaguuccaggaauuccguccucucuuucauacuuuauuuuccucucuuuguguuauuaccagcauacagucaugcaagaacaaauuaacaguucauuggcauacaaacaucuuucucaccuugaaaaaaaaagaaaaaaccaaaggaaaccccaacaaauucuuugaccucccuuccucuauaacuuaaugaccuauuuugcuuccuuuugcagcuaaacuccaaggaguuggcagcacuuuucucauauccuuuucacauucaguuaagucuaccucaguuaggcuuugauguccagcacucuacugauagugcuuucaggcucgugcuaauguucuccaucuuauuggacuuaccagaggcuuuugagacaguugaucaugcacuucucuuuaaugcuuuuuucacuugauuucuaggauuccacacuuuaguuuuucccuccuucauguauugcucacuccuucuguacuuccuuugcugauuccuccucuucucuccagucuucugacggucaccuucucaucaauucacucucagacuaucccauggcuuuaaauacugucucugugcuaacaguuccaaauuuauaucuccaccugagaccuuccuguagacucuugauuuauauauaaguugccuuuuugacaaguuuacuugaauaucucaaacuuaauaugucuagaacuaaacuucuuuccuccacacuugcucccucuagccuucuucaccuuaauugauggcaguucuagccuuccguuuucucaggcaagaaaccuuggagucagcccugacuucucucauuacccacuucuaauccaucaagaaaucuuauuuguaagacagacaguucuuguuuuucaacauaauuguguuccauaaaguugcuacagacugaauuugugaauacugagccauugcucccaggggagauacgaugguuaggauacugugggccucuggucacauuuugccaaccugucaauacauaacuuuguuuuaugccucuuucuguuuaaauacauuuuuauacacauacaugcacauauuuuugauucauuaauauugaacucucacagucaacaguacuguaacucaugcuugaaugcagcuuauuuaacacacucguuuucucauuaaggcacaucauugucuucuugugcuuaggaacacuacagcacuccagcacuacacuugggggccauuugaaaacagcaguuaacaucaacaaacacaaagaugcaaaaaagaggugcuaaauagaucccaaaaaggauaccuguuuacauugugucagcugaaagaagaagucagggcacugccuuguucagccucagcuaggaguguaugcaucaggcaacucaaauuucucauagcucugugcauguccgauuuugagauuauaaauaaauuucauguguagucaauggaauccacaaaacuaauaggaucgaucaacuguauuuauguuuaaggagaaacacauuuucauauaugacauucuguuguuuuauuugaaggagcuuauaauagccugcauuuuuugagaacauccccugagccaggcacauagacccuuuaccugcauucauuugauguguguaaagcauuagaaugagguaauugacauagcauauuucauuggggaaaaagucuguugcauuaauuauaauuagucacuaaacacaaacccacacugacacuagauuauuuuuaauucuacuagguagugcuacauaaguuugagguguucuuugaguuguauuuaguacuuuauuuaaauagaauaugaagcccuuuucuuuuacacauaugcauacucacauaccacaaaaccacuuuucuauauuaggggcuauuaggcaguaguuauacccuaucuaaauguaaugcauuauauauaauaugaauuaaauuacauguuuucugccuuuucacuuuucacaguggucuguccuuacacacagagcaaagcugccaaaagcacaugcacuuugaaaugcuucuuuucucuaguagguuucucuugaauuugagcccuaguauacauugccaauaagaguuucuuuggugguagguguuuggacuuaauaaaauuuagcaaagguaacugacggcuguaggguuugaauuuaaucuagaaaugaaaaaaaaaauacagcaaauggguaaaauaaguauguauacaugauaauuguacauuaaacuaguuguauauauauaagauaaaccauaagcauucauacgggcgauuuuuacuugaaaaacuggaacaagucacauacuuagauugagaauguauuugaagauuucccaagagguuuugcaaguuggagagaguuuauaggucugagaaagaagacuuuucaagauuuaguugcagagaguaaacugaggaaaauccuaaguagaaaugauuauuagacaaaauggugaguacauuucacugaaauuagagacuaaaacaagggauuucuguaaauugugaagcauuguauaaaugugauauggaaguugguaaccuuauuugauggaaauuauuguaguugcauuuaucuuuuuauaauagcauuugacagauuauuuuugcugcugauuuuuauccuucaaauuuacaaauaugaauucauuuuccacaauuuucaguucaagcucaaaacuaaaauucauugaaacuaauauauaagaaagugauuuguaaauuugucggcuuuuuauuuuuuuucagaaacaguagagggagcuaaugagaagaaaaauaauguagagucuuagaguauaaaaugguaaccuguuuuuguucuccccaaucagauuuuauuugaaguaaauggguuuucugaacuaaacuuacguuaccuuuuaaaaauaggaaauuauuuaaggaaguaaaucaguucagccaaaauuaaaguuaggaagcuucuagaacuuuuaugccaaguauuaacuuuauugaaaagccaguuguaguuaugacuacuguuuuauauaguuuuauauucaacaaauauaauaucuauaagcauuuaugaaaauauuauaaaauuuuaacuauucacugaaccaaguugcuuaguauaagcucuuagaguacaauauuguucuucaguucugaaaugauuauuuuaauauggucucuaaacuaccuaauucuugaucucuuauauugcuaaaaaauaaaaucuccuucucaaaacauugguagggacuaauauuaaaaugucuguauuuguaacuccaaaagaggccacauuuaauuaauguaguggucagaggaaaaagaaaggccagauauaaccccauuuucauuuucuuauggauuuuauaaacaaaaaagaaauuugucuaccuagcuuauuauccuguuucuugcaggaacuaauuaauuuuaauuaaauguuuugugaauccugugaaauauaaagcucugugcuguaggauagugaaaaaugaacaaacuuagucucuguucccuggaagcauaaaaucuaggaauauuuuguuguagugcauagcugagauaucaccugcaaagaguuaggggaugaaucucuguacaucuuacuaaucccuuaauaguuuuuacggaaugaauguuuacuuaagcuuuuuaaaaaucaaacuuuagccauaacugcuuccugggaggagugaauuaggcaaauuuguaacaucugguauaaauaacuaaguucaucuuaucuguuaauacugcuuucaaaaucaacaggugccucuuuaaguguuauuagauuuggugaugccauauuuacacuauuuguauucuuaacauugaccacauaggccuucagaagcauuuauuuuuuucuuuguucaguuuuuuaugugguaaguucuuauugaacaccuauuaaguuaggcacugugcuggaaacuagagauagaagagugagcaaaaauauacaaucuugguuuuauuguacuuuaaauccuaucaucuucaucuuuacaagcuaguaucuuaaauugucuuacacguucucgcacaguugucacuuucucuuuuucacuucaguugucucugaaauaaauugaguuuucucgagauguguccuagccuucuuaauuuucauuuggauaagaauuuaccauuuaaucugauauugucuguuuaccucugcuguccuuauaaaaauuauccauggcuacuucuguucagacuucuuaucuugcguuuugaacacauauucaucacauuguucauggucaccuuuuaugaaaggauucagauaaaagcaauaaacagaaaccuuuucccucagucauccagcuuuuaguuuucuauuacauauaaucaguucaugucuucaaugguaauuauuuuguugaauaagcugugguguaauguauacauuugcagcuuuuuauuuuaaguaacuggucauuuuggugcauguauauuuaaaaggaaucagaagaaagagaaaaacauauuuauuauugauaugauugccuaccugaaaaauucaagagagaauuaacugcaaaacugccagaacugauaaaaacuuuguauguaguaagauggucucuugccagaucaacauuaaaaaauacaguuuucuuaaauuauuuaacaguaacaaucaaugagaaaauguaauauaaaaauaauccacaauagcaaccaacaucauaaugcauauggaauaauuuggaagguguaccccaaacuguugauacuacggaaauguaauuguauuuugucauuuuuuacucuacauuuuuguauuguuugaacguuuacagugaguauauauauguguuugcauauaaauguaugcauguauuguguaaucauaaauuaguauauuuaauauguaauaauuugaaauggucucuaaccucugccauuguuguuuagggugcucaggaacggauagauagcuugcgucgaacuggggugauccaugaaaaacagacagcugugucaguagaaaacuucauugcagaauugcugccugacaaguaaguguauuauguuucucuuggaagcaaaauauaauugggucugggaguugacacugaauacuuagcaaaaagugucuccuguuuuauaaccagagagaaaaguauauuuugaugcuggcuauaucacuuaacuagcuguguguccugcauggcuuagcuggcauuucuauccuugugucucuuuuuuaauuauaaaauggagauggucaugccugcuuucugagaucaugcuaauaauuaauaaaauggcacuaaguauaagaugauagauuugguguggauauaauugaccaugaguagcaaacacaauuauucucauaguuauucaaagucguggaauauaugggcaagaaggccugauggcauucucuagguuugaguuucuagugagcaguaucucuccuguacucauaauaguuuagaaaaaccuccagacagcauaauuuaucauuguuuuucagguggcuuuuuaugggaaaaauuuuuaauuugcuuaauugauuuauauuagaauaacuucccuuuguugaaaucuaccuucuuuuguauuugcauuaugguuuuguuguuuuuauuuuuuauuuguuuguucaguguugaauaacaaugggcauagcauuuuguggcuuguaauaugcaaaauauauccuccaacuuugaggcauauuauaggccagugggaaagaagauauauguaguacacagaugagcaguuuuaaguaauuguaaaaaggaaacauaauuuuuugcugacaggaaauauauaaaauuucaguggagguaacucuguggagauagugucaggugaaauucaugaauaauuagggcuugaacuggauuuugaagaagaggugaaacuuggccaaauggaacaaaggaaguaggauguucuggguggagaaaaaguuugaagguaauugaaauguauucuugggucagugauuauaucaacuuggcugaagguuuguuggaugggaaaucaagaggugacgggacaaauugugaagagcucugaauucuagguugauaaguuucaacuuucuauguaagcacugagaaaccguccagugauuguugugucauuuuuuuuuauuaaccuguuacuguucauuuaauaauuaacauuagaaauuacaauaugccuuuuugauauaacaaaaauuauaacuugugauaauacuaguacuacuuuuaauacuauucacucccuuuucaccuuuugcgguaucauuguuaaguauuuuaauucugcauauauuuuaagcucuuaagacauaacugguaauguucuuugcagucaguauuuguuuauucucugaauucuuucuugcauuucuguuuuucugucuggggucauuuuucuucgaaaggaagccuaaaguacuuccuuugauaauacauuauaguucagagcugcucacuaccaauucucucagcuuuuguuuaucugaaagugcuuuaauucaccuuuauuuuugcuggauguagaagucuagguuggcaguuucuuuucuuucagcacuuuaaaaaugucaugguacuguuuucuggcuuccgucauuucuguuaaaaagucaucucuccauaaauguuuucuuuugagaagugucuguucauguccuucgcccacuuuuugaugggguuguuuguuuuuuucuuguaaauuuguuugaguucauugugauucuggauauuagcccuuuguuagaugaauauguugcgaaaauuuucucccauuuuguagguugccuguucacucugaugguaauaggaguggugagagagggcaucccuguccugugccaguuuucaaagggaaugcuuccaguuuuugcccauucaguaugauauuggcuguggguuugucauagauagcucuuauuauuuugagauacgucccaucaguaccuaauuuauugaaaguuuuuagcaugaagaguuguugaauuuugucaaaggccuuuucugcaucuauugagauaaucauguaguuuuugucuuugguucuguuuauaugcuggauuacauuuauugauuuuguguauauugaaccagccuuucuucccagggaugaagcccacuugaucaugguggauaagcucuuugaugugcugcuggauucaguuugccaguauuuuauugaggauucuugcauccauguucaucaaggauauuggucuaaaauucucuuuuuuuguugugucucugccuggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuguacucuuuuugguugguaagcuauugauuauugccacaauuugagauccuguuauuggucuauucagagauucaacuucuuccugguuuagucuugggagaguguauguaucgaggaauuuauccauuucuucuagauuuucuaguuuauuugcguagaguuguuuguaguauucucugaugguaguuuguauuucugugggaucgguggugauauccccuuuaucauuuuuuauugcgucuauuugauucuucucucuuuuuuucuuuauuagucuugcuagcggucuaucaauuuuguugauccuuucaaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccuacuuucucuugugggcauuuagugcuauaaauuucccucuacacacugcuuugaaugugucugagauucugguauguugugucuuuguucucguugguuucaaagaacaucuuuauuucugccuucauuuuguuauguacccaguagucauucaggagcagguuguucaguuuccacguaguugagcaguuuugagugaguuucuuaauccugaguucuaguuugauugcacuguggucugagagacaguuuguuauaauuucuguucuuuuacaugugcugaggagagcuuuacuuccaaguauguggucaauuuuggaauaggugugguguggugcugaaaaaaauguauauucuguugauuugggguggagaguucuguagaugucuauuagguccgcuuggugcagagcugaguucaauuucuggguauccuuguuaacuuucugucucguugaucugucuaauguugacagugggguguuaaaaucucccauuauuauugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuucugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuugccagucugugucuuuuaauuggagcauuuaguccacuuacauuuaaaguuaauauuguuaugugugaauuugaucccaucauuaugauguuagcugguuauuuuucucauuaguugaugcaguuucuuccuaguuuugauggucuuuacauuuuggcaugauuuugcagcagcugguaccaguuguuccuuuccauguuuagugcuuccuucagcagcuuuuagggcaggccugguggugacaaaaucucucagcauuugcuugucuguaaaguauuuuauuucuccuucacuuacaaaacuuaguuuggcuggauaugaaauucuggguugaaaauucuuuucuuuaagaauguugaauauuggcccccacucucuucuggcuuguagaguuucugccgagagaucugcuguuagucucaugggcuucccuuuguggguaacccgaccuuucucucuggcugcccuuaacauuuuuuccuucauuucaacuuuggugaaucugauaauuaugugucuuggaguugcucuucuugaggaguaucuuuguggcauucucuguauuuccugaaucugaauguuggccugccuugcuagauuggggaaguucuccuggauaauauccugcagaguguuuuccaacuugguuccauucuccccgucgcuuucagguacaccagucagacguagauuuggucuuuucacauagucccauauuucuuggaggcuuuguucguuucuuuuuauucuuuuuucucuaaacuucccuucucgcuucauuucauucauuucaucuuccaucacugauacccuuucuuccaguugaucgcgucggcuccugaggcuucugcauucuucauguaguucucgagccuuggcuuucagcuucaucagcuccuuuaagcacuucucuguauugguuauucuaguuauacauucgucuaaauuuuuuucaaaguuuucaacuucuuugccuuugguuugaauuuccuucuguagcucggaguaguuugaucaucugaagccuucuucucucaacucgucaaagucauucucuguccagcuuuguuccguugcuggugaggaacugcguuccuuuggaggaggagaggcgcucugcuuuuuagaguuuccaguuuuucugcucuguuuuuuccccaucuuugugguuuuaucuacuuuuggucuuugaugauggugauguacagauggguuuuugguguggauguccuuucuguuuguuaguuuuccuucuaacagacaggacccucaucugcaggucuguuggaguuugcuagagguccacuccagacccuguuugccuggguaucagcagcagugucugcagaaccgcggauuuucgugaaccgcgaaugcugcugucugaucguuccucuggaaguuuugucucagaggaguacccggccagccgugugaggugucagucugaccuuacuggggggugccucccaguuaggcugcucgggggucaggggucaggggcccacuugaggaggcagucugcccguucucagaucuccagcugcgugcugggagaaccacugcucucuucaaagcugucagacagggacauuuaagucugcagagguuacugcuuuguuuuuguuugucugugcccugcccccagagguggagccuacagaggcaggcagcccuccuugagcuguggugggcuccacccaguucgagcuucccggcuguuuuguuuaccuaagcaagucugggcaauggcgggcgccccucccgcagccucgcugccgccuugcaguuugaucucaggcugcugugccagcaaucagcgggacuccgugggcauaggacccucugaaccaggugcgggauauaaucuccuggugcgcuguuuuuuaagccuguuggaaaagcacaguauuugggugggagugacccgauuuuccagguuccgucugucaccccuuucuuugacuaggaaagggaacucccugaccccuugcgcuucccgagugaggcaaugccucacccugcuucggcucgagcauggugcgcugcacccacuguccugggcccacugucuggcacucccuagugagaugaaccugguaccucagauggaaaugcagaaaucacccgucuucugcgucgcucacgcugggagcuguagacaggagcuguuccuauucggccaucuuggcuccucccacaguagcucaccaucacuggccaucagagaaaugcacaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauauguuuauugcggcacuauucccaauagcaaagacuuggaaccaauccaaauguccaacaaugauagacuggauuaagaaaaugugguacauauacaccauggaauacuaugcagccauaaaaaugaugaguucauguccuuuguaaggacauggaugaaauuggaaaucaucauucucaguaaacuaucacaaggacaaaaaaccaaacaucacauguucucacucauaggugggaauugaacaaugagaacacauggacacaggaaggggaacagcacacucuggggacuguugugggguggggggagggauagcauuaggagauauaccuaaugcuaaaugaugaauuaaugggugcagcacaccaguauggcacauguauacauauguaacuaaccugcacauugugcacauguacccuaaaacuuaaaguauaauuuaaaaaaaaaaagucaucucuccaucuucuuguguauugucucugugaagauaauauguuguuuucucuggcugcuuuuaggauuuucucugucguuuuauuuuuugcgguuuuagaaugguaugauuauauguauuugcuugcuugcuugcucucauaauuauuuuuuguggauucgcugagcuucuugauucuguggauuaauaucuucaguuuuggaaauucuuuacaauuaugucuucaaaacuugcuucuggcccauuucucucccuucucuuuguaggaccuuaauuacaugcccauucaccuuugacagugucucacauugucagguuuuuucccccacucuuuuuuuccucucuguuccuuaguuuugacauuuucuauucaccugucuucagguucacuaauccugccuucugcuguguccagccuguuguuaaacucuuacauagaguucuuaccuuuuaaaaugcagguucaauuuaucuuuugaaugccuguaucuuuaaauguaguugaacugucuuuaccucucuuuucuugacuauaugaaccauaguuaacuuuuaaauccucaucuacugauuccaauaucacggucacuuguggucuguguuagucuccuuuuuccuuuugguuugaauauauggugcugucucucugaaugcauaguaaucuuugaaaaccauuguuuagaaaacaaaacucuagagucuuuaagugaucuugagaagguucauccuuuccucuauaauaauauacacaauuguaggggugugaggaaggggaggguaauguaguguacuucagucacagucugagcugagucaagucuaggucgguguucuaagguauauucacuggcaucauagaaaaaacuuuccucauaccuucaguaacacuuuuuaggauguccacaccugaaagcuugguuaguauguuauucaccauagagauuauugucugcaaauuaugcaaaauaaggcaaaauaaaauuuagcuaagcucgacuuuauggaggcuucacaaauacauuaucuugauugagaaaguuguaguaaaauacaaaauaucuauuagucuaccaaauaaaauaaaugucauuauuuaauguuuuuaauuuuaaaguuuuaggauaugaacacuauagacauuauaaagugccauuuuaguauucagcaaaguuauuuauguuacuguauauuuuacuuuguuguuuuuuugaauguguaaauaaaagucuccuaauccauuuuauauuucauugcauuuuauuagauuuacauuaaaaaauaggcauuaaacauuuuccugcuucauauccuuuuauuguuuaaauucauuuuugaggguaucuggcuguuucaugauuuggguuagcuaaaauuugggugguacuacaguuguuuucaauaaagucauuuuuaaaauuuaucauuuuguaugauauauaagucucuuuaaaugaagagaaguuuccuggauuucaugaggcuguuuucaaagacugacucauugugaauaauucagaaauugugauuagaaggauuuauuauuaaugaagagaguauuuguuauuauuuccucugagcuuauuuuuuaauuuguuaguaacuuaguugaguacauauucaugauagaguuuguauuauaaaauuucccauauuuuagcaagugacaauugaaaaauauuacucauaagcuguuugcauauucaauguauguaaauuuaccuguugcauauuugaguacccuuacuuugauuauucucccuucccauggagaggaagcuuuccaugauaaguauuuuuaaauuuuuuuucuuugugguuauugucuuuuuuccucuuagaauuaauacagaguaauuuuaucuguuguuuuuaugaauuguccuuuugcaaguugguaagaaaaagauuuccuuuuugaaaucuguucuaucugaauaauaguacuuguuuuuucuuuuugucuauucaugauaaguuuuauuuggcauauaaaccauuugaaacucguaauucuguugcagaugguuugacauugguuguuuggugguugaagauccuguccauggcauucaucuagaaacauuuacacaagccacaccagugccuuuggaauuuguacagcagguugguuuucuccuuugcuuuuucauuaugcuccagagaaacuuacacuauuguuuucagaauaaaaauuuguucgguuuuuuuguuagaaauauguucuugauuuuguuucagucauuuuucuuuuaguauuuuucuuugcuuuuuaauuuccugauccuuccauguuguuuuaguaccuuccuccuuuuguuuuccaggugucuuugaaagguaauacauuacaugguuaaucauuauuucucucauuuuuuucuuuguuuuuacucugaguucuggaaaagauuuaccuuuucuaguuguuuuauguccgccuuucguuugcuuucccuuuuaucucacauuucauuuccacuguuaucuccauuucccuuuuccuugauugauuguccuccuguucaucuuuagugaaaucaacauuagaaaccuuauaggcacgugucuuuagguuuuuggcugaaaaauggaccuaauaguguaccuauccacacaguuuccaggagaauguaaguauaaaugauaauccuuauuccucuuuuuuuuuuuuuuugguguguuuucucuaauccuuucaugaacaaaauggaauauaaauauauacuugcauuggaaucucugugcucuuaagugguauucuauugacuuuuuucugucaauuucauaaaauuuuuguuacaguuguaguuuguacauuguuaaauaucauuucaaaacugccuuucaaacuuauuugggacaugaagacauuugagaaucuaagaaaacuauugggcugucucccaagaaaaaugcguguauguguacuuucauagaacuuuggcauauguguucacauaaucccuaaaaguaaccucuggccuacuuauuacaguuuagaaagggggcuaagaauugaugcuuggaauuugaaauuuuacugaaacuuuuauuuauaccguaauuucuuuucauaaguucaagaaaaccuuuuuauagauauuaacauuacacucauuucaauaugaaggugauuaaaagacuguaagugaauacuaugcauacuguuaugccaauaaauuagaaaaauuaggugaaagaguggauuuucuaggaaaauagaaguuuugccauaguuaagaguauuagguugaaccaaaugacguuguugccuuugauggucagaaauaguuauauauugucaguuucauaugauucagcuuaauugaagcauuaaaauggaagaacuuuauguaacuaaaaaaaaaaaaaucacugaguaccaaugguguuacaagugaguucuacaaaauguucagagaugauuugcuguaugagguaucaaaaauagagguagagaguuuuccaguucauucugugagacuagccucuuuuaacuuuaaaugaaauuauaguccaaagaacuaaaugucaaaaccauugguaaaauuaauaaauaaaauucagaaauguauuagaugaacauuguauccugaccaugaaaaauuugucccaagaacagcagaaugguucaacaauaguaaauuuauguaauucaguacaugaacaucugcauugaaaggagaaaaaagauuuugauaagaguugaagguauuugcuagaaauaaucauacuaauagcucuuaguauuagacggguauguguguacuacaaaaucaaagcaaacuucagaucuaauaaauaaaacacugaaaacguuauaauuaugaggaugcuccugucacugccacuguuaacauugcuguagaucuggggucagcaaacaguggcucacagccaaaucuggccugucaucuuuuuguaauuaaguuuauuggaacacacccaugccaguuugcuuacuuauuguuuauagcugcuuuuguacuauagcagcagaaaugaauaguugcaacagagaaugucuggcccacaaagccuaaaauauuuaccaucuggcucuuuucagaaaaaguuugcugaccccuguguuagauaucugaccauugcaaaggacaauuuuuauguuguuuuuaggaauauauacuggaaagaaguagacaugaaagaaugaaguggacucguguguaccaguaccaaaagauagcuauuacauauugcugaguaaaagucaaaaacagcacaucuaguaugaucccauuuacuagcaggcguguguaugugugugcuuuaaaauuuuaauaagaauagggaaaaaggccuggaaagauaacacagcaaacuguuaauagugguuaauucugaauaaugguauuuaaaggguguuauuugcuuuuuacuuugcuuuuuauucuguuuguuuuauuuugugucauuugguuuuaaaauuuagaagauacaaaacugugugcauugaaaugucuucuuuuuauccucagcuauucagcucuccucccuguuucuuuuuauucauucuaaaauguuuuaugcuuuuuuauuguuggaauuuuuuaauuuaagguaauggaaaucagcccuucagguaauuagaauuaucaguauauauuaguaaaaaucuggaaauaaauuucauacaauuuguacuuguuaaacuuaaauauaaaugauuccucacccccauaaaaaaccccagcuguucuggauuuuugccaauaauauagaauaccuuguuucuaaaaagugugguccuuggcuuaacaucauaagcagcaccuagaaauuuguuaaaaugcagauucucggguccuaacacaggacuagugaaucaggagcugcauuuuaacaagauauucaggggauucauaggcaugccauaauuugagaagcacaguguuacuggugucucugaggacguuaguaguauaucugcuguuucucuuugaaauauagugaaauacugauacuguaguauacacauuggaagagaguacuuagagcagggguucccaagugcuggacuguuugcaucagauugacuuggaagcuauuuuacguacguaauacuguacuguuucucuuggaaccagcuguagaguuuccaauucaguuaucuuggugucucaguuaucuuagugggaugugagaaacuggauaucguuaaaaaagaaaaaagaaacaagagcuccucaggugauuguaauacauggcacauuugguagucauguauaacuguauagauccguucuagauguggcuauacuucucuggacuauaccuaacacccuaaaacagaaaaaccacaucagucuuggauaucaagcaaugaguuuauucuucugucauuccuuuguagaugaauaaaugauuugaauaggagcaaauaugaguugggucaauuaggaauguugcaucagugguugauguuguccaggacuggauauuacuugauacauauuaacaugugaaucacauuuccagagagaauuuccauaauugagcaauucuuuucugaauggauuuaagccuuaauuuucaguuuuccucuuucugguugaaauuuuacuacuauaaaagauaacuuuagcacugauuuuaguaccaaucuuauuauuaaccugaagugacacuuaauuuagaacuagaacucaaaccuuccgacuguuagccucguuaauggggauauuuuuuaaaaaauagauguguguaauguuacauugauuguguucuagccuuguaaguugauauaguuggcagccuagcuguauuucucagaguuugucauaaucuauauuuaaaauaacaugaaacacuuugaaaugucacuuauagcuaguuccaaugauauuuuuaaauguauuauaaguaauaucaauuucaucuuuccacaggcucaaagucuaacuccccaggacuauaaucugagguggucaggccuuuuggugacagugggugaaguccuggaaaagaguuuacugaaugucagccggacugauuggcacauggcauuuacugggaugucccgucggcagaugaucuacagugcagccagagcgauagcgggcauguauaaacagcgccugccacccaggacagugugagaggagaccuaccugggagacugagacuuucccccacuuuuagcuugauguuaaagaagugguuguaccuuccuaaaucgaauagucuaaaugaauccaguaguuuuuaucauuuuccuguagccugcaauuuuucuuucucuagaaaggcaucaugucauuccaggagacaaaaagaaacaaauccuuuuuauagucauaccauuucaccuaucauaguacucaaaaaagaaaauauacaaaucuauuuacagcacaauuuaauauaccagauuuauaagguggaaauucaugugcagagacauuuaacuuaaugccauguacuugauuauuuuguucuuuaaagaagacauuauuaaagaacauguugguugaauguuuauaaaagcaugauuugcuuuggcuucaucucuuuucugucagucuuugacuacuuuuguaugugcacacgaucucagggcuggugcugagcagccugcucaacagucacuauaagacaccuacuugucgggagauguuccacauuucugugcauguuuucaguaauaugggccaaaauaauggaauugauuauuuuccuuuuuggccaucacguacacauguaaucuggaaaaucauaccuuugucaauuuuaaacauaacuuuuggcauuucccagauuuauacuaugaacauugggguaauacauuuuauuuuuucauugcuauaugacagcuaaggggcaaaugauucaaguauauuuuaaaucagaaguauucaaauuauuuuuguauaauacuguucaguacuuccaagaauaagcucugacaacagccauuguuucugcuuccacucauauucucuacacauuuuaauacagaaauuuuugagaggggguuacuuuauugcuuguggguuaguaugucucuuacuucaauuaagguuacuuauuugguuugccuuaagcauuacuuuuuuaacuuugugccauuuggucuuuacuuuuuauggauguuuucaaagaaacuauuuuauauucaaucuaguuuauuuagucuacuguauuucuauuucguggaagccuuuuccccucaaauaauauauuauaucauuuuuggacuuauauaaaugauaauuaaauaaauuuuuuucuuaauacuguuggacuuuguauauacaaguucaaauaacuuuuucgaagauaguuucuuauauaaauguaauuuaauuuuuuuacucuucuauacaguucuuuagauguaaaagaauuagcacaaucucuggcaguuuuauaaaagcuguugaagcucuuguccugcacugucuuuagguaucauagguaucagguuugcuuuguguuaaugccacuucaagucauuauuugguuucugcuauuuuuuuaccugaggauaagaagaaugaauauuaaauuugaauauuaaauauauguuacuuuccaagcacuguauaaugacuguucagugaauaucagacuuccgugucauuaaaagucaugagagacagcacagagagguuauagguugccuugguguacuuuuguccaggaguaacagggacagaauacuuucuuucuuuccuucaaguacaagaaggcuuucucuaccauuugcgucuacacuuuauuuuaaaagcuauccuuuucuaguaguauuuuaucauggcaauggcaugaugacaacaacagucuuucauuacagacugaagggaagcauguccuuacuuaaaauaguucugcuacuuucccuccuauuauaaggaaaucuuacagauucuaaaaauaccuuaauuuuucuuugauuuuuauuuuaccaagucacaaaugucuuuuugauguuuugagaauuguucucauagaaucacaaauacugacauuucauuagaugauuauuuuccuagaauccccaaagagcaguggcaguccauggcuugguugaagcuagaaauuuuccugccccuggugaccugguaagccuccugcucggaaccgugugagugggugaggaagaugagagauggucagauggaagagagaaauacaugaacugcucuggccucucugguucuguucuuggcccagaguuuuugaaaagcagcggagcaugacugacuucacaugcucagcuuucucagccuuuuguuuauuuuguuguccuuagauuucccuguuguaaaaggggcaagaaaaguaacucaucaucucuaacacaccauggcagcuuagccagguagucuuaguggugguguuuaggcauaagauaugcugaucaucagucucaggccacaguuuccuucacuaaucguccagcuugaguguucuguucucuuccugcccauuuccuugaaccuccugcucuagccuuggcggagggagagugcuauuugcuuuuguucucccucugucuuaggaaaagccaucuuuaauauaguucuucaccacuguugggguuguuuugugauuuuuuuuuucuuccgaagaacuccugguuguuauuggauuuuguauuuuaauacaaauuauugaauuuuauaagcuuguacacaauauuuaauuagugugaaaggaaacaaagaaugcaggaaaaauaauuuaauaucaaccucaguugacaaggugcucagauuauucaauucgggauccuccuuuuguuagguuuuugagacaacccuagaccuaaacugugucacagacuucugaauguuuaggcagugcuaguaauuuccucguaaugauucuguuauuacuuuccuauucuuuauuccucuuucuucugaagauuaaugaaguugaaaauugagguggauaaauacaaaaagguagugugauaguauaaguaucuaagugcagaugaaaguguguuauauacauccauucaaaauuaugcaaguuaguaauuacucaggguuaacuaaauuacuuuaauaugcuguugaaucuacucuguuccuuggcuagaaaaaauuauaaacaggacuuuguaguuugggaagccaaauugauaauauucuauguucuaaaaguugggcuauacauaaauuauuaagaaauauggauuuuuauucccaggauaugguguucauuuuaugauauuacgcaggaugauguauugaguaaaaucaguuuuguaaauauguaaauaugucauaaauaaacaaugcuuugacuuauuuccaaag

SEQ ID NO: 18559 - RNA, 766 nt, Homo sapiens
uauuuaauuucagaauuaacuggaggaggaaaaaaaauauguuggcaauagaaacaaaauuggcaaaaugauaucaaggagguuuaaaaauuuacagaggaaggaaaucuuauaaauuauacuaaagugagcuuauuuuaagaaaaagcucacauuuucuuaagaauaauaguaacacuuuuuaaauaaauuuuuaaaaaauuuuucuuaaagcucuaaggagugaggaacaaacauuuauauaaguuucuauuaggcacuggaguagaaacuuaaaaccaacauuauguuauugagcccacagauuuuauuacuccuauuuuuauagguaagguaacugaaacuuagauuaaacugcuugcccaguaucacaaaacagaugaaucacagagaauucaaacaguaugugacuugcugaaccagucucuuccccaccauccugaauauuuacuucaggaaguuauagguacauaauccuauaaauauuuguugaauguaagugaauucaaauaauggcaugacgacuuuuccuuaguauacuuuuaaucuuacacuauuacguuuagugaaaacaauuuuuacuccauauuuuucuuuugaguuugaaagggcuguuuugggcuuuccugcugguaugaaacuauguucuugacauuuggauagccuccccaauuugagaaaccauuaacuagguuugagugucauuuuuaggauaaaagccacaaauguucucuagugacaucaggaagguauuugaagaaaauuu

SEQ ID NO: 18560 - RNA, 6410 nt, Homo sapiens
ucuucagauauugaugaaugcuccuuccaaaacauuugugucuuuggaacauguaauaaccugccuggaauguuucauugcaucugcgaugaugguuaugaauuggacagaacaggagggaacuguacagguauggucaguuaccagcuaaguuguguucugauucauugaaaugaguauucugugcuaagcauaaaaauuccugagauuucugcuuagcuaaucuaugcauuagguuacacauuuuucagaaaaagaaaauuauauucagaugcauuuauuuguaacuauggaauugaugcauuuuuauguaaauaauauuaaauuguuaucuguaugauuguuaaauaucugacaugaaacuaguaaagugucucuuuauauauauguucauguauauguauauauaguacauguauauauauauauacauguauauaugugauuuuuguuaagcaaauagugacauaauuuuuucguccucagaguugcaaauuuuaauuaauuacaauguauuuguuaaggauguuaaacgcugucauaaauacucuguccuugauguauggaaccuguuuuagguauauaccaaaauuuaagauauuuauuuuauuguguugagucuuuccuagugaucuuuaaucuacucacuugcaaaaauuccaccaaauucuuuggaacagcaguaugcacagaaaaaguaaaaaugguaaccugggcauuuuaaaugcuucuccuagauauugaugagugugcagauccuauaaacugugucaauggccuaugugucaacacgccuggucgcuaugaguguaacugcccacccgauuuucaguugaacccaacugguguggguuguguugguaaguaaagcuauaugaaacaaacaaauagaauuaucaaguugaauauucagacucucuugauaaugaaccgugaugaguguuugcuacaguuaacuuaaaaacaaaacauuauguggucgccuuuauuguguuucucuuccaaaucaucugcuccaccuuccuccucucacggacuugagaaccaaggcacagagaagugcaguaauuuguucaaggucucagagcuugaaaguggcagagcuaaggcaguggcccagguugccaccuggcuccuuguccaguguuuggccaggauaacccagaguggugguauagcuguuagaauaucuauuucuccugccuacuggaagggucauauagcaaaguaaaugaagugaugagaagcaaggaauuagagagauggauuuaugagccaaaccauuggagcagaagaaguuggaaggugacagggaggaggaggaggccguaaugaagguucagaaucuguggucagcaccucugaucuuaaaaaaacaauuguccagcuuuuacuaucugcacuguuacuguauuuuccuagagaaggaaauggccuggagaauuuucuggaaguauacaaaaaaagggagggguggagaauuccuugcuugaguagaaaucugccuacuguccucagugucaguuuuugggccugcagcaaauggaaggaauauuugcugcugugauuuauacacaacuuauauacuguuuucaaguuuuggagaauacuuuuaauuaucauuuacacaaacuccaagucuguguuuuccauucaaaauaauucauuugguaaaguuugagugccuucugucuaagggcuggaguugcaacagugaacagaacaagcacauucucugcuuuuguguuuacauucuagaggcagggagauaaauaaaagcaagaacaaacagaauuggcacuggaggugguuggaggagaagcgcuauguuauauuagggaugggggagucacagccuuuaaggaggggacagaccaacuggaccacugagggaagccuccaguuacaaggagaagccagugcaaggggcauguggcaggagaaggcuggcguuagagacacagcacaaggcugcuuguagcaagagaggagugaguggaggggacagggaugaggagaggaaucagaggagcagucgcccaguucgcaaagugauucucaacccaggcugcauaguaaacuccauuuagaaccuggaaaagauauugaugccuguuacacccucagaaauucugacucacuggggccucaauauuucuuaaaaaccuccuuggaacaaaggcugugaacaggcagcucauaaaagagaauagucuaaacauuaaaaaauguaagcaaacaaaugcccaaaaucauuaggaauaagaaauccauuugaaacaauuauaugaaugccacuuuacacuucauauacuggcaaaaauuaggaaaccuggauaaugugaaguauugguggggacaugagccuugaggagcauucuguucugcugguagaaguguagaccagggcagcacugcagauaauauguuugcacaaugguacaccgauuaacugucaguguauaaucaauuuuaguuuaugaguuucuuuuugaagcaauucgauuuguauggauugacacuuuauugcguucacucauucuuagugccaaaaaaacaaggacuuauucuaucucaaaagugccauaggaaucuauuggaaccuuucguaggucugaaacauuauaaaauauuaagagaucuuguuuuuccuuugucuugaaacauuuugacguuuuaucauccuagcuguuauuuuugucaauguucaacauuauguccaauggauacaacagaguaaaauaacgagaaguggaaaauuauggcaucaccuagaaguaacaugcauuagugaaauaaaaugucacuguuuuaucauccuucaguuuucuuauuauauuguccuaaggauugcaucauuuuucaagaaagugcaagagaagacuggagacaccuuacuugaaaucuucuuuuagcauuuauugaacacaguugagaauuuagaaguuuuuacuuacuggccauaauuuuuggcaaagagaaaaaaaugaaguugagucagguaacuacaaagagacagagagcagcucuuuugucuagauucuaaaggugauggugaagugaaucaucuaagcacaaucccagacuacgugucuucagagaccaauauccuaggugaauguuuucaaacuucagaaucagcaagugaaaggacaguguauuuccguagacaaaggaaauacaguauucucauccacuuagucaauagaaagaacuucaacccgcaauauuugguaacaagaaccugaaccaucccagguuuguggauucuuucauauuuucaugacguuucuguaccaaaauuuaauugauaugauucauaagcagacagagauaaaggcagguauguauaaaagguuacuggaaggaaauaugugauguagaaauacagucauuagauugauuguucuaauugguguugauaaaucuaaaaaugaaaacauuuucuauuuguggagacuuuaaagaagacggcuguccucucaucaacaaaaucaugaacuguuaauguuuucaaacauuccuuuggguauugcauuuuuaugaagcaagaacaagaagaaccagaaauaaugauaagcuagaaccuauuagagauguguuugaaaccuggaaucgguuuuuacaaacuggauauauuccaaguucaugaaugacaguugauaagcaauuaguugcauucagaagaucauuuugaguagaauaucuucaaaaccaagaaaauauagauuaaaaaauugaguuagcuaucauuaaauuguuauuaauauugcuaauaaaguuguuuucaacuuuuuucuucuguauauuaguuuuauaauauaccuuucuucuguaaauuauuuuuuaaaaugacuuaaaaauauuaaaaauuaaaggguuccuuggauguaguugguaaaugaugacuauuuuuccugacugaaggcuaaguauaggcaaauccugugaaucaacaauuccuuuuguggcuguauaugccaauggaauuaacucacaggcccauacagagacacauauaugauguucaucacggcauucuuugugguggcaggauuuuagaaaccauuuuuggagaggaggguuuuuuuuuaaaagcaauuauacaccacggaguugacagacuggagguuuacagaacaagcaugacuagaaaaguuauaaaaaugaaaugagauguaugacaaaagacauuuguguacauuuaaaaugaacacauuaaaacaaaaauauuuauuuugcaagagcacauguaaaaaguaauagcauuaaauacauuuggaugaucugguagggaaggagaauaggaaugaagaauaggaauaaaagagaaagggagggggaagagagagaaagaacaggugaauaaaugaggaauaaauaaaccuaauuaggcugggcgugguggcucacgccuguuacuccagcacuuugggaggcugagguggguggaucacaaggucaaaagaucaagaccauccuggccaacauggugaaaccccgucucuacuaaaaauacaaaaauuaacugcgcgugguggcaggcaccuguagucccagcuacucgggaggcugaggcaggagaaucacuugaggcagagguugcagugggccgagauagugccacuguacuccagcuuggcaacagaggaagacuccguccccaaaaaauaaauaaacaaauaaauauaaauaaaccuaauuagaagggggaccaugagaaucuugcagccucugagaucugagauucagcaacaaaaacaaaaugcaaaaucugagacaaaaauaaaguaaaauaaguuuuuuuaaaaagcccaaaugauucuaauaugcagccagggaugaaaauuacuuuguagacugcuaagaacucuagauuuuauucugauugagaagagaagccauuggagguugccugaccuaagguaaugcuauugaagggucacucuggcuuacagaagguaaaguagaccauaguuuagucaaggauggaaguugagaaaagaguuagaaaacuauuacauuagacuagguaaagggauaaugaugguggcuggaacucaguugguagugauuaaaaaaaaaagauaguaaugauagaggcagugguaaguagacagauuccagauauguuuuuuuuuuuuuuuuuuuuuuuugagacagagucucgcucuguugcccaggcuggagugcaguggcgugaucucggcucacugcaagcccugccucccagguucaugccauucuccugccucagccacccuaguagcugggacuacaggugcccgccaccaugcucagcuaauuuucuguauuuuuaguagagacggguuuucaccauguuagccaggauggucgauuccagauauguuuugaagguugaguagacagcccuuauuacuggauugaauaaggaaucauaguaaggagucaaaaaugaugucaaagcuuagggccugugcaacugaaaaaaaaagugaauuuccuuuuauugaaaaugcagaagacugggagagaagacggcagauuuuguacauggaggaaagagcauugacaguuugauuuuagauguguuaacuuugaaauaauuauuagauguuuaagagaagaaaugaaauaggcaauugguagaagggucuagaguucacgggagagaugagauacagaaccauaaauuugagaguucucagcaaaaaaguaguauuuaaacccauagacucaauggagugaucuggaugauaacuguagagauaaagaaaagccuuagauuaguugaucccuuaaguaucuucucuaaguuuguugcaggcuaucuuuuccaaaaccugcaaaguuagcuaugcaaguugaaacuaaaccauuggauaaacucgugauauagauuaauuauacaaaaaauguauuguauuccuauuauuggagguccaguaugucccaaaugagaaauuucuuacuaucuuguccauuccaugaguauaggaaaauauggucuauguggauuucuaaauauaggaaagucugccaugauuggcuuccucugacucaaucucgaaaaagcugaaaagcaggagauugcuugguacuuaaggauuaaaaggaaccuuucauguuaacguacaaaauuugaauuucauccuuugagugacuuuucccuaaaauggaguccuuacuauguaagcaagggcaacuguaagcuccuuuguugcucugcagacaaccgugugggcaacugcuaccugaaguuuggaccucgaggagaugggagucugucuugcaacaccgagaucggggugggcgucagucgcucuucaugcugcugcucucugggaaaggccuggggaaaccccugugagacaugccccccugucaauagcaguaaguacaaagcugaagaagaggaagaaaaccaa

SEQ ID NO: 18561 - RNA, 2567 nt, Homo sapiens
guacuccaggugauuccagcauaacuuauccaugguuugugucauuaggaguccacauccacaccucugcucuuuccuguuccuguaguguacacucccccggugacagggugcucacuggcaccccaucuuccugugaauaacucaaauaauuagaaaauguuccuuuuacugagaugcaguuggucuucaucuauucaugcucuaaacaguuccuaagcgcugacugugcgcuagacacugccaggcccgggccucgaggaggaaaagacaguagggaagacauuauagagcaugaagucaccauaauuuucccuaaagcaugcuuauugacaauugaggaacaaaguguuguggagcagaagaaggagucccucacccuaggugugagaugggauucuggaagcuuccugaaggauuugagugggaccuugugggaggcgugagaguccaugaagggggugugagggggaggguauuucuggaaaguggaccagcaugugcaaaaauauggaacugagcacgggugcaggguguucugcagaagggagaaggcugugcuagaggagccagugagggccagcauggggugggcuucacuaaggaaauggggaagguuuuagugaugggucuugcugggugcuguguggggcgcauauuggagaaggguaaugccagaagccaggaagccugcaagggaugaggccaugggaauggagagaaggggccacccacugggcaccuaacaggacaggugcaaaguggggugcuuauuaagauuccuucuuuccacuccauuuugagcaggcugcuuaaagugguggugaugaugaugaugaugauggcagcuuuauaucgagugccucagugcuugggcugguaguaguuucucuacauaucuuauuucuaauucucagaacaacccugagagaaagauauuguuguccccacuuuacagauguggauauuuaggccaaaaggaggaagugacuuguccaggggcagacaccaaaugggaaucugauuccaguggaugucucuuuucagugcacuggguggucaaugcccacucgcucugaaaucaucugacugugaugcccugccuuggaguuuagaaguugagugcaggcuugggagucagacuggaugggguagguucuaacucugccacugcuagccggaugaacuugagcaagucauuucacaucuccgagccucuguuucuccaaguguaagaugaggacaaguauaaaaccuccuuuauggguuuguugugaacacagugcagggcacauuuauaauaagagcucagucaaugguagguuucaugcaacugcugcucuaggcuggaaaaguuguucuugcacuggaugcagcaugagaagcuggcugcuaagaugucacugggggucacuaaagcugaagccugaaggaaagccucucauugcuguagagcucucccugccucucucucugggggcgauggggaaggucaggaguccagcccauucccagggugugugggauagcgauugcauuuuccuuuugcucuggaguuucacuccccuucugggucccaagggcccaauggccugacuuuuagaauugcuugcaauugguguuuucucuugaauuugggggcugccauuuaaagccagguuuccaugagcugaagaccagccauucaagaaucugaaaaguagacaagaggacuccaguugccucagguugguucugcugugcucuggaaaguaacugcagccaccagguaugaaaaggagccugguggggagaccacugcacccaaaacaaauccuuucuucuucugagaaugugacuuuuucugguguuguaaaaaagaaaaaaaaaagaaugcucauuguaaaaauaaaaaaauaauaauaagcaaggaguaaaaugugaagugucugcccacauaguccucccacauacauauguacaccuuccuaccucugccauuccuacacaccagagguaaccacugaugacaauuugguccuucuagaauuguagaauuauuugaauggauaaauaugugcauguguauauagaugcauacccacauaggcaugucuuuguuuuaauggaaucauacuauauggauuguucuguaucaugcugcuuuauuuaagaaguaaaauuuggauccugaaaaagcaaaucacucaccuuucauguaauuugagauuacauggaauaaauuauaagaaaucuuucauauaggcugggcgugguggcuaacaucuguaaucccagcacuuugagaggccaaggugggcagaucacuugaggucaggaguuugagaccagccuggccaacauggugaaaccccaucucuacuaaaaauacaagaauuagccaggcaugguggugugugccuguaaucccagcuacucgggaggcugaggcaugagaaucgcuugaacccaggaggcggagguugcaguaagcugagauugcaccacugcacucagccugagcaacagagcaggacuccaucucaaaauaaauaaauaaauaagaaaagaaauccuucauauaaaau

SEQ ID NO: 18562 - RNA, 72427 nt, Homo sapiens
cgagcagcaccgaaucggccgggagggccgagggagaauccggguggaagucgagaaauccagccccgauagcagcgcucggucccgccccggcccccgccccggggcgcucaccgcacgcccgccggccgccccggccuccggagcucuucucuggccggcacccacgcggcaucacgggaucgaaccccgcucccagcggccgcgauucggggagguaggcgcugggccgaggagguaaggggagacgggcuugggggcucucggcgcacggguacgccccucugggcuagggggcgaggcagcgcgccccaaccuucagucuccagggagaccccuccccgcugcgggacgagggggaggcugcgagcugccccggcgcagcgccgggccgggacugggggcugggcaccgggagggagcgggagggggaggagagcgggcgggaggaggcggcggcggcggcguggagcgggggugggagcggcgggaggcggccgcgaagggguuaacccuggcccgggccggagcccggaggcgcacgcacggcccgggggacccaggcgucccgcuccucgccgggagcgccccuucccccgaguggcgccccagccguggcagguaagaggccgagagggcccgggccugccaguccccugucgcccagccgguggggcccgagcccggcgugcaggccgcgcggggcccccagcggccgccggcgcaaguuuggugcgggcgggcgccgggcgggcggguggagucggccgggccccgcgcgcgggggugggaggacaaaggguagggggccgcgcggggccgggggcaggcuggggugcgggcgagggcagcgcggcagcuguaggucacggauaaugucacucacgaggaaugcccccucccccuccccugcucccgaacaggggaaacuuuugucuagcgagggaggggguuagaggccggguccuggcuucgcgaaggcugaggcagccggaccgguuuucugcgggcucugagcggccugcugucuaacuccccuccucccucagggucucgggagcaagaaguucucccuuugcacgcagcucuuuaacgcccugggacaggggugaggagggggcgccggugggacgggugggcucuaggaccggccgggaaucuggggacuggccacuuggcuuuuugcagauucgagcagcccggugugcccugcgaggcuaagggaauacagagccccacccccugaacgcccauuguugcccuccccacccaggagagcuuucagaauggccugcgggcaguuuugcccccaggucucuucagagcgaccuggcuguuugucaguuuccagcggugugaccuugaguggguuccuuaccuuccccuagccucaguuucuucaccuguaaaauggggagaaugguauuugcuagaaugaggaugagaggagugugugguauuucaguaaauggugucaugcuuauauucaacaaguacauuucacguuuacuguguguuagggcgcuggacuaauucauugcuuuacauacauucucucauuuaauucucccgcauuacuauuaaccacauuuuacggaggggcaaacugaggcgcaggguuguaaaggucacacagauagaaagugguggagcuuggauuuuaccucccucucucagccugugucucagccacagaucucuagagugucuugcugugacagcucacaguuuauuucuccuuuuuuuuuuuuuuuuuuuuuuacaacuuuggcccuguacaguuucauuuucaauugaaauuauggggacaucuguccucuuccccauuuuccccaccggcagguaaugcucucuucugccugguacuuguuccaagugaggucuugugcccuggcucuuguuagcaugggcagcuggagcaggagggaggucaguuggagacugggccuggaacuccguaaugguccaagugcuguugcuggcugcugugucuauggcagugcggauggugcagggagaagccugucucccuggcucugacuggagacagcugguggcuuugucaacaggccucucucccuagcacccagggacagccacaucuuuacuucucuuucagaccagguuacuuucagaucagcagggggcagagguagggcaaggguguucuuguguaacuuggccauggcagggguucucauugcuaacuaauagacgggucuggaugcgcagaguccuugaggauaguaauagugucaggauugcagaacccuaauggagaaugcauguguguacaggucccugagccuagcuagcucaguauugggcacccuguaggcccucaguaaauaucccacaagugaauacgugaaguggcuuagauuucugcuggcuuucacacccuggguuggcccaaucauuuggugggggugacaucuuaugaguacugaucgggcucugauugagguccuugaguaauuacuuuaaaaauggaaaacaaauugcaauuuaauuaacaacaucuuaaaucuagggcugagagagagugugguggguggggguagauaaugagagaaguucuuggggaaggaaaguuugugcauuucagccugcuccgagggguguuccagcacugugucuggguuuugcaggguuuguaggcuuuuugagggcccuggaaauagggggcccuccugggcugauaguucagcuuguaggaauaaauguggaaauuccguugcuuugcuggacauugaggggacucagaaaagcagggcauugaauggaggaguuggaaggcugacucgucauauggucagacuguccuugucauuguggucagagcaagaggaaaggccucugggggaaucaacaaguaaagggagggccccagcaagcaagagaacauggauagugagccuccugucgcaaggagguaugcgacgaacaguuuuguaaucacaaguugaggauguggucaagaauuuaagaucauaggcuggggguuggcgucugacaaacucacaaaugggcucuggucuaggcagcccagagcucucucugcccuaggcuuuggaccugcuuggcugugcuuuggccgcccuuccaugcuuugggaccaaagccaggccugcaagucucuggaggcugggccgacuucuacuggccuggaauuuggauuugaguauggcuugaaauaucuggacuguuuggaggacuuggacauucuuuacuugaaauggaacauuaggguaauuugugaaauguguauggaaaaugucuguggcugagggugacaggggacaugaaauggggugcaguccugcuggauucaggagaggcuguucugauggaggacagaagacaaggauucaaaugauggcuauggggcaggaucugaucaguuauagauggguuuuggaaggucaguggaaggaaacgcuuucugcuuauuaaugucagcaaggccuccuggaggaggaaguguuuucgagggugcagacugcgggaaaugggacaauaggagacaagauuaggucauggggagccugcagugcccugcucaggaguuuggauuuuauucuguagccuauagagaggacagaggguuguaaguagcucauugacucgaugccuguuccugugccuugugucaggcaccaugccaggcucuuuacagacaccccauugaaauaucacaauacucugcaaaguagcugcugcugcugguccccuaucccugccccauuuucagaugaggaaauagaggcucagagggguggagucacuuauagagcuggaauuugaacccaggccugaacuauuucugccuuacuguguugcuucucaggggucuuuugaccaaagaugggagcaagacuggcagaguuaagaccaggccagagauugcgcucaucaugguccugcagaaagcugaccacaggcugacucaggcagcggacugacagggaaggagggggaagcugcaggacuuuguagcugucuuggcauuuggggucgucacaggugguuuuaagguuuggggaauaacccuuaaggggcaauauuacugcuuucaaaucccugaaaggcccucuacagguagggggcauagucuuguccuucaggguuccugaggauggagaaagcaacaagggugacagcuccaaggaagcuaguccggaaguaagcugcccagaaagaaggcgagaacagcauggcugaagguaugcaaagagccugagagcugcagaggcggcaggaggaugcaucagcaggggcaggccuggguggccacucucaguucccuuuucacccaagaaucucagcauuuggauggugccuggcccaccuccacccucuguuuucucauagcuuuggagcugcccuuccugcacguccuggggaguuccauauggccuggccugcagagcuccacugggagaguccuugccguuuggaauacacucagcccagcugacugucaaggggccccuuggggaugucuggagcaguggccagagcugggcuaaggacuguacuuucacagaggauuugaacccucugcuuccauuucucaucugugaaauggggucagucucuuuuuccucaccugugaagaaauaaggcuaaaucaugaaucaggcugaaucaguagggcuuagggcaaaagggcuggugaguuuguggauuugaaagugaagacgcaggcggggguuguuccccuccuucccugcaguggagguuaaaggaggcucucuugguuucugggggucaccagcaaaguugcuuucucugucuguggggcucuuacaaagcucugccucacagcuucugucuuggagguguggagcucaguggaagagguggauguuugggggcagcgguccuggacccugcggccucagggcuaaagccaauuugccaucaaaauccuuaucuagauggaggagaguuugugcuaaguugccuccuggcccuuuuauuucuacucaccuuguuucuugaauacagauuggauuaaucuaauuuuaaaaugugcaugacgaaugagcauuuguuuauuugagggcaauguaugggaagugccugcugugugacugcagggcccccucucccacucccccucaacucucaagcagaacuggccucuuucccucucucuggcugugcuccuggccccuccuaccucuacaaaucugcucauggugaaaaugcugcacuccagucacuuccccuugcucacccuaaaauccucccuaccaguacacagcuccagggucaccucuuccauguagccaucccuaauucuccagagcuggcauugccugcucccuccuuuacauguguagaaccuguuaccuggaccucucaugggcccuucagcucuuagcuuugaacucuagcuuccuaaagacaagucuuaucuccucuaggcucuguacucuggaggcaggggcugcacaugaccgcuuuccaaugggggugggcaguguuguagaguggaaucaaaaguccuggguucaaaucaccauucugcuacuacuagcugcaugaucuaggguaaauuaccuaaauuucccuggacaucaguuuccucaacuucacaauggggauaauaauaguucuguuuuguuagggagguuaaggaaaucagugcuuugacauaguaagugugcaguaaguagaagcuguucaaagauaacaguuguuauaauuauuguuuguagcuagaggggaucuguccuuuuagagaugagagaaagaaucccuggaauuugaguuucugaacuuucugccuaauggccugagauggcaugugcagaugaggaaacugaggccuggagagauagagcaauuugcaugguaugugggaacaucugguuucaucuaggaagcuggacaggauuucuuuucuuuguuaugccucuguuuuucuucuuccuuccugucaucaagccuaaggugcucaaguuccaugggcucaaucuccucccuggugaccauguugaaggaugucuaaagauuacaccagauaaauugggcuggcugagaaggucccgcugggcuggcggcccuguggcuguccucguaaccagggacccguaccccagacugcaugggcuggagcuuuuggaggccucccacccagucucacuuugccugggaagggggagaggauggcggcagagacaggugacaugggcuuggucuuggggcaggugacuagaagauccagacagagcaaagguugagagccaggcucuggagccagguggccuguguucaggucccugcugggcugcuuccuaugugugagaccuugggcaagcuguuuagcucuuccucuguacaaaggggaugauaauuauccccaucugacaggauuuagaaagauaacacacugugagcccaaucuaugugaauuaucguuauuauuguaguugauauuauuaacuaaggaguucauuuaauccucacaacagcaaugagagauaggcacuauuauuauucccuuuuagcagauguagcaagcaaggcuuagagagguagguggccagccuggagaaguuuagucccaggggauuacagucagggcccgcugcuuucugagggguugcucuggccagaggagguagacuugugugaggugcuggagggcaaauccaauggguagaugggccaggagaggcugacuucaacucaguguaaugaggagacuuaaaaaaaaaauuagagcaagccaagauggaagggauugugucugcagggagcgagcucccuguuucuggagguggaagcagaauccuggagcucaugugaugaagaagugguggggauggccucguucagaccugaggucuggcuccacgagggagggcuuggauuuuuaucauccuaggcuguccaagggaucggccugucugggcaggucccaggguggcauuagguggagguuugcuauagucaucgcugcacggcagccaccucugguuuacaccaccagccuugcaaguaugaccugcccaggcagaggccagaugaggagaaaugaguguugucauagcagggccuuuacucaugcugcauccucugccugcauucauucccucccccucuccuuaugcccgggcaacuccugcuaaugcuucugugaguguaagcaccaucuauucauggaagcucuuccugauccaccugcaggcuaagucagugguucugaaaguuggguucuggaucaguagcgucagcguuaccugggaacuuguuagaagugcagauuaucuagcucuauacuggaccugcugaauuagauauccuggagggugggauucagcaaucuguuuuaagaaccuucccgcugauucuaaugcaugcugaauuuuuuuuuuuuuuuuuuuuuuuuuuuuugaggcaaaguuuuguucuugcugcccaggcuggagugcaauggugugaucucggcucacugcaaccucugccucccagguucaagugauucucccaucucagccucccaaguagcugggauuacagaugccugccaccaugcccagcuaauuuuuguauuuuuaauagagacaggguuccaccauguuggccaggcuggucucgaacuccugaccucaggugaucugcccaccucgaccucccaaagugcugggauugcaggcaugagccaccgcaccuggccgcgugcugaauuuuaagaaauacuaggauagaucauuaaaaaaaaaaacugaugccuguuuccuugggcucucuuguuuucagccuauucagucacccagcagaugugggggacccagaguaaagcccagguucucaccacccuguuuucaaggagcccccaucuuguaacagcucccuaucccccaggaaacaaucucgugacacaaugaugggauacaacagaaccccaacaugauuauaggagccagugcuggggcaacaugaggaaggcaggauuggggagcuggaagagcaggggagauuuuguggguugcaagccugggugccagagacauggcagcucucuucuggggcuggggccagggcagggguugggcagagagcaugggcucugccuuaaagaauagugugcuuagggccgggcgugguggcucaugccuguaaucucagcacuuugggaggccaaaacggguggaucaccugaggucaggaguuugagaccagccuggccaacauggugaaaccccaucucuacugaaauacaaaaauuagcugggcauggugaugggugccuguaaucccagcuacuugggaagcugagacaggagaaucgcuugaaacugggagguggagguugcagugagccgugauucugccacugcacuccagccugggcaacagagcaagacuccaucucaaaaaaaaaaaaaguauagugugcuuagguguguauaugcacacguguguguggugugggugcacacauaugcgauuacaauggccauauguagucugagggggcugaguggccuuaacugcuaucaauccagugguuuuaagcaucucaauaauuuuuuuccuuuuuuuuuugagacggggucucacucugucacugagacuggaaugcaguggugcgaucuuggcucacggcaaccucugccucccagguucaaaggauccucccacuucagccuccugaguagcugggacuauaggugugcaccaccacgcucagcuauuuauuuguguguauuuuuuguagagaugggguuuuaccauguugugcaggcuggaauccaacugaacucaagcgacccucccaccuuggccucccaaaguguugggauuacaggcaugagccaccgcacccagucagcaucucaauaauuucuuuuucuuucuuucuuucucucuuuucuuuucuuuucuuuucuuuuccuuucucuuucuuucuuucuuucuuucuuuucuuuucuuuucuuuucuuucuuuucuuucuuuucuuucuuucuucuuuccuuuuuuuuucagagucucacucuguugcccaggcuggaaugcagugaucuuggcucacuacaaccucugccucucagguucaagcgauucuccugccucagccucccaaguagcugagauuacagaugugugccaccacaccuggcuaauuuuuguauuuuuaguagagacgggguuucaccauguuggccaggcuggucucgaacucccgaccucaagugauccaccuaccuuggccucccaaagugcugggauuacaggccugagcuaccgcgcccggccucaauaauuuuuuuuuuuuuuuugagacggagucuugcucugucacucagucuagagugcaguggcacgaucucagcucacugcaaccucugccuacuggguucaagugauucuucugucucagccucccgaguagccgggacuacaggcacacgccaccacgcccagcuaauuuuuguauuuuuacuagagacagcauuuugccauauuggccaggcuggucuugaacuccugaccucaugauccaccugccucggccucccaaaguguugggauuacaggcgugagccacugcacccggccuaauaauuuuauuuuuuuauuuuuuauuuuuuuuugugauggaguuucacuuuuguugcccaggcuagagugcaauggcgcgaucugggcucauugcaaccucugccucccggguucaagcaauucuucugucucagccucuugaguagcugggauuacaggcgccugcuaccacgcccggcuaauuuuuguauuuuuaguagagacgggguuucaucacuuuggucaggcuguucucgaacuccugaccucgagugaucugcccgccucggccucccaaagugcugggauuacaggcaugagccaccgugcccggccuuaauaauuuuaaugaugaugaucauaauugcugcucacauuuauugacagcuuauaaaugcuugcugggcacuuccaugucaccucaucagaagcaauccccaggacaauccuauagguaggcaguaucaucacuauuacuguccccacuuaauagaugaaaauacugaggccacacagcuauaaaaggauagaucuaagaauucuguggagauauauagagugcuuaaaggcaugaucucauuggaaggagagcaguaggggauugucauggaguguuuguaucauaggcacaacuuacggugauuuucuaaagauguccccaaauauauauuuugucaaaugagugaauuaugcuuuggaggaagguggaugggauuguguuggggugguuagggcuccagccuccaagcuggggcuuccacugcagacauuguuguucuccuguuuuguggaugggcugucugaggcucagagauucaguagugaguucaagguuccacugcuagggcaaaagaacaaaucagagagaugaaaguggaucucuaacugggcaugguggcaugugccagaaaucccagcuacucgggaggcugagguaggaggguugcuuaagcccaggaguucaagaccagccuggacaacauagugagacccugucucaaacagcaaaaagaguagaucuccuuugguucuaacaagaggggaugugagauucaagaucagagcccacuguccacucugcugucuuuucgugccucgguguccccaagcugcugcccaggagcccaagggugggcagucuuugucugacacaggaaccccuucacuucacauuuaggggauugaggccuaguggagcagggacucacccacggccacacagggggucagaauuacuguugaggccagaauccagaauuguuucaguuccaaccaggaagggguuuguuucccaaaaccugucccuaccccaccccuucuuuggcaggcggaguagcugucgcccucaggguggcccagagcagugcuggggguagagaugaaggugccuugugaagacacugccaagaagggguggggcaacuuccaagaggaagagcaccaagaagcccaaaccccagacggaaaccaaauguauuuucugggcccugagaggauauuuggaacaauggaggugggaugagggaaguuaaaaagggcuucuugauauccuuagaaaaaaaaaauacaggcuuuaaguuugacuuuuguuucucugaaggauguuuguguaacuuucugaaggcaggaucccagcacucugugaagcuugucagaugcuguuuuuuuguuuuuuuaaauuuuuauauuuuuuugagacagagucugcucuguugcccaggcuggagugcaguggcgcgaucuuggcucacugcagccuccaucucccggguucaagcgauucuccugccucggccucccgaauagcugggauuacuggugugugccaccauacccagcuaaauuuuuuuuguauuuuuaguagagacgggguuucaccauauugaccaggcuggucucgaacuccugaccucaggugaucugccugcuuuggccucccaaagugcugggauugcaggcaugagcuaccacgccuggccauuaggugcuguuuuuauagauucagggcuuuggagcugggaaggacucgaucaaguagucuccucacuuuauaguuggugaaauggaggcugagagguggggggccugcuugaggucacacagugaggcagccgaggucuuggaucuuccuauguguugcaagaggcuguccaucuugacuuaccaccuccugggaccuggcuggcaugggggcugggcggucacugaugagggguucccuucaaaaugcucauugcugcuggggauaggauaaggccaggucuggucuugggcaagaugagcccacugguggggagaaggcugagaugguacaccugguaaugccacccucauccagaugccaggcccagcugugcaccgucugcccagcagcugggagcugugagucacacccaguggauacagaggcgcaggccauugugugccgugauucauucuguucucccggccccgaagggaugacgaggcccugagcaccgauccaugcccacgccuguggaugaaagcugauaugaggaggcccaggggaccugagggagucggcucccucugcuaccuccugucucuugaguauccugugaucgugaccuguccauucccaccagugcagggguccaugagcccccaaaggugcagugaguuguaggcauuucuguguuuucuuuuucugaagaaagaguuuguugguuucaucagaucaucagaaggcugggugucccuguggagugcugacggggccgugugcacugcgggcuugagaaaugguggcagcguggugcaaauagaaaguagccugguggcaguguagcauccugggucaggguguggucuuggagacgggcuguuggcuucugagcuggcaccuccacuuaggagcugugugacauuggguaaguuacuuugucugugcuuccucaguaaaauggcaauaacaguauuuaucucaugguguuauaguuagacuuuuagguaaguuaauguuuguaaaggacuuaccucgugcuugguacaaaguaaucauuugguaaaaguuugcuguugguaguucuagcucugcuaugaauuugcugagugaucuuguaagugucugauccuggggucuuagucuccaccccuggcuccgcacucugugcugggcuuucuaggagcugcaggaccagcuuagagagcaggggugggcaggggagguaggggaaacccuuucugcauucugggacucccuagcccaggcccucccuggcuuuguccugaggcaggguuauguaaccagccgggucuggccaggcagggcacgauucucaaccuccuuuugucccuccauugucucuuucucucccuuccccccacggagcugucguuagcugaccuguuccucaagcuccagggaugaaauuggacccuugcuauucugccaccaauugauuuaguuuaguccagagguuugcugggcuggcggccccuccucccgcuaccuggggacagcacuaaacugauaccucuaugccugcuucaugccuccuuuuuggggaggaaacacaggagucuagaugacuugggcucuugguccagccugccagguuguagggacaggauguuccugccuauggccucugaaguucuagagguacaccccacucccuauccaggauuccuuccccagaagagccuucuccauccuugcagcccagcaccaaugccuucucuuccaggaagccuuccaagguaccucagcugcagggaaguuggccucuacugagcuccacaguguguucucugucccuuuuaagaaaacagaggucacaaacuggcaggccacauuugcccuaugggcagauuuuguuugguccaugccaaauauugagcugguugccaaccagagguuuuacauaaaaacucagacuucuggcuuuauuucaaaaauuggaagacaggaaaaccuugagccuacauucuccaggggucauugcuggaggugaggcauguacacuucaccccauccccagccagccauuucauaugcuuacaugaucuuucuggucacuggaggcaucugaguuugcaacccuguccuuaagcuaugaaccacuuucucuccuaccuuguuccuuugugggcucuucuaaggcagcggguguaagggcugugggcugaaucaccuuugugucccucgaagcauggaagcauuggagcaucaugcuuaggcucaggacgguuuccccaguaggagcauaacaagugcuuccugugugaaagcagguguggccauggucuaucccuccagcugugaagguuccauuugcuagaggccucugggucagccugcucugugacccucgaauccucccccaagauaagcucugccugcguagccacugacccaggcggcuucuuaagcugcagauaacagucccugaaagggcgggccccacccugcaguguaaccaaggagaggagcauccaccugcagcugucaccaggucuuacucucauggugggcuuggaggaguuuagggaggggaggacugugcucagcagccuucagaggauaucagguccagaccucugugugcugaggccagcagggugaagagggguguggaccaguucagauguuuacuggccugggcuucuucuccauugggccucucugugcuuucuccuccuagaguauguugcuuuauccgacagcucccuuguccaacugucugucccgucaagguuuauuuaacucauucaauugaaaucuuaaguauucccuggggccugcuaagaugucuucuccuggaagaggucuuagcugagagguugcaauuguucuggcuacaggaaaaaccugggaagcuugcaaaaaugcaugcagauugcugcccccacccgcugccuccugcucugauucuuucauucuaggguguagccuccccauccugagaacauucagaccagggggucuauagaccacucuuuaaggacugucuuagugcauggagcccagggcugguagggaggagccuuggguggcuguugugcugggcgacauuaaccaugccccuuucucucucugggcuacucuuuugcccccugugccaauguucugggcuuccccaguugucguggcugagugcaaugugagcuauccuuggagaggauaacacagaguggauuggggcaggugccagugucuggguggggugagggcugccaguccuggccccacccuagccaggcccagaggaguuucacauucacauuagggaacaggucaggagaggaggcagacugaaagccuggcucaaagugggcaagugcugugccccugguaucaggccccacagggaaagccuggccuggguggcccagugaccuggccacaggcugaggggcucuccugcugugugguccuguggcaggcaggcugaaacaucaagugcaggcaugaacaagccauuuacagccggguaaacugagguacauagagggaagacacucuccuaaugucacuugaguggguggaaagcugggcugggaccccaggucuuccaaugccaggcaaggccacacucuuccaucuccaccucccucugcaggggcaguggcagaucaucuagcugggacaaucaucugauugucuaugacgaccuaguuagagccuggaaaaaugaaccaucgucacagccaccccggaggcaugaaaccgguugggugugcaaauuaccccucaaacauucuccaucccauuuuuuguuguuguuguuuugucuuuccuuaaacuaucugaugggacagcugccucugugcccgcuuccgccugacacugggcuucgugcucuucauucugagaacaaagcuuccuucugauaguccuccugcugaccacaggaaaagggcaagcguagcaccagccucccuccucugccuccucuugcugggagcaugggguaggcagccuuggauggaugcuggaaaggccaugaagguggguggcggcgguccaguccacauucccucuggcagcccaacugucaggacucagaaguucucccucauggccaaaaggagaggaaaaggcaccggacagggacaaacguaaagucuugucauccauugguccaagcagucaauuggacuagaacaggacugggaauuuggcugggaacuggccaggcgaaaacccucaggguuuuagcuggcccagguugagucuuguaucagccucuagccccuggucuguaggggcuguguaagccuaaaguuguguguucagaugagggagacaauagucccucauucaguauauuuguauuaaacaucuacuuugguccaggcucuuuucuagaacugggaugcagcagugaacaaaacacauggagacccuguuuuggacguggggcugacauuugaguggugggaugaaaugaacagcccaacaagcucacugucagguggugagaugugccuggaagaaaaauaaaacuggcuugugggucaagagugugauuugggggagugacccagccaugucagguggucaggauggucccuggugaggggcaguagacuccgggaggguggcccacgggaaauugagggaagaauuuuccaggcagagggagcugcagggcaaaggcgcuggaacuggagggcauggguggccagaggcagggcugaaagaaugagaggaugguggaggagaggggccagagggcauguggagacagguagggccucuuggccauggggaggacuuuguuguuugagucugaguggaggggaagcugcuggcgggcccgaugugaggacugacugguuuggguacacauuuuagagagacugcugggggugaggguggacgcaggaugacuagcugggaggcugcugcagucuugccacgagagagguugggcgagucagugguggguggggacggcgggggagcaaccagggguugguucuggauuuauuuugcaggaugagcugaugggauuugcugauggauuagauguggggugugagaauagaguguugaccgcaagguuucuggcuugaggaacuggaaggacaguuggacaguauugcuauuuaccaagacagagaaggcugugggacaagcagguuugggaagagcaauuaagauuuggggucagcugugcugggguggggccuaugcuggugggggaggggcauggugcacaugggugcuggguccugcauguuccuguugcugucaggaacagcaacagggguugugugaggggccccaaugcuaggagucuguucugugagaacaaauguuuccuggucccuucauguccuuuucucucucugcaaaccucccucugcuuuucucuuccuuuuggacgaggaaaaaggcagauucugaagccucauugucacugugaugguccuagccuuucugccuggcaugccuccugacagggaguuccuucugggguaggcaagguugggggcggaagggugggguggagguucaggccuuauccuggcucugcuaccaacagagcucuuugccuugguuuccccuccuguauggagaaggguugagguggccccaggguucugaggguggcagggagcauuugaggaggccacauggcacagugguuaagaaucugggcuuggggucaggcaggcaugggcaugaauccuugccugcugcuuggcugugagacuguggacgaguaacauaaccucucugagccucaauuuucucaucuguagaaaugggccagugauaguaccugccucacaggguuacugugagguugaaugaggaaauguccauaaagcacuuagugccaggugcagugacucgugccuguaaucccagcacuuugggaggcugaggcugguggaucaccugaggucaggaguucgagaccagccugaccaauauggagaaaccccgucucuacuaaaaauacaaaauuagccagacacgguggcacacaccuauaaucccagcuacucaggaggcuggggcaggagaaucauuuguaccugggagguggagguugcuuguggugagccgagauugugccauugcacuccagccugggcaacaagagugaaauucugucucaaaaaaauaaacaaacaaaaaaauaaagcacuuagcaaggcccuggcauauagcacaccuaguaaaccaaggccucugcucacagugacccaugcaggcaggcagguaaggggcuuggccuagugagugggaggaaccgugggagguuauugaauaggagcaugccaggcaugugguuugauggggcagcugugaguguggagacuugggcugaguuuucuuagcaaguccaagagccccuuccaccuuccagagugagagcugcgggccggcccuaauggaccaucuuccuuucccuagccaagggucuucauuggcuuggcaugggcagccucuguuuugcacaggucccuuggggugggguggucauuuuccuuaaggccuccuauaggaccccuugucucuauaucccaguggcuagccuuagggaaaugugagggaagggcuuugggggugugugacaucaaagggacuuaauuuacguguagguagggcucuggacagggcugaugggucaggcggauccuggaguggcaguccacuggacacugggagugaccucgguuucuggucugcauccaggcuggguggugcuugcuccagcagagccguggagagguugacaauggguggaauguggccccuucagaacccacacuucacuggugcccaggcaugccagccaagcccucugcuucugcaagccuguuucccagcaguugagcugugccaggacagccaaggacauuucagaguccccagggcucauagccaggcugucaccgggcauugcuuauuuucccagggcccaggagucuucagggaugguggggguucuggagauguuccaaggacuuuucuuaacagcuugguaaauugaggucuggagagagcaaggcacuugaccaaggucucacaaggccgccucccucauaucugccacuccccucuguuuccguguccucugcacagacuccuggccuucugccuggacguuuguaacaaccucccucuugugggcucccuaagagcuuuguuuguccuccauuaucguaaucuugccauaaucugccagaugcacacacuauuugaugugucuaccuccuguccccuccacugacugcccgugacagagucuccccgacagagcugugcagcaugagguuuaggccccaggcucuggagccagucugaacucuguuuggaugccagcucugccccuuccuggccuggugaccuugggcaugauacccuacuuuucugagcugcugucuuugugaaaugaaaacaguagcaauacuuaguugauaggaaugucaggacaguuaaaugggauaacgugugaaaugcagaguacaacaccugguaccaaguaaacucucagaaauggucaucauugucccaaaggcccaucaguugguugaacuggaaagucgugagcauggaggaguagacccaagcuuggacugggaggcagaggaugugggcuccaaguucaucucaaacauuguguuccugugugcguguugggaagccacuuauccucuggaaaccccacuuuccuuuucugagaaagggggaagaaaucccugcuauacuuuaauaaaguuggcaugugauaccgcagcaaugccugugaaaaugcuuugcaucuguguaaugauuuaaaaauggcacagcgguggcuguggugugcugauggcgaugagggcauuguaaccacaguggugggcagcuggccgggcuggaggcugguucaucuguggaaugcuuagugcccacacggacuuccccaucccugccuaccugcucccggcuguccaccagccugccuucacauuagccccggcauuauaugcuagaaaaugugggaggugcaaagagcugauggcauuuccccagcccugguggguuuucuguuaucuguggcugaugccauggaauguggggauuaagaaccagacagaugcugguucgaaucucagcuaagcacuucccaacagggaccuuaagcaaguugcuuaaucucuguggaccucaggcuccauauuuguaaaaugaggccaugaucaaguagaggccaagcauuuaacaaagagcccagaacauaauggcaucaggugguuguauaauguguauucugccuggaacguggucacugacaacguggugacugacagguuaucgauggcaggaagcuggggccacugugcccauuucggggauuugcugcagaggucgguuaugcucccuacagaauaacccagcuuagauuuaggagggucuauggaaucauauggcaugauucaauuuuuuaaauuaacucguuuuuuaaaauuuuauuuuuuuuagagauggggucuugcuguaucucccaggcugcagugccauagugcaguuguagcucacugcggccuugaaugcccgggcuuccagcaauccuccuaccucagccuccugaauagcugggacuacaggcucgugucaccaugccuggcuucaugauucuguuuuaugugaccaaacugaggccgagaaaggagugguacuugccugaggucacaggcagguuguguaagaaggccgggccuaggaugaggcaagugaggcaucuaagugcagcgucucaggaggugcccgcugugugcuugcacauuguggagaauaagaaccuuuguuuuugagagagggucuagcugugucgcacagguuggagugcaguggugcaaucugggcuuacuguagccucaaccuccugggcucaggugauccucgcaccucagcccucccauauaacugacuauaggcacacgccacuacgcugucuaauuuuuguaauuuuuuuuuguagagaagggguuuugccauguugcccaggcugguguugaacuccuggucucaaacuccugggucaaccugccuugagcucccaaaguguugggaugacaggcgugagccacugcaccuggcagugagcaccuucuaaaaggcuccucgcgggccucaccugagccuaguccugggugaguuccugaucuaggacuggaacccuggucuccuggccccaugaacuguucuggaccccugcgagguacuuuuuagagucucgcugaggccuccuauuccucuuuaaaaggagccucugugaaguaggucacccagugcuuuuugcuccacguuucuguucucuagcuguugucuguguccuagagaaagccgggcccacuugcccccaccucuccccaccuucugcccccucccccugccagcugcgccuccauguaaguacuuugagucccuuaacaccccaaggcguguugguggccagcuuuugucgugaugacaagccccagcaagucuacagggacuggcugcuuucaugugggcccucggugaagccuccuuggucucagcaggcccuguguuguacccaccaggccucuaggagauuagggggcuucuguggcuccagauggcucaaagcuuuucccuuccucuguguuaucccuagcccaccuggcuuccguccucacuggccacggggcuugggggauuuucagucucuccaaggcucuggcaucuuccagagugggcuagucuuggaguguccaucugagccauucuuucugucaccacugcugggccugccugcugggccuuaggugacuucuugagagguggccaaagcugcuaaucccuggaaggggcuccuaggauuucccuguggcuggcaggacccuuggccacccacguggugugacaugaggagccuggaaagccagcccaaccuccauccuuaagccccacguauaaacauaccuuuuuuuuuuuuuuaacugcagcucucagagccugcaguucuacuguugucagguugccuugugcucuccuuggcauccucuaagaaggcaaauaccuuuucagcugggugcuuuuaagcauuugcugucaagaagcaagcccuggccagccuggcccuuuuccaguguucugugugaccguggccaaguugcuucucuucucugggucucgucuuuguaagacccuuuucagcucuagcacuuugaggcuccagcauggauucuuacacccuccacaccuuugccggucaccuuucuuccuucucugcaggguggggcacagggaagggccuggcagcugagcuggguggggccaggggccaaaagccagcaucauagacacuuuucccuccagcugggcauaccaguccuuccucuucuucucaggacagguggggaaacugaggucuggagggggaagggccagggcuggaaccaggacccaguuauccuuauugccagugagugcuccuccugcuguuggcugcuaccucucuugagagggucagaagacccacuagcaugagggucagggacaugcuuuuuccuuucccguggaaggcuccuccaggcagggcuugggugaggcaggcgaggugccagugguucccugggcacggggcagaaucggaggaggacauccucuuucugagguuaaggagguaggggcuggaggccuugacaagggagguggcaugaaggggcguggagguuucuaggaacgugguugguggcgcagggugcucuagggccaccucccucccuugcuucugccuucccuuucuccuggggaggggacugggccaacaguaaugccauuuuuccuggcccugggauuaggugcagccguguuaaggagaggacauucgagagggcguggcgaagugaagaggaaccucacgccacugccuggagcuccggugggucugggucuggucauugucucgcuggcuccuguccacucugaccacugucccuggcccccugcccuguccaguccuuccagguccaucugaguguguguguguguguguguguguguguguccccaggagggaucuggggguacaggcuggcacuugagccuggcacuggguccugccuucauuccagaucagaagcagcucccggaacugccccagggagaggucuaggcugaccuggcagauuccugauggaggagaaggaggaggaggcugagggaugggaaggaagggcucaguuucuccuguggcuucuccagacagcuaggcauguccacaaauccaccugaagccagcagguccaagaguuuaaagauuuauuucagggccacgggggaagcugaaauggugagaucccagggcucucagauguuguguuuguggcuuugguccugucuagacugugagagccauggcuugucaaagccagaggggccccuagagaauuuccauguucuuaacuuggcuuuugaugggggccagucacaaccacucugaauuugugugucuggggagagaaucugcuaauagccaucauuagauucucaaaggguucuauaacccccagaaggucacagacuucuccucuaguccauaccccucacugcaguugcagaaacugaggcucagagaagggaagggacuugcccagagacucacaggcggcaauggaggcuguggcacccccugccucugucuuccugccagcauucugccugaccuuacaagcuggggaagcuuggcucauucaggggacaaugaccucucauccccugaugagaggaaggggaugacugggagggaaggacugggaggcuguugugguuuccaggcccgcauggauuuuggcuucugcauccuugagauggaggccccugagucugccugugccuuggaaucucucaggguguaucugaggccuggagucgggcaugcgggagggugggggcuaguggugacccacauuucccagcuccucugcaggggaggcagauaggggagaagcucagggugugauaaaauuguuuuuacuucacugggcauaaaugacaaauaaaugaagugaggguugggaagugcuugguagagcgccuggcacaugccaggccgugaggcgaggugcucaccauuguccuuugcggugcccugcuagcugagaucuccugcuucugacccucgcuccugccucuuccuuagcaugaggccucugccuggggcaggagguggccccccuuucuuuauuuuuuuugagauggaguuucgcucaggcuagagugcaauggcgccaucucggcucacuguaaucuccgccucccagguucaagcgauucuccugccucagccucuggaguugcugggauuacaggcaugugccacacaccuggcuaauuuuguauuguuaguagagaugggguuucaccguguuagccaggauggucucgaucucaggaccuugugaucuacccgccucagccucccaaagugcugggauuacaggcaggggccacugccccgagccgccaucccccuuucuuauauuggggugucugaugggggcgugaggacccucuggcugaaguccugccuugcuggguuccauggugcaccucucugcagugcaggcuuucccaggaggcugaagcucagcuagagaagcugggucagcagcccugggccuggucaccuccaggaagccucucuccugggcugcagaccuggcuugggagugguguggaaaguaggacugcagaaggguaacgaacaggggcuguggggugggcugggaggggcauccuagcuccaccucugcccagcugugugacuucgagcgguugcuuacccucucugagccuccauuuccuugucuguaaagugcucauagcagugacaccucuuucaggguguuaggauugagcgugauggagcagguaaggcuccuggcacagccccacauguucgcaggagcuuaacguuggccgccaguaagggagguuaugauauguguugggauaugcugcuuuguuccuuuugagugucugugaucugagccuaaggaaaaaauaguucuggauggauuugacucugucauaggcagauuuggggauagggugggcagagagccccauuuugggaagauuuguggccacugcauaacauucugugugauggaccugacagccuuggugugcgugaagagccucagugggacugucaggacugucccguccuugggacgggaggguggcaggugaccugccguguuccccacacagccccacccccaggcugucugguauguuugcucgguaagcccuuuuuuucagagcugguacaaagguaaacucgcaacucaggcccuguuggaagaaggacacauucucaacaagugaggucuaaguuccugagguuuucuguugggccuucccugccagggaacccagaacagauucacaaguugagaaccagggagugaaccaguagugcuuaaugcuuuguuuccuuguugauugacggaugaucugugagcuacuuccaagaaagaucacuagaggcugcuugugauacuaaaacacauauaaaauggaugaaaacaaacacagacagaaaacuauugaaaaggaauggagaaagggaugugcagggcaucuggcaaauguuagcugucuuaggugaucacagaggggcugcggagaugggggaugaggggcccaggcucuggagcccagcagcugugugcugaaguucccauucacccccuuauuagcucugugggcugcagcaagugacuggccucuuuggaccucaguuucucauccguauaauggggggaaucuaggucauggugcugugguaagguugaaauaauggcauguaacgcagacauggcaugucucauaaauggaaguuaauguuauuaaugcauuuagcuuggagaugccgcguagcagauucacagaggggaagguaauuggcaagggcacaaggcucuugaguaccugcuguggguaggagauggcuugugccuuggaaagcuuucagugaaguugggagccccauguucuaguugcaagaacaacugauaccugguguugcguggugggauguggagcaggggagcucaaucaggacuuuagaaauccagagcaggcuuguucaccucccugcugaggcuggcauuggaggaggagggacaggguuuuaauggacaagaaaauggaccaagguaaaugagaguggggcacaccagacggcacaagccaggagguccuuuccucucucugggucucaguguccccaggggcuuacugcaggguagacugugcucucuguggcccugcgacucugagccagaccuccaacagucucuuucccggugguggugguccuggacucuggggugacugacaggcggcagcuuggcuccuggccaggcagcacugugggggugaugggggauggggcauguagcagauuccagcagaggaagggauuugcuucuggucucggccucccagggauguaaucacgcuggagaaacucccgcacagcugggaagcaaauguggaggauuuuccuugcugagcuggaugugguggguggggcaggcugugguaggguggcugguggagcugggaagcugugggguguggcugggugggggugaugaugugacugugcugggggugugacuggcugggaggggcuggaucagcuauggggaguggcccugggugcauguggggcuaccuguuccccaggccugcagccacugcuacgcccuccccugcucaggucccugcccaaguccagguacccacccauucacauccuucugagguugcuggcagagcucuuucugcacugaccuccucucagcccccaccccaugugcauguggcccagaugccuaugaugaugccauuugagccugucaugugcaugugaaugugguguguguguugggggggcagggagcagugugugguccacagagggcauugucaagagugaccuaggcuggaaauaaaaugugggcugggugagcauucaaggcccugggcaccuucccccauucacugcagccaugucguaccagagacauaaaaccuuggguuccagagaccucuagaaacccuuguggaaaggucauggucgccacugcauuuucagugccuaguggcaugcuuggcaccuaguggugcucaguaaauacaggaugaggaaacaggucguuugcuuguuccgcacucccagaaagaucucgaaccuccuuccuggaucccauucucuugcuccuucccucuggcgucagccuggccucccuuccucucucuuucucaauucacuacuaauuugauauguggccuugggccaguuccuuccugagccucacuuuccaaaucuguuacugaguaaucauuuuauuagcuuauauuaccaugugccaggcacugagcucaguguuuuacaugccucaucucucuuugucuugguagcugcccugcaagauagauaaguaguauaaaccccauuuuagauuuagugaaacugagguucagagagguugagagauuugcucaaaggucaugaggcugguaaauaauggagccaacauucaagccccagcugggagccacugcacccgggaauuaccuguaaucccagcacuuugggaagccaaggcaggaggauugcuugagaccaggaguucaagaccagccuaggcaacauagggauaccuugucuguauuaaaaaauuagcugggcaugguggcacacaccugugguccuagcugcuugggagacugagguaggaggaucacuugagcgugggaaguugaggcugcaguaagugugauugugccccugcacuccagccugggcaacagagaaagacacugucucaaaaaaugaaaauaugcugggcacaguggcucacgucuauaaucccagcacuuugggaggccgaggcagguggaucacuugaggucaggaguucgagaccagccugggcaacauggcgaaaccccgucucuacuaaaaauacaaaaauuagcugggcaugguggcaggugccuguaauccccacuacucaggaggcugaggcucgaaaaucgcucgaagcuugaacccaggaggggaaggcuggagugauccugggcaacagagcaagacucuuaaaaaaagaaagaaaagauucaaagauucaagcucaggcaggcuagcuccagucucggccuuuaacuguuaugcuagcugucaccacuagagugaaauagaagggugugcacagcccuucuaaggaggccugcuggcgcacaguaggcaugguguacaugugaguuggguuacugggcacaauucaccaugaaaggcauggcuugcucagucuccauaccugcuuuuauggagcucuuggucucauuccuggagcccacccauucaucacaggcccaagccggacccccuucccuggucccagucucuggacagcuugcuccuguaagaaggcccuuguaccucugccccuuuucucuuauggguccggggcagcauuuucagguggggauguuagauagagugacuucaacuccagagcaguggccacgguuaccgugguauuucccgaaagugcagcguugccauggcgucuccaugacgaccagagcaucucauucauuauccucagcaccuuggcagggaaagcugggacuagggcuaggggagugcagugggagccuggcugagggcugugggccacuggccuuuguggcugagguuccccucaugccccugccuaccccaagccaagguuccucugcaggcucuggaguuaucucccacccauggguucuggguucacauuucagcucugccacugaacaguugugugauguugggcaagugacaaccucucugagccuuauuuuacucaacuguaaauguggauaacaauauuaguuguaaggauuacaugaaaugagguauaaaaagugcuggcugggcgugguggcucacgccuguaauccuagcacuuugggaagccgaaguggguggaucaucggaggucaggaguucaagaccagccuggccaacauggcaaaaccgcauaucuacaaaaauuagccgggaaugauggugggugcuuguaaucccagcuacucgggaggcugaggugggaaaauugcuugaaccugggaggcggagguugcagugagccaagauagugccauugcacuccagccugggugacagagugagacuccgucucaaaaaaaaaaaaaaaaaaaaaagugcuuagcacagugccaggcucauaguauggcaguauucauaaugaugauaauuauaauguuguugguguuauuuuuauuguaggaacccuuggguuucagggaggaaugaaagaccaaacucaaagucaggaaggaaacccauuugagucaagauuuggugguuuccaugugacuguggcaagucacuucaccuugaagucuuugucuccuuaucuguaaauuggaaauaauaacagcugcucauucauucauauccugaguauucaauaaggaccugacccugggaaaagugggagcuuccacgaugaaucagacuugguuccugcccuugaguggcacccgggcacugggggaggaggaagaaaggacacuguuuugugcugagggcugugugugccgggugcuggugagggccugugcagaggucaguaagcccugguccugccccacagaucugcaggcuacaggagguagagccaugugcaggaaugcccccaguuuacucugcacagaccacaugcucaggugcacccaggggcugggcaggaagccagaugaaggaaagagguuggcugugagacuguacauagagaugcugaugguguuaacugcaggauacacagcccauuugaggcuggcacucuaagugccucagcugaugguggcaggugaggaugugugcccagugucaccagaacuugcccucuuuagagacaaguuagaaguucugacuuuuauauaaaaucuccugauuuaaaaauguugcuaacgaaucccaaauuaaagaaaaauacugugcaagccaaagagcacagucugcauuuuguuugggcuccaggguccugguuuucagccucugcaccguggaguggggaugaggcgggagccugaggaaugagacuuaggagugggagagggggcagugguuggugaugacuucagaggggucaugacuuuggaaccuggaucuugaaagaugaguaagugucccaagggguccggggaggcauuccaggcaaugggaauuucaucagcaaaagccucaaugcuuccccgagauuggugacuggcugggugaggcuggaauuuaggggaaacugcuggugaugucugcaaggcccagcaggcccaggguggugggggucauugaggccucagccccagcuguccuugaggccuugguggcugcagggggacuagaagccccucaguuacuuaccucuugagccacgggaguucuggagugcaggcgggugaggagggccuuggguggaggguggcagccucugaguggguugcagaggggcugugcuggaagcccccuuugccagccggcugaguggcuggcacuuugcuacaaagcaacuggcuuccccccacccacccccaccccaggguauuuggccuucucugaggacaggggcuaccuugcucucccucugcccuggguuuugccauggccuuaucuucagcuucuuggcuucuauccaggcagccagccagcucccaguaagggccacagccuccaaagauagggcuacuuuucagacaugcugugagaggaggacggcagcccuggcugccuggcccucuguguaauaaguguguguggugccugccugccucagcccuugcucucccucugugaaaugagcugcccuccccugccugaguccuggggcugucagacucucaagagagggaugagcuugaaagugcuucgugagcuaagcugugauccacaucgugagggauugucauaaguauguuaaauaagcaacaggggugcgugauaacagcagcugugugccaggcgugguucugagcaucuuauguaucaacucauuuaauguucacaaccuugggaaguagguagaauuuccauuuuacaugcuaggaaacugaggcacugagaaguuaaauaacuugcccaagauuacauagcuacuaaaugguggagcuuaguuuugaaucgaagccacuuggcuccagucugcacguguaaccaguaggguccaucaaucuaggacuuuaggucuguggauggguggcagggaggcucugaacuccuugaaauuauuaugauauauauuuuuuugagacagagucucgcucuauugcccaggcuggaguacggugaugugaucucaccuuacugcagccucugccuccuggguucaagugauucucuugccucagccucccgaguagcuggaauuacaggugccugcuaccaugccuagcuaauuuuuguauuuuuaguggagaugggguuucaccauguuggucaggccggucuugaacuccugaccuuaagugaucugcccaccucggccucccaaagugcugggaugacaggcgugagccaccacaccauuaugacauuuucuaguguguguguguguguguguguguguguguguguguguguguauggcuuuauuguuuagauuuuuaguuuuacauucacagcaaaauugaaaggaagauacagauauuucccauaugccuucuuccccugcacacacacacagcuucccccauuaucaacaucccccaccacagugguacuuuucuuuuuuuugagauggggucucgcucugucgcucaggcuggaaugcaguggcacaauuauggccacuguagccuugaccucaggggcccaagugauccuccugaguagcugggucuacaggcacaugcccugacaccuggcucauuuuuuuuuuuuuuuguagagaugggggucuugcuauauugcccaggcuggucuugaacuccuggccuuaagugauccuccugccucgaccucccagggucaggggacugcaggugugagccacugugcccaacccagagugguaaauuuguugcaacagaugacccugcauugacacauccuuaucacccagaguccauaguuuacuuucggguucaccucugguaguaugcauucuguggguuuggacaaauguauaaugacauguaucuaccaucgucgucucauacacaguaguuucacugccaaaaaaauuuucuuugcuccgcugauucauacucucaacccccaaccucuggcaaccgugugcauuuuuuuaaugcgcauauuuuuuaugucugaaaaaugucagauucccacaggguuucguggcucccacauuccugagacucugagcugcaucauucacacucugaaagauuguuaaucugauagagggucacugaccacagcacucaagccugcgaggaguggcugguggcugcucuccuccgcuuccaugggauuggguggccaacgugggcagggcgccaucagggcauccccaccuccuauccacugugcuucuguccuggcccuaggccaagggguggggcugggcugcggccacaggcugcccuuaucaaugguaaaugggacaccuggguacccugaguguaaacaggaccagucaccccagccuuccuggcucugcccaggacaccugcuccuucuugcccugcucucagcuagaauugcagggagucccuggaaagugccacacaugcucuuaucuccaagcugugguaugugccauuuccucugucuaccccugcccaacccuuacuuuuucuucuggucagcuuagguacccuuccuccaggaagccuucccuguccccuccuucccccugccagaagaguuaaggaccccugagcucucccaaacccccaucccauccccgucugucacacuuaucccccugcauugcagaugccuauuuucuuggcugccucugguuccucaggguacuggcacugaaauguagaauaucagaggugaaggagcccccggagaucaccugccccaacccccuuguaacaugcaggaagcccagagggagccacacagugcaucauggcagagcugagaccagaccuguugucccagucaccuccucauuucacaaacaaaaagcggaaauaaaaaucacccagagauaaucacuguuaauguuucuuuuuuugcauuuagcaccaguuucuagccuaugcacaaaaauauuuaacuaaauuaugaccgcacguacaaacuguuuuauaaauguuuuugacuuugacaauacauacgguaauuauauuucuaugucaguacauguccuucuccaacauauuguaaauggcugccuaggauuucaucauaugcuuguauuauaauugcuuuuuuuuuuuuagauagagucucgcucugucgcccaggcugcagugcagugacgugaucucggcucacugcacccuccgccucccagguucaagugauuccccugccucagccuccuggguagcugggacuacaggugugugucaccacgcccgacuaguuuuuguauuuuuaguagagaugaggucucaccauguugcccaggcuggucuugaacuccugaccucaagugauccacccaccucggccucccaaaguucugggauuacaagcaugagccaccacgcccgacccuuguguuauaauuccuaaauacaaucucccauuguuugggauuugcuguuauaagcagcacuaggauuuguguucuuguggaaaaaucuuuacacacuucugcaguaauaccucuaggauaaauuccuggaagugcagcugucgggucuggagcaugcuguacccaugcugagcacaucauauagucuuggagcuggaagggauuucaaagaucuuuacccucuaggcugggcccaagccuugaauuccccccuggccucuuuagcccuggcucuuacaccuuccaucuagaccugggcaacucuccuucuagcuuugagcugcugugacugauaguugcuccuugggggccaggcguggugguucaugccuauaaucccagcacuuugggaggccaaggccggcgaaucaccugaggucaggaguucaaggccagccugaucaacauggagaaaccccaucucuacuggcaugguggcucaugccuguaaucccagcuacccaggaggcugaggcaggagaaucacuuaaacuggggaggcggagguggcagcgagccgagauugcaccauugucuagccugggcaacaagagugaaacuccgccucaaaaaaaaaaaguaagaagaaaagaaaguugcuccuuggguugcugggaaaucucacuucuugugacuucauuacuauuuaagggagacugguagacuguguuugggguugcuguuugggaugagacaauuggggccuuugugucguguauguacgucuucguuaacucuuuccagugagaugaguauaggaggcguggccugggugcaggcggugcgggggguucaggcugagggggaggcuggaacccagaguuauggcugccuggguggacagaagguccagggcgggggaggccuccccucugcauccugugguggcaguauggcgauccucaggaaggcuauuuggucaucuguuguccugggcugcugugugcaccuguggguacguaccccgaggaugagagauaccugguugcauuaugggcaaauaugacagcugccauguuucuugugccaagcuccucagacauauuuacuuaacgcucagcuacagccaugagcuacaggggugcugguguuacagauuagcucacugaugcuuuaaagguguaauggucaccugaggccuucucacacagcuaaggcacacaugcccugcagccugcuaaugaauccuggcuuggcuucauucugagucuucagaaugaaaagacugauggagacucagucuuuucaucuaucauauggggcugcugggcucauucaaagagagcaacggguuaggaagggaauggaauauggugaggaugugguauucagucgugauuuagaauucuaccucuaguucccaggcugugcaaauguuuaucaucucuccccauccguccugcuccuggauuuuucuuggccuagucuuggacucugauaaugaucaaaaauagcaacuccaauuuguagauaccauaugcuagguacugcuuuaagucguuuacaaacguuguuggacuuaauccuccaaccccuuaugagauggguucauauuauuuauugucugccccauuuuacaaguagggaaacuggggcucagagauauuaaagagcuugcuccaaaucaugcaaccuugguucggcagccguacuugcauuugggcauuccuaggucagcuccuguguguccacaguuagcugaacccugaagcccgcacucugacgcuccuguucucuccacucuccacagccuuagccccgugggccccacggagugagcggcaugcagcacccccgggccuguccaguguccucuggccugcugcccugcacccccagaaggcccugacgcccuggggcacuucugcucugcacaggaccacgcggggguuugccauggugacauaaaggggcgcggaggaaggaaggagcgugaccagccuguggacugcgccccuggcugggaggaaggacugggggcccagauccuccacucccagugccccacaagggcgucgcuuccuaagucucugugaauuuguuggucaguggacgauucucgugucuccuccuguguggggccuugggguagccagggcaggccgggccuccgguggccaaggucucggaggccaggaugccugcccuggcaugccuccggaggcugugucggcacguguccccgcaggcuguccuuuuccugcuguucaucuucugccuguucagcguuuucaucucggccuacuaccuauauggcuggaagcgaggccuggagcccucggcggaugcccccgagccugacugcggggacccgccgccuguggcccccagucgccugcugccacucaagccugugcaggcagccaccccuucccgcacagacccguuggugcuggucuuuguggagagccucuacucgcaacugggccaggaggugguggccauccuggaguccagccgcuucaaauaccgcacagagauugcgccgggcaagggugacaugcccacgcucacugacaagggccguggccgcuucgcccucaucaucuaugagaacauccucaaguaugucaaccuggacgccuggaaccgggagcugcuggacaaguacuguguggccuacggcgugggcaucauuggcuucuucaagguacacaagaagcaggguccccgagcaguucagagcccccucugcagcucagugccugaauucucauuugugaaauagguguaaugguagcacccgccuccugggguuguugggaggguuaaaugagugaguauauguaaagcacugggagcaugcggugcccacugccuggcaagugcuuuguaaguauuaggggagcgugccagggggaucgccugcugugcgugggguccagcacacagcaggugcuugccuaaaggaggccacagaguaagugugaagucagaggagcaugcucugcuaggugccccaaaaucugucaaggcaaucuccccuagggagggcgugugcacccauuuuucagaugagcaaaccaaggcuccggguguuaaguuacuuaugugagguuuugcagccuguaaguggagaagccgagauuugaaccuagacauagacaguuugggcucucuaucccaugcucuucccucuugguggugguggaguauggcguuaauauaccuccugacccagagccauuuugcaugaggagaaagaggagaaugaaaucccacuggcagauggggagcugcucugggcuuuauggggcuuccagaaugaccgccgggauugggguccuugcaggaagggugucccagagaaucuguccuuggcggggggagguugggaauggugggcgggggauccagaggcuguggucagagaagucugaccugcaagaugaaagcagacacuagcugggacucuuaguuggaugcuuuggagguggcagggaauuuguuccuucauucaacaaauauuuacugagcacucacaguguuugugguccugugcuagcggugaucgaaguggacaaagucccugcugucauggagcuggcauuucagugcuuugggagugggugggugacaggcagugagcaaauaaacacaggauggggcaggugugaucaguacaaaaagaaacaaagcagggaaaggacacagaggguagugggggugggagcuugacauuauuuuaggaaagucgucuuugauaaagugaccugaaauaaaugaggggaggagccauguggcuuucugugcaaagagucuuccaggaagaagggacguuaagugcacgaguccuaaagcagccucuugcuuggugugagccaggagaggaggagcgggagaugggucagaaguggccuguguccgcugcugggugcccguuugugccaggccuuccuggugcacuugcgcacugggcccugucuccuggagggcuucucauggcguguucuuucacacccuaauacagcaggaagcucugccacugaaagguauugugagccaagaauuugaaggcccuuagaaguccugcaguagagcaaccagugagauuuguucucaacuggcuugaucacaaaacccuuucuuuuacagagcacccucaggggaacgcuggccugguuuauggcuuuacaaugacaucaagucagauuaucuccauugucugguugucucuuuucucuuggacucuguacccuuuccugccaugaacuucguuaaguucuauucagagucccaggccugaaaagcgucaagaggcugacguuuauugagugcucacucagugccaugcaccgucuacaugcguugugcagauucacgcacuucacacgaaggcagguggcuagcagccugauuuaagauaggaggaaacugaggcaaaggaggauaagcaauguguccaagccuacgccucugaugaguauaggucugggauuugaacucaagcaguccggccccagaggccuuagucuuaaccacgaugugaugaguccaggagccucacauaccacuuauucaggagaagugacaucagaggccacacccagugcacagagcucccacagucuuuggggaccaggcggugggcuguggccauugggcguaauugguacaauggagcuugggcgcugucuggccccaauuccuugcucugcagaagguaaacaggaggccuagggaggggugcgggcauguucagagucucaucguggggccagugguaauuccaggacuuggugcucuuccuacccuguugccuaggacaagacuauccuugguuuugagcagaggccugugauuuucugcucaaaugcaugcccucugguggucaaggcacaucuuuccacucuuucugcaagaccaacuuccccgcugugugcugggcuugccaaguggggauugucugugggcuccagggaucugaaaacucauuuuccaguucccacugaugcuggauucccagggcagugugagagcagggacuuaaaaguccagacagguucaaaucucucugucauuuagaaacagagugacuuggguaaaaugcucaacucaucugcaaaguggggcuaauuacagcugcugccucacuggucuguguugaaaacaagacaguggguggggagcacugagcccauugccugguaccggagccacucaauagaugguagcuaucgugcuuugucaucuccagguucaguaaacagcagugguagcacuguguccgucuuguggcccugaccaaugugugccccugugagauccuggaggguggugggaauagggucauccucaucuggaucccuacuuccuggcacugucgugccucaaccuugaaauuccaggugaccuggggcuaaacacacccuggcaggggucuggcaaggaguaccugaccucuuucauugagcacuuacugugucccagucacugagcucggugcuuugcaggcauuucauggcuaauucucacagcuauccugugaaguaggcacuuuauuuucagauaaggaccugagguucaaaaaguuaaauggcuugucccgaaugacauagcuacagguugagugucccuugucugaaaugcuggggaccguaagugucucagauuuuggaaugcuugcauucuacuuaccaguugagcaucccuagucugaaaaucugaaauccagaaugcugcaauaagcauuuccuuugagcaugaccuuuagaggucacauuggugcucaaaaaguuuuggauuuuggagcauuuuggauuuucagauuagagaugcucaaccugugguaagucauagagccaagaucugacagucaagcuuguuguuucuaacccagccacaggagcaaaugugcugacagggagccugaggcucagagaggagauguaggauucccaaggucccccagguaauggugaggucugugcuuggccuccaccucugcguucccgaaucagggcuccuccucccucugccugggggaccccauuggaagacuuggugucuccggaguggguacucaguggugaggagcaagagggauuuccacugcuguggggugaggccugcagugaggccagccucucggugcugaggcccucuauucccuucuugccugguucauuucauugccaauggauaggccaucagugacuuggcuuccucccuuccuggauggcugggcagcugacugagccuccagcaccuggcagucagcucagggucgggacuuugaaaugggaucccucagcacccgcgguccaguguggcaucccaggccucagcaggcgauggacaaggccugaaaugucucuggccccuaccgcuuuuguccccacacagcccaaguaguucccagccuuggucagggcugucuuaggagucgugagcagccuggaguuggggagguagcugaggacuggucugugcgcugggccucagcaccccaggcuggcucaggacaggguggggagguacucuugauguuuggagaaucacaugcaggcuacuuaaugugguuuacaaggccagggcccugcagagccuuuuugggaauuagaggagaugagugaaaggcgcucuucuggacagguacagcucugcaacgggcacaggcucagcugagacuuuacccugcccccgccacugaccugcgcaccccugugugugcucccugagcagcucuccugggggccccacacaugaccccaucucccccuccaaacucauuuugcuuugcccugccccacucacucuccaggcagcagccacauggaucuuuuuaaaaugcaaauuagaaccugucauccuuugauggagucuuugagggcuuccugcugcugcuucaauccuccagcacccugcaggccuggcuccagcugaccuaucugccucaucuccuccuuucccucuuggucacucugcugucuucuugcuauuccuuggucaugcugaggccuguccuaccucagggccuuugcacuugcuauucuuggccucuaccuuucccuuuguuugugcuuguuuguucuuuaaauguuagcucaaaagucccuuucuccaggagaccuccugagcccacuaacugugcccaguaaucuacuguuccacaaauaugaaccuccucuguguagcaugugccacacugaaguuuuauauuuauuccugugauuucagugaaugucucucuucccuccuugauuuuaagguucaugagagcaggggccaugucuuuguuuuucucacuguaucacuggcacuuaaaacagugccugacacagcaaauaguuguggaaugaacagaugaaaccuguauugagcgucuaucuaugccagguacuagagagcuggcuguuccucuuuuauuccuuuuaaaaauccaguucugcauugaauuguguguguuccugcuggguaucaagcugggcacuagggguccaaaggcgaaacaucauagccccuaaccuuaagggguugcaggcuggugggagauagaacgcugaaaauauaauauugcagcugaggugagaaaugcugcagcugaggcuuuaacauggucucagggaggccagugcagagaagaggguauaugcauugggugugaauuaugagcaggaguuugucaggccaagaagacggaauggaauuggcacaggaacaaggacaaauuguaccauauucaggggcagguggcugagagggugaggaaggucaugaaggaacaggggcugugagccuaaggaagaggggacuggggcacacugucuucagacuuccagggagcugagcagccacaugccuugagagaagggaggcagagacuucaccacugauggcagugaccgggcaggcaccauagugagggaguggccucuggggugcuaggggcauauggggcacccccagcagaaaccuccucuuugaacaucugcauuggcauccacauaagaugucuccugaagaaaagguugcguggccagaggcaguuuggaaaccccaggcaaccacgccuaaugguuaggugugugggugcuagggcucgaccucuuggcagcgauucauagcuccucccaaccacugugcuacugagggcagcaugccccuccaagccucgguuuucacaccugugaagugggauacgcaggcugaugugaggacugaaugagcaguuucuggucaugccacaggcccuauucugagcacguugccgguauugauacugaucauccucuaccacuccuggaguuacuuucuguucuuagccacauuuuacagcagaaacugaggcacagagaggugauauaacuugcccaaagucaggcagucuagcaggauucauguucucaacugcuagauuuucuucuaugugguuuagccucucuaggccuccgucugcuauguguaaaauggguaugagagcagugucuccaucuggggucauuggaggauuaacagcauuccugucugcaaagugcacagcaccuagugccuggcuuugguaagugagucguguguuugugaguauauuauugugcaggguggagcgcagggccaggguggugagcccuccaugaauguuggugaauauugauaccacuguuaugguccacaugugagagacuguguccuuugggguucuggaugugacaguucuguuccccuuccugcccuccauugacugcaggccaaugagaacagccugcugagugcgcagcucaagggcuucccccuguuccugcacucaaaccugggccugaaggacugcagcaucaaccccaaguccccgcugcucuacgugacgcgaccuagcgagguggagaaaggugugcuccccggcgaggacuggacgguuuuccagucaaaucacuccaccuaugagccagugcugcuggccaagacgcgcucgucugaguccaucccacaccugggcgcagacgccggccugcaugcugcacugcacgccacugugguccaggaccugggccugcacgacggcauccagcgcgugcuguuuggcaacaaccugaacuucuggcugcacaagcuugucuucguggaugccguggccuuccucacggggaagcgccucucccugccauuggaccgcuacauccugguggacauugaugacaucuucgugggcaaggagggcacacgcaugaagguggaggacgugaagguauggccgggggugcuagaccgggcaaggcagguggggccuggcaagcuucagccuucaggugccccaucgugggugugcccugucugcaucuccccuaugcugggaguuacuuaaaagacagucccacucugcuuccuguccugccaguugguucuuauuaauugucuuauuagaagcaaguaucauuuaaaacuugauugaagcauuggccaggugugguggcucacaccuguaaucccagcacuuugggaggcugagguaggcggaucacuugaggucaggaguuugagaccagccuggccaacacagcgaaaccccaucucuacuaaaaauacaaaaaaaaauuagccaggugugguggcguaugccugucauccuggcuacacaggaggcugaggcaggagaaucgcuugaacccaggagguggagguugcagugagccgagauugugccacugcacuccagccugggugacagagcaagacucugucucaaaaaaauuaaaaaaauaaaacuuuauuguauugaaguauugaauaugaggaauuuugcaucuggaauguggaguuuaaguuuguauaauauguauggaagaagacauccagacaaagaugggagcuguacaaugcuguuugucugccuuuaauuuaaauaugauuuuuaacucuuaaaaauguuuauguuaaugucagagcgccuacaaaacucuuaaaauaaggaugagagcuugaaucaugcaugaggcagauuuuaacugagguguaaguagacaguggaaugcauguguuuaauucaaaaaagguuugcuggccgggugugguggcuugugcuuguaaucccagcacuuugagaagccaagggaggaggauugcuugagcccaggaguuugagaccagcuugagcaacauaaggagaccuugucucuacaaaaaauaaaacauuagcuggguguggugguaguaguccuguaguccuagcuaucugggaggcugaggcaggaggauugcuugagcuugggagguugaggcugcagugagccaugacugugcauggcauuccagccugggccacagagcaagacccugucucaaaaaaaaaaaaaaaaaaaaaaaguuuuuacuaaacaaaacuguguaaaaguacuuugcagaccacaagauuuuacacacaugugaacugucauugugagaaacagccuacaaauuaagaccauuaaacaaucuuuaaaauacaguuuucaucuacucacuauuuuauuuaaacuuauucgcaaaggagauggcauccuaguguaaauaggaaauccggaucaguugccauaaauagagggcaaccauaacaauaaauccaaugaaaacaaaacagggggauuaaauucuagagacauucugcugccugcugacagccuguccucucuuauaggagauuagcaaguguuagaaacauauuagcaccaaacccaggcuugucuuugauguuagcaggaggcuuuaaaaagagacuuguaagaggaauucugaaaucucugguagggguuggcccuggggccuggaaggaggguccugguggcauucaucgcccugccuuggucaggagugaacuuugcucuuccuuacaccucuagagaagagcagaauggaugacauucgggagcaggcacugucuggggaguuaagaccuaauuugaaucgaguccuaauuugacccuaaugaacuaggugacuugggcagguccccucccaugccugagccucagcuauaaaaugaugaaauggggugaaugggaaguuuucaggcuauuuccuggugcccaggggucucccauaggugccuggauagcugggguggggguuagggggauguuuuggugccaggcucagcccuccaggcuccaccuuaguugcuccagcggugcugcuuugcgcugcuuuuacgcauuguguuuccuccugaaauuccauucucuuaaaggcucuccuguuuaaagaacguuuuagccuuccagucuaagucuucaugcagugccaccaccugccucuggcaagguagauugcucuguguucuacucgagguguucuuccaguggcccaagcucauuuucuccugcaggaacccagguucuugcugucuguccagugaguucuggagagacugugguccagggucagguugagccugaggagaucagguuccugggcucacuguguuccuauaagcccugaauuucucucucuuauuaauuuuccguauuuuaaauuuuuuuuuuuuuuuuuuuuuuuugagauagagucuuacucugccacccaggcuggagugcaguggcgggaucacagcucacuuaagugauccuaagcacaagcaauccucccaccucagccuccugaguagcugggaucacaggcacaugccaccauacccagcuuacccagcuaguuuuuuguagagcccagguuuugccauauugcccaggccgaucuggaacuccuggagucaagugcugcacccaccuuggccucccaaagugcuggguuuaugagcaugagccaccgcaccuggcccuauuuuuucuauuuuuaaagugaaaggaaugauagcaguuugaagccauuucuauagaacaauagaaauagaaaaauaggauacaaaccaaaaauacaaauagaggcacccucuuucacacacucagcucaguccagauugcaaagugcuucuccagccacaauccuacuugccuuaaacauuuuugugaauaagaaagggcagaguuuuuuuuuuuucuuuaaucccaagcacagccuacaacagagcccuucuuucagagacaugaaugucgccucauuagcuuguacaguacuggcuguacagcgcaauuuaaauaauaccaauagcagcugccuauucagggcuuggugaguccuugugcuuagcccuuucuggccguugcuucauuggguccuuacagcagcccugugagguggguauuguucugagucccauuuaacagaggugggcacugaggcucagggaguugagguaacuugcccaaggccacacagcuggagcaugcacguccaccaggcggugcacggcccugguaagaugcugauggugacuacauugccuggggagggccaggacuuuuaguuuguaaaguguucugauagcuggcucuuacagguuucuuuuuucuuuuucucucuuuuuuuuuuuuuuuuugagauggaguuucauucuuguugcccaggcuggagugcagugacguuaucucggcuccugcaaccuccgccuccuggguucaagcaauucuucugccucagccucccgaauagcugggauuacaggcgccugccaccacaccuggcuaauuuuguauuuuuaguagagacaggguuucaccauguuggucaggcugguuuugaacuccugaccucaggugaucugccugccucagccucccagggugcugggauuacaggcaugagccacugcaccuggcggcucuuacagguuucugagcugcuuuguggcucguguguccuaaccccagaguacaccuguguguuuguuucacaagugucaguguccccucauugacucgaagaguacugggugcacggugcgcgggaagaccgcauugcugggcacacagugucccauccuuggaaaggguauggcccuuuaaagucagcacugcauuccaucagcaaagagaaauccuccacauuugauagaugaagacacaggcuuacagcggcagugaccacagacguagcauuggccaccauuuuucaucacuuaccagaugugaggcaguuuuacguacaauaucuuuuuuacaauuguuuaaucuuuuuagagcagggucuuacaguuggaccuguguuggauucuaacugcugggcucaagcaauccuccugccuuagccucccgaauagcuggcauacaugcgguuaucuuacuugauucuuccaagagccuuaugagggagauauuaucaucccuguuuuacauuugaugaaaccaaggccuagaggaaugugaagccuuuucaaggacacauagcagagcuggguaggauucuagauuuucccuugccagaggccuggcggacggcagcauagggcugguuucaagaguaugugaucugugcagccacacagagccccacgcucagagggagcccauuaugugguuuaaugccugcuguugccuucuugacauucuuuuuuuuuugagacggaaucucgcucugucacccaggcuggagugaucuuggcuccaguggugcgaucucggcucacugcaccuccgccucccggguucaagcgauucuccugccucagcuucccaaguagcugggauuacaggcucgugccaccaugcccggcuaauuuuuguauuuccaguagagacuggguuuugccauguuggccaggcuggucuugaacuccugaccucaagugauccacccaccucagcuucccaaacugcugggauuacaggcaugagccaccacgccguccuugacauucuuuauaauuuuugaacaagggauuuccacguuuuuucacugcccucagugggaaaagcagggagcuccuggcuuucccucacucauuccuuucuccccugccuguccuaggcccuguuugacacacagaacgaacuacgcgcacacaucccaaacuucaccuucaaccugggcuacucagggaaauucuuccacacagguaagugggccugccccugcccucacuagcaacuuccaggacuccucagcacccaaacccucaaagcacccauccaugagggcagcggguggguuuacuggcccacauuagaggcagaggugaccccucugcccccguggagccaacagccuacaagagcagucacaacccaggcagaggccaucuggggacaacagcagcggcagcaacagcagccgcuugucccucccuguccuuucgggcugagcuggccuggguggggcaucuucucccucuugccucucccuccuaucuuuuacaauuauguguauuauuucugcuuauaaaagaagcugguugaguuuuaagaacauuacagaaacauguagcauagaaagugaagaugcccuguaauuguacccaccuuggaugaccagugucauggguuuauuuuagaguccuaaggguugagggugagggcuauagguugcuuggugcgcacuuuccuuccucuuuggggcucucucacuugcuguccucucuucaucugcuguccuucagggacugggcagaaccccucagcuggucaucugcagugaccauucccccuagcugccuucugcccaggccucagugagacaaccucucuugaauucuaagaaaaccauuuauucaauaauucagcagauggagggguauaugcaacauagccccaaagccaaauaggagugauccuggguugucugucuguauuuuuuauauucuuuuuaaaauuuuuuauauauuuuuggcugggcgcuguggcucacgccuguaaucccagcacuuugggagggugaggugggcauauuauuugaggucaggaguucaggacuaccuuggucaacauggcaaaaccccaucucuacaaaaaauagaaaaaauagcccggcgugguggugugcuccuguaguaucagcuacuugggaggcuaagucaggaggauugcuugaucccaggaguucaaggcugcagugagcuaugaucgcacaacuguacuccugccugggugacagaguaagacuccaucucaaaacaaaaagaaaaaaaauuauuuauuuuuagagacgggaccucucucugucacccaggcaggaguacaguggugcaaucacagcuuacugcagccuugaacuccugggaucaagcaauccuccugccuuagccucccaaguagcagguacuacaggugcaugccacuaugccuggcuauuaauauuuuaaaaauuuuuguagagauggggccuugcacuauguugccuaggcuggucucaaaccucuaggcucaaacgauccucccaccuuggccuuccaaagugcugggguuucaagugugaaccacugcaccugguuguuuuuuauauucauaacccuuagcauaucagaggugguuauaguaauaugucugagauagagggucaaacauccuguauauauacaaagagcuuccauagauaauuagauaaaagacaagugaccugauuuggaucauuggaauagaaucagagcagguaugucagagguagaagaaacccuugagaucauugacuccagacccugaauugugcagauggucccaaggaucuagagagcagauagucuuggccaaggucccccacugagucaagggcacacucuagacuagaauucagggcucugggcuggggcucugucugcuccugugcuguagcccagauaacucuuccaggcagcuccugggugggcucuggccaugcucucccauccccaggcacaggcccagguuagagggccucauggcccagugggugguucugagcugccuguguugcugcagguaccaaugcugaggacgcuggggaugaucugcugcugucguaugugaaggaguucuggugguucccccacauguggagccacaugcagccccaccuuuuccacaaccaguccguguuggccgagcagauggccuugaacaagaaguucgcugucgugaguaagauuccuugcagggcagagcggggcgggcuaagggcugggcuggagguccagacugcuggccucuugcugcuuuugcagucugcucugacggauuuuuacuaacaccucugggccagggccaagggagagcugccuuuauagccacugucuccuugaagccccaagagaauaaccccuuuacagacaagaaaccaaggcucagggaggucacaccagcuacuaagagguccagcugggacuuaaacucaggccauuuguuuccugugcccaagcucuuacuagaaggggaggcucuggaaagcuggaagagguggucaaugaggagggaacgagcccuaggugcuagguagaaugaagagaagguaggaaaggcccucguccuugucccucacuacaggguacuugaguccuuugugcuagaggcaugugcaccggaccaagagucaggagaccuggguucuaaucccagcucugccaguugcccacacugagauucugggcacauuccuugcccucccaggccucagcuucccaucuuaccaugaagucucagaccagcagccaugccgaccuaaccucugauuucucucucccauucuacaaaggggggauaaggcccaaaggggaaggaccccuaugcucacccuggccuggucauccucucccuaggagcauggcauucccacagacaugggguaugcaguggcgccccaccacucgggcguguaccccgugcacgugcagcuguacgaggcuuggaagcagguguggagcauccgcgugaccagcacggaggaguacccccaccugaagccagcccgcuaccgccguggcuucauccacaauggcaucauggugagugggccccuggaagcccaggaggugggagaauggagagcacagucugucaugugugugcauacgcuguccugguaagcacggcucugguuugcuggcuuagggguugcagaucagcuucugcugccuccucuggcacccgaggcucucugccccagggaaggugggcugccacuccgaccccuuucaugagcucuuucuuagcuuuugugacagaggaucaagcaauaaucagcauucuugaaagagguuucugaugaggaugugggacagggcucuguuacagucuuuuugcugauuaaaaauuuuuuucuuggcugggccugauggcucacaccuguaauccuagcacuuugggaggccaaggcaggcagauugcuugagccuaggaguuucauaccagccugggcaauguagugaaaccccaucucuacuaaaaaaguacuaaaaaaaaaauaugccuggugauuagccaggugugguggugcaugccuguagucccagcuacuugcagggcugaggcaggaggaucacuugaaccugggagaucgaggcugcagugagccaagauugcgccacugcacuccagccuaggugacaaagugagacucugucucaaaaaaaaaaaaaauuuuuuuuuccccuggggcuucuaccaugcaucuaucccuuuuuuuuucuuucuuucuucuuuuuugagacagaguuucacucuuaucuaggcuggagugcaauggcacaaucucagcucacugcaaccucugccuccuggguucaagcaauucuccugcuucagccucccgaguagcugggaagacaggcauacaccaccaugccuggauaauuuuguauuuuuaguugagacaggguuucuccauguuggucaggcuggucucgaacucccaaccucaggggaucugcccaccuuggccucccaaagugccaggaauuacaggcgugagccacugugcccagccucacaucuaucccuuuccuuggcacuggggacacagaaaugcacagaacggaggaaaguuccugcccuuguagaccugacauucuaguggcaggagacagaccauaugcucaugcauguguguugugggaagucagggaccccgaacagagggacuggcugaagccauggcagaagaacauaaauugugaagauuucauggacauuuaucgcuuccccaaucaauacucuugugauuuccuaugccugucuuuacuuuaaucucuuaaucccgucaucuucauaagcugaggaugaaugucgucucaggacccugugaugauuguguuaacugcacaaauuguuuaaacaauaugaaaucugggaaccuugaaaaaagaacaggauaacagcgauguucagggaacaagggagauaaccuuaaagucuggcugccugugggccagguggaacagagccauauuucucuucuuucaaaagcaaauaggagaaauaucgcugaauucuuuuucucagcaagaaacaucccuaagaagagaaugcguucccaagaggaggucucugaaauggccgcuuugggaacguuugucuuuuacaguuguugauaagggaugaaauaagccccggucucccauagcgcucccaggcuuauuaggacaaggaaguucccaccuaacaaauuuuggucagacugguugucugcucucaaacccugucugcugauaagauguuaucaaugacaaugugugcccgaaacuucauuagcaauuuuaauuucgccccguccugugaucucgcccugccuccauuugcuuugugauauuuuauuacauugggaagcaugugaucucugugacccacacccuauucguacgcucccuccccuuucgaaaaucacuaauaaaaacuugcugguuuugugacuugggggucaucacaggaccugccaacaugugacaucuccccuggacacccagcuuuaaaauuucucucuucuguacucuuucccuuuauuucucagacugacagacacuuagggaaaauagaaaaggacccaugcugaauaucggggguugguuucccccaauacauguguaaaauauacaguggucagauggugaugagugccacggacaaaguuaagcagggaauggaaggaaggaaugcuggcaagagaagcugguuuaaauaagguggcuaggugggccuuccuggaauaagccacgcugccacaugaggaagagcacucaaggcagagaacacaagugcaaaggcccugaagcgggcugugcuggcuguguuugaaggccaaauaggaggccgggauggcuggaggggagugagggauggugguagaugaggucggggugggugauggaccagaucgauagggccauguaaggccagccauuggauggccaugggcuuuuaggcugagaugggaagguuuugaauggagcaugaucugacucaucuuugaaagggauuucuaucauucuggcuguuguguggagcagagacuguaggggacaaaaguggcagcagggagaccaguuaggaggcacugcagucuuccagaccagagguggcagcagcuuggaccagggcccaauguugggauguggccauacucugggcuuagaauaguuaggccugugguuagaugaguuagauauagggugugggaggaagagaggaguccaagaugacugcaggguuuuuagucugaggugcuggaaggaugaguugucaucaguugagcuggggcagcaguggguaggcaagguuuguacauuuguccaucaguccauccauccauccacugaccucagcaccaggcccucgugcugaacuccaggcacuccuuuagguccucaacccugaacuccagggaugagguggugacaaggcaggcccauucccugcucccuuggagcucacaguuucaugaggggagacagacgacaaauggcuaagccagugugugacaacgagugucaccaggugagguucuaauguugcaagggggcuugcagaacaugucugggauugcugcuucagagagggccaggcaggggccguggcugcagcagucccaaguuuccagaaacauucccacucuguuacuuugaggccugcucauuuugugcagagaauagcagugaaguuuguaaaauggcaagggccuguaguucacuggggggaacgcugugcuguaggcugcacccaaggguaggggcugugcgaccacauggagacugccuuucugaggagcagcugggccuucuuccucugaggaagaguccucccaccacccucaugccagaaggcaccauagcuccucucccccacccccuccucagguucucccacggcagaccugcggccucuucacacacaccaucuucuacaacgaguacccuggcggcuccagugagcuggacaagaucaucaacgggggcgagcucuuccucaccgugcuccucaauccugugagugcuccacagcccauggcugcuggugagaaggggcugcugcacagccugucugcagcugacacaggcuuccuggagccaggaaaggguggagaggcaugagugagugccuggcaguugggagacccacucuccagcacuggcccugccucggcugugugaccuuggcuaaagaauccgagcaugcuuuuuuuuuccuuuccuaaucauguacuuuaauacaaaaguguuggcauuuuuaugcauguucccuucagucuuugcucauguguguauacacacauacacagauacacacacauauaugaacaacauuugaguuuucuaggucucgcuuuccuuauuuguaaaaugcaaacaauuaccucugcuuuaauaauauuaaauaaacuucaaguggugguuguuauucagcucugugggcugaguacucuuuaucuuccaugcaccccaccccuaacauuuacaaaauaaaacccaaauagcucccacauugggucugcuuuccauuucaggauuguaauauuuggggucagucaggccugguucgucugucaccucauccaaguacucgcagcgaguuuguugacagcgccagcguaacuuccacuggucaucaggagccuugcaagcuaaggcagggucagaagggucagaguuggcggugaggguggcucagacacugaugggcccugccucucuccuccccuccccuggagcagaucagcaucuucaugacgcaccuguccaacuaugggaaugaccgccugggccuguacaccuucaagcaccuggugcgcuuccugcacuccuggacgaaccuccggcugcagacacugcccccugugcaguuggcgcagaaguacuuccagaucuucuccgaggagaaggacccgcucuggcagguggggggcugggcagccugggcagguugcuacagggauggaacgccaccacucacaggcacacacuccagauauggacucaaggcucagccaucaugccuucacacucucgcucgaauguaaacucagguccccaucuacuuaccagcaugggugcguucacuccuuugcacacaugcaugcucauacauguacauacuuccccacgcagaccuacaugcaugcagucauacauagccuuggaaaaaacaguguuaaaaaaacgagugggcuggacgcagugguucaccccuauaaucccaauacuuuaggaggccaagguggcuggauugcuugaacccaggaguucaagaucagccugggcaauauggcgaaacccugucucuacaaaaaauacaaaaauuagccgggcaugauggugcgcaucuauagucccagcuacucgugaggcagaggugggaggaucaguugagccuagagguugaggcugcagugagcugugaucacaccacuguacuccagccugggcaacagagugagacccuguuucaaaaacaaaaaacaacuccaagugaacacagugcagacaaaguacagaaagugaaugcguugucuuggucaggcucuuagauaaucucuuguaucucuucuaacuccagcaggcucugagugggaaaagggauugaugggaggguuugggggccaguuuuugggaaagucugcuccuacgggcuuuuaaaaaguggaagcagaagcuggaauuggugacagucucauaguucagaccaggaguccacaaaccgugacucaugggccaaaaccagccugagaccuguuuuuguaaagaacguuuuauuggcagacagccacgcucauucuuguaucuacugucuauagcugcuuucaugcuaugacggcagagucgaguaguugcaauggaaacuuccaugccccaaaccuaaaauauuuacuaaacacuuaccaaaagauuaauuaaacuuuauaggaagcguuucuugacccccugguucagacgcagcuuguccaguuaaauucaacaagugcuuaugaguuccuguuacgugcuaaggggcauuuugcgagcucuuugggggacaugaaacugaccagaaguggagccugccugucaguggcucagugucuggggguggggaugugacaaggacacauguagcauguagguaucaugcccauugggcuguaagggccacauauccaugugcagugggaguccacugacuggguucuggggcgccccacacaucccuuccacuguuguuuuaggaccccugcgaggacaaacgucacaaagacaucugguccaaggagaagacgugugaccgcuucccaaagcuccucaucaucggcccccagaaaacaggcaggucucucugcucuugaccgagcuuccccaacugccugcugucucagccacagaauucugaggacugccuugcccuggccccacucccggauaauuugcucccucuuucccaggaaguaggaaugaaguuggggugaacacaaauugccugucaguauggaggggaaagagguggaggaggggccuggaguucuccuauuuauccugaaccauagccucagggagcucucccugcauuauccugggagucuccaaguccagucagagaagcccagaucaguugcucugcuaguuugaguaaugccaagcaaaacugguacaaagaggacugugaucaauuagcuaugucugccagaggugcaguagggagaagcagugacaugauugcuaagcauuugucauccauacaacccugcaaggcacaaaugggcacucccauuuuguagacagaaacucaagguucagagaagucaagugacuucccuuaacacauucaguuaggcaauggcaauuccaggccugaacucugaucucugugacccugaaacauauacucuuaauugccaaacucuauagccuccuucucuucugggcucucucauuauagcauguaaaccauagacuuauaccacagaaagugaaugaacucacugaggaggagguagggcagggugcaugagugagcagaggguauugggaagaagagacauaggaacaagauuucuuaguucuuuaagaauuucacauuaacagaacugcagggugacaaacucccuuuucccugagcuccuaccaagugccagaggacagaggcccagagcuggaaaggaccagcucuucugggaugcugaggggacagcagucaguuaaacauggcuaccagagugcaguggugaggcagauucugaggccacguccucguuuagugaagagugcugugauagauuagcgauguccguaguagguacaggaguugcgguguucacaugcaugccauauauuugccacccuggauuuaguaauuccuucauugcacagaugaagaagcuaagaccagagaaaggcagagaccuucccaggagcccccagugggucguggggagcuaggcccagaacccagacucuaucuuuuggcugggggcugggcccugggucucaggugucuacccuccccacaggcaccacugcccucuaccuguuccugggcaugcacccugaccuaagcagcaacuaccccagcucugagaccuuugaggagauccaguuuuuuaauggccacaacuaucacaaaggcaucgacuggugaguuggccuuucuguccacagcgggacgggaaggccauccuggggccucccaggagucugcuguggccacagcaggaagcagcuggagcuugcucacacacagcugucauuccuguaaacagggacaaagugcagugacccuugaaucauggugugacagcguugucauagacaggacacucgaugaggaggcccuuugccccuuugcucuaccgccuguagucagacgcugaggucgaaguccaccccucccuugcuugcagagaaacauccugagucuuggggaggagaaggguuugcccagggucccaaggucggaaauccaaauguucuggcucuccucacugcguguggcugacugugaagcagagguguucuugugggcccuucagggacaggucgcuggucuuugggcgucacuuggggaagucauuaagauugccacuucccaccagagccugcagagguuaccuuuguagagguucccagcagaggguccuaguagagguucccuuaagggugugggggccagagcagagaugguuuuacucuccaccuuuucaguuggcaucuuucucuauuugccuuuuuucuuucuuuuuaaaaaauguuucaugucagguagguaaugugcugagaucauaacaagguucgagguggguacaccucacacgugugugaacacccaaucaucacgugcauggacugcaaaguuugccuuuuuaaaccuuguccauguauuaccauuauuuauuauuuuuaugucaguggguucccuggguggagagguuaugggccuucugucuuucuuuuuuuuuuuuuugagauggaaucucgcucugucacccaggcugcagugcaguggcgcgaucucggcuuacugcaaccucugcuucccggguucaagugauucuccugcuucagccucccaaguagcugggacuacaggugcccgccaccaugccuggcuaauuuuuguauuuuuaguagagacgagguuuugccauguuggucaggcuggucuugaacuccugaccucgugaucugcccgccucggccucccaaagugcugggauuacggcgugcgccacugcgcccggcccaucuaccuacauuucuaacaucuccacagucucuugucuaaaaucuaguguggucagaugaauuauuggaagucaacauuuuucagguuuuagaaagguaauguggugcgaaaccauauauuuaguaacaucuucagcgacaccuggggcagcacccuguuagcaaauucauuaauaugucuguagcaaaguaugugaauauuuacacuaaguaagaggaauaagucagguuuuguugccaaauggcuuugcuacaaaccuaggaaacaaagccuguguuuucaaagcuuucucaauugagauauuguaaacaaaggauuguggacaugcaaagaaaauucagaaagaugagagaagacguaauuccuuggcccaauucccaagagcuugauuuuguagguaggucuaaaguggggugcaggaauccagcaggcccccagaacgcucugaugaagcacauccuugggaccagccuggaucagccccaccucacaggauaggauagggacccuguacccuucaugagaguggacuuugcuucccacaagccccagaaguuggacccugaguuugcauagguagauuccccugggagggucuggaguguuccuuugguuuccagagguuccuucauccagagguggccauugcucuggugggauaugggcauuagucuggaaagccgugcucacccacagcaggcuggggagggguuguggguagcaggagguccugguccacagugacggccuagaagguguucccccaggucaggaaagaaaguccgcccucuggaggcccccucugcucugugccagccucccuggggcaguccuggagccacucugagccccagcucgcccccuagaggcagagagagugacagcccuggcaguuaagccuggagcagcugagggggcgggauccuagaguuuaggauugaggggcauuacccccuccccaugaccugcaacugccggcgcacccacaagucuucagauccucccaacuccagagucuucuggaaaaggaacgaauuugaaacagggaggcugccaagaggccauuccccuccagaauccccacuggaggcaaguccuuguuugguugggagcaaagcuucccacuugcucucugaggacauucuaccccagugccucgcccuugugcugcauucccuuagcccccuccucaugaguuuugucugugagccgccucucugggcuuccugcagguacauggaguucuuccccaucccuuccaacaccaccuccgacuucuacuuugagaaaagcgccaacuacuuugauucagaaguggcgccccggcgggcagcagcccucuugcccaaagccaagguccugaccauccucaucaaccccgcggaccgggccuauuccugguaccaggugaguggggcugggguggagucccugugucgggaacacagggcuccgucugacacucaguuacucacucacucaacagauauuauuaguaagcaccuacugugugccagcccugagccaggcgccuggagcguggugauggcugagaauagaguccuugguggaggagacaggcggaaauggaaagccagccaccaguugacuguccaccugccuagugucaugcgggguccugccucuacuucugacacugacaagagguggaggcugguuacgccuagaggaagcuuagauuuggugaacagcaaugcaggaucauacugacuauagcuuccucgcuggacacgggugggagugggagcucauggaaggacaagacacaagacugccauucacaguggagaaggcaggcaccugaccaagugaggcaguuaccugggcugugauacauggagaggguguggauccaagccccuaucuggggcauguaugaaccagagcugucuuuuuuuuuuuuuuuuuuuuuuuugagacagagucuugcucuguagcccaggcuggagugcaguggccugaucucaacucacugcaacauccgccuuccaguuugaagugauucuccugccucagccucccaaguagcugguauuacaggugugcaccaccacgccaggcuaauuuuuguauuuuuaguagagacaggguuucaccauguuggccaggcuggucucaaacuccugaccucgugaucuucccgccucggccucucaaagugcuggcauuacaggcaugagccacugcgcccagcugaaccagagcucucuuuaaugccuauggccugacuuaauuuccugccugccagcccacugagccugcaggaaugcuuuuaggccuucccuggugggguaggcggagucccuccccuggcugccagcauuccugugauuaugccacacagccaagcacugugauucagaaguggcgccccagcagaaagccacccuguuguccaggccgagguccugagcauccucguuaacccagcagaccaggccugugcuugguguuggggaggggguggggcccugggucuuagcccaugguugccagagaaguguccccuguccuggcugggacagccucuucaggccuggccacugucauaguucccacccugcuuugaggcucuuuucucagaugugacaguggcugucucccgccugggaccuugcggucucccgcagggcuggcaccugccuccucuuugcucccauggaagucucuccuccugccacucucugaggcuggugaggaagccccuucuuacucuuguucucuagggcuucuguuuaugcccugaugucugcuuuccuguggcuuuuucuuuaggagaagaaaaccgagaaacacuugucaaguguuucuguuuucugccgugcugugugcccccgccuccuggcgcugugcagggaaugggcagucugcuuucaugggggaacguaggguagagagagagccgccacagguugggucagucccuguucugcacugacacugcuguacaucugcaccuuacuggagagucacagcugguuucuagaaggcagaggagggguuucacguuuguguccccuucucaaagauuagaaaaccaaguuucagcaaguuucaugugguggcauuugaauccaagucuucuaaaucuaagacccuauuccuuuuucuguccaugaucaagagggguaagggauagaaggagaagggagacucauucuccccaggaggaccugggaagauguuggaggagaggaagggugggggccugucucagaaggaggucgggacgaggaggacgcugcugugcaccauauugccccagcccugggcugugugugauccucaggggaggggguuggcggcugggggauagugccugucgcacaggugccugagcucuggcuuucuggacuuagugaauucugcagauucggaccucccauggcauuauuuuaagugauucagaccagccagucucccuuuuauaguucuuucccaguccuucugauuuccauaaaggagaaaugcucacuuuagugcaaguggucuuacguccuuucuaacacugucaaccucugcuuucaacaaagagagcauguucagggccuguugcacacauuugugucuggcuggaguuugagaacauuguuuuuauugccauuugugagugguugccuucuauauaugacaacagugcagcagcgugaucuuggcucacugcaaccuccaccccccgaguuuaagcgauucucgugccucagccuuccgaguagcugggaccacaggugugcaccaccaugccagcuaauuuuuguauuuuuaguagagacgggguuucgccacauuggccagcuggucucgaacuccugaccucaagugauccacccaccccagccucccaaaauucugggauuacaggcaugagccaccaugccuggcaucaggaaacccugauuucguccaguucccguauuucaaagauggagaaguuggggcucugggaccaguggcuucccuugacacuggacacagugagaggcagagccaggacucagacccagagcuccuggguccagcugaggaucuucuggccaccuugcgggcugcugucccucucaggccacuuccuuuguguccuccaaguggcaugcugacccucuuuccuugccugcagcaccagcgagcccaugacgacccaguggcccuaaaguacaccuuccaugaggugauuaccgccggcucugacgcauccucgaagcugcgugcccuccagaaccgcugccuggucccuggcugguacgccacccacaucgagcgcuggcucagugccuaucacgccaaccagguagcugcugucccugacccuugugagggcagucacaguacuggcuugcugugguuagcggagagccuccaacucuuucucaccagccguggggacagauaugcccuccuuggagagcuagacccuugggucuauaaaaagauuuuauuauuauuauuauuauuuugagacagggucucacucuguugcccaggcuggagugcaguggugugaucucagcucacuauagccucgaugucccgagcucacgcaauccuuccaccucugccuccugaguagcugggacuacaggugugagccacuguacccagcuaauuuuauuuuuuuaagaaauaaggucuuacuauguugcccaggcuggucucaaacuccugggcucaagcaguccucccuuggucuuccaaagugcugggauuacaggcaugagccacugcaccuggccuaaaaagacuguagaccuguuuaucccaagguugauacaugagaacuccccaagccugugucccaucaccacaggcccuguagcccuaaagggacccagaaagcccugaggcaggcaggugggagcaaggagacugggcguggugauggagggagagccugaucauaccaggcuguuuauguauuuauuuauuuauuuagagacggagucucgcucugucucccaggcuggagugcaguggcacgaucuuggcucacugcaaccucugccucccggguucaagcguuucuuccaccucagccucccaaguagcuggaauuacaggcaugcaccaccacgcccagauaauuuuuguauuuuuaguagagacgggauuucaccauguuggccaggcuggucuugaacuccugaccucaaguccucugcccaccccagcaucccaaagugcugagauuacaggugugagccaccgugcccggccaugcccagccauaccaggccuuuuaggcaaacuugcggaguguuugagcaggagagugacauggacuggaagcucagagagaggccagagagggauguuuguagggaccugaggggcaggcaggguuuggugagagcuuaaauucuaggagaaauggcauugggcagcagaagcugguggaaagcaggcgugagaccacagaggccugagcuuggggauaccugcccuucaacaggggaggaggagccaguucuagagggugcagggucccauauuuauaagcaggcccauuccugcugccguggcuguugcccuuguuugccaccgaagucaaagcaggucccgauccccuuucucccuuuccagauucuggucuuggauggcaaacugcuucgcacagaaccugccaaagugauggacauggugcagaaguuccuuggggugaccaacaccauugacuaccacaaaaccuuggcgugaguguugccuuuuccuuucugcagguuauuucccugauaaggcaccugggccaacaaagccaaagucuugaauaauuaugagagagagaaguuaguuagagucagaaaguauggaaaguuauuaauaugacuuaagucauauuaauaaagguaucaccuuaaaaaaaagggagaugaugaaucuguucuacucuggucagaccauccuggggucuucucuuuggucugggcugaacauuuucagaguguuuuauguaaguaaauuagaucaguaaugagcagcccuaauucccacaagauuuucuuagcauuagcuuuuuuuuuuuuuuuuagacagggucacucuguugcccaggcuggagugcaguggugugauuuuggcucacugcaaccucaaccucccaggcucaagugauccucccaccucagcuucccgaguagcuugggaccgcagacaugugccaccaugccuggcuaauuuuuguauguuuuguagagaagggguuucaccauguugcucagccuggucucgaaugaucugccugcuucagcgucccaaaguucugggauuacaggcaugaggcaccgcccccagccagcauuagauuuugacuuacgauuucaggaaaaggaaacacaaauguuguugacaguuaauaaccguacucacucagaaccuggugcaagugcguugagaaugcccucccacuaugaguaaaggccugcccgcauugcaugggcucagggcuaggaaaggcugcuuuccugugcuaugucacagauaagugacacacucagcuggaugaggggaccccaagagaaggaggaaucaagucacccuccuuggcuccauucuugggaaaguuuugcaacaagaauauuccgucuucacugucgugggaguugaagguggagaagggaagucaguccuucaccuugagggagaaggggccaccugcugaggcugugggccauggugucagagaugccuggguuagggccccacauccaucucuucagccuuucaagccucgcuuuccucaucuguaaguuggggauaaagauaauaaucccugcguccugaaggccacugaauugaaugaaagcuucauguggggcucuuagcugagagcuuggcaugcacuaagugcuaaauaaacgguagcugcuauuguccuugucaucaucaucaucaccaucaucaucgucaucgucuauaccuauccuaugacccuuucagaaaucucuguucuccuucgcuauucaugggaauucuguuuucuugaugcccucaugcucaagaaucuccucauaguuccucauccagggcuaaauucugaugucaguauuccucccuucccauaacagcuucggaucucauaucccaaaaaugccuuugaagacaggaugauguuggcagucuugcugugucauuucugaaguuuacuccaaaaaaugaaauucuccagugacaggcaugcuuaagugcagcuguggauacugcauguuuugauaaagaugaaauuuauuaaaaagcaaaagaaccuccacuaaacaccccucuucccauugacgcugggagggguaaagaaggcuucuuggguuuaaaaaaaaaaaagaguuacucagcauugagaaugcucagaaaagauuucccagaacacugaaggaugggaaacuguucauguuguagauugcugaagcggcuguggcuggucgggcuggaggagagaagacucagaaugugcgagcugcccuuugccggaaguaggacaggcacguuuagugcagccuaggacacauuugaucccacagauggcacauagcuucugacaguccauguggguucaagagcaguagauucccuggucucugccauuccugggguccaugaacauggcuuuaaggucggaaguggguggcugagccagcucccauccaaagacuuucccaccuccacagguuugauccaaagaaaggauuuuggugccaacugcuugaaggaggaaaaaccaagugucugggcaaaagcaagggccggaaauaucccgagauggacuuggauguaagugguggacacacuaccuguagcaccugcauaaggguaaggggucccuguauggaguugagggggauucucuuuccuuuaccaugcacucagcauguucauggccuuagcauuucuuggacaguauuuguaagaggaggaaaaugggggcugggacauggugggucagaccugauuucgucaaacaaguguugguuaccuucuacuaagggcugagugcugugggguuuugaggaugagccagacauguucucugccuucaaggaacuccuggucuuggagggguaugagucccaacaccacuaaguagaauacaggcagagagugcugcgcgcagucagagagggcacacaagugcuaugggaauucagaacaaggggaugucacuugaaccugagagggguaaaaaaggcuccuuaaaggagggaugggggucucuggaguugcgccuagaaggaugagauccauuuuguaggauuuggacauauggaaugggaggguagguaagaacagcauguguaaaaccauagggggaaaaaagaaauuuuaaaaauauauagaaaaagggucacagacugggggucuuguuacuuccuccuuuuccuacuugcuucuguuuuuguuuuguuuuguuuuguuuuguuuuugagacagggucucguucuguugccuaggcuggagugcaguggcaugaucauggcucacaguagccucgacccccugggcucaaucgaucuucccgccucagccugccauagugcugguauuauaggugugaaccaccgugccuggcccuggcccugcccgccuuggguuuugauuauuaauucucucuccucucccuaucagaagaauuuugacuuagugagcuauauuuugaugcuccugccaacugggaguucacuauuggaggcuaccauuuagaaggagauuguggauaaauaagagguguaugggggguggugccagcagcaugguggguuuuuuguuuuuuuguuuucuuuugagacggaguuucgcuuuugucacccaggcuggagugcaaucgcgugaucuuggcucacugcaaccuccgcuuuccggguucaaaagauucucuugccucagacucccgaguagcugggauuacuggcgcccaccaccucaccccgcuaauuuuuguauuuuuaguaggguuuucccauguuggccaggcuggucuugaacuccugaccucaggugauccacaugccucggccucccaaagugcugggauuacaggcaugagccaccgugcccggccgagcauggcgauuuuuagaggaggucacucuuaagucaguacacaaggucugagcuuuccuucccguuacagucccgagccuuccugaaggacuauuaccgggaccacaacaucgagcucuccaagcugcuguauaagaugggccagacacuucccacuuggcuacgagaggaccuccagaacaccagguagccguggccaccacagccagacugaacguuugugaaagcugggacaucccaccacacgcugagccagaccugcagagugggaagcuggaccagggcagcugcgcacuuaugagcaauacucuguggaggucugguggggcugggggagcacccaggcggaucugcaagcaccucggagcacccaccgcugggucugcggccuaagggaccucccucgccagcagagguccauuccguucccagcugcuccuggggaggccgcuuccugguaggagggaguccacgagacucuuuucugucccucacuguguuccgccgacuguccccucucgucacccaucacucccugcuuccgcagggcgccccucaguauucgcugccauaugucccuguccuccaggcuguaggggaggagagccuggccgggggagacagacuggacauuucccuguuucgagccaggcucuuccaaggggccagcuggguccccggagucaguccuaggcuggaugggaggguggcccccucaagaggacucccagccuccacaucugguuccuaccuucacaucucacccucccguucuggggaagaauuucugguuccuacaguauccacuccauccucaaggcuucccgcagggccuuggggcacugccuugccaucgggcccaguucuccgggccccaccugcaccccuuucuucccccugggauaugaugugugguguuuccugugguaaaagacugaggcaggccaggggucugccaguaacauguucccauguacagacacgguccccacacccucccagccucaggcccaggcagacaugggcgagcuggugagacugccagccacggcuuugcuuagccaccuguggccgagggcucucagagacccccuuaaccucccaaauacuaagaagcuaaaauauuuuaauauuuuguuuuuuuuuuucuuggugccagaguuuauacccugggugcuggggucgcacuguguuauauauauauauauauauauauaauguguauauauauauauucuauuuuuuuugguuggguucguuuuuaauucaguccuacaaaauggugguaagccccagucucaggggucacccugucuuagagcuagagaugagguggcagggagggaggcuguguccucaguggccuggggcugagcagaccuuaggaaggggcccuccccagugccguggcugcucuggggcuaccccaggugaacagagguggugagaugcgcagggaagaccagcucucuccaggacaucgggcugcgugaaguccagugacccugaggggauuuuggccaaaggaaacagccagggcugggcuaggagagcuggggucaaaagcugccccacccacucucccucacauggugcuaggcugggagcugcccugagagcugggaugcccaccaaggcccacagaacugucuccaggcccuuguagacagugggaucucugggcugauuucugguuggggucugcuccuaccccaccccauuuaacaaugugaagugacugaggcuggggugccucucccuggcccccuccaacugccaaauucugcuucccucugaaccccaggaaauacuuucuggagaggcuugucuuguucagaagacucuagcaucuuggggcuggaagguccuuugacggguaugaaacagguccagaaaggggagguggccugcuuggccgacgucauggagccagcugggagcagggcugagcguugaacccgaggcucccgguuccaagucccaucgugcuccucuuccaaugccacacugccucugagcccauccuugggacccuacucugugccagguuccugucccuuccuccgucacagcauggucauuccaggauauggggacaaaccacuccuucccagccagggugccuuugagccuucucauuccgaggucugcguuugcaucccugucguguucucccucgagggguccuuccccagccugugggggccugggucuguucugagcugauucccuuuucuccaguucucugcugggaugaagaaaguuggacacucagugggaccagcugcaggugguuucacuguguacacagcaguguccccaucaugccucucaauggggccugcaagccugggaacuugggcaucguugggccagcaggaugagcagcaaagggucugaggacaggguggcaugucugcuugugugcucaugaagacaugcccacgccauggagccaggggcuuauagagaggggcagugacuuccagagucccauccgucagugaggggacugggcugcgggaugggugaggaucuuacagcucccagguucggaaaucuacccucuaggccuggaggccucucucgcagagcauggaaggcaggagaggugggcuggccuagggcaggagcuccacuucucucugccucuggcuaugggaaggagcaggcgguuggaaauccugugacagcagagaucuucuggauuuuugccuggacccuucugcaagccuggagacuggaccugccacauguuccaagucugucugccuaggucacugcugccacuucuccucccacuaacagaccuuucuugaagacccacuagguccagacacugccgggacuugcagguaugggggguagaaggagaggcagauaagcugccuggggggcuguuagcuaauggguacaaggacacccccucccgagaagagaagccacagaugagugggccagcgaggccagucuucaauguccacuaauucacucuaagcauuuggccaaaaaaaggagagagaaauaacugaaauuguucagguggcuccaucgucuauucugugguccccuccaugagccuuugccccagggugggugcaggugcgagugucaccugcagcugccucagucauucagaguuccagagccuucugugguggagcauccugcugcuuggaggaugagucugaaguuuaaaaaugggccuuuucugagccccccugaugagcagucagugcuucugggcccagcuaaggaagccaucuguucccagcagaggagagcugcugcgcugaccugcagagguugguggucccagcacagagcugugcccaugggcuuguuagugggaaaagcaaauacaacaauguuuuaccaaacauuuaauuaugaaugcccacuccccagcaucuagaucuaaaauuauuaacauuuugccacauucuuuuucucucucuguguauguauauguuuucucuguccuaauuuaaaaguacauugcaaacaucaugaaacuugaucccugaaagcuucagccugcaucuccuaagaguuagggcauuguccuacacauuggcccaguaucacagccaagacgagaagucauuucccagcgaugucugcuaucuaaucuguauucaaauccccccaauugucucccagguaacuuaugugucugguuuuggaaucagcauccagucacggugcacacauugcauuuucuaacuauguuuuuaaaaccucuuugaaugcugaaaggucuucccucagcucacuuugaguuuuuaaaugacauuguuuuugaggcccuaggccugcugucuuuuugaagccccacauucugaauuugucagauuguuugcucauggugucgcauaaccacuucuucuauccccuguacuuucaaggauaauuuaggcuacaugagauuuugccuuuugugcugacuugacagcuucacuucugccuaagaugcgccuccacugucaccuguaccaagugccaaaacagcagaggggccaguuagagcaagagcucugggggggccggaaagucucccuggagaaggccguaauaucugggccuuggaaggaaggacacagggcucuggaaggaggaggcugcaugccugaaggcugggccuucgacccuggggaugggccacagggcaccaaacacaucauaugucucucucuuucuauuuuggggucccaggguuuucauuuccuggagacccguggucugugugcacuggagcagagccaggcucucaguugcagcagggaaaagccuacauggggaacugccucccgcaagcuguggugugagaagagcccuggcuggcagcaggagcugugaaguuucaucccagccgggugcauuuaguagcugccugaccaucuuccucccaggcccucaguuucuucaucuguagaaugagcagauaggggccacagcagggauuuucacacaucaaaggaggcagccucugcucuaguugaugugaggaugagggggcggccuagacccccugcugcccaggccguugaggcaacacuggguuccuggcuugacagcugugggcuggcugcccuugccagcucagacggcuggcgaguuuucagcuucccuaagggacuggcauaggguuuuguggggucaaugccaggaaccugggggaaacuggaugcguuuuauccuaagaaguucaucccuccugcucuuacuguuuccggcccuggaggagaaugagggaggagaggguuuucuaugacuguguuagcuuuuauuauuagcaagagggcuccuuuuguaauuugugcaugaaauucaugucauuuccugggagaggagagggccgacuggagaggguggggggcacacuggggaagcaggcagagguuuccuucccuuguagggggguggggagaguggggagagggggugcuauccaguucgccugaugagggcucucgaaccagccguuuuggguuguguuaaaggugagaccuuccuccauuaauguacaaucucgaacuaacugcuaauaaagugggguucuguuuguacac

SEQ ID NO: 18563 - RNA, 572 nt, Homo sapiens
gccuuuuccgguugcagcgccgcgcggugagguucucuaguccacgcucgcagccaugccguccaagggcccgcugcaaucggugcaagucuucggacgcaagaagacagccacagcuguggcgcacugcagacgcggcaauggucucaucaaggugaacgggcagccccuggagaugacugagccgcgcaugcuacaauacgagcugcuggagccaguucugcuucuuggcaaggagcgauuugcugguguggacauccguguccgugugaaggguggugcucauguggcccagauuuaugcuauccgucaguccaccuccaaagcccugguggccuauuaccagaaauauguggaugaggcuuccaagaaggagaucaaagacauccucauccaguaugaccggacccugcugguagcugauccccgucgcugcaaguccaaaaaguuuggagguccuggugcccgugcuugcuaccagaaauccuaccgauaagcccaucaugacuaucaaaauucaccuguauaauaaacaguuuuugagggauuuuaaaguuuccaggaaaaaaaaa

SEQ ID NO: 18564 - RNA, 42681 nt, Homo sapiens
cgcggccggagcgaaagaggagccggaaguguggcgcgcgaggucuaagggcgcgagggaaguggcgggcggggacuaaggcggggcgugcagguagccggccggccgggggucgcggguauggccgaggccaggaagcggcgggagcuacuuccccugaucuaccaccaucugcugcgggcuggcuaugugcgugcggcgcgggaagugaaggagcagagcggccagguaagcguucgugggccgugugcgagggccgcgugcaagauguggagaucagcggcccgcggcccgcgccccguccccaggcgacccggcaggcgcccggagccgggucccgcagugcucgacggcgcggccagggguaccggaggagccgcaaucucugccuucccacugcgacuucaguuccccugggccucacuuuccucauccgggcaguggguugggccagaaagugugcucgcaggggccgaacuuuguaauucccgcuucccuuaccuccacgcccuuccugguagcggguauuuuaaguuuccuaagucucccgccacguggcuaggcucugcgcggcccccccuggggcaaggagguugcugcgagucucggggguggauugcgaccagccccucgggggagcgccuggaaaagggacccuacagccucuuaguugagcuggaacucaggccuuuagcgauugucuguacugagacggucagcuuugguacucgaacucgugguacagucauuucuuacuugauuaauucaacuguuaauccgguacucagggugcuuccugguguucgaauggugagcaccaucucucagcccuccuggagcuuacacucuaguaagguagacaaaucaaagaaucacaaaagugacuauaugcuuagcaccgcaauaaguguuaagaaugagagggaugggccgggcacgguagcucacgccuguaaucccagcacuuagggaggccgagacuagcggaucaccugaggucagaaguucgagaccagccuggccaacauggugaaacaccguuucuacuaaaaauacaaaaauuagcugggcauguuggcgcacgccuguaauccuggcuacucauguggcugaggcacaagaauugcuugaacccgggaggcagagguugcaaugagucaagaucgugccacugcacuccagccugggcgauaaagcgagacucugccucaaaaaaaaaagagagauggauggcagauugcccuggucaggaauagcugagguguaaaugccuuguggugggagggaacuuguguacacacuggccuggagaaaguccacucucuugagcccaggaauuugaggauacaguaugagccaugaucaugccacugcacuccagccugggcaacagagcaagacacugucucaaaaaaaaauuuuuuuuaaguccauagcaggccagguacgguagcucacgccuguaaucccagcacuuugggaggccgaggcaggcggaucacuugaggccaggaguucaaaaccagccugaccgacauggugaaacccugucucuacuaaaaaugcaaaaauuagccaugcaugguggcaugcaccuguagucccaguuacucgggaggcugagucaggagaaucacuugaacccaggaggcagagguugcacugagcugagacugagccacugcacuccauccugggugacaaggcgagacuccaucucaaaaaaaaaaaaaacguccauaguggcugaagugugaaguacaagggccagaugccccuggggagauggaggcaggggcuggcuggaguggucuggugggcaguuugaucuuccuuggaagagcagugguaaaccaauggagaguuuugaacuggugagacaguauccuaaguagucagaucccuuugcccugugguguaggcucugcuccuaaugcuugcucucagaaccuccuggagggacuaaagggugaugggcccuaagacguuauguaugcuuuucccaguuucucugaaccucacuugcucuuccuaccgcagcuaugguacuucacagauaaggggagcaagagauaguacccaucuucauuggagcaaaauauccugccgucauggagcacacauucuaguaggagcagacaggugacaaauagaaaaaguuuaauaaguuaaugauauaguauauccaaugauaguuggugcuugcuauaaaaggcaggcaagggggauaagggaugucagacuucgauuauaaguaggguagucaaggaagucucauugagaaggugucauuugggcagagaccugaaggaaaugagggagugagcuguguaguuaacaggggagagaacauuccagacaagaagaauagcaaggccgcguuagaggcaggguggccugacacauuugaggacagcaaggaggacacuuugccugagguggagcagagggaaacugacucuugaaaucuuaguguuaccggcucacugcugggcacugacagauggucuuguucaaaccagauagcagccugcaagguagguaucgcuguuguccccauguuaagaagaaaucugaaguucgaagacgugacgagauuaguucaguccacccgugccccacauugcuuagccucauuagaguacuugauauccuggcuuauugacauuuacagagacauugggcccucuggccucugcuccaaaggccuggauuccaccugguucccucugcuuccaccaagggacugguaccauuugggcccagucuucucccagcagacuaguagacuguggucaugccaccuggaugccucaggugucugggcugugauucgugcuuugggaagauuggcuggccacgucuuugaaagcuuuuuuaaaggucaaagguggggaaaacccugucucauggccucuaggcauggauagugccagagaggcugggagcuggaugaaugcuagcuuggaacauuccaccucuggccuuucaaagggguugucuaaaaagguuuuaguugggauugguuguucuucuugucucuggaagguuugggacagaacuggcagggccaagcagacauacuucccagagcaaaaagacccucuuuuuuuuuuuuuuuuuuuuuaaagaaagggucuugcucuguugcccaggcuggagugcgguggcacaagcauggcucacugcagccucgauauccugggcucaagugauccucccaccucagccuccugaguagccgggaccaccagugcaugccaccauucucagcuaauuuuuaaauuuuuuuauagagacagucucacuauguugcccagacuggucuugaacuccugggcucaagugaucuuccugccucagccucccaaagugcugagauuacagguaugagccaccaugcccagccaaaaagacccucuucugaaccaccugucuauacaagucaugaguuuggggagaucugggcccaagaaggauccuuacugugcuggggauuaauuguggcuuucucuuuaccucucugcagaaguguuuccuggcucagcccguaacccuucuggacaucuauacacacuggcaacaguaagugguggggccuauaggguggaguagggacggacaccccaagcaacucagcuuggaauaagcugggauaccuaucuggucuaagaucuguccccauagcccacuguggacaccauuguugccuccagaaagccagcucacaucacauggauggguauuucuguguggauaucugguagugggaggggacauugagagcugugaucucuuaagaacaagagcuucucaccagcuugucaguugcucagcaaacguauauugagcaccuccugaaagccaaguccuguucuuacuuaguaugcaaauauugucacaagugagacagacaugguuccuucuuuccugcagcugacauuguagccaaggagguaggcauaagucaaagaaugaaacaaaugaauguuaaauuacagugguaguaaggauuacaaaagagaggaaucuguugccacagccacauaaauggguaagucuggcuucaucuggggguccaggggaagcuucccugaggugaucuuugacuugagagcuauaggaauuggaggagugaacuaugcaguggguagagaguggcagguggaguguaccugccaguggaaauugcuaaugcuaaguccuguggcugguggacaguacagauggggcuaggucaucgcauggauagccaugcaugggcugguuauccauggugaggaauuuugucuuuauccaagagcaguggggccaugguagggugaaaaagugaggagauugcucugcaccauggugagacugguggggccauggucaccaucguccaggcaagagcugauggggcuugacacagggagaacaggguagaaaguggauucccaagaaucauagggaugaaaccagggccuguggaugggugggagaggaaguaucuuauugacuccacaucuaacuuguguacccaugcauagagcuugaagggaacucaguuuggaggggaaagauuucaaugacauguugagugugagaugccuuuuaaacauguaaaauuuauguacucuucaaggaagggggaaucauccaaggauauaucaacagaggaaugguuggaaaauggagagaguaauuguguucucuucaugcacuggccugaccacagcugacuaagggagugaaggacaugcagacauaucccaugaggaaugguagagaguacugaauugccuuggauggaaaggaggcaggagaggggugugagggaccacugcacaucuuugaggaccaagaauagugcguucucugaggccccggagacagaagugggccccaaauguaccugcuucaggaagacagguuucagcuucugaauauaaugacaucagagcuaucuaaaaaugaggugggcuagguggaaguggugggcucccugucauuagagguguguaaacaaaggcaaaaaugguguggaagggauuacagccucugguggagagcuaaggucuuugaaaacccugccaacccucaguccucugcugcuaaggagagcuuagagcacagggcacagcccacacuuccucacccugacuugcccaggugaguggguguuauucguaguacuuccuucccccaaaaaacugcuucagugagcuacucugcacacucuucccugccacuggccccuucuaugggugagggggacaaggaccucaaacccacgaaaggcagccuagccuagcaauucccugcagaguucaaacccagcaacuagcuguauguaugaccuugaguggauuucuuggccucccugagucugucuucaccuauaaaaugaaaauaaugauggcaauuaucucauugcauugugaggguuagacacagugcuccauauaaagugcuaaaacuaccgguuggaggcuccccgacuuccugcacccgccucaguauuuauuaagcaucuacuacaacccagcaauauucuugauauagcugggaacaaaccagagaaaaaucccugcucaacauuuuuguugggggaaaagaggcagaauaaauugauacauguaaaaaugaaaccuguuuuuaacaggagaauccugacaaguggcuuuccugggaacaagggacccuacuaucacaucccaaaccaugacagagcagaguccaucgcagcugggaaaccuggggccuagacagugacucccugggaugggggucaaugggcgugagacuucaaaguccagggccucagccaucugggugcuuauccuacccaugcccuagacucacuuugccaugagcaagucacuuaguuguucaguuuuugagacaugugugaggcacugaggauacuguagugagcugccagcugccuuccucccugggccuuucuguguaggggaggagucuaggaaguaaguaaaauaacaggagauagagaaaagcuaugaagaaaaugaaacaggaucacagggcagagcaugccuuggaagaggggcaaucuucgagggccucucuuggggggcuacauuaaaguugagacgggaaggacgaggaccugggcagagucuuccaagaaggcacaguacacacagcauguucugcagggggaagagccugggcgguucugugaggugccugcaugggucagcuccuaucacuuaaagacugguagcugcugcagcuguuauauaacauuauccagcauuccugauuauuuuaaagacuaaucaagaauuguaaaagcacuuuaugaagugagugaaaaugcagaauacaaaauugugccuauacuguguuuucaccacuguuuagauucuaugcacauugccuuuaagagcuggaaggaugcgggaaggucugucuagucaauucuuguggaguuguucugucacccaguugguauagacagucacccuuguccugcagaaccucagagcuuggucggaagcggaaggcagaggaagaugcggcacugcaagcuaagaaaacccgugugucagaccccaucagcaccucggagagcucggaagaggaggaagaagcagaagccgaaaccgccaaagccaguaagagccuugcagcuuugggaacaggcuauggaauauugauuguucuaggguagagucuaccuccagcuucuucucuuaucacuagaagaccuaaaagacccuggggaggagauugggagggcaccacauaucuuuggcaguauuugagcccuuccuccgugccaggcauuauaucuccaugcucugggggugcaaggccgaaccaaaacaaccagaugggcccuuccagucucauuugguguauggggcccaggagcugcccuauuacaggcucccaggugauucuuauuagcuggaaagaagacacacguucagaaguacugcuggagggauuucagaaagcagcuagcggacacauuuucugugugaccugugggaugcuuuaggaauugcugaucuucauguucauuuagaauuguacccauuagcacuggaacgcuguacugggcacugguuuuacaccguuugcaggaguaacucagucaaagcuuuuauagccccuucuucuccuaaggucccagggcuccuuguacuuuccccaacagcagccauaacucuacagaggaauugcugugucuccuuugcaucguauuaucuucuuuugcuuacauagaagacacauuucuuaauacuuauuuuuuauuuuucaagacaaagucuugccauguuguccaggcuggucuugaacuccugagcucaagugauccuccugccuuagccucuugaguagguggaauuccaugcacauaccaccaugcccagcuuccugagucugcuuuuaaaguguuugagaucauacuagguauauauuuuauuauuuuuuugagacgggguuucacucuugucacccaggcuggagcacaauggcgugaugucagcucagggcaacccccgccuccuggguucaagugauucuccugccucagccucccgaguagcugggacuacaggcaugcaccacuacugucagcuaauuuuguggguuuucuuuuucuuucuuuuuuuuuuuuuuuuuuuuaauagagacgggguuucacaauguuagccagacuagucucaggugauccgcccaccuuggccuccaaaagggcugggauuacaggcaugagccacugcgcccuggauauauauuauauaucgcuuaauuuuacauuauaaaugcaaaacgaguucacuuugaacuguagaagagcauauagaagaaaacuuaaagguuuuuuguuguccuacccuguucccuaucauuccuaagugcaucuccucauagguaaccuuuaaaacuuccuccuuugccucuauauucauucaaacauguauucuuacaugcauauauacagaccugcaugcuauuugaaacacaaaugguaaaauuucuuacugauuggcuauuugguauuaaucaauuuuauaagcugugauaauggagguguaauuacauuuuuuuguuuguuuguuuggggcuuuuuuugauaugaggucuugccauguugccuagacuggccuugaacuccuggccucaagugauccuccugccucagccuccggguauguaauuuuauuuuuuuaaaagucuucacuggguugggcaugguggcucacacccaccgguaaucccagcacuuugggaggucaagguagaaggaucacuugagcccaggaguuggagacccgccugggcaacauggcaaaacccuguaucuacaaaaaauuuaaaauuuagccaggcaugguggcgugugcuuguaguuucagcugccuaggaggccugaggugggaggauuacuugagcccaggaggucaaggcuacagugagccaugacugugccugcacuccagccugggcaacagagcaagacugucucaaaaaaaaaaaaaaaaggaagaagaguccucguuggcauccugggcaacauagugagacuccgucucugcaaaaaauaagaaaauuagcugggcaugguggcaugcacugguggucccagcuacucaggaggcugagauaggagaaucaugugaguccaggcauuggagguugcagugagcuaugaaugugccacuguacuccagccugggcagcagagcaagacccugucucaaaaaaaauuuaaaaacgcauccucauugagagagaaacaugcugaaguauuugugggcaacgugguaggaucuauggcauuuucuucaaaguaaugcuugauggggaagggugagugagauaauacaugagaugaaaagauuggucacaaguuguuaaugguuggagcugccugguucuuccuuucuauuuacuacuuaaaaauuuuccauaauuacagaaagagagagauggagugaagugccaggaaaagaauuagaucaugccauucaucucagcaacauucuucuuuuuuuuuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugaggccaccgcgcccggcccaacauucuucuuaacaaaaagaaaucugagauuuaaggagacaauacccugguauaaaagcacugagaagcugggugcgguggcucaugccuguaaucccagcacuuugggaggccgaggugggcagaucacgaggucaggagaucaagaccauccuagcuaacacggugaaaccccgucucuauuaaaaauacaaaaaauuagccaggcauggugguggacgucuguagucccagcuacucaggaggcugaggcaggagaauagugugaacccaggaggcggagcuugcagugagccgagauugugccacugcacuccagccugggcgacagagcaggacucugucccaguaaauaaauaagcacugagaaucagugaauaucgauaucuaacggggcccagguggcaugguucagccaccucuccacuaagaagccauuugaauuccaggcaacuuucucuguggaccugaggcuggcugccugccugaccacugccccuucuugccgaacagcuuucagggcuacagugugguggccugugugaauggugcccauugcagugugcagugcccaguaggcagcaagaaugugggccaguccuuuucccuccaggggccuccacgucucaugcugcgggggaguugggaauccaucaaggaugcagacacauagcuucauguuaccauccucuucucucuugcuccugguggaccuggcugaugcaucacagagcucauuccugcaagucugggcucagccucagauccucaugccagcaccaggcagccaauaccaauagaauuguuaggugagaugaaaccuguuugccauucauagaugagaaaagcucaucuggcuccuuuagcagauguuuguuucuugcagccccaagacuagcaucuaccaacuccucaguccugggggcggacuugccaucaagcaugaaagaaaaagccaaggugagugggacugccuuccaagcuauugccuaugggauuuaaggugccugguaggggacagucuuacaugucagagaaggauaggguugugaguaauugccccaccuggauucagagcucaaccugugucaccaguugugggaucuuagucccuucaccucucugggccucaguuuacuuuucuauaaagauaaggaugaugccugcugcagugggccacugggcacauucuacaccugggguaggcgauuucuuuccucuuucaugccugcguucacccguucacucaacagaucuugacuaauaccuguuauguuccaggcacugugcuagguguggaggcaccguagugaucaagacaucugugguucugaaacucuaaaagcauuuuccaaacuggaaacugcucaaaaaacaaggugucauuuucuaauaauccagaaagcagaguuagauacauacauguauaaagaauugugccucugcgauugccuggagcauuagcaacaaugucucaaaguaauuaugaaguaaugauaagaucaacaacaaacugcuacuuaccacuuaguaaauaacuaccaugucccaagaacugggauucuguuuucucaacaccucuggugagaggaggugcuguuuuuaaccucacuuuaaagauugggaaacagauugaagggguaguuuacccaaacucacacagcuaagaagugguaagauuggguucagaugcaaguggccugugcucuuaguucaccaugccauaccagaugugucugucacucuuguucucuguaggcagagacagagaaagcuggcaagacugggaauuccaugccacacccugccacugggaagacgguggccaaccuucuuucugggaagucucccaggaagucagcagagcccucagcaaauacuacguuggucucagaaacugaggaggagggcagcgucccggccuuuggagcugcugccaagccugguaagaaguccccaccucuaggaaccuaguccccagaacuugggcuggugaggcaggccuaggcauugcuuuaaguucugggacauuucuggaaucaaaaguuugucuccaggacagccagguuccugcaucuuaggacuuuucucaucaccuagacgagggagggucagcuuacagggaccuggccucaggcugaacagcccaccuggugguuggagcauuuucugcuuuaugacucccuggugaguuacagggacaacuggcagcucagagacuaaacugaaaggccugauuugccucuguuuccuauguagaguagacaucugucuggccugcaucaguggauaugaugguggauggagguucuguagacugucaggugcuggugcauauuuguuggguccccucacagcccuucccagggccucagagaugugugggaacauagggauggugaugguacccaccucagaagggggcuucacagcucagugcaugugaggcacacgaggggugagcgcucagcaccuggcuuugaugagcagcugguuuguggggaggugcuggggaggggcaggugaggcuggaaagggagucccucaguccccuccguguccgauccucagggauggugucagcgggccaggccgacagcuccagcgaggacaccuccagcuccagugaugagacagacguggagguaauugccacccaucccuaggaguugcccucucccagccucuaacccuuccaggaaccugucuggggcuucagacaccagugggcccagaugaguucagcaacugugguagggugaccaggagcuggaaaggcugcagccggagaggggcagggagaggagucuggugcugcuugcugcacucugagugugagaucagcccugggggcaggagagggacacccuccugccugugagacuagacaagccuuccugggagaggugcccuggaguagggccucaaagcacagugggcuucacugggaagggauguggaggaggcagggcauuccagacaggaaauggggcaagaacagggcccagaggcaacaguguggcugucguggucuggcuagggcugcggcugcugagaggguucugggccaacuggugaaugccaggccuagacacuuggcuagaguugggcaggacucuuggguuugugaacuuugaccuggaaaaggucuccacagguuacuuuuuauuguguaccuacuaaguggcagaccuggggaauauagugaugagcaggacaggcagaguuccugcugccauggggcaagggagcgucccucagauauuuaauuggugauggcugcuaugaaguggaaauguagagggccacgcagggcaggaaccugacguugaugaguaggcguaagcagaaggaauggcaugugcagagaaggcggcaaagagaguuuggugcuuuuaaagaacauugaucuuuuuuuaagacagucucacugugucacccaagcuggagugcaguagcgcgaucuuggcuagcugcaacuuccaccucccggguucaagcgauugucgugccucagccucccaaguagcugggauuacaggugcacgccaccacgccuggcuaauuuuuguauuuuuuguggagacaggguuucaccauguuggccaggcuagucucgaacuccugaccucaagugguccaugugccuuggccucccaaagugcugggauuacaggcaugagccgccacgccuggccaaaaccuugaucuuuaaaugagagggagaaaccaggcacgguggcucgcaccuguaagugcagcacucugggaggccaaggcaggaggaucauuugaggccagaaguuugaacccagccugagcaacauagugaaacccugucucuacaagauguuauuuuuuaaaaaaacaaauaaauuauggggaaagugacacaagaugaaguccuagguagacaggggccagaucuucugucugaccuugaggaccaccauaaggaauuuggguuuuauucuaggggcugugagaagccaugccagcaaggagagauggccugauuugcauuuaauaagauugcuggcugcagccuggguuggagggcagugcagaauaaaagcaguaagaccauguaggagacuauuggaguaauacugauacuggcauaagaggcugggggcugggagaccaagguguccacaguuggaaagauguuuucaagggaaaaccagcacaagucagggaugaacugaucuggugcccagggaacuucucacuuuacugugcugccuggcccaguaacccugugaagguugaaagcucacccccaucuaccccaggccuuaccaagggcugcccuccaccuuccguccucacccuugcgcccuagauaccaccagcuguaaggacaucccuggcuucugucaccccaggccuugccaaagggaagaagaccacucccagcccuccauaaacacacaaccucaaugggcugaggcugugcagagcuccaguagcagacgccccagaaacccagggccgcaaggggucugauggaucucagagguagaaguagggcacugacugccugggaaaugucugaauuguggaaguguaggaaagagcucacagagggaaggaauuugcccaagguguggcaagccaguggcagaggugguguucacauccugaacuccuggcccucaggagggcugcugugaucagauacuugaguuuaaggggcagacaggaugcgcucuccugauugagaugcaagcccuucucucaggccaagcccggugugugccaggugggagaugaacguaaugguuuugagaucuguuccaaagucagacaguccaggguuccaguggggcucugucccuucauauugaucaugagugauuuuaccucuuuaagccuuguguacuuuucuggaaaauggaucuaaagcuaauagccgucucagggaguugcuuaaaaauccagugacauuaggaaagagcuuuaucaacugcugaagccccuaauacagaaccuuagggggaaacaguaauuauuauucauuuucuaauuccauccucuuguuccaggggaaacccucaguaaaaccagcccaggucaaagccucaucaguuucuacuaaggagucuccagcaagaaaggcggccccagccccugggaaggugggggaugugacaccccaggucaaaggaggggcccugcccccagccaagagggccaagaagccagaagaggagucagagaguagugaggagggaucugaaagugaggaggaggccccugcagggacacgaagccaggugaggccuggaggagggcugccccuuggaggaccugcgggucccccagcagccugagcacucugccaugagcaccucugccacuggaguuggggagagggaggacuauggugugaaguugaagagcaagaacagccugcuucccacaggggagucuugcacuccacuuugucugugaccaacuuuaccucaguuucucugccuaguaaaugggccgcuguccucgucccagccaguccugcugugagggacuugagaaguuuugauugccuaauccucugacuucucaggacaaaccagacccugagcaggcaaacacuacguuagcuaaagggaauccaguucccuuccccaucugcugggagugggcagggcugcagccccaaggcccuggguguaucccaagggcaagacaggggggcuggaaagcaauggaagucagagcaggaaggaggaagagugagggucacccacccagccccaggccuggggcaggacaaggcgggggcaugcaguagauaagcagauccccugcguuagcugcugguaaaugguaaagaggaagugggggacauaggaauggcaacuugaagcagagugcucugggcuggccuugggagaaggcgucucaguaaagaccagaaggaggaagcacucuuaggaaggucauuccaggcaggggcucagcaagugucaaggcccugagguagaaguaggacuacgaauugugacaaauuguuguucccaccccaucuacagggaacuucuacgccucggcugucuauuuugcagugucugggggcuacacaguguuggaugggcauccacuuugagaaggaacacaaaugugaauuuuuuuuuugagacagagucuugcucuguugcccaagcuggagugcaguagcggcaaucauagcucacugcagccucacuccugaguagcuaggaauacaggcacacaccaccacacccagcuuguguguguguguguguguguguauagacaggguuucacuguguuucacaagcuguggacucaagcaguccucccaccuuggccucccaaagugccgugauuacagauaugagccaccgcaccuggccauaaaugugaacuuuuauguaaaaucugcuuucuccauguuggcucaaaaauuuaaaaaggagcuagccaagcaagaccuguguggagcagccugcacuuucugcaugagaagcuucuuagaagaucagagcugcuguuuucuaggguuguuggcccagggcugaacacccagggccuuccagggaagacagggccugcagccacccugccaaagccccaagacagugcagagccccaccgaggaguuagugaagagggggccaggugugcaaaccuugccccaugaggcugagggugggcuuccagggguccugcugcuguccaugugcagaaaguccagugagggccucccucagucccuuccccacuuucagacugccucuucauuccuucccuucccugggccuuugcacacccccuccccacagcccagucugaugaugcucccgauaagccagugccugugccuccagagcucucuggccagugggagcccagcagaggacaggcucuaacuacccagugugcuggggcaccagggggaaccauguuaaggaaguggugucucuuagggagccagagacagaggaggcaguggcuaagugaaauggaacagggggcauggaggcuccaggagugagagugugugaagcugaucgauuuuugagaaaccaggaggccaguguggccaaaguaucagucaagguggggaguggggagggaagcaggggaggucuuaggagccucauuaaggccucuggacuuuauccuaaaggcaucaccagagaguuuucacaagcaggagagcaagcugcccuuucuuuuucaccagguaaaggccucugaaaaaauucuccaggucagagcugccucagccccugccaaggggaccccugggaaaggggcuaccccagcacccccugggaaggcaggggcuguagccucccagaccaaggcagggaagccagaggaggacucagagagcagcagcgaggagucaucugacagugaggaggagacgccagcugccaaggcccugcuucaggugaggccugaggagggagacuccaugcagccaggcccguccccagaaggccuucucaggacuuguucucccacucugggccagagccccgggcgugccucagaccccagccccuuacuccccucucacuguguggcaucauuugcccuaucuggucuucuguacgugguguccugugucuccucacacguccauccucugggcugucuccccuugucuuguuucuccaggcgaaggccucaggaaaaaccucucaggucggagcugccucagccccugccaaggagucccccaggaaaggagcugccccagcgcccccugggaagacagggccugcaguugccaaggcccaggcggggaagcgggaggaggacucgcagagcagcagcgaggaaucggacagugaggaggaggcgccugcucaggugaggcagaggggagggguggagaguagccccaugccuaaaccccagcaccugcauggguguggccaccuuugccacauccagcuccugucuccacacguccacccucugggcucuccccucauccuguuucucacuccaggcgaagccuucagggaaggccccccaggucagagccgccucggccccugccaaggagucccccaggaaaggggcugccccagcaccuccuaggaaaacagggccugcagccgcccagguccagguggggaagcaggaggaggacucaagaagcagcagcgaggagucagacagugacagagaggcacuggcagccaugaaugcagcucaggugaggcuggaagccgcccugcauggccugugcccugccucaaaagaccuccugugguuuugacuuuuccucucugaaccuagagcccugugcggcuggcuucguuugcucuccuccccucacucacauucuccuucuggacucccucccuaaucuuguccuuugugucucccaggugaagcccuuggggaaaagcccccaggugaaaccugccucuaccaugggcauggggcccuuggggaaaggcgccggcccagugccacccgggaagguggggccugcaacccccucagcccagguggggaagugggaggaggacucagagagcaguagugaggagucaucagacagcagugauggagaggugcccacagcuguggccccggcucaggugaggccccuuccuguaaggcucuuucuuuuucccccccacucagaguggagcugccuguggccucccaaccucacacugggacucugucuacaaucuuaguuucuuaaugucugcacacaccuacccugggcucccucucccgauccuguguaucucacuccaggaaaaguccuuggggaacauccuccaggccaaacccaccuccaguccugccaaggggcccccucagaaggcagggccuguagccguccaggucaaggcugaaaagcccauggacaacucggagagcagcgaggagucaucggacagugcggacagugaggaggcaccagcagccaugacugcagcucaggugaggccuggggaaggaggcugcuacauggccugaucugccacaccacagucagcacccccggggagcugugcucccucaggcagagcauggguuuuggcugguggggcagaacagaugggggacucugaguucaggaaccuucuccagccuuucuuugguguccccucaggcaaaaccagcucugaaaauuccucagaccaaggccugcccaaagaaaaccaauaccacugcaucugccaaggucgccccugugcgagugggcacccaagccccccggaaagcaggaacugcgacuucuccagcaggcucauccccagcuguggcugggggcacccagagaccagcagaggauucuucaagcagugaggaaucagauagugaggaagagaagacaggucuugcaguaaccgugggacaggugaggccuguguuuucugggcgggccucagggccgccccuacgugguccuuuggacuccuggagacaccucucuuccccuugucaucccaggcaaagucuguggggaaaggccuccaggugaaagcagccucagugccugucaagggguccuuggggcaagggacugcuccaguacucccugggaagacggggccuacagucacccaggugaaagcugaaaagcaggaagacucugagagcagugaggaggaaucagacagugaggaagcagcugcaucuccagcacaggugaggccuagaaggagcaggcccaucccacccacaccuguuccugagccagggcugaggaugggcuugacugggggcuaguguugccugcaggugugcagaagccucagagguagccucaacacagcuuccuucccuaucuuucacuccaugucuccucugcccaucagagcuccagggucucugucuuguuugccuuuugagguccuccugcugauugauucccugugguuuucacaagcucuggaguucccacccugccaggugcugcccuugucugggguugcugaggcgcuguuccucagggaaguccugucucuguggagcauggacaugcuccugcaguguggagcgaugggguugagauagagggugugagccugggcugcgcagcaugacaggugagagcaucuaggccuuuuacaggagguggcagcaucugagccaugggcugaaagaguuggccaggugaaaugggcagggagaguguuccaggcagaggaagcagucugugcgaggccagggaaugagagagugccuggcuugggugccuugccacaggcggcacauuguggugggauggcuggcaguuguuuagagccagaccgccuggguucaaguuucagcuccacagccuggcaagugcuguaagcccucagagcccuuacucuccuauaaacaggaaaucagcccucacagguuugggugagaauuuaggugagaucucaccugcuacacccagcaagggagcugcacacagcaaguugucucugucacccugacgaugggccaggcuaauguggaacagaucaggagugaggucuccaagccuggaagagcugagagaagauggcucacucccugcacucacccacccacuguuuauuauuuuuaauugucgcucuguuuuuuucuguaaccacucagaaauuagucauuucuuuuuucucuguaccagagcacacauuucuacugauuuuuuuuuguccuccucucguugacuugugggaccucagggcucuagaauuccuccauugagguuuuuaagcucugcaggggccccuuccagagccgccucuacucuuucccaagcugcaggcacauuccagacccaaugccuuacagaguuucauuaugcagcucacuuaaauauuugucuucccuucugagccucccaccuguaccaugagguggguguuuuauuuuuauuuuuugaaccaugggcuauuuugaaguaagccguuuaauuuccaaauaucugggauuacccagguuucuuuuuguugauuucuaauuuagucacauugugguuggagaacauauuuuguaugauuuaaauccuuuuuuguguauugagacuuguuaggucaagucagucuugugucuuguuucuuguggaaaacauggcuccccucuggaggauuuacgugcucuacugaugagcaccucggccugagucauacuugguccacacuguagggaaucuucuugaaguccugauucuucaccucauuugaccucauguguuugaggaaugcugggggaugggguuguuuucugacacugaccagaugccaucccugagugaggcaggggccuugagaugcugccagaguccucauucuguuucacauuaggcuugcugucacuccuguuaaggaucucacucugggaauuucccuuuuuuuuuguucuccuucuauuuguuggaaucccugacaggccuuuuggggguucucuggauaucgguuaaggcuagauuaagcugaagaaaaccuuaaacaacaaguaucuuguucugccguggcugcuugagcuccagcucugaccucagcauuccaucuagccuggaggaggaagagacauguuucugaccuuuuauggcacucaacuuacauccuaugagccagaauuuaaugacauugccaccuagcugaaagggagccuggaaaacaucuguuuuagguagucuugugcuuagcuaaugcuaaggaaggcacgcacaaugaguuugaguguuuauuauguuccagacaucauguuaaacucugaaucuccuauuuagucuucaucauaacccguaggugggccuuauuauuaucuccauuugauagaggacugaacugaggcccagugagaucaagugaugagcucagguucacacgccuauugcauggaggagccagaauccagacucgggcuccagcuccagagucuguauucuuggcuagcugcuuuacucaaucucaccuucucccuccuuaauucccuuuucuccacucaggugaaaaccucaguaaagaaaacccaggccaaagccaacccagcugccgccagagcaccuucagcaaaagggacaauuucagccccuggaaaaguugucacugcagcugcucaagccaagcagaggucuccauccaaggcaaguggggccagaagccacaggagguguggaggguugggguagagaggaggaccagucacugagcccagccaggagaaggugcgugcaugggcaggccacccacccagaguugugccauaguggggagugggaccugaaaggaaucacuuuugccuccaauacuauuaucccccugcaauucaggugaagccaccagugagaaacccccagaacaguaccgucuuggcgaggggcccagcaucugugccaucuguggggaaggccguggcuacagcagcucaggcccagacagggccagaggaggacucagggagcagugaggaggagucagacagugaggaggaggcggagacgcuggcucaggugagggggagggaauggagaucauccccuacaugggauguaacaccuuugccacauccagcuccugucuucucacacguccacccuccaggcucucuccucucauccuguuucucccuccaggugaagccuucagggaagacccaccagaucagagcugccuuggcuccugccaaggagucccccaggaaaggggcugccccaacaccuccugggaagacagggccuucggcugcccaggcagggaagcaggaugacucagggagcagcagcgaggaaucagacagugauggggaggcaccggcagcugugaccucugcccagguaagacuugccaggccucugagccaccaacacucacuccucagaacggggguauagggcugggcgugguggcucacaccuguaauccuagcacuuugggaggccgaggcagauguaucacuugaggucagggguucaagaccagccuggccaacauggugaaaccccgucucuacuaaaaauauaaaaauuagcugggcaugguggcgggugccuguaaucccagcuacucgggaggcugaggcaggagaaucccuagaaccugggaggcggaggcugcagcaagccaagaucaugccacugcacuccagccugggugaugagagugagacugucucaaaaaaaaaaaaaaagaaaaaaaagaaaagugaaaaaccaggguuuagggccagguaaggaaaagaaaggaaggccagguuaaggcuuaaggcuccaguuccaccaugcccuccuccgucugcugucauccacaucuccuuagguaaaaccugcuacuaaaaccccccaaacgaagacuuccguagcuaaaaguguccugggucuauaucuaggucgaggucuccaccagcucuauaagcuaggccaguauuucccaccaaggcauaugagaccaagaaucuacauguuaguuauugugcauacguuaacguuauacaaaaugacucucccugucagagucccagggaagcuuggaguguggcacaggucccccugagguccuggagagauggaggaagucucauccugcaccuuggcccggagccucacauaggcaggcgcaucuucucaggcagggcuugucuagcuuagugcaaagccuggacccuggagaguggggagaaagaaaaucugaacaauucccucugucugcuugcagaagauagcagggcuugcuacauccuacagaaguguaggaugacaaacuccagcacugccaaggcacaggugugugauggaaaugacugaugcaggccuggcaggaaugauagaugucggccgggugcgguggcucaagccuguaaucccagcacuuugggaggccaaggcgggcggaucaugaggucaggaguucgagaccagccuggccaacauggugaaacccugucucuacuaaaaaaauacaaaaauuagccaggcgugauggcaggcgucuguagucccagcuacucgggaggcugaggcaggagaaucgcuugaacccgggaagcagagguugcagugagccaagaucaugccauugcuuugcacuccagucugggcaacagagugagacucugucacaaaaauaaaaaaaagagaugauaaaugucaggagagaugguagauagugguagcaaguagggcagaccggagagcccuugccccauccagaggggcaguucuuaucagcuucagccagucaugacuguggagauggaccuucuguguggccaggucuuccauuucuuaagggaagcuggaagucccugugccaggccaagcuccauaaccucuuagauuuguuuucuucaugaguaaaacaagcacugagaugaaugcucccuagcccuaaccucugccuuugauacaccaaaccaacaauuacugggggugaaagacauuggccccacccucaaggagcucacagucuguggggcaagacaggugaccggauuaucgcagacuaugcuaguggugcugacagcugaaagagcaggucucugagaggccagaaaaggaggagaugauugagcugaaccugaaggaugaccaggcacaaaaguggagaaggccccucagugugugcagaggggcugggcaugaaggcacauggucacugaaggcagcuguccugcaggccguaggcccucccaggugcuuguuacugguagauuuauggaggaccuaaaugccagacuaagacauaggccccggccauauuuugggcuguguaguuuuuuuguuuuuaaguuuucaaugaguucuuagucagaauggccuaaucuguaggagaaagccccauucaaaagagcuuaaauaaggggauugacugucuuaaagugcacaaagucccagguuccagcugcugaaaagcugguuccuuuagcugagcgucagugguaaccagauuucuucaucucugcacuccacuagcuuuauggucauagcagggcugcagcaucuccuaaagugcugggggcaggccaggcacgguggcucacaccuguaaucccagcacuuugggaggcugagacaggcggaucacuugaggucaggaguucaagaccagccuggccaacauggcgaaaccccaucucuacuaaaaauacaaaaacuagcugggccugguggcaccagccuauaaucccaguugaggcaagagaaucacuugaaccuguggaggaggagguugcagccugggcaacagagugagcagagcaagacuccaucucaaaaaaaaaagagauuaggggguagacuuaaggcuacucagaccucaggcuggacguucuaccgccuuagccauagacaagaggccgguaguucccaugacuggcugggaggagggcccacccucccugaagcaugugguaggggccacugaacagagugaggguucuauuagcaaggaacagaugggggcauggcuguuaggaggcagccugcagugugcauuguaguugccccauuuaaaaauuggaaaugacauguacaaaucuuccagcuucucuugauaaauuggaagcucaggcagccuggguccuacuuuuuuggcuaggcugaguagggaaaaggggggcccccauuccaauagggaccacugagcugccaucaccaccagcauuuccacccagaucucugaguccuccucugacugcagugcuugcucauccuuccagcccccaucaucacaccugccccaacaggaggggaugguagccaguggaacacuucuagguggcuccugcuuuuggcuggggguguuacaaccggaggugagcugugcugggaccacuggcuugugccugcaaccuugucccaggcugcugucaccucuugucgagacauugggccaacagcccugcagcccucagguuuuagcugcaucggagucauaaaucccuuucauguucggagucagcucuggaaggagcuagcaggguggaagcauguuuccaguggcuguggggcaggucaggccagcagguaucccugugcaugugcaggaaggggccacgcugccuccccuggaaaccagagugccugagggucauugccuacuggcuguuucccccucagcaaaugccccacuccccgaccacgugcuuauccaggucuuguccccucagaaggacaguaacuccaaaccugccagaagcaagacccuggccccagcacccccagagaggaacacggagggguccucggagagcagugaggaagagcugccacugacccaggugcgccaugccuucucucugcagaugcugcaggaucagagcugggcuggcaggccuugcaggagagggcagaucuugcccauagggaaaaucucgccauauuuaaacagcaccucacagcuuccagagcucuuuccucuauugugacauucaucugagcccugugaggcaggcagcaguacacaguuaaacauacaggcuucagagccaggugguguuggggcgaagcccagcucuuccacccaacagccccaugguccugggcagaugccuuuuccccugugugaggcucaauguuucagccauaaaauggggacaguacuggcaccucucuccugccucugugcacuggugccagcacacaagguacuugccacaguccccugccuaagaaagggugccuguuaacugugagaagggcagggaguguugccccauuugacagauugggaaucaagccuuagaguugaagcaguuuccccaaauucucaugauucauaagaggcugaggaaagguccaaacgcugguccccuggcucccuguaucucucuguuuucuguuuaggaccaggagucuucuugaaucccaugagcucugcccaggacccucucucaagcaccuguggcauaccuucaugugcuccacugcacccagagcuuaagccacaguccugcucaggcuacaccuccaagggugggaccaggcccaccuuaucuuccuguacuccagaggcccaagucagccaugcuggugugguccaagcuucugugugaacccuggcccuuccaucagacagcauuacccuuuguccuccucuagccccaagcucccagaagcuucugccaggcaccucagagcaccagcuccccugucccagggccuaaccacagauccuggaguucugcaaccuccagaccagagcggucucaugaaccaccuccccuugaauaucacauaccacauuguuaucaauucaucaguaaggucagaugcuguuugcacaccuccagcaauagggugcucacugccucucacuuuccaauggcacagauuacaaaaguaaagaacaaccaccaccaacaucgguaacucccuguauucucauuuuucuguuuaaucuccacaacagcccuaugaggguggcucccuuuguuguuugcauuuuaaggaacugggagugaggcucagagaaguugagggaccugucccagcaucacauggcugaugacaaguggacagaccugguguuugagcacaggccauucacauucugacccguugccuggugcugccccgacacucuccucuccugggcuugggcauugcccucuggcucuguguggagccuuuacgaggccaccugccucucugagggaucuaaacaacugggagggaggggaccgcucccccuuucucuguggggguggacuaacacaauuaaaaugaacauccugcuuaaacugaaccauuuaauugguauguuaguccugaagauucuggagucuauuuaaaaagcagaaaagaagucagcgguuuguacauucccccaggaggauucggggaagacgggcauagcccggggaagcugcagccucuuccugauugagagauuuuuaguuccuaauccccagcucacuaauuaugauuauuuucauuauuguacauuuauugagcaccucucuauugacaaguuucagucugauuuuauuagcccaucaguggggaaagggauugaggccaggguggugggcagagucccaggcugggaggcagggauagauaccuuggcuccauuccuagaccccucacugugccuccgcccuguugugcagaguagaccucaggccagagucugugcuggggucaggacagcuuccagauuuaaaaacaaguaggugauacauauguuaaauaacuuaauuuagcuauuccacaauguauauguguaucaaaacaucauguuauauaccacaaauauaugcaguuucacuugucgguaauauuuuuuaaggccaacuucuucuauuaguuugucaaagacguaggcccugcucucaaaguuuuagguugaaucaaagaaaaaggaaaccuguaagaaacuaaauucugguguuacauugaggccuagcauaauugguucuagaaggagcuccagucuggugccuggagaacuaacuucuaauccuggcucuggcaccaguuugcugguugcccugggugaggccacuugccuucucugagccucauucaucucaaucucugggaugagacuuccuggguuggugggguggaccuugaggcuccaggccacauccccagagaguagaauuucucaguccccuggaguggggcuggccuagaucuguuaagcagccucaggcaauucugagagagguucuuggaguguuuguugccuuuguggucaugucccuugccaggguccgcagccuaggccaucagcccccucuccccacucugugacuugcuggaaugaaggcacaguuagaaugagcucagcuuugacaggauggggugagcacuguccagaaagccccuagguuugguucugcaggcaucagaccuacagguaggagggguaucccaggguucccucuggguccuuacugcccagcaccuauagggagguacaaccaaauguucaggccagugcugguuuugcugcuucacucccaucaguuuuuuuucuaacugaccccagaacuacauuccuguguauacugugcuuuccaguuuccacagugcauuggaaccccuccagugaaugagcccaggcugggauaacuacuagccguuucauuaaacgggaaacugaggaucagaaaguugaggggcuugaccacacagugaagucaugagagaggcguaaugagaagcaggucuucuccuauacccugggcaagcuucacugcccaccuuuaugaacucuacaggcuaaugccccgccccaaccccccacagccaagcccccugcaccaccucccuccuacggcccagaggcccagugggguggcgugggcagguggaacuaacaggaggcuuuugcugcugagcugcuuuuaacaucccaagacgcuauuguuugccucaguggguucguugcuucucuucguccccgacaaucuguuccugucuucacauauauauagauccccccucccucaacuguaagccuucucccacuuuccauccuucucuuuuuuauaucgugggaaggaaggcucuggaaguggcagaucggagcagccgcgggggaggcuauuuggcagggguaggaaaggccuaagcccagagaagcuuccacccucaggcaggcaccuuucuguuuuacuuuuuacuuuaugccucuccacagcaccuuagcacccugaggagccaggugugcuaagucaggcucaggggguaaacaggauggugaaacagagaccagucuggaccugauuccacuccucucuuagccucaggcagcucccucuuccugcccuccagcucuucacuggccagagagggagcagagcucaaaccagaucugacauuuggggaauggaaaguagaccugaccagcucccuggcucacaaccauguguguucucguuagcuggagguucaggaaggaaaugggccuggagaugcccucgugugcggugaacauguucagggauggugcaguucaaaaccagacuggccugcagaauaccagggagcugcuguugcuuguuugcuuuuucuuuuauuguuuccuuggaaaauuuaaagcauacccaaagauagauaauguaaagaacccccacguaccauccccagccucaacaguuaggaacuccugagcaggcucguuucacgcaaacccuccacucaguuccccaacgccccuggauuacuuugcagccagucucagacaugucagcucauccaccaggauuucaguaugcagcucucaguuauaaggaccuuuuuaagcacaacuacgauacagugucacaccuaauaaguugaucuacccagucagugucccuauuucccugauugucucauggaguucaguuaaaggccacguacggcauugaguuauuaauccucuaagucuuaaucuguugguucucacccacucacccaacccuuguuucucuugugcauuuuuuuguugaagaaacugaauugguauagcuggggaguuucauccugggccauguaucaggagggcugcaucagaaccucugggguuggggcaacuagacuguaaauaccuccccaggugaauugcauauuccaaccaggcagccuuggaaaacugcuuagaccacucccugcauucagcaaguaacuguuucugaagccagccggggaaagaaggcagaauuggacauucuggccguggcuuugcuuccaguagggacagcagccuugggucgcucccuuucccucugggcuugugguuuucccacuuuguauaagggagcugauccugcugaauguagggcuucacugugagggucaggugggcucugggaguugugaagugcugugcugggucuuagcagauguguggggugggagggggcacccugggcagcuggaauggcuucugugcccagcugccccugagcucaguggacccuuugccuuguaaaacacucccuaaccccaucaccuccuuucccuggccaagccuuuaaucacuggggggguguuuuguuuuuguuuuucaaggugauuaaacccccucugauuuuugucgacccuaaucguaguccagcuggcccagcugcuacacccgcacaagcccaggcugcaagcaccccgaggaaggcccgagccucggagagcacagccaggagcuccuccuccgagagcgaggaugaggacgugauccccgcuacacagugcuugacuccuggugagcgcagcccuuaugcaguggugggaggggcugccagcacugccccacauugaggcccagaagggacaggacacuggcugagucacauagcaagguguuggucgggaggggcuuggggucaggucucugggcccugcauuagccauucugauuagggccuggcucagaccugcaguucugggggaauaguugccagagcuuuuuuguggcagccccagucauggagcccagaccaguggcuagaagcugcagggaccagguuccuacauagucuaagaaagaauucuguaucaguugacugccuguggaacaaguggucagggugguagugagcuucccguccuugguggcauguaaaguagguuaggcaaucccuaagccagagacaucacagggauagauuucaucuaucagagagacaggaccaaucugagguuucuuugacuucugagaaucugugauucuaccaaugacaacaggaaaaggguuaauguuacuauuacaguuauuguaacaguuuuacaagcaauaauaccugauccugauaggacaauuuaaaaaugcagacgggugcaguggcucacgccuauaauccuagcucuuugggaggcugaggcaggcagaucaccugagaucaggaguucaagaccagccuggguaacauggcgaaaccccgucucuacuaaaaauacaaaaaauuagccuggcgggcgccuguaaucccagguacuugagaggguaagccacgagaaucgcuugaacccaggaggcagaaguugcagugaucugagaugugccacagcacuccagccugggcgacagugagacugucucaaaaaaacagaaagcaggcaaaauagagauuacugcugggcauggugguucgcaccuguaaucccagcacuuuagaaggccaagguaggaagaucgcuugagcccaggaguucaagaccagccugggcaacauagugagagcccuaucucuaccuaucuaccuaccuacauacauauguacauauacauauacuuauacauauauguguguauguguguguauauuuuuuuaauaaaaauacagauuagcacauaagaaacuauaucaccuguaauucugccccaaauaauuacuguuaacauuugacaaaugcuaacuuuauaaaaaccuaaaauauacguguguuuuuaaagcaagaccauacuguaucuaauguucaguaaccuucacuggauauuuuaugacaucggguuuuuuucaucuuuacauauuugcagcacaauuccuaauggcuacagagaaaucccuuggguggacaugcuacaguguguguagccagcaccauguuggaggaagcagaggguuuuguuucaggguggaggggugagggaguuggcuguuauaaacagugcuuugaagaacaugcauguaaccaggccucugcagauaaccacggggacucuuaggagagacgauuuuaacugcaaggagagucguuuggugccggugcucuggcccauugcucaggaguggcagcccgaccaguugggaggggaggggaugaggaagccuggggucacccccagagcagccauuugagcucccugagccuugucaaaugacauaaugacaucuccugccugggaggcuuggagagggaaguaaacaagcuucuaccucuguaagcccugagcacagcucuagaucaccagcacaggccgguaaauuggguuauugccgcugcugaggaggcgauggggcuuuugugcccugaugugcccccaucucgcuccauuucaggcaucagaaccaauguggugaccaugcccacugcccacccaagaauagcccccaaagccagcauggcuggggccagcagcagcaaggaguccagucggauaucagauggcaagaaacaggagggaccagccacucagguaccuggugggcaagggaggguaaugcaggccagugggguggggcccuacuuccauacuuacccacaugugcugaugggauggccugcaauugcugucacgcccacacuccagaggucguggccucacagccagaggcuuucuggccuccuagcuacaaccccccaaaucaccuuugaguuaugaggaagaguaaucuggggacacagccuccuggccaagcaagcccugcagcacucgagucccucaugagauuuuccagcguaguggggcuuuugauuuuuuuucuuccaguuuugaaaugccaugaacaaaaguugcccuuuuuugguguuuguaauagugacuucagcauucuuccaagccuuuaccaucuucagugcauuuuuauuugguccuugccugaaucuaaaagcugggcauuuuaggguuaauggcuggugcauuguuuagaucauaaaacuuagcacacauccccaccccaagggcugcgaugugaccagcauucagcaaggccggaacccgggucuucugagacccaguucauugcucuuugggccauaucagucugguuucccaucccacugagaggaugaaguccaugacacacucugaccucucuuccugaggggugggcuaaggggguguuggggggcgguggggcuggugugccacccacucccugggcucaucacaagcuccaggucaaaaacuucugggaacaugggugucggaugggaagucaggcuguggucacugcauccaugagcaucgguuccugccaggcccuagggauacugcaggaaccaagacagggacaaggaauucccaggccagucagggaguggugaggggcagcgauuaaacaaggaaacccacauauaaauaaaaaguauucaccagcugguaggagaggaaacaauaaaaacuagagaauaguggggugaccugcuauaugaaggccuccugagacagcgaugcuuaagcagaaaaagcagccagucacaggaugagcugggccacccuccaggcagggaaacugcagguaccaggucuucgggggaagcgcuugggaaugagggaaacugagagguggggacagcuggaugaggagcugggggagaggagaugagccaggccguggcaagagccacgccacauuugaaggcucucagcaaggggucaugcccaauuuccaugcccaccacucucccugacugcuagugguuauaagaaguagagauggggguccaccagguuggagauuauccccagugaaggugcagauugaguaguggggccuaagcugcuucccugcccugggcugggaacugucccuugcuccuugagaacaaugugauucgcucauaaccugaagccugccaccaguuuugccccuuugacugccccucagucccugcuccagcccucaccccagccagacagcaucugaccaggguguggcacagcuggcaucccaaggacuugugagucugagggcuaccucuugccacccacaggugucaaagaagaacccagcuucccucccacugacccaggcugcccugaagguccucgcccagaaagccagugaggcucagccuccuguugccaggacccagccuucaaguggggugagcuuggggagccaggggaagcaagcccacggagcguagaaggugcaggcguggcccugcaucgcggcaccagcacucaucugccccaugaccucugcacuugguuugccucccucggccucaguggccuaaucuguaagaaggaauuacaguaccuuucguaguuggaaggaucaaaugaggcugcaugugugccccaucuaacacaguuccuggcccuacugaaguguucaggaaggaccaggucuuacuugcccuaauuuuuccuuccauuccuucuccuuucaccgaauuagguugacagugcugugggaacacucccugcaacaaguccccagagcaccuccguccaggccaaagggaccaacaagcucagaaaaccuaagcuuccugagguccagcaggccaccaaagccccugagagcucagaugacagugaggacagcagcgacaguucuucagggagugaggaagauggugaagggccccagggggccaagucagcccacacgcugggugagggugccaggggaaaggcaagggugggccaggaagaggguguuguguggccugguggagccauagcucuggccucagcuccauaucucagacucauucugcaccuguggcugagccugggccucaguuuccccaccuguacaacuucaugaggaagucaauccaaaugauuucagagaccugacuuugcuguuugaccacucucagcuuuuugguaucagacucccuucacuggcucccaaaaacuccagggccauguuucuggaacaguggaaagcagggaaauagaaauggggccucaggaauuagaaauaaggcuuuggcauucaaaugucgcaccuagcaugcugugacuagcgauaagugugcaaggaguguugaagcaguaggaagacuuguggugaggcggggcaggggaugggggugagggaccugcagagagaccagggccuuccugaagggcucugcccuucccggcuggcaggggccaccuggggcuaccaacaggauacugugcuucuccaguaggucccacccccuccaggacagagacccugguggaggagaccgcagcagaguccagcgaggaugaugugguggcgccaucccagguaacugcaagggagaggacuggcagcccauaggccuuaggguggagccccaggccaggcuccugucuacccgaucccucaggucaggggucuggguccccucucuucacagaggccuugggcaagguccugucugcaaggcaccacguguggcccagccagcagaccacagccaggcugccuccguccccucauagagcccugaguagcugacccuuggggucuguagaagggauugaccuugauucugggugauguccggacaaaaacauucuuuagcagauuuauuuuaagguuacuaucuguauguggcaaaagcuaguaauuuuccauuuguauuaauaagaaauuuccuuuuuaaaugugccugucuagaaaguguauuaauuaaaauaguucaggaggcacacgccaagggcugaagugcugcucugugccuuguuguccacccacucugcacugauagggcagggugauccuagaggccccaggcugcuuuccucacagcaggccaugacucgggcuggguuauggcagugggguggggugguggcagccucuuucacaaugggcuucuucagucucuccucucagguuauaugaccccuggacuaaccccagccaauucccaggccucaaaagccacucccaagcuagacuccagccccucaguuuccucuacucuggccgccaaagaugacccagauggcaagcaggaggcaaagccccaacaggcagcaggcauguuguccccuaaaacagguaaguuaaggucugcaggagggacauagcaggacacagagggacagggcagugggccccuucuugcccuccuguagcaacaguccucccaacaugguccugucugcccccagagccucuccaagugagaccuuguggccuugcauuggaccugaagaugcucaucaaagugcagguggggccaggugcaguggcucaugcccauaaucccagcacuuugggaggccgaggugggcagauugcucaagcccaggaguucaaggccagccugggcaacacagagagaccccaucucuaaaauuuauuuuaauuagccggugugauggugcacgcuuguagucccaauuacuugagaggccaaggcagaagaaugacuugaagccaggagguugaggcuauagugagccaugaucaugccacuacacuccagccagggugguacagugagacccugucucaaaaaaaaaguacaggugggccccacgcccaggugucuggcucccauggcccuggacagccuggaaguggggguguauccagcccuggguggugcugaugcaccugguaggauagcccuugccucagaggaagcugcgucuuuuggcuuguggagcaaguguuggcucucuccaaccaucaccaucaacuuuucuucccuguaaauaggcucacggugugggccuugggccucagaggauagcuuagacaauaggcugacagucacguuuggaggacacucagcacaugcaggagaccccaggcaguagacuggccccaggcuguucugacucauuguaaagccuuggaaauccccuggccacucuggaccucugugucuuaaccauacaaaacagcaguugauguauccagucugugucaaggcauggcacauguagaaaauagucacauuguauuuggagggcagacuggauuauucaauucaccuaaccuggggcauccacacucccugacccuacuggagcuaagggucaaauauguaccagcugggcacacuugggacagcuccagggcuuccccagccuugguguucuggguguuugcagauaagcagcagaaaagugggccuggcgcaguggcucgugccuauaaucccagcacuuugggaggccagggcgaguggcucacuugaggucaggaguucaagaccagccuggccaacauggugaaaccuugucucuacuaaaaauacaaaaaacuagccagcaugauggcaggcgccuguacucccagcaacucaggaggcugaggcaggagaaucgcuugaaccugggagguagagguugcagugagccgagauugcaccaccgcacuccagccugggcaacagagcaaaacucugucucaaaaaaaaaaaaaaaaaaaaaaaaggcagcagcagaaacguaggcucuggggagagagguuuccggggcuaacugcccuccccagcuucccucuccauuggcuccugccaucuugaagaauccccagaggauggaauugggccuccagccgucccgggggccccucugccuaaccuggccugcccugcccaguccaccucccccagcccaccgcagcucuagagccaaaagucgccagaaauccugguuggggcugaggggccaagcucacugcaugcugcagggggcagcccuagccucagugugacaugaguaccacauagagugugacauggaguauccaccugggccuuccuccaggcaaacaccuccaggaccaaaccaccaagccaccuuucagagcccagcaugcaggaguguugugcccaugagacccagaauggggcagagaccuccaagucacuuggaaguuagagccggugaggagacccagucauggggcuuucagcugcagcuugccccaggcugggucggaagaggaauugcugcucacuuucuuccccaacauucucugugagaggcggugcgacaaggagacauuuuagagggggcuguggaagguuuuuuuuuuuuuacacguguagucagcacacaauuaucaaaggcaagcagaggcguggaaaauucuaaacaaaggcugcaccagaagucucucuggcaggcaguaaaccugcuuagucagccaccacguguauauacacugcacccagagcuccccaccuugccuggacccccugaccaggaagggccgaguguggguaaucaucaguugaaugucugcauggcccccacuuuuauuauaaaucuacaauguaucauaggaagccuuacuguucauccaccccucacguuauagacagggaaaccaaggcccugggaggagauggguccuggccagaaucacacugaaagugggugggaaagucagaccuagaacccaggucuccuuccucccagcuccagacuccaucucccuccuuucugaauuuucauuccauugauagauuucaggcccuuucauuaacauucuggagucauuuucugucccccacccuaacuggaguuuuuaguauaaagagacagggaaaagcuguaaguuagaaaugaagucagggugugaaauugguggaaaggugugagcuuaggagaccagcuggggcagagugaccgccaagccuugcucuccccaucugugccauuguaagaaaagauggagucacucccugcacccucuucgcucuuagguaccauaagaucugucccccaacucucccagaucugugaccccacauucucucuccauagguggaaaagaggcugcuucaggcaccacaccucagaagucccggaagcccaagaaaggggcugggaacccccaagccucaacccuggcgcugcaaagcaacaucacccagugccuccugggccaacccuggccccugaaugaggcccaggugcaggccucaguggugaagguccugacugagcugcuggaacaggaaagaaagaaggugguggacaccaccaaggagagcagcaggaagggcugggagagccgcaagcggaagcuaucgggagaccagccagcugccaggacccccaggagcaagaagaagaagaagcugggggccggggaagguggggaggccucuguuuccccagaaaagaccuccacgacuuccaaggggaaagcaaagagagacaaagcaaguggugaugucaaggagaagaaagggaaggggucucuuggcucccaaggggccaaggacgagccagaagaggagcuucagaaggggauggggacgguugaagguggagaucaaagcaacccaaagagcaagaaggagaagaagaaauccgacaagagugagugaccgcuucucccagcccaccccaagggcugcugggcaccccacgggggcgggagggacccucagccagcaccuggucucauuccucccauguagaaaagagaggcugagaccagccuggccaacauggcaaaaccccgucucuacuaaaaauacaaaaaauuagcuggaugugguggcgggcaccuguaaucucagcuacaugggaggcugaggcaggagaauuguuugaacccgggaggcagagcuugcagugagccgagaucacgcauugcacuccagccugggugacagagcaagacugucaaaaaaaaaaaaaaaaaaaaaggcugagaagugguuuguccagagucacaggggcagcuuguggcaaagcccgaacucgauuccagagcacuugagucagcacugccaggaaugcuccagaaggacgaggagucauguccucuuuccccaagcccagugcagcagaucuuggaggaaccugcuucuccagccagcuccugggugcagaauggaccaggaaccagacugucagaauccucaucccaaaccccaucuugucucuagaccucaguuuucccuccauaguaacacuggcccuuuacugagugcuguucuagacuccgcaugcagcaggaccucauuuagguagaaaugagacucagcagguagaaaacugcggcucgggcucggagaaguagagaugcuguucagggccacagaguuuugcuagguggagccagagucaaaccuaggcagcacucucgagcaucgcccuggacgguggguugccagugacgcccgaagagccagcucguucuggaacaaaagucgggcacccucagagcaggacuugcagccccuuggugcucagaacugugcuagauuuccauuuacaguagggauagauaguguccauuuaaaauaaauuugcgggaguuuuaaaaagugaguugagcuaaagaaaaaugguagucauccaggugguccauggaugggacagaaaucaugagcuggccuccagggggcaggugaacuggcccugcugggugaucaccacagcugccagccuguuuuauuuuuauuuuuugagacagggucuugcucugucacccaggcuggaguucagugucaggaacgcagcucacugcaggcucagccucccaagcucaagcgauccucuugcuucagccccccaaauagcugggaccacaggcgugcaccaccauccccagcuaauuuuuguauuuuuuguagagacaggucucacuauguugcccaagcuggucuugaacuccugggcuuaagcaauccacccgccucagccucccaaagugcugggauugcaggaaugaaccuccacgccccgcccugcuggccuguugugauggcuucuggugguguggggaaagcugggagcccugcccugugcaccucccaacauugaccccagcacuuaggauuaccaucuguuguucaggaacuuuacuuuacuucccuuaggaaaaaaagacaaagaaaaaaaagaaaagaagaagaaagcaaaaaaggccucaaccaaagauucugagucaccgucccagaagaaaaagaagaaaaagguagagaguuccuggggugucucaggccagaaaacagacccaaacccaagcccccuccuacacacccagaccugguuccugcccccuucccauuuucggggcccagucgggggcgucagggguugugacacaccagggaagaggcuggcagggcauguucccugagcacauggaagccguagaaguggccugccggagguagaaggguguuggggaaggaaggagagacuccccccagcacagggaaaccagguagacuguggcagguuuccaggugaaaggaaacguugccugggcugcgugugccccagcuggcaggcuagcccugaacaacagcuguccucacggcgcggggccuuagcaccucagacacagaugaaguucucaccuuggccagcagggccucagcuguauuuaggagagcugaacaucuguuugccucugcccuuggaggucgcugcagacccaguaucuauucuaggggaauucacuaguccucaggaggugggggcagcaguggguggggaaaagcugcaggucugagagccucucguacuucccuccucacagaagaagacagcagagcagacuguaugacgagcaccagcaccaggcacagguacgcuucccaaucauuccugagcauucagggugggaggacagcucugguguccccuguggucccagagagccaggcagaccugauaggugggcucuaaggggaaaggaggcuggggaaagagguucuguugccaaggguccauggggccacuggggugacaucaggagcuggcacugcagcaucagaaggauccagaacaguaauggcaguggugacaccgagugcaccugggugcagggguugugcaugcuuuagggggugugcccugggauggagccuguuuguaggugaggucggauacagcuugguuccuccuucacuugugagcgguucauuuuccucaugauccuguaacuugggggcauuuccuuuugggaaggaagaugguuuacucaagaugagcuaucaccauggaucuaugcuucccuauggaggacaggcccugccaagugguggugacaguuagcugcuccaccuggcucugcuggcccuguggucacccagccuccuguaaaugggggugaugcagagcccgccuccugggccaguggugaggcuuaugugaagcuaaacuaaacacuaaaggacucagcccaguucucagaacauuccaagugcuaaaaaauguccacugugguuaaugccuccccccugcauuggagaugccagauuucauuuuccuugcaggggaaaagggucaggaaauuugacaucugcauguguuuccuuccccuagggauuuccuagccgagcaguggccauccccaugccucugaccuccaccgaccucugcccaccauggguuggaacuaaacuguuaccuucccucgcuccacagaagaagacagccagcuucaggggucccugugcuggccaagccagugagccugcggggaggcugguccaaggagaaaguggaccagcucccaugaccucaccccacucccccaacacaggacgcuucauauagauguguacaguauauguauuuuuuuaagugaccuccucuccuuccacagaccccacaugcccaaaggccucgggacuucccaccaccuugcuccacagauccagcuaggccugaccugugccucaucccgugccgcucggucucuggcugaucccgaggcuuugucuuccucucgucaguucuuuugguuguguuuuuuguuuuuuuuuuaauaacucaaaaaaaaaauaaaagacuuggaggaagggugcaagcucccagugc

SEQ ID NO: 18565 - RNA, 4628 nt, Homo sapiens
aggccuuauuauuagaacuuuauucaugauacugauuguucaucaaugacuaugucaauaaguuuucuuuuaaaauaaaucuauagccgggcgcgguggcucacgcauguaaucccagcacuuugggaggcugaggcgggcagaucacuugaggucaggaguuugagaccagccuggccaauguggugaaaccccaucucuacuaaaaauacaaaaauuagauggccaugguggugggugccuguaaucccagcugcucgggaggcugaggcugcagugagccaagaucgcaccacugcaauccagccugggcgacagagcaagauucaaucuccacaaaaaaaacacaaaaaacaaaaaaccuauagaaauuaguaaagucaaucaauucaggaaaauccccccccccccuuuuuuuuuuuugacugagucucacucuugcccaggcuggagugcaguggcacgaucuuggcucacugcaaccuccgccuccuggguucaagcaauucuccugccucagccuccugaguagcugggauuacaggugcccgccaacacacccggcuaauuuuuauauuuuuaguggagacgggguuucaccauguugaccaggcuggucucaagcuccagaccucaggugaucugccugccucggccucccaaagugcugggauuacagguguuagccaccaagcccaccccaggaaauacuuuaaugaaguacguacaguggcacuugugaauggcaaaaauaacaaagaagguacuucagugacugaaguaggaucuaguccagcucuucaucauacagaggggaaacugagacucagagagaagugacuugucuaaaggaacccaggaagccgguggcagaaccuagaccugacucaccccagugcccuuucccuucccuguagcaccugcuguaucugcacauuagcaaaccccacugggacugacacuccuacccuggcuugcacccucucugacugaacuuuguagaguacagaggccaaggacacccuccaaaaaguugugaagaagaaaacaacaucuuccuuuaauaaaucaaaugaauucuccaaggcuaacaaggaagauugaauucucggccgggugcgguggcucacgccuguaaucccaggacuuugggagguugagguugggaggaucaccugaggucaggaguucaagaccagucuggccaacauggugaaacgccaucuuuacuaaaaauacaaaaauuagccagguaugguggugcacaccuguaaucucagcuacuugggaggcugagguacgagaaucacuugaaccugggaggcacaaguuucaguaagcugagaucaugccacugcacuccagccugggcaacagagcaagacuccaucuaaaaaaaauaauaauaauaauaauaacaauugaauucucaugcaaggagagguagcuggaccccauaugucccuaucacccuggagcucccucacugaucaugguagccaccaucuuacagucuguccucugggggcacuggucccccagugugaacuuacaauccccacaaagcagggaccaggcuaaggcccaacuguaaaggcucagcgauggcaaaauugaaauaaucacagagaggaagccaugcagcccuuggccugccucuaugcagcgggccccaucuuagugcuggcccccagacuccaggcuuaaacaucugcucaccuccaaggcugaacccacaagggcagacccagaguaagugcucauucccggccaaguuccacccuccagggcccuauuuuuuccugucggggacuugguucucucccacccuaugcacagggguagauauuggaagccaccuaucuuuucaaaagacaccaugucagguggcuuuucuuuacaaaugccuccuaggacuccagcccuugcugacugcagcaaggcccagugcccccagcaaugcuaagcucuguuugucccuucugggauuguucuagauuguucuaaugcagucucacuuggaaacugacuuuuuuuuuuuuaauuuuaucuauccauugucucucucucucucucucacuuucucucucucucucucucucucucucucucucccuaccuaccagguuaugagacuggcuauuuuuuuguauuuuuuguagagacuggguuucaccuuuuugcccaggcuggucucaaacuccugggcucacgcaguccaccugccucagucuccuaaacuguuggaauuacaggagugagucacugcucccggccaaaacugacuuuuagauuccacugcguuuuuuucaggaauuagcccagcuugggacgagucagauugcuucucuggaccugaguuugcauaucuguggaauggauauguuggucuuguaugccuccagcccugaaugcugucagggacgcuuauagagcccuucucagauucuauaguucggcugcugggugaccucugaccucugaggucacucccaagucuaugacgcugaaacccuacauucuguaugucugagagcccaaauucaaagucuguuauucuauggugccuaagacuuggugauuuuaaguccuuauucaaagccuggguguagcgugcuucugauauuaggggauggguguuauuggauauuuucugcaauccugaaaaaaaaagacauuuuacauuuuucaggaaauaaguggcucacaaaccuggcuuggcaccaggaucaagugguagggaaggagaagggagauuuuuaauauuagagauucuugaacugggcucucuaagggugggguuggggaagcuguguuuuaagucagcaccucacaugauucagaccuauauucgggcuacacaaagggaagggcuccucucaagcccaagauacagaucaccacuguccaaccccucccugggucauugucuuucuaugcuuucauuuccuaucuugaggaaaacaucgaguuucuagaauuaauauaauaauaguccuggagaugccucauguuucaucugguggaagcuggugucagggacuuugucagccccaucaugauuccaagagcuaugcaucucucccuaacgcuggaaagucccaugaccucaccccaugaccaccaauaccauccuuaucauuucaagguucuaagauucuacaauuuucauauuccuccacguuuccacaauucuguauaucuacaguagaaguagauauacaguagaaguagauauacuucagacaggcccacgggccgugucugaacuguagauauguuucacuuggcuugcaugauguuuuaaauuugaauuagaugccaauacuaaaaaaugaagaguuuucauauaaaaauucagauuuccagauucucuugaaaaacgaggcacgucaacacuggucucacucacauggcaaccaccagggaagcugugugcaggaugcccucuuuaggugggacaagacauucuauucgccacaguccccaucacucccuaucgccucccugacccagaggcaaagggucaguugucauuuagcaucuuauacccagcucagcccccguuguuuaugugccugccugguaccuggggggauccggauuugagacugugcucacagcucuucugguucuaugauccucuaggcuuauuccauguggcuaacggucaugauucaaacauuccauuuucucauguuugaugaauucugcaugucugaacuccacuguaucuaaacuaggaugugauguccccaucaucuagaaguucuaccuugaucccagguagcugaguccugccacacaggccccuucccugcaaaugagucaggcagggcgccuccauugagagggcugcugggaguggagaaagugaagaaagugagacaggaggcccccgguugcaucuccucugccccucccauccccuccuccaguguggucccggaacagcaagcccgugcacaccaccauccugaauccccacauccaccugaugggcgacgagucagccugcaucgccuacauccgcaucacgcaguaccuggacgcuggcggcaucccacgcaccgcccagucggaggagacccgugucuggcaccgccgggauggcaaauggcagaucguccacuuccacagaucuggggcgcccuccguccugccccaguaagaaucccuccuuccugccucccaggguaauguaaaggaugggaguguugcccuggaggggguuacgucggggaagcugcugccuucagcucugaaaggcugcagagugggguggggagaccccaagaagggggccaggccugcaggucugggggaagagcugggcaggagccaccagggaccgcauggacuccaucuaaagcggcaggguggguggguugcccaagcaggaaacaccaugcccugagaagcaccccgugugugucuuacagcugagggaccaggcuggggucgcugcguugcugugccgcagagauccacucuguccguggaguggagcugcugguucucccagguggauuuugcuggaauucucccaugucaucaccccaccaccgucacuucuguaccugcaucaagaaaaccugcuuguucacaaaagucaucgcaacuucaga

SEQ ID NO: 18566 - RNA, 42069 nt, Homo sapiens
aagugggggggcauggaagcccauaguggugugagcuccugaggcugccagcagccagcagugacugcccgcccuaucugggacccaggaucgcucugugagcaacuuggagccagagaggagaucaacaaggaggaggagagagccggccccucagcccugcugcccagcagcagccugugcucgcccugcccaacgcagacagccagacccagggcggccccucuggcggcucugcuccucccgaaggaugcuuggggagugaggcgaagcugggccgcuccucuccccuacagcagcccccuuccuccaucccucuguucuccugagccuucaggagccugcaccaguccugccuguccuucuacucagcuguuacccacucugggaccagcagucuuucugauaacugggagagggcaguaaggaggacuuccuggagggggugacuguccagagccuggaacugugcccacaccagaagccaucagcagcaagguaagugcuggaaaaagugggaaccccagccccaugcccugucccuuugcccuaaccugcaucucuucgaguagguaaaaaaaaaaaaaaaaaaaaaaagggaagauauuuuuaacaaaacaagaugagaggaggcugggagacugugggugaugucagggauggaggagccaguuuucuccuuuccccugcucuggggugaguggccuccaccucaucaucccugcugcuccugccuucaucaaacaauccucagggguuucugggugcugacugggggccuccaaagcacagcacagucaauggggaguggggagagcugggaagagcgggagaggggaauugggagaagguaggcaggguacacagaaagcaggggacuggggaccucaggaccauagccgcuguuccuuggcccaagccuuguuucuaagaaucagucuggcuuuaggccagucagccgccaggcaaccucuggggauuuaaauggauuugcaaauuuucuagauucuuaagauauccuucuaaacccccagcagcuagaaaaguuugagggcuaggaaaguucgagggugaugggcggccauggcaacccccuagcggucaugcugcugggucugggggcugggaccuggcugucagaucugggggcuccucugugaagaaggggucagccacugggccauuuccuuuggucccaggcagcugcucaggccuccucguugucucccuccuucuggacucuaccccuucuccaugccauucuaaagcauaaauccaaucacaccaccucccugcccaggauccgccuauggcuccccagugccuggagaaagucccagcuccuaacagaggcugccacugcuugacacuuacugcacgccgcaacugugcugagugcuuuaugagacugaucucauguaaugcucaccagcaaccccagaggcagugacuguuuuuaccuccguuuuauacaugaggaacuugaggcucacgcagccacauaacuguagccacacagcuaguaaguggcacagccuggagagguuggaaucuccccgugccccauuacuccaaacuugggccuuuuguucccgccagucagaucccagaauucccagaaggaaugcgcaccauccugcuugugggcauuugcccucccucuucccccuuucuggaaugcccuuccucaucacuuuucuuucagggauauuccauacaccaccucuuccaggcagccuuccuagguucuuccugucuuccaagugcuagccaugcacuuugugcugaagccauguuacuuggcccuccccuguuggugaucuguuuauguucuguuuguucaucagagauuguucaggccccagcagucagaacugaggccgcacuuucugcuggggaaagguuuaagguuuccccauccugugcucuucccccagugcccagcccuggauaggcagugcggcugaaaaaauguccuggugaaagggaggaggagcucacugaagaccuucugcucccaagugugagacuagaacccaggccuccagccuucucacaggugcccuuccaggacaucguguggcuacuccaggcagcauuccuccauugcaagcagggaggaguaucucugcuucccucugugaccucccaauugcacagaggccucuagugacaaguucugaagucaugcaguccuccccugucuccaagcaggagacccugaauccacagccuucagggacauacagucccugaacaccuaccucaugcaggcauagagccugguacuucacacaccuuggaguccucauggcaaguuuuugaaaucaguguuauuaccuacuuuuuguagaugaggaagcugagaucuggagaggcuaagugacuuucccagggccauacggugaguuaaggugguguuuaggcugaagucugccugacucuaaaggcuuaccucgugcuccccgggaagcucccagucagagggaagaaucuccauccuccugcagagccugcuccuggcuucagcaccuuccccagcagaaagugcagccucaggucugacugcuccaaggucugcccgggcccuggcuuggucuugagagaggaaagagaccaucuggucagcacccuccucccagacagcaguuaucagcagccccccuccucugcgggaagaagagcugggacuuauaauugcccacacauguggggcaggcaguggaaagcaccguggauccagagucaggagacccagugcuugcccuggcuugauuuaaauccaccguguggccaaccucagaccccccacaucccaucucugggcuccuuccgcagcugggaggcagugagcgcuguggguaaccagcaccaggcuugggcaucagaugacuaugcauugaccccgagucaguuucuggcugacugugugaccccggggcagcaccuugccucucugggccucaaucuccuucucugugagcagcaggaccgugugugggcuccaugagacaacagcauuggcaaggugcuuaccacaguuccugcacuucacagcuggaccucuggccacuggcugagagaaccacugcucuccuggccuccugcauuggaacacuuggcugugaaauuaaucugcaaccugcaaaaggcucugcccacagaagggaccuggacaccauguauguuccaaagauccguguccauccuccaggcacaggccacagucugacucugagaccagcugccuucuaggcuaaaggagggugcucugggcauuggcucagaacaggcugcugcugaaugcagugggaagggagaaagggaugaaaaggucuucugaaaugcccacccauuucuugcauuugauucagaacccagugggcaguggguucuuggaaugggaaucuuuuuggugcccccugucuucugacccagagcguuaggagggaagggaagggguguugggccccuucccagggucagggcuuguagcaccucagcugggaagcagugugagcaugaugauauaacaggaaccaacucguucuuagcacuuucugugucuacuucaauugugcuuuacaucuguuaccucaaaguugcugcuguauuccucagcacuuggaacaugcugggcauucaggacauucuuaguaaauauuuacuggauuaauuuaaccaucgaggcugggcacgguggcucacacauguaaucccagcacuuugggaggccgaggcggguggaucacccgaggucuggaguuugagaccagccuggccaacauggugaaacccugucucuacuaaaaauacaaaaauuagccagacgugguggugcgcaccuguaucccagcuacucaggaggcugaggcacuagaauugcuugaauccaggaggcggagauugcagugagccuaagcgacagggcaagacugucucaaaaaaaauaaauaaauaaauaaauaaaccgucacagcaaccucaaaauuagauauauaaacucuccccacuuuuuuuuuuuuuuuuuuuugagauggagucucacucuguugcccaggcuggagugcaaugguaugaucuuggcucaccgcaaccuccgcuucccaagcucaagugauucuccugccucagccucccaaguagcugggauuacaggcgugugcgccaccaugcccagcuaauuuuuauauuuuuaguacagaugggguuucaccguguuggccaggcuggucucgaacuaccugaccucaagugauccgccugccucagacucccaaagugcugggauuacaggcgugagccaccgcacccagcuaaacucuccccauuuuacaggugagaaagugcgcagagucaguugccuaaagucccacagcucggaaguggcggagcugggauuugcaccuggguguuucugacuccagauccccuugaugagaggcuggauggggccugggaugccccuggggauccaguguaaacccugagaaugugccucagcugugggggcccucagcauuccagagguagucaucagacccuagaacccuaugggacugugcacagaucguucccuucuggggccucaguuuucccaucagucaaacgaggagguugacccagaugaugguaaaucuuucuuccagcccuaaaacaauuucaggauuccaagccaugccagcccagauuggcagcugcacaagccuugcuguguacucagggaucaugcauauuuaauuucacaaugaaaggguuuuuuucuuacccuuuuucuacacauuacagaaagaggucaggaucgaugaccacuaauggaaaacuuuaaccugcaauaacaaugaggaacuuucugacaauuaguguggccccuuaacgugcucaguuucuugaggagcucagagggcuccuacaguucccacaugcccauuuuccugagauacugagcagggagggucggggaggaaggcccacuaggggcuguguguggaugcuguaacccuuuaggucucuuccagugcugcguuuucaaaccucauaugcucuaauuucaagaggaagcaaggcuuuggcccagaugagugaugggauccagaggugagggggggaauggacacagggaccuaccucuggugggagugggugugaaauucccaugcuuguugcuuccaguguggaagcccacuucacaucccuccugagcccucaggcccagauccucaggauaaagucuuccugaaccuccaagccuuagccccagagcccacccugcccccgcccccuacauccaccagaugcuuccugggguagcccacccccagccuggugcaggaggcugaaaaucaaaguguacugcuuuaaccgcauuaaaauccccuccucuccucaauucagaucagggcuauuugaugucucaggugccugaaaccuuuuaucugccagagguaccagcuucuccgcccugugauggagagggcugucccuugggagggucagggggucugaaaguuccugaaugucagagaugaaaaggacuuuugggggucaccugauccaacugcuuuauuguauggaugggaacuaagguccagagaggggaaggguugcaccuaagguccguacagaucauuggugaugacgcugagccugggaccugggcucgccuuuguuccaccacaggugcugggucuuuaccaucucucugaaggccuggagagacccagcuccaccucugugguucagggcucagccuccaggucugucugggcuaugggcugaaaaggagcaaagccgucccaacaagaaaugggaaucuuccugggugguuugcuggacccccgagcuuuuggccauaccacuucuucauucuaaucauaguuuccucuuauaauaaaguggggagaagccaagggagaaguuuaguggcccccagagguccauccagcucugcccuuagccccugagaguuccuaccaugcuucuugugacuguuuugccacauccucauugcugcugcucuguuaccuucccuucugagaaguggaaacccaagggcagugacaccaccagcuucuucacuucugaggcugagccucagugguuauaggguggggcaggguuuccaguuagccuuagagggguagggcucagcuuucuaaacaugucacagaagcccuggccccuccuggcccagagcauugaagguaaaggugcagguuugaccugguggacuguggguggcucccaucucaccuguauuuguguccuuaucaguguccaacccagggccuaucugcugaauggauagugaaauaaucacuagauaaauaaaugcauguagagaugcauaaauggauugguggguggguggauggauggauggauggauggauaaaucgauggagacagacagauggccuccccuuuaguccagggcacagagauggcuucaugaguacucauccuccugagggccccaugcuuagaagggccuauguuugguuuaaugcucugcagucaucauuuugaaauuguuaauaauuuuuaacaaagagcccugcauuuccauuuugugcuugccccacaaauuauguagcuuguccugccagggaguucaggcugaguuugggacggcuucauccccaacacuggccuugcagccuccacuguccccauccuaauccacagccucccacuaaaugccagccugcuggugucauccuccugcauggaggcccccuccccacagugccuggaguuacagcauugcccugccaagccagcagcuacuacccgccaucacuaucaacaccuugaaaaguuggugguccagagaaaauccucacacagcaccgcagaccuuuccugaagucucccugccuccuucccuggccuccugcugccuccuucccaggccaucaccuaccuguuugcugaagagccccaguuucuagcccaacagaucucucccugccauuucucccagaugccuuucaucucucacagagcccuggccauaccuuucccuggcaucaucugccaaaaaacucaagaaacccuggaggccuagcucaaggccaccucccucaggaagccauacccgcucuccccacuggaguaaucauauacuguuguuagucaccauuuacugggcaccuaugaugugccaagugcugugcgucaucaucucuggcccucccagaaauggaaaaggaggucucccaugccauuucccaggaaauugggacucagauaaguuaaacucagagaacuggggcuuggacccaggaauaaguggcuuccagcuggaaccacugcucccagccuggcggggcucccaucccugcccuggauggcaucaggcgcagccuguuggcuucagagugccauaugucuguucugcccucaccagcucaucuccaucaccucccuggaaggaaagagucaccauugccuauccaugccaguucccuagccuagugaauccuguguuauuaggaggcagccgagggcccaggacugaagagcugacccuacagagccauuuaaucucucauaucguguaagcguuuacugagcaccuacuguaggccuaauuccauauuaggaaguugaagagaguccagaucguuguuagguagguauccugauuugugggaagucauauuaaaggacuaagacaaaaguucaggaaagaaguaauugacagacaguggugauuagaugggucuggccuuagguuggccaccgaaucgccgagugugcuaggaugagacacuccucacugagccucaggacacugaaaagggcuguugcuacugauuguaccaauaaucagcagcuaccucuuccugaggagcgucuuuugggagaggccuucuugcaccgucucauuuaucacaugcaucacuuugcugagaagccuagucccguggagucuuggcugugcgcgcaaggccgagugagugagugacuucuucucccuugagugaaugaauaauaauaauguggccaccaacuuugcagagggcugugugccaggcccuauucuaagcauuuugcuuguguuaacuccuucaauagcccugacaacccagugaugagccccaaucuacagaugagaaaacugaggcacagaggggugguuaagugaaugaccgaagacaggggugggaggacagaugcugagacagugagagggucagugaaacauggggguucucugcccuccugcucugccgcccaggagggcucugaggggaaucucaauguuugguaauuggcacugauaagugaaggguuuacucauuagcuagcuaccccuccccuauuugcaggcccugggccugugggggaaggcugugugcuggugggucagugugaauggcccaaggccugccuguccccugcccacuuggcucugagaacccauucuauuugcggcccccaccccagcccauggcugcuccgggcuggcagcagcccggggaacagaagguuugcuugucugcgccugccgcaccccccuccucagucucagccugggaccccucucaggggcuccuuuggcugccaagggccuggcacucccuguugccauggcaccggccggagaugaggcucugggggguggggauggggagggcagcagcaggaugguggaggccuggaacucugcagcuacagaggcccuggcccucugcaaacaguggaagggggugcuggggcccccacaggggcaggccuggacccugugcacagcaggccuguggcagagccggccacacaccugggcugauugccuggaugcuguaucccgcaggagcacugccccugccagacccuggcuuuccuaagcaaaaacucucuccucagccuugugugcucacccucagccucugcagcgaaauuguggaguucuaucccuaguccuggguucuaucccuagcucgacuuuaaaauuauuggugacccggggcaggccucccgcauacacugccccucagucagagcagaggcgggacccagaucccugaggaucuucucaucccugagauccuggauuccguauggacgccauuagagggagaacguuucucuguggacagauggacagaacuguuucuggucaggagacagacagucuggcaugacgggcaagaauucagguuuuggcaguuguggugaugcgcaccuguagucccagcuacucaggaggcugaggcgggaggaucacuugagcccaggaguuugaggcuauagugagcugugagcuaugaucaugccaccacaccacuguacuccagcgugggcaacagagcgagacccugucucuaaaaaaaagaaagaauauaggcuuuggagucaggccggccugaguuugcauucccguuccuuugcaucuuacuuauugugugaccuugggaaaguuaccaaaagucucugagacucaucauucuccucuguaaaaugggaauaaugaguguaccccccucacaggguggucgugaggaugaaacaaaaucuccagaucaucucauuuagcagagugccuggcucuaaauuaguagggacuuuuguuuguuuccagauugggggggaucagaacaauaacuagaaagauguccuguauuuggggagagggugguugguggauagaagcaagaccaauaagcagagaauacagugagauaaacuguacucaguguaauuaacaauucucaauagucugcccucugaagauucuaagcuggcuaagaaugaaaugggccacaggugagguggugagagcccugucaugggaggugugcaauugcagagaaggugggggagaugugaauagagggaauguacuaagacuguagggcucugugaaaaauggagugacuguuucccacucaaacugucagcuucagcuuuacccagcucaaaagacagcgugaaagagugaaaggagaaguugggacaaagaaggcgaaaagauaaggcugacgacuuuauuuuuuaauuuauuuuuuugagacggaguuucacucuuguugcccaggcuggagugcaguggcgcgaucucggguucaagcaauucuccugacucagccucccgagaagcugggauuacaggcucccuccaccacgccuggcuaauuaacuuuuauuuuuuuuuauuugagcuuguucugugccagguacugggcuguccuuuuugcggggcuccuuaucuuugccuccugccacagaggggcugucucaugggcauugggcugugugcucuggagccugucugcccaguauuaaacacuggagacaccacuggcaagcuuuugggcaaacaauguaaacagucugugccucaguuuccacaucuguaaaaugaggaagcaguacugaugucaugggauuguucugaggacuuggugagaucauucauauaaggagcuuagcauagauagugggugauaaguacagcagacccuugaacaaugagggggcuggggacagccaccaacugcaaaguugaaaauucauguauagcuuuugacuccccaaaaacuuaacugcuaauagccagccuacugugggccuuacugauaauguaaagucaauuaacacauauuuugucuguuauguauauuauauacuauguucuuacaauaaaguaagcuagaugaaagaaaaucacaaggaagagaaaauacauucaguuuauauuaaguggaaguagaucacugaaaaagucuucacccuugucugcacguuaaguagacugggaaggaggaggaagaggaaggguuggccuugcuuucagggguggcagaggcggaagagguggaggaguggaagggugggaaggagguggauguuucacauguguggaacauucacguguuaguggaccugcacaguucaaaccuguguaguucaagggucaacuguacuaaaucagagguagcuauuauuauuauuguuauuuuuaaggcuguuggaggcccagauggggccgggguggguggggggacucagggccaggaauccacagggcccuggggguaacccucaaggcaccgcaggaggcaggaagugcuugcucugcagccggugggcaggggugugcagcaggccucccucccucacugaccuccuucucaggcugcuucccagccuuccuggggacccaggcccccucccuugggcccccagcagccgugaggcacacacugagcgcuuucccacgcacuguuccaaguagccagccgcaucgcugcccccacccccaagcacaggcacucugacgggugaggggguguuugcugcaggagagcggggcucgggcuggggagaucagcccguucuuuaucagccuggccccauuccagacagauguuucaucuuauuuuggacuuccagaaaauaggucauuucuuuccauuguguucccuggggaggccucauggggagaggagcaugcagugagugacgagugugagggccuggcuugggcccuggggagcuggaggggcagccgccuuccucccucaguugugagggagcugucagggccgggccggaagauucugaaaggcugggcagagaagccagccuuugccugagggggauggagagcagaggagggccggagaggucacauagguauuucagaaaggucccucuggcuggggugugagaacagguggaggggacagauuggaggugaggagauuggcggugggauagccagaggcagccgagccugugcuggaggagggggugcagggggcuuagcagccuuccagggaaccagcgcuauucuuccauccaguuuggacuuccagagcagcgggagcacacgccaggccccaucuuagucgauuucugcugcuuuguucaggggacuuuguagguaccuggagaaacauaaagaggaccccgggccuagaagcagcguggcacagagaauggcuccaacaccgagugggcugcgccgggcugcucucuuucuguagcccuuagagugaucccgaggcugguggggagguucguggugcagggguggagcacugagccuucuccaacaacuggaaguggagcgagcauaggauugaagggggcgggugggagccucggccacuuccccaguuucuccccuccaccuguaacugucuccucacccuccgauccugcucucuucucuggcucccaggauggggcucccugaucacaugacccaaucacacccacaucucagccugcuuggggacagccacauggaccagacuugccgccaggcccaggcugugcugcuaucccuuuccuacucuuuagcugcuggcgggaggacuucaucccuggcuccagaugccucuugcccccacagacucccaggccuggaacuggcagccuucucugagcugagucaugacaugggucccuccccagcacccccaccccgagcccagcauuccagcucagcacagcugccuucccagaguggagcccugagggccacagcaugucagcccugaaagugcucccaagacacucuugcccacccuuuugcacagauaaggaaacugaggcucagagagggucaggacuguacaguagucacccuuagcugcaguuucacuuucugaaguuucaguuaccccagaucaacugugguccaaaaacauuaaauggaaaauuccagaaauaaacaacuuacaagcuuuaaauuuugugcuguucugaguagugugaugaaaucuugcacuguccugucugucccgcccaggagugaaucaucccuuuguccauauacgcuacccaccuguuagucaucaacaaaguccacuacugacauccagccaucaacaccaucauggcucggugguccaggaucacuuggagcagaugaccugauccuucugauaaugucuggaggucaguaguagccuaacgcuacuucacaauucuuacgccaucaccucacuuccucuuaucacguaggcaccgugucauuccacgucuucacaagaagagugaacgauacaguaagauauuuuaagagagagaacacagucacaugacuuuuauuacaguauauuuuuaucauuguucuauuuuauuauuauuguuguucaucucuuacugugccuuauuuauaaauaaaacuuuauaauagguauguauuugcagggaaaagaacauaguauguaugggguuugguuuuauccaaaguuucaggcaucuacuggggccuuggaauguauucccugcagauaggggggaccacuauccuauaagugggugucacagccgggacuagagccaggucuucuuacuucccaccccaaccccccuccaaagucugucccaggccuguaaagugccccgguacggagaacagaagacuggacugggucaggagacuggagucuguggcucacuucucccaacaacuuagcaaauuaccuccucugagucucagucgccaaucccugccuggcugggcucgugcagagaaugugacuuugaaacaaaggucaauguguggcaggacagaggugugcuguggagagggcaggggcagcuauagccugaagccuggggccuugagccaccagccucacaucuuagcaggggcuggaggcggggagcugcgcagccaggugagcuucagccccaccgaucacccgagcccaucuugucuaggccaaaacaaugggcccucuugcuuuccuucccuaagccucaguuuccccacgagcacaauggagcacaggaaggcaguuagaucagauagaugaucccugagggcucuggcgugcugacauuccaagacucugaccccauaaccccauggccaggccuccuccucccucaggcauuugguuuauucagagcaucccaggccugagacugccugcccccagcaccccccucucccugcagcauggcccucucucucucaucucacugcuguuucuacccggccuguuccuggccuccagacugaacaucccacuguccccucagugcccacagacccucccuauccuaaaccugcucaguugcagcucucacuccugcucuuugaccucauucucaucucagaaaauggcaucguccccucagcacgugcgcguguacacacacacacacauacacuucugccucccaguauuccaagccagauacagaggugcauaccucccucuccagccccucaauauuaagucacccaguccuguugauucucagcuaaguaacucucaaauccaucuguuuuuuucaguccccacugccuucuccccagacccaaccaaacaugcacguuggucagagaagcgguggagcugguggcauagaacacagagucacaccacuucacuuuaaucucugcucuaccccuucuggcucuguguuccuagcccaguuauuaaaugcucucugccucaguuuccccacuguaaaauggaaaugaucacuguaucuaccucauagaguugauggagaaucaagugagccaauacgugccaaaugcucagaaugguuccuggugcaguaacacgggcuuucuggcuugucuguucaugcauauggcuguguguucaggugaauuugggguucuaugugcacauguucugugcauguuguaugugcugcauacacaugugaacuguugcacacgggugcaucuccacgggugcugggcacagugggagcugcgcacauguguuuuguguggguguguacauguuuaguaccugcaugagggcuuggcacccacauggccucuugcauacguauguguuucagaggagugugcgaggaagugcguaggcaggcaucugugcaucugugcuguguguaugugcugaccaugugcaggcuccccccaucaacccccgcagcaaugcagggcccccucccuggccugccugugucgugggagccucaggacccugagggagggaagcuguugcuggcggauguggccaagaugggcuggauuuauuuagauuaaggcggugggaaaggaguggagaauuguacgugcugggaggagggaagucuggggcucugagaaugacuccccaagcaugcuugcucuccuggacuuggggcacccacuccucuccccuggacuugggguccuuacucugcuccuuugacuugggguccccacucugcuuccuuuugacuuggaguucccagucugcuccccuggacuugggguccuuacuccgcuccccuagacuuggggccccccacuccucuccccugaacuugggguuccacucugugccccggacuugggguccucacucugcuccccuaaggggucccucugagucacgugaggagcugggcaugaucuccacuuugggccucugagccuacaaccuggccagaauaggaggaaucaggagggguuccuggcacauagcacucucuucaugggcaaaagggggacaccuaggggugcccucccucucucugcucuagaggccucccugggcaggagaguacagcagauagggggagugccugcucucugacugugacauccagcuuguccuagguggcccuucccuagaguacaguccuccuaaagaggggaaguugucacaggcaagcccacuaccaccaagucagcugccugggccucccugggauuggcuggaaccagaacagccucugggaagcacaaagaggccuaacacauuugguggaaaaugugggguaucagggagucauccaggauggccugggaagucaugucugggugcccuaagcccuucucugcccucccuggcccuccagccucuugucccuaccacucuuuccuugccaccuccugggguuccacgucaccagcggaaaguccccugaaacacuguugaaacacuguugucuaacuuuuuuuuuuuuuuuugagacagagucucacucugucaccaggcuggaguguaguggcgugaucucagcucacugcaaccuccgccuccuggguucaagcgauucuccugccucggccuccugaguagcugggacuacaggcacuugccaccauguccagcuaauuuuuguauuuuuaguagagacgggguuucaccauguuggcuagguuggucucgaucucucaaccucgugauccgccuggcucggccucccaaagugcugggauuacaggcaugagccaccaugcccagccuuggucuaacucuuaauuguauagauggggaaacugaggcccagagagggaaacaacuugucaaagcccgcacagcaagucuguggcugaauagucauggaaauuccuuucguggaaugagauggcugguggauucuuaugugacucuagccucaggaauguagcccccuccugcuuacuagcccccaccuccucaaaacaccccgguaagauucguggugacuagaaucuucucuuuggccugucagaaaggcagagcuucaccauagggacagcucuuugagaugacaccugccaaccucucuauauggauggggacgcagaguucagagaggcuggagacucgcucagucucacagugggucccagggugcuuaugaggggagcugauugcucuauucauaguaaagccaguccgagaucccuggggugccuacaaccucccuacggcauccacacugccugccuguccucuccccacagcuugaaucugccuuuuugcugugugacuggggcaugcuucuguccuucucugggccucugcugcccauucaaaaagcauaccuccuagcucagagucucuaagccacccccagccccaggcccagcagaagagagccugaaggggagaggauggagugccacaugggaggagggucgggggcugcaugccaugaaggcccagcccacauagccagcccagccuuccagagccaggccagccccgcugcagugaccucccuucuccuggccagccggccaaauuccuccuuuagaauaauaaacaguguggccagccagggagacugggagaggaggggcagggaagcugaagugacccccucccccagccucugcuaaugauuuucuuuggcugagaucucuagcaggaagggggcagccagaggggcaccgacggaggggcagaugggccucugugggggcugcuggcuccgccuuggcgcugcucccuccugaccaaggaggccuggcauccagcuggaggggcuggggcagaggaaugguggggagcagaggcuggagggggcgucagaagggcugggcuuugagucaggagcaguucagagaggggagaggaagaaacgaggagaccuucaggcaggcagucugaaagggaggagggaggagaagagcugauuugcucagacuguuucuugggguguugggaagagcuaagauuggggguccauaggcgggaggagccuugccuaugucccaccccugacaugugaaugcagcccugguaggugagguacucaccaucauccacuuccagagcuggggacuuaggccacagggagagcgauggcacaagagguggcaugcuggggccugaacccggucugcagaccuaaacugaaaacuaaaaggggugagauggggagguaggggcaagcugggcauggccuucagaggcaggccaggcugggcagccccacagccagaggaggcuccuuguugccucaucaugccgucaccucccaaagcucaugcucugcgaccccuguccucuggcguccuuccugccaaugcugcaggcagacucuuggcauacuuggcuccugguggucucuugggaccugaggugugucuuccaagauagaggagagcaagggccaccccauucagucugucucugucuuuguccuugcuucugucucugucuuuguccuugcuucugucucugucuuuguccuugcuucugucucugucuuuguccuugcuucugucucuuagugccucuggugcugucucucugggcaccuccucucugucucugugucuuugucucuuucuacuucuaucauuccaggucucuuucucucugucucccucucagacaggcucugcuguggaaucuuggguaaacuucucaccuucucagagccucaguuuccccaucugcacccuggggguggggguggggggagccuggcuucacuggucuccaaggaccugugaggccuggcugcucgaugggaccucuccugggcccagccccuagccgcuguccccugggccucccuguaugcucugggcugaguaaagguguccaggcccaccucccacauuccacagccccggcuccccggcuucccuucccacagcccacagccuccuccauuuccuguugugcuuguggagcugcgggaguucucuggguucuggccuccccccuccuccucccaucccuuucaucacacuuucccaaauauuuguccuggcagauaagagccugguauuggaacugucacccggaggacaggcugucagagcugguaggcuacuggauaccauccagcccaacuuccccucccucacuguacagacagggaaacuaaggcacagagagagucuggggacgcagccgaggccacgugagagucacaagcagagccaaagcaaaggccaggaccccaaggcuaaguccgggauggagaggagacagccuguggucaugagugcccuuucaggcuugggacgugguggcuuuugacuucagccccucggacaugaaggcuggguggcccaagcuggggcucauucugcaggagccagguggugagauagccccugucgcugccuccaccugcccugggcccugacuccuguuuaacucugcaggacaccaugcggcuuccgggugcgaugccagcucuggcccucaaagguggguagaugggagauaagguaggggacccggggggcugcggaguggaacccuggagcuggcaggggugaugugugcugguggcagggcgugaagcaccaggcacacugcccugcccuucagcuuuaguuuucaggauuuccagugggcucuguggaggccuccagcugccagcccuucagcucagaaagcgucagugggccccugcuuguccagaaccaucagcucaaauccuuugauuggcccuccagaccccaucccaccuucuggcccacaccccuggccuccuauccucggucugguggaucuguggcacucggcuuggaccccucauuggcugggagcuuccaggucccugcugggcuucucagcacaccccaccccucacuccugcccguuaacaugucuucagcucugcaggggcugagcgacugacccagcaauuaaugaccagccagcagccugcccggcagcuggccauaagauggacuggcugccugaccgcccaccuccccuccugaucuguaucaccagggggcauggagggcguggccugaaaaauccuucuccaggggaugucguggagggggaccaaucacuugacacacacacacccccaaccccaguucccuccagcccaaaagggccucagcaucuuuucuggccccccucugagcuaccuaagccccucccucccaucucucucccacccagagccaccucugggccuugggcagaaccugggcagucgggggagggggcagagagcuguagggaagaggcucagaaagugaccugggaagcaaugcaggaacuggaggccagggaauugcuucccgaggauuuccuggccccuucuggugccuacugccuacacauggcacugcugaaggacucagaggcuggggucuaacgggacugacagaggcaguccagaggaaucccuggggccuuggagcugggcgagcgguccucagagccauggcuggagagccccagucugucggauaaaggagcugugcuccucaaggaccugagggcugugcauacguggccuccucgcaggcucagccuugggagaggugcugaagccccuguuuccugaugucugauaccuccucucccaaaggcgagcugcuguugcugucucuccuguuacuucuggaaccacagaucucucagggccuggucgucacacccccggggccagagcuuguccucaaugucuccagcaccuucguucugaccugcucggguucagcuccgguggugugggaacggaugucccaggagcccccacaggaaauggccaaggcccaggauggcaccuucuccagcgugcucacacugaccaaccucacugggcuagacacgggagaauacuuuugcacccacaaugacucccguggacuggagaccgaugagcggaaacggcucuacaucuuugugccagguaagggcucccagccugugugcccacuccuuaccccucuugucaacuggaggcaucaggggaaguccagagagugcuuuaguuuauugugaaaugcagccauccuagaaaagcagacaaucauggaaccagccuggcucagucggggaguguguucgcacccacuccuuggucugggugaucugccugcucccugccagucacccuauuccugccucccaagaacucuauauucucagcugcuuccaaucugcucccucuugaccccacaucccuucuuccccauucuccaagcuccagauaucagcugcauuucaacuugugacuugccuucuuucuuacccuggcacugucaauaucaaacauuagagcuggaagggaccagcucuaacauuugauuuaugcucuucugggagcaucccuauucuguaacggggagacagagggccagagauggcaaaugacuugccacacagcaauucaggggauggccagaaacccaguuccccugauuuauucacggcuccacuccuggcagaucccaccgugggcuuccucccuaaugaugccgaggaacuauucaucuuucucacggaaauaacugagaucaccauuccaugccgaguaacagacccacagcugguggugacacugcacgagaagaaaggggacguugcacugccuguccccuaugaucaccaacguggcuuuucugguaucuuugaggacagaagcuacaucugcaaaaccaccauuggggacagggagguggauucugaugccuacuaugucuacagacuccagggugagcccccuuucuggccugaugcucagcagaggcaaguauaacccuccacagaggaauagcccuuuacaguuuacaaagugugggacuccacuucccaguggauucucaccacagccuucgaaggaagauaguguuuuccccauguuacagaagagggaaacucaggcgcagagagaggauggagcuuguccccugucgcagaauucgauaguggcagagcuggccugugcaacauggucggugagggcacaagcuucagagccagcugggucgaaaucccagcuuugcuauuuccugucugagugacuuuacacaaagcacauaaucucucugagccugcuuccccucuuguaacguggggauaacaauggcugccuaccucauaggaucaauugugaagauuaaauaaaagauggagaguaccuggcacauguuaugugcucaauacauuucuccuguacauagaucuccagaggguacuuugauuuccagacuguuaucccuucuagaacgucagcuccauaagaacagagauuuuguccacuuuguucacuacuguugcuccaguguccagaauaguacuuggcauguaguagguauucaguaaauauuuguugaaugaaugaaucuucuacaucagucauccuuucccucucuagcccccuacccuauccccaagcugaagugcuaguggcugguggugacuuccccagaccuaagccaaucucucucuaccagugucauccaucaacgucucugugaacgcagugcagacugugguccgccagggugagaacaucacccucaugugcauugugaucgggaaugagguggucaacuucgaguggacauacccccgcaaagaaguaauguggggccaggcaggggucggaggaggggccaggaacggguggauaucuggcuugcaggcugauuucuccccggccccuccugauuuggggggccugcccaaccuguugcugcagagugggcggcugguggagccggugacugacuuccucuuggauaugccuuaccacauccgcuccauccugcacauccccagugccgaguuagaagacucggggaccuacaccugcaaugugacggagagugugaaugaccaucaggaugaaaaggccaucaacaucaccgugguuggugugugccuugggcucagcccaauccccaauuccuucaacgcuccccacccucacccacuuugcugggugcagagugauggugagaguugcauuuuugauacagugaucagggcugagcuggacccagugccugucacagccccgggguauagucagccacacuccagugcagcccuagcuagccucugugccaaccaaaaccccaauuccaggauaaaccccaaaccaaaauguagugucagccccaaauccaacccuaucucaaccuagacuuucugacuagccagagccccagccccaaccugacuuccaagcccaacugccaucccagguccgggaagccccauccccaaauucaaccuuaucacuagucccagcaucagccacaguacugacccagaacagagaacuguuaguacaacucuguucccaaccugggagcuggccccagcauccauauuagccccaaauucggccccuucuccaggcccuguccccagcccaauuucaaccucagcuccggaaacuccauggcuggcacgguccccaggccugaagccccaccccacaggcuggccuccuuugggauucaguuggugcccugcccccagggccccgccccugacggucaccccuugcagagagcggcuacgugcggcuccugggagaggugggcacacuacaauuugcugagcugcaucggagccggacacugcagguaguguucgaggccuacccaccgcccacuguccugugguucaaagacaaccgcacccugggcgacuccagcgcuggcgaaaucgcccuguccacgcgcaacgugucggagacccggugagcagcucgcucucccaucccauucuugaaguuauuuuucuuugcagccgccaggcagcccucggcuuucagccacaaaccuaggcccagcuuucugagagcauauuaggugccaggugcuggggaugcugcagcgaccagagcugacaguucaucccuccuagaguuucuagucuaguggaggaaacagucgccggucagaugaucacccagauguuuaguuguccuugugauggguggggccagcaguagcagccaagaaguaaacgggcagaugacuggggaagagggugccaggcaggccacucauggccugugguaucccugaggcuggagauuugcuggcugacagagacugugguagguuaggauggagcaguguccaccuuucugaaggggagagaaauaggacuuuccuucaaugcuccccacccccacccacaguucaucucaacccucccucuuggccuaggggaacugccugugggugaggauuuacgagaccugguuugagucccggcucugcuaccaaugccgagaugaccuuggcaagcccuuccccucccugggccuuguuccucuuuauaccaggaggguggggagaacuguaagaguccuuccgacucugacagcugccuuuccugcuccccagguaugugucagagcugacacugguucgcgugaagguggcagaggcuggccacuacaccaugcgggccuuccaugaggaugcugagguccagcucuccuuccagcuacagaucaauggugaugagcacgccccucgccaugucccugcuccuuccccucccugcccccguucccucucccuuccugcacuguccacccacccaugggaggagugggagagggagccuggaacucaggagauggauucuaggccacugacccacugccgugugaaccuggccucugggccucaguuuccccagcuguauaaggaggccaucuggcuagauugguguuuccaaaacuucaggcacuuagguaccaaggccaugauuuucccuucucacauuccacuuauacuguacuauuaacucgauagguauuuauugagcaacuaccauaugccugucucuucaagguucuugaacuucccucccugccuuugugcagcuugcauccaaguaggggaagacaaacacuaacaguagggaggaaaaccccagcaaauuacauagguuagaagguaacuaacacugcgggagaggaaaaacaggggccggguagggaagguugagagugcugggcacagagugauggugugaguugcauuuuugauacagugaucagggcugaggaagugacauuugcaugaagaccugaagaaggugaggacauuagcuuaguggauauuuggggaaaggguaccucgggcagugcaaaggccagagcaaucacugaaaggcuugugugguuggaacagggcuguuggggagaguggugggagaugaagucagaacggggauagggcagugggggcugggagaagggcaaaucgcauaggucuuugugggccuggugcagacuuuggcuuuuacuaugaccgaaaugaagagccauggcaggguuuugagcagagaaaugacaugauaaugacuuaauguuuuguuaauugacuuucuaaaaacaaauuuauuuugaaagacaaaauguaaccucucuauuguagguggaaaaucggcaucacaugucauaaauauaaagcaaccacuaaaauaaacucagagaagaccaaacaaugcuauuaaaugcuggcuucaugagcuugguggcccaggguucugagcuugaggccuagccucccuuuguuaaaagggaagauuagcaagucucagagagguguuaaagacagacuagcacccugcugaggcguucccuuugaaguacccagaagggaacccaucgguuuucacacugauuccugguauuuaauguucaccugcagucuacagcccuccucccccaagagagucucugggccagguccuccccugaggaccuguccuguuaacuguccugacccucccgccuccuaacucagugcucucuccaugcagucccuguccgagugcuggagcuaagugagagccacccugacaguggggaacagacaguccgcugucguggccggggcaugccccagccgaacaucaucuggucugccugcagagaccucaaaaggugagcagaccugggccucagucucccaguguccccagcuggcuagaaaaagcucgugaagguuaucuagucccgcccguucuucuuggcauauuguuccgggcauagaguugcauccuaggaggccaggucaccaccuccuugguccuacucuguaugaccuaaauggucccuuuuccuuaccuuuaccccugggcaguuuggccuagcaaagugcagggucugagccccagagaccucacccgcccuguagaucaguucugcacuccuggccaggucgauucuaaugcaguggacagaggcaggauucagugcagguucugccucuaccccauacgccgugugaccccgugggucaaauaagaauggauuuugcaauccacguugucaguucugggaugggagcacccccugcugaccaguagagggagcacaggaggagcccgcucggaaacaggcagugggacauaggaacuggacacguccugccuccuuccaccaguuucuccucaguuucccugucugcaaggggaaggggcuggcagccaacccuaccggcucuccuggcagguguccacgugagcugccgcccacgcugcuggggaacaguuccgaagaggagagccagcuggagacuaacgugacguacugggaggaggagcaggaguuugagguggugagcacacugcgucugcagcacguggaucggccacugucggugcgcugcacgcugcgcaacgcugugggccaggacacgcaggaggucaucguggugccacacugugaguccccagccucaguggccccugacgaucccaaucccuaccuuaauccugccuaauugguaaugugcccauguacccacagcaggccaaaggaguuagcaugcccaggggcaaacaggagcauugugaaacccuguuguguacaugcauaggaacacauucuggcaaacacaauauggguacacacguguacaaacacaagucuguaagccauggauaugaauauccuucagugugguguacauauacuauauguaugucguaagccauguacaugagcaugccuguuccuugaacauaggugcaaauccucuguguguagauauguaaaucgucuacugaagaaugcccaaucuccagucacuccuguaaagcuagaguguauguguauaagcauacaccugugcacuaugccuguccauguauguaaacccaccacguguuuguaagccauguacaugagcaugccuaauucccagacaucuguuuaaaccccacaguguaugucuguaugcauguaccgguggguacacaauuccuguacauguguacaagcaaugcauguacaauuccuuugcaugcaugcaaacuggcauagugcaugucuguaagcauauaauuggagcacaccuuucuagaaaaguguacaagcauaauucccguacacaugugccugcuguacaauguacaucuguuagcagguacacauacacguguaauuucugugcguaugaacaaugccuaccagugucuugaugcuuuuguguaucuagcugcccguccuuaugcauacaugcaccuguaugagugugcuucauuuauucaccuuucuucuucauucgauaaauaugaggacccaacuucucauugaaguauaaaggucaaagggcucagcccugccuggaccuccuaguacccauaguccagagagagaaggcagacaaggaacuuggcaauucccuccgggaucaccacauuaggggcaaagccuggagggagaaggggucccaugcccagcuaugggauucaggaaaguauucuagaaaaggaaccuuuaggugaaaaccugaaaaaugacuagaaguuagccugguaaggaauggugucccacucagagggaauggccuguguaaaagcccagaggcaaaaugaguuccuagaaaugaaaagaguucaacucaaucuggcuggaggaucgaguguguggauacuuaggggcuggaaggguggcagauaaaggggaaggaagugcuaugggauggagcuacaggggucggcagaucuagagcaggcagggcuccaaaggccaugugaggcaucuuggucucuguguaugcaggucccugggcauguucaggcacgugccugucuagagcugccuccuguccccugcccugugguggaugggugggcuucuuucauccccucauuucacccaugcucccacacaugcauacacauucucugagcaaguggguaucugggcagacaguguggacagccugaguggaagaccagcucugagccaaggcagaugugacacuuuugugugacuaaagccugagcgggaagcugagcaccagcacacagggccuaggauggcugcaagagggcuccuucaugccuccagcgauggcugccuagaagaugcaggcuuccuucccaggaccgagaugugugaugagcgggaggagggaggagaagagggauguuggucugggacccugaggaggaaggcauggcgaggauagguaaggguaagggagaauggauaaggggugagagacgaaguuggagagggaagcagagguagagucaugaagccucugccuuaugugccauuuuaggaguuuggccuuuuuccuuuacugauaacauggggaagcauccaaaguuuuuuuuuuuuuuuuuuuuuuuuuuaagauggagucuggcucuguugcccaggcuggagugcaguggugugaucucggcucacugcaagcucugccucccggguucaaacaauucuccugccucagccucccaaauagcugggaugacagcaguccaccaccacgcccagcuauuuuuuguauuuuuaguagaaaugggauuucaccauauuggccaggccggucuugaacuccugaccucgugauccgcccaccuuggccucccaaagugcugggauuacaggcaugagccacugcacccagccuccauccaaagauuuuaagcauaacaauggcauucacuuaguaauucaacaaauaguaccagcuaccuaccaugugccaggugugguuuuagggacugagguuauagcaauggauggggaggaggaggugggacaggacucccuagggagcaaagaagcauagauuggggacagaagaggagggaaugaguuccauaggaccucauggguggccagcagggcagggcaggggagaggcaggucuggcggggcuggaugaggagagugggaagcuguacagcgaagaggcugaggccuugaggguggaggagacucgaggcuuguaagggccagugugagccccacuuuguuaacuaccgucaccacuccaaccccaacugggcccuuugggugaaguggggagaaguggccuccgugcugaggucuggauucaucaggcugggggucucagccauugcucccucaguggccacucacucaguccaccggccacucggucaggcauggagcuuggagucugaccgagcuguggcagccccagcaaggguguggacucagaggagagguaagccacaacccagcccucaggggcuccagggcuaaugggagguccaggcaauggacaggaacucagaacaggauuugcaccccguccagagcucuggcagcaaggccagacugacuggcagggcugaagggacguggaggccagcagugaucugaguggggguaguuacugaggggauggaguauuuacaggacagucugaacguguggccuagagcgagaugcugagggucugacacugcaggcugauggggaggugggcgcuucuauucuggacaggauguguacggagggaucuaugaugccaaagauggggugaggggaggguagcugcccaguuugcucauggccugcucucaucucugccuccagccuugcccuuuaaggugguggugaucucagccauccuggcccugguggugcucaccaucaucucccuuaucauccucaucaugcuuuggcagaagguaagccccucccuggcccagugggugaagacuggcacaucauuauuuugcauaaauuccaccccucugcccuccuugaaugcugcgugaucuggccacaugcagggcucagcauggaacucagguggggacuugugacgcuggcugucucagcuuccuccacccccagcagucugggccaaccugagccuggcccgagcuauccaggauucccuuccccuacugugucauuaaguccccggguccugcugagacaccauuccucucauccuagccauggagcaugggaccuuugagguggacugcaugggcuccaggauucuuccaggucucacccauggagaaccugugauucuacugaaaugcauucugauccuauuagucuguaauuucaguguucugcuuugagauuuuaccauucugugauuccaacauuuuaagcuuccugaaucaggauuacagcaccucaugaucccaucuuucuaaaauuccaguccugugguuccaacaccuuaagaugucaacauucuaagcuuacaucuuucugacuugcccagcacuggggagggccauccgcauccagccgaguacccuaccuggugucacuuucuggggucaccugcucuacuacuuccaucugaggagcagcgaaggcugggagagaagcuagagaggagguucucaugagccaggcccucagcugccaguugcuccucagucugccaaguccugaagccuccucuggggccccuuggucccuguucccuccgagcccacgaagaccuuggcucaguugagcacuugcugugugacuucaaauaugccccugccccucucugggccucagggucuccugccccauguguccuagacggacgaaccuaauggggcucagggccugagacucccucugauaacuaauuccugggguugguccuccagaagccacguuacgagauccgauggaaggugauugagucugugagcucugacggccaugaguacaucuacguggaccccaugcagcugcccuaugacuccacgugggagcugccgcgggaccagcuugugcugggucaguccugagaggccucauguggcaguguggggacucaaguugggugggaagacucucugaggucuggucccagccuugccaugacuagcuaugagaccuagggcuggugucuugccuucucuggcccuccaucuccuacuauguacaaugagagcaagaccaucccccaggaacugccuagcauugagguucuaugauccugugacccugugagacgggaucccuauguggcaaaaguggaaggauugaggacaggcugaguagcaggccuggucuggcuggggaagcugaggagguacagagaagcgugcucccuugggagggaagaaacuuuccagagauuaaagauggggcagaaagcaggcaggacuuagaugagauaccaggaaagacagggagguauugugguugcaggaguguguuuagggaauauccugaguccaaggugguuuaaguaaugucuagguugaccuaagagaguggcucuuuccccucacugggcaggaagggugauagcggccggggguaggggaguggggggaggggggcagcugggggagcggugcagcuuccugguaggccaggagcuaauggaucaucucugcaccaggacgcacccucggcucuggggccuuugggcaggugguggaggccacggcucauggccugagccauucucaggccacgaugaaaguggccgucaagaugcuuaaaugugaguaguccuuggagcccuccacaucugggccuucaccucucccugccccuccccacacacuuagccucucccaggguggccugaugcugauuugcaggcacuagaggggccaucacacugcagcaggcacugcucccgagucugggucugguuugggaaagagcguuccucucccuggccuccucggccugcuucccccuacccuggccucuuccccuccucagagugugggugcucacccccgccaggcugccugggucuugcagcacagggcggggcagaagagucagaauaggcuccugugguggggccuccauggagccuccaugacugggccuggccuggggcccccauuuuccucagccacagcccgcagcagugagaagcaagcccuuaugucggagcugaagaucaugagucaccuugggccccaccugaacguggucaaccuguugggggccugcaccaaaggagguaccgagcccacugccccagaggccucagggaaagugcccaccaccaaggccaggccccgccuaccccccccucaggccuugcacaacagcacacuccugcuggaggguccgugcccacccgcuccagcgcccucacugcgcggucccagagggcggugggguuuagaaacucacaaaaucacaacaccuucaaggcugaaggauuagucaggucaccagucccagcagcuuccagaccaugguguuggcugacacuuuuuuauuuucccaauacauuuugaaaaccaauaaauaacagcucacaugacauuaagaugaguuauaugcccaccauuggagaccaccagcuugcuacuugggagcuaccuucauuugaucauagaagaaagucucuguggccaacugggucuauuugaagcucugauugccaguuaggcugaaaaaaaauguuaucaccauuugcagcugcuuauugugagauuugggauuuuccucagcauuaugcaaccaaaauaaaauacagaaguauguuggguacauagacuuauucacguuugcaaugaucgcucauuucaacauuuucguuuguguagauaucuucaaguucucacugauugacuuuaaguaaaugcauuguaguugaauuuaacuacuaaagugaucguuguaaacaguggccuuuaucugcuuucuauacugggcuccaaaguaagcuuuaguuugaaaacauaucaauaagagccaacacugcgagcucgccacgugcccagccaauaaagacaucaucucauuaauccucaugacagugcuuugugguggguuuaauuagccccacuuaacagcuggggaagguaaggcucagggagacuaaguaccuugcucuccaccacagaggcaggaaaagaauccagauuugcaaggcacuaaagccuccuagccgucaugccaaagugucucucccacauccagccccugauuagccucauggccuugaagggacgccugaggccuccauagggacugucccugagccugucccucugcaggacccaucuauaucaucacugaguacugccgcuacggagaccugguggacuaccugcaccgcaacaaacacaccuuccugcagcaccacuccgacaagcgccgcccgcccagcgcggagcucuacagcaaugcucugcccguugggcucccccugcccagguaccaggagggaggccagggacugaaucuuugggauaccugaggagcaccgcuccuuccccuccuuuuguccaggaggggaagcugaggcugugacagggcaggggacagaaucacuccuggagcuagggcuguuccacaagaugguccaccccagaugagggaauaacacuaaugccaggcccugugcugcuaagcccucuacagaugugacaugccaucccugugucguggguguuugcccuucaguccagggcaggcagugauggaggaaggggcagaggcuguggugagaugagagccaagccucccaauuugcacaguggugcuccaggcuguguuccucucugcagccucuacacaucagccuccacacugccucucagggagcucaacuccagucuuugucuuuuccaaaaagaacacuucuuaguucuguugcugauuacaaaaacaaagacaagaguagcuucagaaaagcguaaaagaccuuaaaacccacucauguccucuccaauguuuugacauucagucucccaggagccaaagggcuucucccaucuuuuuccugccuauagagacagauguguguagagccccacagcucuuuggggagcugaugcuacaggcauagguagcggggugaauccuggcugccuaugcuggguugcagucaggcacucccauggccagguggcgcuggggaggccacaggaaggcgccucugaacacacccgucuugugaccuuugcccuggggugcuguaaucgccucugggugugagcucucuggguucuaacugucauuuugguagccucagugcccagcuuggcccagcagguugguugaaaagucuugauccacaggcuuuccuacugggauagacugaaggaagaugagugagugugugagugagagaagaaauucaugaguggcaaggggcaggaggggaggggaaggcaaagccugcaggcucuccugugaugcuccuuuacccccagccauguguccuugaccggggagagcgacgguggcuacauggacaugagcaaggacgagucgguggacuaugugcccaugcuggacaugaaaggagacgucaaauaugcagacaucgaguccuccaacuacauggccccuuacgauaacuacguucccucugguggguggacauagugacauaguaccccacauccaaacaggcugaugcucuucacaugcccagccuugccaaaaacccugagaagaagggagccucgugcccauuucauagauguagaaauugaggcuagccaccuggccaaaacugaucuguaguggaccccuaaacggaagcccuguuuauggauccggaaacaugcguagaacccucagggagggagagagcagggauaugggaggaccuggccuuuugucgugguagggaaagugaucuacucagcuucagccccaggcuggucuagugucccugagaggcaggcaggcaggccaggcugggcaaaaguggcccaagggcuaaugccaaaaggccaaugagggcacugauaaagcaggagaacuuugaguuugauauuaagaaaucauucuccuuuuaggggagaccuagacgaucaguagccaccugucuuggacauucagucucccaggagccaaagggcagggguccugugggccagaaggagauauaagauagcaggugacccucugcuucuccucuagccccugagaggaccugccgagcaacuuugaucaacgagucuccagugcuaagcuacauggaccucgugggcuucagcuaccagguggccaauggcauggaguuucuggccuccaagaacguacgugugguguugguggggcagagugggggcuguggggaggugggucacccagccagccagcauccuccaagagcacaccaggguggccucucgcacaugggcaguguuguauuuucccaaagcccuugacaugaagggucuuuccccacaauuguccccaaggccucagcuccccucuccccaaacccagugcguccacagagaccuggcggcuaggaacgugcucaucugugaaggcaagcuggucaagaucugugacuuuggccuggcucgagacaucaugcgggacucgaauuacaucuccaaaggcagcgugaguaccuucccuggccccugcagggcagucacagugccugugaccgcaggaacagauucccuccugaccaguguggcugcagcucauaggaaaucuguguggggcuccuuguggccugcccugacagcagugaugggcugugccugcccagcuaugugugcagggacaggauggggagccgcccaggagugcauggagcaaguauagcggcggggagggcuggcuauaauggguccagggugggggaagggggaacaggccgaauguguuguuccagugguggugggcagaggaagaagcccaggugacagggcaagaaagaugagcaggucacaugcaguagcagggauuggucugguuaaaacgugaucauccugccugucucucaucuccccacuuuuccgcaaaccccagauggagggacgcuaggcccagagaucaaaggcagccaggauaagagcuuggggggugccuugacaagucccuggcucccacacuucacuacucagacccuggggcuuuuccccagggacaggggcugccuuguccccagcuagugagaaaggaaacagccucugguccucugaccagcccugggauggacaugggaacugugcugcgcagagaccagggcccucacagggaaugggacggagaagugguugugggugggagcugccagauacccuccucccaucccaggugcagaguggggcugagguccuuccuugcacucagcaccuguccugaccucccuacagaccuuuuugccuuuaaaguggauggcuccggagagcaucuucaacagccucuacaccacccugagcgacgugugguccuucgggauccugcucugggagaucuucaccuuggguaugcuugcuuccuccuccagcccucagcauccuggccuggugucuaccucgaccacucaugccucuggccugguggggcuaugggacgagcccugauacagggauccugguucaggucccagcucugcuaccuucucccugcugugugauguuagcaaauucuuugcccucucugggucucuuuaucucccugucugagcauugacagguuugaacagugacaucagaaagccugcuuggcucucacauucuggcugucuauccuggggaggguuguggucucuguucagagcccaugaaggagcccacaguuccaaaugccaggggcacugcccccuuacccauaccagggccagcauggcucuccuuguccuguagaagagggugcccugccacuuuuccaccccugagccuguguaucucuugucucugcuccccaacagguggcaccccuuacccagagcugcccaugaacgagcaguucuacaaugccaucaaacgggguuaccgcauggcccagccugcccaugccuccgacgagaugugaguggagucucaugcauuugggaggauuuugugcugcaaacaauagauauccaacucuacuggcuuaaaccaaagaugagagauuuguuagcucagagaucuagaaagccuugguguaacuggauccagccauucaaaggauggcaucaggaaccucuuguucuagcccugagcucugcuuugcucuguguggccucauuuucaggccagcauugcccaaauggcuaccagcagugccagucucauguccuacugcuugcuccauagugccagcaaaagucccagagcugaccuucaagggcucagguggggucacaugccaucaagaaccaaccguggaagcugcagggcugaaaacuguuggcgaagguuggcuccugugcucacccaggcguagucaaccuguggaaccauguggaaugggggcucugcgagggccucccaagggaauauccagagacaggaccucuggauacacccagccaccacuucccuccagcuccuuuccauggcucaccuuguucugagaggcagcagccuccugcucccccagcccugccuuguccccugaacccugggccagaggcccugacccuucucccuauccccagcuaugagaucaugcagaagugcugggaagagaaguuugagauucggccccccuucucccagcuggugcugcuucucgagagacuguugggcgaagguuacaaaaagguauguugaggcaggguagggguggagcacggagagcucuggugcagaagucagacaccgaguacaaggcucugcgugaugggcuggcauuuaggggaccacccuuuguccucucugggccucaguuucccugcugguucuaggaggggaugggcuggcgcugugaguuuauuuuagcagcagagagcuuuaugaaauggaauccuacauggaagcugaucgauuagaugcagggagggggccuagagcacugucuguccugcugccucccucaggccuuuaccuccauaccgaaccguggggcuccuucagaagugugaauaaccccagguuacaugaccaugaaccgccugaccacuuggauccugucacaggauuguccaaggcccaaagagccaguagggcccugaaacccugccccguccaacaacacggguccaagugaggaggaaauacacauggccuuugacacagaggcagcuccuucuuuggguucauuucucacccccacugccccccggggauggucccagggaccugggagauggaguaaggucaucaccacuucacagcaaaggaaacugaggcccugaagaaggacgcugaggcagcaugagagccugugccugucugcucugaagugggggaagaguuagaguccugggugcuggucugauaacugccccucccugggugguccugagcucaccaugccuuguaagauucuaugugagguaggagggcagcucaaccauguggcuugggcaaaucccuuuccccucugagcagcgggggucuuauuuauacaaagggggaugggcucgguuagaagaucccugaaggcauuucuggccugaccaucccuguuucuuugguucucccugccccgggagcagaaguaccagcagguggaugaggaguuucugaggagugaccacccagccauccuucggucccaggcccgcuugccuggguuccauggccuccgaucuccccuggacaccagcuccguccucuauacugccgugcagcccaaugagggugacaacgacuauaucaucccccugccugaccccaaacccgagguugcugacgagggcccacuggaggguucccccagccuagccagguaaccacccuggccuggggccaaggaaauugugcacagugugugugugugugugugugugugugugugugugcgcgcgcgcgcgcgcgcugccagguuugccucagagguaaguuacguaggguaaguacuuaucccuaccaaugaauagaagacagaauggaacucauuugaacuuugaugcccugagguggaaagggcaggcuaguaaaaacaaaaguaugggcugggacuuacuugcaagguagcuauuuccuuuaagggagcccccagagguuaucuauacucucuuaucucuagguccuguccuagccccaaaaagaagaagcaaaccuacuuagcauccccagcaccccagcuguuacucauggccagccugaggccuauguucuguucuucagcaccacgcccuggggccagagggagccugcuugguuguaggagucagaggugccuaaaggaauucaggacagaauucagacugggaaggagauucgugguuuucuuuugccuugggaaguggugaaguuacagcccagagggggcuuuauaggaggacccugcuguuguguggacuugauguccacgcaggaucuccccuuaacuggagagaagggcuccccaugaggccacgcccaccuccaaagcgagauccagcccaaggugaaguggcuggagccccaggcugggguacugucccaacucugccacuagccgcugagaccugggaaggcuucuccucugcgagccucaguuucuccauaugugccaggagugcacaccggccuuagaaggcuccgaaggcccucauugcucuaacuguugaagaggccaaccauccaagagucccaguggauggugcagaggagugaagugcagcgcucacacagcuugaggugugaaugcucacccuguuuugugcccucagacaagcugcuucacugucuaaacauugguguccucuucuuuuuuuuuuuauuauuuuuauucauuuauuuauuuauuuuugagauggaguuucgcucuuguugcccaggcuggagugcaauggcgcgaucucggcucacugcaaccuccaccucccagguucaagcaauucuccugccucagccucccgaguagcuggaauuacaggcaugcagcaccacgccuggcuaauuuuguauuuuuaguagaguugggguuucuccauguugagacuggucucaaccuccugaccucaggugauccgccugccucggccucccaaagugcugggauuacagaugugagccaccacgcccggccagugucuucuucuguaaaauacaaacaguaaaaguacuucuauuaggcggucauugcaaggauuaaaugagauagcauacaccuuuaggagugcagaggagggagaugcuggugggugagaaacgagcuuuggagccagcugacccugcuccgaaguuccagcuccugcacuucccugcugugugaaguggggcagugauauaaccucucugagccacacuuuccucacggugcaggccuugcauaguuuucacaagaguuaaaugagccggagugugugaagccuacggugcagggguggacacaccgaaggcucuucaugacugcugcuggaauccuccugggcuccuuccuagccccucacucacugccucuuuccucuagcuccacccugaaugaagucaacaccuccucaaccaucuccugugacagcccccuggagccccaggacgaaccagagccagagccccagcuugagcuccagguggagccggagccagagcuggaacaguugccggauucggggugcccugcgccucgggcggaagcagaggauagcuuccuguagggggcuggccccuacccugcccugccugaagcucccccccugccagcacccagcaucuccuggccuggccugaccgggcuuccugucagccaggcugcccuuaucagcuguccccuucuggaagcuuucugcuccugacguguugugccccaaacccuggggcuggcuuaggaggcaagaaaacugcaggggccgugaccagcccucugccuccagggaggccaacugacucugagccaggguucccccagggaacucaguuuucccauauguaaaaugggaaaguuaggcuugaugacccagaaucuaggauucucucccuggcugacagguggggagaccgaaucccucccugggaagauucuuggaguuacugaggugguaaauuaacuuuuuucuguucagccagcuaccccucaaggaaucauagcucucuccucgcacuuuuauccacccaggagcuagggaagagacccuagccucccuggcugcuggcugagcuagggccuagccuugagcaguguugccucauccagaagaaagccagucuccucccuaugaugccagucccugcguucccuggcccgagcuggucuggggccauuaggcagccuaauuaaugcuggaggcugagccaaguacaggacacccccagccugcagcccuugcccagggcacuuggagcacacgcagccauagcaagugccugugucccuguccuucaggcccaucaguccuggggcuuuuucuuuaucacccucagucuuaauccauccaccagagucuagaaggccagacgggccccgcaucugugaugagaauguaaaugugccaguguggaguggccacgugugugugccaguauauggcccuggcucugcauuggaccugcuaugaggcuuuggaggaaucccucacccucucugggccucaguuuccccuucaaaaaaugaauaagucggacuuauuaacucugagugccuugccagcacuaacauucuagaguauuccaggugguugcacauuuguccagaugaagcaaggccauauacccuaaacuuccauccugggggucagcugggcuccugggagauuccagaucacacaucacacucuggggacucaggaaccaugccccuuccccaggcccccagcaagucucaagaacacagcugcacaggccuugacuuagagugacagccgguguccuggaaagcccccagcagcugccccagggacaugggaagaccacgggaccucuuucacuacccacgaugaccuccggggguauccugggcaaaagggacaaagagggcaaaugagaucaccuccugcagcccaccacuccagcaccugugccgaggucugcgucgaagacagaauggacagugaggacaguuaugucuuguaaaagacaagaagcuucagauggguaccccaagaaggaugugagaggugggcgcuuuggagguuugccccucacccaccagcugccccaucccugaggcagcgcuccauggggguaugguuuugucacugcccagaccuagcagugacaucucauuguccccagcccagugggcauuggaggugccaggggagucaggguuguagccaagacgcccccgcacggggaggguugggaagggggugcaggaagcucaaccccucugggcaccaacccugcauugcagguuggcaccuuacuucccugggauccccagaguugguccaaggagggagaguggguucucaauacgguaccaaagauauaaucaccuagguuuacaaauauuuuuaggacucacguuaacucacauuuauacagcagaaaugcuauuuuguaugcuguugaguuuuucuaucuguguacuuuuuuuuaagggaaagauuuuaauauuaaaccuggugcuucucacucacagacuuuguggucu
